United States Patent 7,491,813 (PROMOTER POLYNUCLEOTIDES IDENTIFIED FROM ZEA MAYS FOR USE IN PLANTS) - sequence listing, part 2

SEQ ID NO: 516 - DNA, 124 bp, Zea mays
aaatccggtgcgatcgcccacggtggaggcctcgtcggccgccgagaggagccgctcggggctcgggtcagggttccggtacttcgccggcgccgcctctgggtggtgggaccggtggatggtc

SEQ ID NO: 517 - DNA, 469 bp, Zea mays
tcccattccctctcacggtctcacctgatgatgtgctgcagccgtccagcgagaggaattggatgcgcgggcagctggtgagatgagatccgtgctgggcagtggactgagcagtgggcaggccatcttctccgggcggcgtccgagtatatcagtcagtcaactcctcatgtctgtcacgtgacttcccttccctttcgtggacctggcttccttttcatgggcctggccttcaggaggcaagcaagcaagccattcccagcccataccacccacctaggagcggcccatcctggtgtgtcgcggccttgcgggggaagcgtagaaggcactagaagtagaaggtagcagcagccgccaccgccagcgaatcacgtgacttcccctccccttctcccctctccactccatcgtcaaggaaggaacacggccctaactaaaccctagctaagggaagggaaacaagacc

SEQ ID NO: 518 - DNA, 141 bp, Zea mays
attagttgccaaatatgttaggggcaaacaccagagtcccaagacttgtgtttgggtacccaaggtgcttgtttctaatgtgaaaggacccaagaccgtttgggtacctaagaacaagacctaaatttgttttgtaggttt

SEQ ID NO: 519 - DNA, 1180 bp, Zea mays
tttaggttaaggtgtgtcgatcactgcacaagccaagtcaaaaccaccactgacaccgtaccggctgcgatcgaatgctaaatcaagctccatgctcaggcctcactcctgaatccttagtcgtcgtcgtcttaagtaactagtaattaaaaatgtcttaatttgttgttgctagtatcggtgagacgagacgacccatctgctgagcgagctagctagcttaagcgtgacgctggcatcactgtcactggcaccgtataatgcatgacacgacacgattccagttaccacaggccacggccaagctcgtttgtatatatacgcgcgcgcacatcaaactgccgtggtgagcgatcgatcgcctagctgcgcgccattccgtgccgtcccgagtctcttctcttgacacgacctgcggaaagcaataaggcaaacctcagtgagtcctgtccacgccgatgtactccttcgagcagcaggaccacacggcggcagctacatctccagatatgtttgattagtaatgcttttgattggtaaatcgatttgtcatacgagactctggcactgacatgttgtatctccttttgttttaaaatgttttagttagtgttctcatcaccagctgcagtttatggatcacccaaaaactcaccctgcacagaaaattttcctcttactccaaacaatccatatggcaaaacaaaggtttgctgcctctttttcaatgtgaaaaccttctgaagattgttagctctctaagttgactgaaaagtttcagatgtgcttaattgtgttttttggtataccattcaaattgattaatctgatgcatttgaagctgggtattccaaataaaactgttgtcaattttctgtcagaatttaataatctgtggtaggtacagtactaacaagagttatgacaactgtcatctcttccttaaaaaacttgactaggtctgtttatatgagcttatctgrtgctaaacttgttcatttgctaatacagagagagaccgtctaaaagtattgtgcaagatataaagcatgcactcatcatatctaagtgatcggagtgatattgattggcttattagatggatattggcccagtttatctttcatttttctatagctgttagaaatttactttgctcatagttcattctataattaat

SEQ ID NO: 520 - DNA, 148 bp, Zea mays
aactggttactctggcgcgtacataggattatttttccgtgtaagctacatgtgttctccgatatatgcaggtgaagatgttgagttagcctatctccgaccttactcatccgtatacctatattcaaatttcactctatgatttata

SEQ ID NO: 521 - DNA, 1220 bp, Zea mays
cttagcccgagtccgagccgtgggtcgggcggagcggagttcgccgtcttccggggctttgcccgagtccgagccctgggtcgggtggagcggagttcgccgtcttccggggctttgcccgagtccgagccctgggtcgggcggagcggagttcgctgtcttccggggcttagcccgagtccgagcccttggtcgggcggagcggagttcgccgtcttccggggcttagcccgtgtccgagcccttggtcgggcggagcggagttctccgtcttccggggcttagcccgagtccgagccctgggtcgggcggagcggagttcgccgtcttccggggctttgcccgagtccgagccctgggtcgggcagagcggagtttcctaggtgcctttggcagggcctggtttcctttgcgttaaatgctcctgcgacttggccggtcggtgcggcgattcagtcagggttgcttctcagcgaaggcaaggcctcgggcaagccggagatgtgtccgccgtcgaaggggggcctcgggcgagacggaaaccccttcggggtcggctgcccttgcccgaggctaggctcgggcgaggcgtgatcgagtcgctcgtatggactgatccctgacttaatcgcacccatcaggcctctgcagctttatgctgatgggggttaccagctgagagttaggcgtcttgagggtacccctaattatggtccccgacagagtcattgttgtaaatttttacgaggggtatgattgtawttcctcacgggccgtgtcctgtgcctataaatagtgaacaatattcctttactgttcacgcattctgtaaatgccaaacgcttcactcgggaattatatctgtcaaaggcagaggtataaatgttcataaaacattatgttcaagcatcttaaattcgtatgataagatatgtgaataatgtcacttatttccgatatattcatctttaatgtttcacattgtatattactttgtattatctttgtaatttggattacgaaggtataaccttcgtaatattctgctcatggtcttcgtccgaagttcattaaatccttggggaaataatgcttcagcggacgaagggcattaatatttgacattttatgttgccttgttcttaattcatagcatttgagagcaagtccccaacattggcgcccacctccggtgaattcacttccacttttttgagctg

SEQ ID NO: 522 - DNA, 1107 bp, Zea mays
atgggagacgaacccacaaagacgaacatgaggaggagcactggcgaggaccaggaggtcggagccccaccaagccaagacttagctactccctctggtgtactattagttgtcgttttagataagaattgagtcaaacttacaaaattttgactacaaataactattttattatttagttttcaaacctaatgtttatatgtacagatttttcttaacaagtacttttataaaagtataaatgtattaagagtttatttatattttaacaaaaaaacatcagtcaaagttatattttggagaccgtgtcactgtcctaaacgacaactaatataaaaccggagggagtaggactccaccttgcagctttttagctccacttccacctatataatagatctggtagcctctcctccctctctcgactgcttgtaacccatactacgagtttgatcatcaatggtgtcggtagcgcaagccaccaatgattggaagtagggacattctgtttgaaccagtataaatcttgcgccctccgcgcataccatctggagcccagaacacgtacaataaatttaattgtcggagcgaggtacaaaacatcgacatatatctaagttgtactttgagaactaagttatgtgctatctctataaatgcatgtacaattgttatttattcaatagtagtgacttttggcttcaatcttaatatctcacatgtgcttcatttttagaaatatatagtgcctttgcggaggcatatcatgacttccttatagtgtaaaggactgttggtttgtggccactttaactaaagttagttgttaaaattgaataactaatcttagttaaaaaatgataaagtattaaccaaacagtccaaaactgtcagcaatccactgcccaagcctttcagcaacgcctggtcgccgccgatcccaaaaggctgccatctttttcctgaaaaccacgagcagttcactacccatccgccatagtccgaaagttaccaaatcctcctgcgaggccccagcaccgaatgccccagcacaacaaggcggcgtcgtttgagaggaagcggctagaggacctgctgccgggctag

SEQ ID NO: 523 - DNA, 1500 bp, Zea mays
acctgtcttccatgtacaacaagacatgccatatattttttttttgcatatcaacaagacatttaggcttcaggttggtctgacagagctcaaagtgaagaaataaaaactgaaattacaggattcagctaaacagtagttcagagttcagggctcgggctacgtcgcaacgcaagtaatatactcatactttagaattcagcagaaacacaggcacgaaatcagtcggtcgcagatccattcattgcccgtcgatgcctcccggccggttccttggattcaccgacactgcagcacggttgacctcaaaaggcccgagatctgccgggtttcgcgacgcatcacaaggtgcgtgcatggcgcaactgcgagcccccaagcacgggaaggtggtccatgcccgcggcgtcgaggaatcagctgttagaatatgctgaaaccattggtgcactcgtagtacttcgtcgcgccgtcgccgttagaaaaatagaaggaaaaaaaaccccggaaaaggcccgcgcttcatcagcacttcagctcggcctcactctagcttttgcacatgcacacagacaggcgactccggtgccttgagctcgggaaagcatagcggccatggcaaactagaccggaccggaagaagcaagcgcctgcttttgcgtcgacgaaggaagaaggaacgtgtgtgatgcggtgacgcctccggtccgagctcgcagaaaacacgctagtactgtactattcccgatggcgcgaagccggcgatgtcgcctcgacggcccaggtctcggtagtaaaccacgcaagagaaaataaaatgacagagagttgtatgttgtagacgggcgagtgcgacgagcggagaacgtaatgccagcgctacaccgctgacgtgtccgccccggctccgggtgaaggtcaaaaggggcaaagggcggggggaaaccgtgggccctatatagcgggccttctcgctggagctaggagaaatcgccaagccaagccaagccagaagcggcagcctcgcgcagcggtctggtctctctggtgggtgcccctcttcgccggtggccggaaagggtagtggagtgggaccgctcaaggagaggccggcgtccccaagtctcacttccgccgtccgcttcccccctggtactttctcttcttctattcgcaagcgcttatagccctggccccttgatcctctccctcctccgtttcagttggtcccgattttgtttagccttcctaggcgcgtgagatcaaaaatccatcggttccggttgccgccatagggttcggcactcggggcgcgcggggggagctttatttgtaccgaactaattcgaagggttcggttaagccccttgcagatcggttttactacccatttttcgattcttttgttgtgttctgatgcgggcttgacggcatcatgttatctggcttgtgatttgcggcaatagggatcgagggaggaaggaaaggaggtgcttcaca

SEQ ID NO: 524 - DNA, 1500 bp, Zea mays
ataaataatgtaattgtcagggtaaatgaaaaggttgggaaatggtacagaaaaaaaatgccttgtgcttagtgaacgtttcatacttcatttttgaagcggcctagcttccttggattatgcctgccggcctataggcttccttagctttacttccaagtaaaagcagctctctgtacacaatgattctgttaggatgttgggcatgtgtgattgtctgattaaaggtgtaccagtttttcagatttttttttggtcatgaaccattcctaatgctaaaaaacaaggatgaagcaaagactatcctatcagaaatcattgtgagaattgagatgaatacatcaattatctgaaaaaaaaaattggacagacagttacagcttcaagcaccatgttcctttgtcctcttagtgggcctgcgtgtgccagatcgttattactcgacattaatacatgcgtaccggacaaaccaaatcccatcgcatgattcaactccatttgtccagccagagcaacaaagaatccaactgtgttgtttcctatatatcctccaggaccaatgggagtgtagggaataaaattagaacgctgtctgagaataaataaagcagcttttgattgacccagctggccggagcaggtgacactctgtatgacacaggctgctgcgccgtgcaaggcacgatcgtcgaccaaccaccatgaatgcctgcagtttgcttgcgtccatttcgctgtcactctgctgcactgtcgccctaccatgtagtattattatgcatggtgctccagtttgtcattagtccatgacaaggggctcggttagtccacagccctagaggctgcagctgcacacttctcttctctgttttcgccggttaaactttccccacttgttgctggccttcgaatctgtggtttgtttgagcttgtaaggatctcttcttcttcactctgtaagtcttgattcagccaatacctaggaataggatcgcaggctttgctcttgcgagcttttcggtgcttctttcatcgttttctctacatgtttctgtatatatatatatatggggatttggcgtcttctctgtagtcgacaataatcctttcccgtctaatcggtcagtcagcggataatccccgcccgtaattctgcactaatcggggcgtgttgaaagcatacagtaataaagggaaggtggagaaagtgtgattagctaatggatctaggtcaccgtaatttataatccttattagcacaatcctaccagtatttcttgtgatgatgctattggattcaactgcacccatcccccacttgcttctgttcttgtccgttcctgtcttcttgacttgtaagatgctattggaccgaaccttatgtatgcctatctaaattagccctcccctgttttccttctctctttctctcttgaaaccaaattaagcatccatgtcgatattgtagagcagggaagcgaagaacagggaagcaaggac

SEQ ID NO: 525 - DNA, 263 bp, Zea mays
aattctgacaagcaccgcggccgccgcacacgcaacacacacgcgcacagtcaccaggacagcaggctgccaggcaggcaacacgcggacacccaattattcacccaagacccaacacccgcccaggcagcaagacaaggacaagggtctccaccgcttcccctcccctcccctgctctgctcctcgcctcctccctcccgaatcccgatcccagcttccctccttcctcccgcccacgccgccaaatcgagccccagccgcg

SEQ ID NO: 526 - DNA, 354 bp, Zea mays
acttcgcataaaaatcaaccacctacaaaaacagagagatacttgctgctaagaggcaatgaaccaacatgcaggctagagtaaggcaaatgatcctacaagaggagcaaaaagccagagagctagagcaagaaattgctgaaatacagggcgaagacccccgccatcagcagccagccggtgcagccaaccaagaccttccccacttccacataccagccttcgcaccaactgccttccaagggctgaattaccttgacgagcgaagccctcttgcaccacagctgcaggcctcccgttggctgcaaattacagagcagacacttacccaacacgaatccaacctagtacatc

SEQ ID NO: 527 - DNA, 762 bp, Zea mays
tgtaagttgtaacgagaggccacgcttaagtctctcaacctcagataacatgcaaaggctagagagggaaatgcggggtttagggaggagacggcgggcatctgccccctctcgaatcctacaycgagagagggggaactattttgcctcctctttgtagccagaaactatcccccaatttctcgagatttttttcagcgcatttctggaccttttggttgaatccactatatcgctctcgtcctttgcctycaccatgttgccaaatcggtgatttagggacatccaactttttgatcggagatctgcaacgttggtatgttctgaaatgaattccccgttgaatcttaaaaatctggtgcaaatgtgaaacctaaattgtcacatttttacagtttctaaaaaatgttacatttatggagttattttataggaaacatcgagttatgtgatcaattggagacctatttgtttgaccctagcacgcaattctgagaaacatggtaacgacatcttcttctgcattgctaaagtttgcgaggacaattgtggyctctcgttgcattggtgaagtttgcatgtcgaagttttcgtgttttgaaatctcatattggcatgggttatcaagattgtaacacttcttgttcttcatcaacaatgtggtatgactatactatcttagcgcctcactaatgggaacttcataggaaaaataagattttgtagcgacctacatgtgaattggggtgtgttcagcttccc

SEQ ID NO: 528 - DNA, 1442 bp, Zea mays
atacgtatttaacaatttagtaactagaataaaataaaataaaagaaatgaaaattataacctagaaatcaaacaactccttactcccactctctcacctctctctcatccggacatatataaaatcttagctagagccacaccacttatatgacggtctagttagctaaccggtcaaggtcgcgcgcatcctgaccccacatagaacgagcatgagagggagagatgatttaccttctacctttcttaaactcaaaactgatatacataaaatagttatctaattaagctaagtcagttttaaccaatttacagcatgggattatttctttattgtacttatcatttgttatagaatttatttgatttaattaaaataaggatgtacaagctaaattaaatcccacataagatacttcgctcattataattagtccagacatacctaaataattgcgcaataagttggggatcttgttacaataatatcaaattacatatttgctagtgggtataaatgtaccaaaccaaattaacataagatgctgctgtatattttccacgtatgacttcatcatttcatttgagttacacagttcttttaaaaggaaaccaataagcttacacagagttggctatgaaaggatggttaaagcttatatgtagtccttctcatcgtctttgtaacctttttgtttcgtgattgttgttttaggctccctttgtactcgttttttgttgttgttgttgcaatacagcatagcaggggattgaacccctactgttttggataaaaaaaaaagatgattaaagataaactagcaaggctcacgccagtgagcagtagcccggtgaacaaagatgcattgtggcaggctggcagccagtagagaaagtaaacgatggaatggcaggggccagccgccagcacccagcagggaagcccaggaatgaaccgcgcgggggggcatcgacggcgggtctccattctccatcgctataagaaaaaagtgtcatgtgcttccctctcgcacctaaattctctgcgtcacgactcaggaagaggtcggagcgggagagctgtcaggcttccagccgagatcctgcaaaccgcgcggcggagttattccgggctctgtgcgagttctgcagttccggcgctgctcttctttcccgcgccgcctgcctgtctgcctgcaagaaagcgccgggggcgtgccgtcttttccccccctccacgcttcagcatcagcagcagccagcagcgcagtaaatttcgccggcgcgttgggcagcagcagcagcagttggcagccaacgtcccgctcccccgcccgctattacttccccagctccgcgacaagctaggcgcgcgtcgtccttgtgctcctctgcagcaaaacgagcttccggcgcttcgggttcagttgcgacttgcgagg

SEQ ID NO: 529 - DNA, 186 bp, Zea mays
gctcggtacctctgctatatccttttcgaccttcggcgccctgttcagcctcgactcggccatcaccgggctcgtcctcggcgccgccgccgcagccgctacactgcctcccgcgccactgttggagacttggagcacaacgatttcttcgtttggccactgttggagccaaacacgagagtagtc

SEQ ID NO: 530 - DNA, 966 bp, Zea mays
cgtgtacggaatgcttatgctccaaatgtttcagacaacgaatttcggagtgatggtcctccctcccgtggaggttatgagagcgacacaggaggccaaggatatgaacagaaccgtgaggttggtggaggccggcgagctggtgctcggcaaaatagctagcttttattgtataagcgatttatgtgcaaatatgtgaaggtagaaataacaacttgtgctgattggatgacttgagaaactgatgaatgcctgaaacgtaatgagaaaattcttcttcctaagtggcaggatgcattcgaggatactccataggccgagtagaaagccactgttcttgaaaaacagggtgcattgaaggacacttatatattgaagaagatgataaatcatacttgtgcgtgaattatcttttttttgtttgatattgaagtaatttgaggtagagggaggctaaactagaactactccctatgcgtaaggtaaaaacgataagtagacttgatttgatcgattgtgggggcttcaatcggtcgtagcccttcatctatataaaggggaggtctggacccgttacacgtcgtttcctgagttaatcccgcggatttagctaacaaatcccgcaagaaactcggaaccctaaaaggttctgcgcacgcgcggaccgtcgagcctcaggttgacgaacatatgccccgtgccttttggtggaggttgacgaaccaaaagcatatgaactaagtctgatgcgagtcaccggcttttcaatccaatatggtgatcattcaatagagccccaatgcataaaggccgtttcggattgcatctttctcggctatgaccatttgatcaatggatcaaaatgaatagaatggaggtgccctcagcccgaatagacgaagggactatgcatataccacggtttcatcgtcgtatcattccatatttgaacatgacaatatatcg

SEQ ID NO: 531 - DNA, 184 bp, Zea mays
tggggctcgggctagctaactaattgaccaggctgctgctaccgtacgtaccgcgcctcaggtcagggtctcatggaagccagaaccagcaggatggatcggaccggagctagccaatgcaacgcgcggggagggggaaggccgcaggtgccagccggacacgcaaggtgatccgggtagagga

SEQ ID NO: 532 - DNA, 335 bp, Zea mays
ggttatgtgattttgaatagtttttacccaagcgaattttatagaagctagtgaaaagctgagctttcgacagtccgtagcagcttttggtggccagaagctacaaaaagctgaaacaaacaggggcaatgtattgcttcaagatgaaccagactgggaatagatacattggctgaaagcttaaaccgcagcctgccctgaatctggaataatcagactacactgtactatttcatggaaagatctaatatttacaaacacttttccagctgcctcttggtgccagttgcatgcattaaaattgtgtcggtccatttttttttctccacagagaa

SEQ ID NO: 533 - DNA, 1235 bp, Zea mays
ctagttgagagagctcaagagctcaccggagaaaatatccctaacttttttttcagggggaatatgagtatgaagcatgaatctactggtagaatagaattttgctgatagctggttttagggcttttgttgcagcttgtttcatataaaggccaggagcattttcccccacttgtttgaccctgtatgttttaatatcactgtagagttccactgacgaatgacgatatacgaatgctataatcggtcggatccattttcttgaccaacagatagatggagcgtcttttggcccagacaacattattgacatttcattcctgcaaatttgaattggattcatgagtcccggtgaaatacctccaaagcacccacccctagtaatttcattctcttgccctttttctcttcagctgagaccagcaccagtgtgtaccctcaattaatattctgctagcacgctgtgagtctgtagactgcaggagccaatagaaaattgcaatgtcgctatatatgtgcatttgactttgtgtttagcagcaacatgccaacatgggagattgggagttgccgacatgatgtgatcttctgcagcatgcaagtgaagctctaacaacatttcaaaatagtctttctaatttttattctaaattatcatttagagtgttattttcataaacatggtcaaccgatatcttttcattctttaacatctagagacatttttgttttctatcttgtgctagcgagaagtcttgttttactaaaatcttaatttgtattatctccgttcttaaatatttgtcgtccgctaatttatttttaaattaaaatttgacaaataaaaaagaacgaaaggaataacaattagaaatgttgctctaacactaacataagccatatggcctcatacacactttctttttcaaataaatgccgacaacacgattaaagaagaatataattggattgctccaacggtccaaccaccaccacctacgtgcagaccatctatgtatcgtcaatcaaaatggatgctgtgttgctcctcacgtctttgtaagctaggagtacgtgtctgcatgtacggggaggtaaccgcggtgcaccagtagtacattgtacatataaacaaggagtatcctggcgcaatggaagcccagatcagtgccatcctccatcacgaggtagaagaagcctgaggactaccctcggccggcgatcgacagagcaag

SEQ ID NO: 534 - DNA, 303 bp, Zea mays
aaacttcaccttacacgaatttcttttcttattggtaatacgtactgtccatcagtcgtctgacctaaaaaaaaagttgcattatgctctacttttttttggcctaaaaaaagagagtaatatagctttatcttccactgatgctgcaacccttcaactgcaagtaacaatgaagcagctgagactgagagatactagtgcttccctgcacattattgagtccttgttgggttggtcggtagcagctgatgtttctaaacaaaaacaatactctggatatataccgacgacgccaggagttcc

SEQ ID NO: 535 - DNA, 719 bp, Zea mays
ggtccgttctgcttctgatccgtgctcttgcgatgcgaggagctgaacgacaaggattgcggccggtgctgcatctatacgaggtagcaggaaaatggccattgcggttgggagatgtgtgtgcccaaagatttttgcaaccttcagtgatttcatttgaggttccaagaggggttcttcgctgtcgtttgacggttttatctgggttgtttctgtttgctgtgccatccatccaagtcatatttctacgagacaagaggttgatgacttggtggtgattggtacatgcaactgtgcaaatctcttgtgtttttaagtgcaggctactggggttctagagctgaggctagggtaggatttgactttttgattgtttttttttgtcccacacttgctgtttgtttttttttttcttgggagccccacgtttgttagaaaaggagataatgtgtggattatccgcactgttttacctttcatttcggtgagataacggacaagtcaagccagattcttgtacagcaaaagtgaagcatttccttttactatcttgatctgtgcttgttgaatgactctgggactgggacctcgagatttcatacttcttttctatatgggcctgtcgtagtgcatactcctagtataaataattgctccaaatactgcgttcttatggttcttgtgtatggtcttctgcagtgacttcgctaaaatgggtc

SEQ ID NO: 536 - DNA, 1500 bp, Zea mays
gcccgcatgatgtgttaggtttgtgggaatatgggttagttagggagtaactactctaaggcgcgcttggaggagtaacacttcacatacactgtagacaactttaacaacgggtatcatccacaagtcgattggaacttgcacccaacttatccttctcgggcctaagtatgttttctagttcaccgtagtttcctaagaacaacatgtttcatcgaaaagttgtgaatgatagcattggtaagaaatttcatgctatagacaaaatcttagaaaatatgtctttgcatatggaaagtttagctagtgctatgaaaagctagcggagttaataaaattttagaaactcatatagcttagttggttgctgttatgcctgactctaatgtagaaaagcttctaggtcaaccgaagccaaccctaataggaagtttaaatgatgtcactactagggtggtaggtccacttaggacccctacatcctagtagttcaaagaggtagtagtagaagacacccatgcaagaggagggggatacacaaccgccaccgagggaggagacaccgaggtcctcgccccatgacttctatgacactatggtgctcccaatctttcagcaatagaggaaggctaccgaagacgaataatttggtaggattgtcgatgacaacctaacaagaaaccattgttgtcgccgaaggagattcaccttaccaaagagtataacactactatactaaataattctccttagaaggacccgaatagttgctccaagttcacataccatcccatgcttaatcaggacccaatatttcgacccgacgatatgtgaacttggagcaagttcagtgtgatgtctaaggtggtctttggcaagctacctcatgacacacgcgctccaagtttaaattatagtaattctaattatattttagtttaagttatagtttacttctgttttgcctttagttaaactttagtaattcagaaaaaacatattaaagtgtagtagtttaaataaatacatgatcaatttatgaaggctggtaaaaccgtgcacctcttattacaatttcaacttaatacaaagctaaaaaaatcaagaatttagcaagatatattgacttgtaatagttctgaccaatacatgatgaaacacattttatgaagagtttgatgaaattgtgcttttaaaataaaattttaactttagtatagagctaatttaaatgatggttcgaagaatttggatcataagtagtagtataaattttattatgaggtccagttttgcttttgggaactagaattcgacgccgctgtggactggtcatggcgtgctaccgcgcatccacggcgccgacggcccaccgaggtctaggaaaaatagaatggttggtatggtagggtaggtgaaccggtgaagattagagggactgagggagagggaccgtgacaccgtgtctagccagccaacctgctgctctagcccacctgc

SEQ ID NO: 537 - DNA, 503 bp, Zea mays
tggcccgccgccgcctcgaatccgccctggctcggagggcctcgcgcccccacggatcggattctcgaggttagcacctggcggcgacgggctcgggatttccccctgttttttcgtgatgattttggtctcattttcgtggggttttagctcgggcatctggcgttgggtggggttttgttattaggttgtatgattttttgatgattcgtggttggttgactggagtttggtgggggcggattcgtactattgttcatgggtttgattttttttcctgggaattttttggggactgtttggtgtggaaaaaaaacagccggtaccattttgtaatgcactagaggtaaatctgctattgtttgatatcttatctgtgtatatgcaggttggtggatttggggctagggttkggggattgactacaatcgtggggttgtttggcgtaatttgaggagcaatgtacaacatggttaggaagtggacctgaggaggacggaggg

SEQ ID NO: 538 - DNA, 426 bp, Zea mays
gttcataagaattttgttataatttggatgtgcagggagcaaaaggataaggtgcagttactattctagcttcttgctcgacgatgcgctaggggtctagggcagctggcaatgaagccgaacaaaaatcccgaatcgacagcctttaaatgtcacataaatcgccacgacgaagaattgagcagcaccgtcccccacccatctcagctgccaattctcctatccgacagcttgcaggacggatactaataaccgtcgatagcacgcaggttcttgcatccgacggctcagaaagccagcctctcacgggctgctctacgcctcccgggccacctggctacccggccatcataaagaggcggcctcccgcccctcctctcctcgcgctgcttgcttgtccgttgtcgcagagagagaaagagtggg

SEQ ID NO: 539 - DNA, 1382 bp, Zea mays
cgctccgttcgatcgtcggtgtgctacctgctcctgtcttccggtccctaagccctcattttttagcaagccgtcgaaccacgcttgctccgtccgggtatagccatgaaatctgttcttgccgtccgttacccgcacagccatatatgtcgtcaggtacgagccagccaccgtgccacgctaactgatacacaagtatcacctctggttggcatccgttgtgcccacagcccgaatgtcatctccatcaggatcgttgcattcttgatgtcgctgtcgtcatatccttaacctatcactaagaagatttctatgttggtgctcagatcataaccaaatgtggagattgccaatattcatttttctataatattgtacacaacgttttaattttattgcttttttggtagtatactctaaactgttgtttcacaatacatgctttattaacatgtgcagacctacatagaaatttactgcttcataaaggttgttccattaagccttcctttataacttcctaacacattgcgttcatactgatgcacacttaacatgttactacaaatattaaatttgtatgattctctgctaactgatttgtttactgttatttgacagtaaatcctaatccttggtttggaaacacgagcatcattaacttctacatatttgttcacggaaaatgctgcttggtcaagattcatttcattacacattcaactcaaatcttcaccttcactactaagacctgcgcttaccattggagtacaacaacatgcattgcaatagtagtttttgcaaaacaaatttccttctattatataaatatatatcttattgcccctcctttctaaacaactcttattttttgtattgcaataatacttccaacaaaactgctcacatacaaatcaaattatcatgcttacgatttgcatgctaacaagtactgaaacacatcttctcttatatatcactaaagtaatgacctgctatgtaccaattaattttataaatatttaacttttattctattttctattgtagacgcaaggagcttgattcaagctgcaatttcaatgacagcgatgctaccaagactccatgatcgctccatccaataaataatatatcagcaacttcgaactatcttttctcactatgtagtcatgaacaaactacttagatgtaaatatgtggcaaccatcatttgctacaatgcactgatgatcaatctgcttagatatatactatgctactatgtagttataaacaacctacttagatgtaaatatgtggcagccatattttgctactatacactggcaatctgtttagatataaatatgtgataatacagtgtttgtcacataaatatt

SEQ ID NO: 540 - DNA, 1500 bp, Zea mays
cttgcccgatagaaagcactcgacaaagarcaggattccggtagtagaggcatctcaggtgtttgtgtctacttcatcttgattcatgttatatgaaatggcattgaggagatctgaaaggccggtcttacggccgctgcctcccagtttcctagatatgatgagtctgtgcttgtcatctaggagcgggatggtacgtagtagcatgatgtgattcggcgaaaggttctctgagccatatatatactcaggattctatcttcttatatatttggtgttttttggctttggttgacggatcccttcaggcttcaagtcctttaaaaatggatctcttgctaataatctaatccacttcttcggttcttcccttgaaagtcttggcttggctgtcaaattaaatggccatttagcactgtgtctcatagtggggatgtagcatttacccgtttgtctgaaaaaaaaaactgagaaccagatctgttcaacgtgtgaattaaaacaccagtgcagagcaggaacattatttggtagttccaaatgcaaagaggaaagcagcactgcgtccgtctttgatggactacagtgttccatctgctagttctgccggcttgcttttccttttgctcgaaaacatatatatttgttgtgcttgtcagggtaactgcccggtggcctggctgtgagtggttcttccttggtttgatggtgacggcgtgctaaggtggtgatgtgcacaacaagcacgtttcatccgtgatctgatcgcagtctctttgctgctgcgtgatgttcggggcgtcctgaagtggttcgggctcgtgttgcctgatacggttagatgctagctgcttgattcatcagtggcgcgctttgcctgctgatgccggcgtgcagatcgagatcaaagtgacggcgagaggtgcccggcgtcgcagggcaaaccacatcgtccatctacgtggccacgcgatgattacactccctagctgcacggctgtttatatacaaatcttaaatgagacagtgacctgtataaatgttgtttccctccaaaactttgccttgccttgccctgcgctgcatgccatccatgtccagtccatcgtcttcgtcgtcgccgttccagcagatctcacgatcccaaaactactgcatctcaccccctttctttcgagaactctataaagcagcacctgaacacgggaaatcccctcgctcgtgtctcagctactgtggccactcatttgccagcaagtggcattatatatattcgttcctccggccgacggccagtacgtacgtaggcgccgacgagctaggtctcgccgccgccgcctcgctcgcggtagagaaagagagagagagaaacagatcgagatatagaacgagaaattttaataaagagaggcgagctagctatctaggtagagagaggccgggccggccgcgcgggggcgggcaagcaagatagaggccgggagcgtgcgcaggaagctg

SEQ ID NO: 541 - DNA, 87 bp, Zea mays
gaaagatacttgaacagatgctgatacactaatgtgactttatgtttgctagttacttaccctttatgtctgctctagggaaagaag

SEQ ID NO: 542 - DNA, 67 bp, Zea mays
ggtaacatgtttggcacaaaggggaacatgtttagggacacaatatgatgggccatcaaccaagggc

SEQ ID NO: 543 - DNA, 113 bp, Zea mays
ctttagaggatccccctgtcatctccccagcgcgtagcacctcccctatttctgcccccactctctccaatcttctttctcgcgtcgacagacagcttggcaaggccgaacca

SEQ ID NO: 544 - DNA, 409 bp, Zea mays
cgtgggagatcactcactagttggggagtagtagtggtaggtagaattccaggaggatggagatagagagggagccaactaaaaaataaaaaaaaacatatattttttttaaaaaaaaggcaattgacatcgaaacaaagaaaaaaaccagaaccctatcgtccaccaaccatccctcccactactacagagcagcgacctgccgtgccgggctcacctaaacccgcccacccggcgagccagcccggccccctatttaagcttggccacccccgccatttccctccaagaagagcacgcccactcctctccggctcctcttcttctccaccacaccacaggcaccggcaccagcaccgcctcctccctccctcctgccaccgcgcggcaccccagccacagcacagca

SEQ ID NO: 545 - DNA, 88 bp, Zea mays
ggtacctaaaacccaagcctaatttgccttgcaggtttatgtatccgagggctcaagctggatcatcgacagcggatgcacaaaccac

SEQ ID NO: 546 - DNA, 1500 bp, Zea mays
ttttatgatttattagcatctattaacaaggtcaaatggttaatatggttaatgtgtaaacaatctatcaaccttttgactaataattagtcaatttattagttagtttgtttggagtccaaggtgctaaccggtaatctgtttgtcaaatgaatccaacaagcccataactaagaagacaagcagaaacagtagattcaagtacagggctgtatgcctgtatagagtcggttcaagtacaggaattgtttttttgtcatccacatcataaataatgtcatgctctaagtgaaccaaaaagaaaaaaagaaaaccaatttgagaaatattctctaccgcaatagtctattctgtttatatcatctttatatattttaaagtaacgtaatgctttatcttttgtttttagcatgttatacatgtagcagaatctagtacacatactaatgggcatcattattttggtcggcatagttaaataaaaccagattaagtgaaaaccggacgctgatgtgaagtgctgctatatattaagggcttgacacgacagagcttgttagttcgtgcaccgtcctgccaatgcaaagagccatggtaccactggtacatgtgtgctactagtactagctactccatcatccgtagacacacaaaaagagatacgtacaattcttacttttctttccaagagatcgaataattgaatgttttcttaaatttaaataaaaggttcaaagcgaatataactggattggttgtagaatatgcattttatttgaagatataaacactaatactatttactataatctgatcagacgtacgagatagattgactgtcactgtacctgtacgacatcattcctttgtgtggagttgaggcggtagaataggagctagcgaagaattgaatagcctccaaaggaggtggagtggggtcaaaaagatgattgtcgggtctgcactgcaactgcaagaaatgacagggcacagagcagaaatcaatctatactgctgctgcatggcttggctttgatcgcaactgtgaatcgctggacctacaacatctgcacatgcagtgatgcctgagttataatttaaacataatataagaagctgattataattatactcctacacatgataacaaaggttgtgcaaggttaagcagatagcaggctcgctatcctcgttcgacaaggcatcagtgcatgtgcatcacagtgtcgggcaatgctagacttgtttactggcaaggcaagagaaaggtagcctctgactgaacccaaaatgcagtggaggcggtaacctggagacagcgaaaggccgccagccaccacccaggcaggcggcaggccaacgccacccgaaggccgcagcaggcaccacacaacacggacacaagtcaggcgcagcccataaccccccaccccagccgaagccatccgatacgggagggcccatccagcggcccaggtcacgctctcacgccacgcacgc

SEQ ID NO: 547 - DNA, 1500 bp, Zea mays
cccacctcacctggtaaataaaacacacccactgtctgcaactgcaaaccgatcttcacttgacttcacttcaacagtgagtgcagaaacacttgaacaacaacactgtcctgtttgtttctgcacagaacctgtactgtgtgccttggctccttggtgcaaaaatgtcgctagaagagtatgcatggcaacaagagtatatgaaaaagcagtaggactctgcgggggggaaaaaaggagaaaattccaagtacatgctagatctatttacaaggaatgaagaggtatggacaatggtgatgatgccagtagtagtcaatgaagagtgcggttgagggttgggagggaccggacgaagggccggcccccctacgtctacgtgcttggccggattcacggttccctctggattccattttcaccggtgagctttggccggatccgatccataaacgcccagtagctgcagtgcaacagtgttggattgattgggtggtgcctggtgctggtggtactcgggcaggcctgttcttgcagttaatctgtgtactctctccacaatctttttccttcctgttcttgggcttccaagaaggaaccgcacgtgggatgctatgcaaaccgatcttactactactgcagtgccactcactgttcactgtcaagaagactctcatctagctcgcttcatactacagctcatctaatctaaccccagcaggcatcattacaaccatgcatgggctgatacatagatagatagatccagctgccctcatgaatactgttcgtgctagttgctctggatctgatcgctgtaatgtgaacccttgcggcactggcaaatcccattcccgtttcagtacgtacgtccggagcgttgatcgccgtgcgtttacagaaggctcactgatgatgcgccgctccttgcagttgagctttattcttctgcttggcattcattcacgccacacacaccacacctgttagagtagaggccggctgcgggctgcgtacgtcgccgtcctcgtcctgcttgtagatcggatccgtcgtgctggatgatgccaaactcatgcccaggttcgacgcaacacgtcgcgtctgtttcatgcacgtctcgaatgtcacctggtgatggaaacaaagctggactgttgcaactggagttggacaagagaagaagctcctcgctgcgtacgtcacagaaatggagttgggattagcagcagccagcagctagccaagattgtggggggaattgaaccgcagtgcagcagtaatggcgggcaccaaccaccgatcgcgaccactcattcttctctgatcccatcactccagtccattcccctcagcggcggcatggccgacgagggcactataaaaagggaaggcactgcaagtgctgagtgtggtgtgcaagtgcatgcagtcgtccatcacatcgatcgactggacacactgacaggatcacaagagtgacagcaagcgccgcccgca

SEQ ID NO: 548 - DNA, 288 bp, Zea mays
tggcggtgccggccgggcggcggcggcagagctgacgcaagaggcggggtagactgttggaggcggtctgaagtctgcggtgcgcgcaaagtttggtcgtgggccgtcggcaaaaaggcccatggggctttcaatttagcgggtgctcccatctttcgttaggataagaggaaccctagtccctagcaacgcctacagcgtcacggaacaccggcgaaccaaacctcggagaaaccctagcaaggccgcttgcccctctcaggcgcgacacagcatcggcgactagcg

SEQ ID NO: 549 - DNA, 67 bp, Zea mays
gcacgcgcgggcagagctttgtcgccgttgcagcttgtgtgtgtgcttcaccccggcgcagggagcc

SEQ ID NO: 550 - DNA, 1500 bp, Zea mays
tctatgcgtatactatacagaggacatatggtattatgtcaatatgacctgaacccctttaaatcatgtgtgtgcaatatatcagattagcgccacgatccaacggttctaggattacgtctctctaattttctctgtgtaccttaatgtcacaatgtgacggcatgcacttttagatttcccttgatgttacaaaacggcgtgcacttttggagttcaaaatttattctaaaataagtgtacctctagctatatatagaaccatctaactctagttatctttttctactttctctattttcaaaatataatgactattttatattagaattggtttttaataaaattatttttttactaaaacgctagaagtgcatttgaaaacaagaagtaactttttttaatcacacaattacaccgtaattggcacttgggccaggagcaaaaaaaaacgtcgggctgtcctctctgcatgcggctgggtcgttcctccgcaatgtacttccacttcctccgcgcgcgtatgctgccggctgccgactgccatgcgtgaccgcccgaggccgcgagacgcggaccgcccctccgtctccggggcccgcgggtgcctgccgagatttctcaccgccaccgctcaggctgagggtgatgctcatcagcacaccgcagagatattatatcagccccgtccaaattccaaatgcatatcaaattatgtggatcaagaacaaagtttaaaaactgttgcgaaaagatggatgcacctaatagcaaactcatgtgcggaatgccaacaggcgctgctttaaaaaaaaaggtacagacatggccctagcaaatctctgagaaaatctagggttgcctcgacaaacgaaatgcaacgaactgcttcgaattgaactgaactattttatgattgactctgcacacaggtccgcatccactgaaccacaaacaaagctaagctaactgtcatcattagtctgacttgaaagagatctcaaacctgagattttactcctcccaatatcagcaaccgttaccacgtacgactgaggccagcaaaaccgacccataccataagagtagtcatcatcacaacgagatagcatacattaccacccatttttttatatggaagtaaaacagaataaacaaatagcaatcacagtattgtgctcataggtcaaccatgttgatgaactgccaaggatgtcacacagcaggttaccttagctaattaaaccatatgggaacagtgaaatgtatttggacatgtctccacataaacctcataagaaagcgaggtttccttcattctcaaacaacatcatgcatgttagcaatctctcaaaagggatattcccaacattcctatctaggccactataaatatacctggccgccctgctgtagatgtagatgtgtagcttgccaacttgagaagagcagacagcacacctgattagactgcaacaacacaccaccgtgcttcgggga

SEQ ID NO: 551 - DNA, 164 bp, Zea mays
ggtttgtcgccgatcagcaacaatacgttagtgcgctggagaaggcatctggggtgttcgatgattgacgtaccagcatagaaggcacgatcgatgacttgcgattggaagtgggaaaagtgaccaagcattgggagtgtgtcgtattcgacaaatccactgcc

SEQ ID NO: 552 - DNA, 217 bp, Zea mays
ggtgcgggtcgcaacggccagtcagcgatcatttcgaatctcgcgcgcatgcgcgccgcaaacggtcagctgaccagtcgggacgtccctataaattcacccaagatgggtgcttcggatccttaccttgccgctttcgccttcttgctttacatgccatcctcctcttccgtgccaagggctcgtcgcctccttttcgtctccctatgttgtttcg

SEQ ID NO: 553 - DNA, 1500 bp, Zea mays
atgggacgggatgggatgatccttgaaataaggttgtttggtttagagtcaatggctaggacaagactatctcagtgttgtcccagttatccctcaaaattagaggggcgagagaggacaccaggggacatccctgtcctggctgtcccgcaaccaaacgtagcctaagagactacaaatgaatcgaaaacaaatgggagatggaagtggggagcagtataagcagtagtgtaaaatagggatatgtaactgtagatgtccatgtttataaagtgaagtttaaaataatgaataagaaagaggataaactgttggaaatagatagcctaaatgtatcaagcattaggctgtctccaacagacactagccaaaacgggcagacattcaggccgttggcttgccacagtaatttagctggccatccatacgtccgtcgtatccaacggagcagctaaaatagctggttcccagggcgagtggccagaagcctcagaagtgggtccggattgtcagagacgaaggggagaaaatggctgccggctctgaaccagccaatctagcttttctctctcatcccctctaaaatagctgctccttttggctgtgttgttggaacctgtttctaggcgctacagtagcaccacggcagccatattggctttggctggccgtttggctgctccgttggagttagtcttagggtctgtttggttgggctgtggctgcggaaaaagttgctgtgggctgtgagctgtggaaaaagctgctgtaggctgtgtgctgttaaaaagctaaaaatcatttggtggaaaccactaaaagtcgttaaaagttcttcgatatatcttttcacaattccatccgaaaagccactaaaagcaggtctagaggtgctttcagatttgcactacgagaaagtcggcttttagaaaaagctgcttcctggatccagccctttggttggcttttgacttttaggggcacaaaagcaaaagccaaaagtcaaaccaaacacaccctaagtctcactcactacacaactcacgcctaacttacgtacgtgcgacgagccctcaagtttaaaacttgagcaacgagctcatccatatttccagtttgagtcgactgattcgaattttcaaaccagtcgggatccaggcctcaaaactgtgcctattggctatagcttttcatgtcaatattgcaggaacctggaatgaatgaaacgcattggcaaaacagtcccatttgaaaccgaaacaaacagccaaaagagaaacagaatcccggaaagaaaaaggataacggtaaggagaggcaaataaaaaaagtgataaggtaaagaaagacaaataaaaaagaataaggctaagaaaaagatttaagtatgcggttgtcgtcgtcatcccatcatctgatcagaccagaaagtgtgaaccatggcatgtccgtccatcctagagttgcttcttcttccggatcctcttgctcctccacgag

SEQ ID NO: 554 - DNA, 219 bp, Zea mays
agtgagcttccctcgtttaccttttcatttttttgggggagcttgcccgcttgggctcttttggttagctgctgaagctgcaggctgcaaagtcgggtgggcgattcgtgcgctgattgagcaattccttgatctgtgaagcctattgaagggtttggcgtggggagggtggtcgactccactcatccaggattcagtgctggtgacgttgtttccggg

SEQ ID NO: 555 - DNA, 556 bp, Zea mays
aagagagctccatcttactcgaaaaataaaaatttaattgcacctaaaagctcggatccaaaatcaacgtcgatgtcaacgttgaataaaggacgacgtggtgcagaagagcgactttcacaaaataatctaaatatttattccatctatttctatttaaatatctttgtagttaatataccgattaaacctagttaaaactaactagttttaaaaatacaaacaatatttatatattagaataaatttattagaaaaataaattcaataatccacctaatgatattaactatattttataaatattactatattttataaaagttagtattttattatatatatatatatatttgattaaaatagagtatgtttgatttttcgagaaacgaaaaatgacagttaaaataaggccgagcgagtatatttacttgcttcattaacggatttaaacctttggccatttctttacagtgcaacgtggacagcgcgagcacatttttgactgaccggcatagcagcctgaggatccaaacaggcgacccgcgtgtcagag

SEQ ID NO: 556 - DNA, 1263 bp, Zea mays
taatgttttggtgattaagtgtccaacacataatctttgagttgttatgtgccaaacaagcaaaaagttcaaatcatatgacaaggtacgtttctagacttagtacattgttttgagtactaacatattgtgtctaagtgctagaaacaggaaaagaaagaattgcaaaagacttgactgagtacagccaaagtccagctcggtctggcacaccggactgtccggtgcgccaagccagcctctggtgaacaggccactctcgggaaagtttggcggcgtacggctataattcaccagactggccggtggtgcaccggactgtccgatgagccaacggccgccagcgcaatccgcgggcgacgcgtggcccgcgccaacggtcggcagggggcaccggactgtccggtgtgcactggacagtgtccggtgcgccaaccgccacgaatctgcaacggtcgtctacgccagaataggaaggagatcgcgcactggacatgaacagtggctgtccggtggtgcaccggactgtccggtgtgccacccgacagaaggcaaggatagccttccttgttggcctccaacggctcctagctgccttggggctataaaagggacccctaggcgcatggaggaggcacccaagcattcaagaaacattctaagcctccaagactccaacttcgtgcatttgattctttgagatagtgacttgagctccatttgagttgtgaactccgtgggttgtgttttgagctcaagttgtgacttgtgtgcatgattgtgcagtgatttaagtcttgtgtgtgttgctctcccctcccttacttccgtacatcttttgtgatcttcattgtaagggcgagaggctccaagttgtggagatycctcgcaaacgggagaagmcaaagaaaggaaaaaccgtggtattcaagttgatcatcggttcacttgaaatgggttgagtgcaaccctcgtccattgggacgccacaacgtggaagtaggcaagtgttacttggccaaaccacgggataaaaattgtgtgtctcttgtgtgctttacctttgcttatccgtgttcacaagagctcgtttcaagctactttagccattctaacttacaaaacaaagttttgtggctattagtgttgaatttttacagatcacctattcacccccctctaggtgctctcaattggtatcggagtcgttctcttcatctaagggactaatcgcccgaagagatggatcctaagggatagggg

SEQ ID NO: 557 - DNA, 945 bp, Zea mays
ctctagtgacatcaaggcaaagtgagggggaaagggggcgatgactagggtagggtttagtaccgtatgagccacctccaccttaggagagacgacgcgaggattgacatatagtttctcactcgaaataaaattgcatttatataggttatatggtagatgtggtgagatcggacatgataactagttctaatagagacatacatcattgtaaatgcttataacatgtttgaacaaaatttccatttagataagatatacctatataatatatagaaaatatagcaatgtatggacacctaataaacagtagagttaatgtgttggtttgtcattatgctattatcatgggccattgggattttgataatctagtgttgtgacagttgtaattgcagtttagcccacttcgaaaatacactatctacaaatcgcacaacgtatgtaataattgtaaagaccggatttgacaaaaaaataaatactgcgtgtactctggtggccatccatggatgggaactttaatataggtaaatctatagttagagccccgaaggtttgaaattttaattaacgattcttgtttgtttgggtccaaattgcacttgtaaatgatggcaatccagcgaattcgtaacctgggtacgtgctgcggccaccacgccaacagaaaggggagtggcctacgccggccgtgcgtgcccacaagaagctagggaaaccggggagaaacggaaggccggggcgcctctggtttcgtcgtctccgcccgtttgttcccccctcttccatggcgtggcaggcagggtcatctcggcacctggctggctataagtagctcacctggctgcatccatcactggcacgcatccgcgaaatccaagagcagcagcagcagcagaccaagatcgagggagggaggaagacagacagacagacagagag

SEQ ID NO: 558 - DNA, 358 bp, Zea mays
gaccacgaaactgatgctttaatataatatagataatgacataaaaacaatttaataaagatgaagatataaattgaataaagagaaaattagagtgagagagtttcgtataacattggagagttttatattttagatgaggatgcatggaccgagcgagtcggcgcgagcctgaccagccacctagctgaacccgaactggcgcacgaaccctagctactacctactagacgtccctgcccccttcccctccggaggtgctggattcacccctcctctccctcgcgggtcccggcgcggacgcaaggcaaaggcaaaaggcggcagaggtggcgctgcagtccaccaattagcggct

SEQ ID NO: 559 - DNA, 470 bp, Zea mays
tgctaggagcaagccaaaggctaaccagaaggataccagtgcaaatattcatcagcatgttaacgcccacaatcaagttaatgctccaaatgcttatcaagcaacaccgtaggtgaaccaaatgacacttatgaatcgaagcgttgtttatggacctcatctctcacattccaaagatgtcatctatggacctcatcttccacatggataatcaactgaaggagcgacttcttttggaacacaagtgactatcaatatacatgaaagttgctaacaaaaactatcacatttttctctaagatcagttcaaattaaagtgctcttattctgtgtttaagcgacttatttttgtatattgcggaatgtctgaagcttatgctcattgttggatctgctgctgctgaataatgttgccatgcctgtggttcatatcacttttcatctgcatttttactacaagcatcctataa

SEQ ID NO: 560 - DNA, 695 bp, Zea mays
ttttaagccgtgaatttgagcttttatttatagggtccaactttaatatgtggctcacatactgatctaacagtgccgattgatatgaagtaactttttgttacattacatcatttatagtaaatcctccataaaatttataatgtgaatggaatattttaaatacagagagttcgacttttaatacaaacctatatatatcatgcaaaacctatgtatacagtttatgcaaattcatggatttttataaccatttacggattttattagtttatgaattaaaataaattaggtttaaactataaaaataataggagacagagtgggttgaagaagaaagttaatcccattagcagtctcatgagcctgtgggaagggggaaggcggcggaaaggcaagggactcctgatatgtgggccaatgagaagggggaaagcagcccattccgtcgcatccatacgaaagcccaggaaaatgcttgtcctccactttagatcgacgtccttccacccgatccatgggaaaaccctagagctagagcttgacgcgcacctaattttgcgcgccaaatgctcgaacaccttcgcgccatagctacccgctggcattggcaatatccgaagcgaacagggctcccgcaccccaacacctaatttgtgcgcgcgcccgtgtcacaaagagagtgaagagagagc

SEQ ID NO: 561 - DNA, 888 bp, Zea mays
gaaaattggttagaatatactacatactgatagaaggccaggcctagtgcagtgttaatatcattgggaggaagacttgtgtctgtttatctcttccccagatcctcttcatgttggagccttcggtattaggtctatccttttttttaatgaagttcgacacactgaagtatgtgaacaatgtctaagttggacactaaaacctgaaaccagggaagctttttgcacaagtttctagtgtgcagatttttcatatgctactcttgaaattatagagaccagaccatctgtgggttccaacatggaaaggaaatgcagagagaaataattcctggatcccagaatagaactacatttctagtacagtcactaaatgcaactgtctgttggattagcattgctctattaacaaagacaaatggacgacactaaaggtgtcagaggtgtttcaaaatactatgaacattgaaccctcctagataccagctaatgaaatgcttggaaagtgaccctcttgacatcaaaagtagtccctttatgttttggtatgctggccatacgtcgcaaaaacctgctacacaaacactggaatagttgttcgagctcgtgtttttaattaattgcataataataataatatagatacatttggctactgtccactacctgatcatcttatttggcaccaactaccctatattgataaatataaattatcagcatgcatatagctgaagttagtttccaagttccaaccaagaatgccattgaacatcacttgcaaattcaatacttttattgaggagcacaactttctaaggcttataaatagcccaaaaaattctcctcttctgctgtatcagacattcagagtttcagactcacaat

SEQ ID NO: 562 - DNA, 922 bp, Zea mays
tgcacaagtcttaggaggagaattgttaaaataatccttgtgcttttagctggtgtttgttttattttctgttagctgaagtcagtcgcacggtctgttgttggctgtgcgtgtagtgggctcggacgtgcgcgttttgttcgcatggagagcgcgtactgcgccatgtatccaccaggcaaggcagttgggatggcagctgcccatgatggttatggggcgtcaggcagggtgttagtgccccgtttctaggaagtagtaggtcacgttctctattgagtcttttatattccagtgaatagagtctgaaaaagctgttcgttgttcacagcaccaaatcagagtgtctccacttgtgtttgtgtgtgtgcgcgattttctctgcaacctgcagggtgagctcgccggcaacaggaggttgtttctccggcgaggtctgacagtggtgttctgggtggccgacatgatagaggaggaggaagtggaggaagaagaatgcatattagggatttaggaaaatagccttggctctggtaccatgcatgttaatgtggcccacggcagaggctctcttggggctgtattccaatatttatagatagaagattacgtagagaaaggtatgcatgtgctacaatcacggaggcacagcctaaacaggaatcaaggtttccatctatctatagatagataacacctttctatgtttaacacacacgccatagccctccgcgcgcgtcaagcgcggaggagccagcaagctggtggaggttttaataatagagaatcccctgaactacctacctgatgcatctctttcctctcaaagaaagaaagaaagaaagaaagaaagaaagaaggaaagaaagaaagaaagtagcagatcgcttgttgctgcgtttttcaggagctcacgacatta

SEQ ID NO: 563 - DNA, 567 bp, Zea mays
gactatggttctaagttctaactcgtgcaatgctatgaaaaggacataaaagctattctttcgagatcttgatataacttgccggttagctttggcaaaaaggtgtctacttttgaattttttaatatgaaaccgcagtacatatttttgatatattcaaaagatcaataaaaaaataaaaaatcagaaccgacttactatacagcaactgtctgcgactgggagcccaagataaaataaaaagaaatgtttggaaccgacctagtgcccgtttggtttccttcgaacgaatataatttgtatgagccggaacgtttcctatgctggttgcagagcgacgagcgacgagctaaaccccgaccgagtcgctgcttgggtgcccaagatagccctaccgcctcgcctctctcgttccccctcatcgccacgccagtcgcctccactcccagtcatctcccatcaccgacgacgtgtcgaggcgagagaagagggcgagtccaagtctagggttcccgccgcatcgacacgggcatcgcaccgcaccgcgaggggcgggcacggaggaag

SEQ ID NO: 564 - DNA, 804 bp, Zea mays
aataccgtaaaccagagggggcggacccaaacgaaaacgagccagccgggcaaacaacactcacatcttacaccagccgcactcccgtgtcctcctctccgagacgagacggacgggacggcaggcaccaccgcaccggcgccaccccacccgccggctcagagcgggggcccggccacccgaatcacacagatcggaacgccggaggaggagcaacgcgggcgcggagaggcccgccagcgaaggcgcaggtaaccgcaaccctcctcctcctccacctcctcctccggtcctcccttccccttcgcggcgcaggcgctgacacgcaggactcgcctgctcgccttacgctccgcagcaggcagtacgtcgccggcggctgcctgctcgcctcgccacccagacgcagcgcgcgcgcgtggtggtcgcgactcgtttctttctggcaccagatcccgtgctgctctgctcgagccgtcatggcgtgcggctccgtgtgcctgccccactaggactaggagggcgctgtgcagttgctcgacctttgctgcaaatctaagactcgggcctcggggcatagcaacacctgtggtcacatcacagcacagtaccgctccatacactggcttttgttgtgcctgccgggtggaacctcgctrgtctggtcgcatatcacctcacttacgattcatcacttcgctctctgcagtgcaagctctgggttcccggatccgataccaccggcctctcggcgagtgtgtaatccagcgagcgagcgctcggttttagccgtgagagcgggag

SEQ ID NO: 565 - DNA, 815 bp, Zea mays
cgaataactaaccttaggcaaagtggggcacagttagccacaaaccaaacaagcccttagtctttagtcccttacatagatgctaaaagggactaaaggggaatatttactctaattacccttgcctagaaaactagtgtgaaacaaaaaaaagagtattttgatctttatgtattacatttaatgtatttaaaatctgtttagcccctacaactaaacaatatagagactaaagtttagtttagggactaaactttagtcctaagactaatggagccaaacggggcccaaatctcgtttaaaaatttgaagcaaacacatccttaacggaccgtgggcaatgagctgagtctcccctgactctgggccgcaaagtcctggtacacttgatcatgttggtccatcctatggctgaccgcgacttccctagactgaaatcaacccattcctaggctcctagcccagcccaacggccgagcacacgatccgttcgagagcgagaaggtcctccggcctcagcaccctcaagtacacagtacaccctcgcaccggtaccgcggtccgcggcacacgacacccccactcgtctgtcgactcacgtctgatcgtctctccccaacaatctctcgagtcttgccattcgcctcagcttgcccctcctccaagcgtccaagccccacccggccattgcctcctcctcctgccgcaggtaagctagctgctccagcttctcttgccatcgcgtgtcctgcactcaccgccctcgcgcgtgtaactcctcctccgtcccccgatcgggctactagtgcaggcac

SEQ ID NO: 566 - DNA, 425 bp, Zea mays
agctttccccgcctctcatcatcgatcatctggctgtccacctcgtgagccgatgagtgcatgatgtgcaagaatccatcaatgccttcccaagaaatcgagaaggaaaaaacgtaggaaagctagaactttctcctttttatttatttttcaagtttttgttcatattaattttgactcctctgccctaccttctctgggttttaggagaattcaattgataagttcattgttaatagtaagtagcaagtgcatcggatgaacgaggggtggctcggcacaccttgatttctttctttctcaatctaacactctcgtgtttcttcttgggcacactgatgagagagcaggttttccatgacatgatggtggcgcctaattttgctggtcgtgtgtgctggatatcgtgatgtcagcagatcggc

SEQ ID NO: 567 - DNA, 88 bp, Zea mays; identical to SEQ ID NO: 545

SEQ ID NO: 568 - DNA, 825 bp, Zea mays
gtgtgcaccggacagtgtccggtgcgccatcgggcccgaagctgcaacggtcgggtgcgccagaaaaggaaggagatcgcgcaccagacagctacaacgactgtccggtggtgcaccacccgacaaaaggcaagtttggccttccttgttggcctccaacagctcctagctgccttggggctataaaagggacccctaggcgcatggaggagcaacccaagcttacaagaaacattctaagactccaagactccaacttcatgcattcgattctttgagatagtgacttgagctccatttgagttgtgaactccgtgcgttgtgttttgagctcaagttgtgacttgtgtgcgtgattatgctgtggatttgagtcttgtgtgtgttgctcatcccaaccttactccgtgctttctttgtgatcaatctttttaagggcgagaggctccaacttgtggagattcctcgcaaacgggaaaaagatataaggaagaaaagtcgtggtattcaaattgatcattggatcacttgaaagggtttgagtgcaaccctcgtccattgggacgccacaacatggaagtaggcaagtgttacttggccgaaccacgggataaaattgcgtgtctcttgtgttgctttttatgtgattgttttgttcacaagaactcacgtcaaagccacttaatcatactaactctctcataattaagttttgtggctatttagtctttgtttttacaggatcacctattcaccccccctctaggtgctctcaattggtatcggagccgttctcttcacttaagggactaatcgcccgaagag

SEQ ID NO: 569 - DNA, 1500 bp, Zea mays
aagaaaaccgtcatggttgctgggcaaattattcctgcttcgggatcttatctccgtctggaaaccattatctttgcttttttgttgtcgtcttttctgatccatagatatgcttaaaaaggaaccttttgttgcgcttatctccgttgagtatctagtgtgctccaaagtccaaactcataattgctttggaacctaaaagtggttcattatcctaccttgtcgttgtctttcaattatttctagagaaataagtacttgactaatgactaggatcagattaaagattaggacagtcttagcagagtttttcattatcaaggctatcacgtcaaaaaaaacctgtctatcttcgtaaataaggcgttaagtctgttgaagtgtcacccatttttttcaagagatttccattttttccaaggaaagcagttcatttatctttaagaaaacgagaatcacttagtaaatatagttgacaaactagtttgtgagccagaaaaccagagggaattagagggcaaaatgataatcccttagtaaatatagttgccaaactagttaggagctagaaaatcagagggtcttaaaaaatttatttaaaattgaataagaaaagattttagtctctctaatcctctccggatttatgtcacccaaactagtcttaaatgagaataaaaactcttttgaaaccctcaccgagaatgttctattttttctctccctacatgttgtttgtgtggtcaaccctactccattggccctctcttcctctccgacgaaaacaaggagttaatcctttcgctgtccagttgcccaacgtcgttgtccgaattccgaaatcaaatcacggggacatgtatagctagctgattggatcaaggattcgagtgcccatacctttcatctgctttcatctcgaggtaaatatttgtagctagtgtgttcaccctgtggatcctaatcgtttcgatcaaggacgcaccctaaccttgccaccttggttccgtctaaggaacggtaacaccaaacgacaacaagacgcggttaaaaaaaattaccattggccttaacgcccgtctccccatttagcctggagcagtagttgtcaattgtcatgtgcgttgctgtctgctcgtctggagcaacagcaatgtactatcttggatgcttgatcagggccctctgaactgtggataggctgctgaacaacatctgactgacaccccacacgcacacgcacacgcgcactcactcgctctgtgcccatacgtctttgcacatgatcctttgttttgctgctgctttgttttgcttgcctcggacagtttcgatcgtatgtcttgattggtgagattctatttagttgctccgattcgtcacggtgatcgaatgacctttctgctttgttttgcagtgccgcgaacaagctgtcgagacggagtgccagagaccagctcccctggaagtgcatgaactagtcagctacaagtttagtac

SEQ ID NO: 570 - DNA, 293 bp, Zea mays
acagaaaccatttcaatagttagatgcatatttgaacgtcataaaccttaccttaaaggcatcaccaactatatatcttacttggtcctttatcattttcaaatgtcaatcagtgaacaccaaattttaggtttgtaaaatgcctgttaccagtcaggaatgagatattatcttcagatgataaataaaaaaactgggaactgggaattgtaccactatgttgtgtgcttagttcttatctaattctaattccttggcttattcttcaataacaaatttctgggaggaggaca

SEQ ID NO: 571 - DNA, 1009 bp, Zea mays
gtgcctgcagtcctccctgtttaaatattgtacttgtgacttgtgaggacatcacatcgttagcacagagtgagctcaaggcgcacgtctgacgtgtcaccgcggacgcagctgtctgacgtggcagagcttgtagccttgtatttcgcaaggtggatacaggatacttaggatgcgtttggttgcgggacaacgactcgcccctccaattttaaaggataattgtggacaactgaagataacgctaagatagtcttatcccaattattgattctgaaccaaataatcttatttgagggatcgttccatctcaactcgttctgtcattacaaccaaaagagaaaaaaaagacattatactagtcactttgtctttttatcccataaaagaattaatcggtttagaaacttaaattctctcggaattcccgagaaattaagaggaaaaaaattaattaccgaaaattccaaagaaaatttaagtttccaaactcaacccaaatctaaaaaaactgctttccaagagctggaatgtatcatacagcagttggattggttggtttggagtgcgcgtgagcgaacaatgatcgattatttgactagtcaactgcttgaatcatatattaattttgatatataagtagaaacaacaaaaggacctggtgccaaaaccgctgtctcaacaaaaaggccagggttgaagctataccatgtccggtttcagcagggcatcatcggcatcggcaacggcaacggcatcgccttgtcctcctataaatagccgcagctcccgcccatcttccacactacacttacaccgtatcaattgtaatctccacagctagctcacgcacgattcccacactagctataggcagctaggctactgtatatagccagtcaccaccaaagtgtgaagtgtgtgtgcgtgtagtgcaagctacctgtaatatatatacgcttgaggcgtcacctcacctagctagctagcggctgcttcaaagctctat

SEQ ID NO: 572 - DNA, 498 bp, Zea mays
tatatatatatatatatatatatatatatatatatatatatatatatggtgatggctaggggtgtttgtttgggattataatctacccagattatgtaatccttattttggacagcttataatcctaaacaaagaaagtcaaacatgtgaatccggtgaactggtagcaaactgtaaacaaagaaagccaactggttcaacggtcaagggctggtaagccaactggtagcaaactgtaaacaaagaaagcaaaaggtaaaaccagaacaatccggtgaagccaaaaaccactacaaaaagtcaaacatgtgaatggactattgactatatgtcagtttagttattcttagaaatcttacctatctggcccgtttttttttaaaaaaaatccctttttcctctccatggagtttcccatcacaagcatagattacgcagtttcagcaacgtcaaagcacacagagtttcctgctgaggagagcgagatagagctcccaa

SEQ ID NO: 573 - DNA, 787 bp, Zea mays
ttaaaggagaacgagcgaccgagctagctatagaaaaaaatacatgttcaactcgtacatttctcgcccttttagctaaggtaaattacaatatttagggagtgttcaaatgaactagaactaatagttagtggctaaaaattagtggtggaattagctagctaacaaatagctatctaactattaactagtttaccaaaaatagctaatagttgaactaatagctagggtgttatgcctcaactaattttagccactaactattaactctagtgtattaaaacaccctttaataatatattcgttctcaaatatttgtcaatctttagtttatttttgaattaaaccgtgacaaataaaaaacgaaggaaatatctagtatgtggatcatatattatttttattttattttttagagagggactattatgctggcttatcactgtgtctcatgtgttgttgcacagtgcacagtcacaacgcactcatattgtgctttttatatacaaagggaacgattttgcacgtacaaacgtaaaaaagtacgaacaatccaaaaggagtccaaagtccatccatcggtccttccgtctcgacaagcttcttcatctcctccgtccttcaccgcttccttgaccctctctctcccccaccccacccacggaaagcttcgagctttcactctataccccagggagaaggaaggaagccggcacagtctactggccttgtggtgccggcaactgactaggatcgagaaatagggttcttggagagcggccggtcc

SEQ ID NO: 574 - DNA, 1012 bp, Zea mays
aatggttgctctgcggcaagcatcccatcgcacatgccacatattcgtcctcttcctgcaccaaggtcggccatatttggcaaacaggcacacaaaaaagtttgctcggcacgcaagatcgatgaatgcacaaaaagtcacaagctcattcgccttccgcgccaatgattaatatagccgcatagatcagagacccaagatctttccactgcatgttctgaatctaatgaggatcagtgatcagtctgcattgctcactttgatgcatatgcagtatcgaaataatcagggctaacaaggttcttcagcatttttagtttccttctttagaggctgtgtggtgcaggtttgtcagctgatgagttgatgggcacaaatgcatgagccccatgaaaccaaccaaccaaacaaacgttctagttacggatactgtgcagttagcttgtaggagtaccacgtagagactagagtcctagtactaggcgctgctacctgaaaatgagcagcgatacagtgttgtagacagagacaggtgagaggagaagagggccggcgagccatggatggagcgaaagaaagctgatcaggtcgctttgtatctgctttgtcagcacatgccatgcccactttttcacaccacaaaatccactttggtctaaagagaaaaaaaaacccatctaaaaagaaaaataaaaacaactgagccctccccagcaagaaaagcacaaacccaaagaacaacagcaacaacaaataaaaccatccagacttgacctccatcagcagcattccgtagcagctagctgcctagctagcaggagtcaggagctgcacctgcacaaagataaacacaggcagcacaaaaccaggctactcgcatataaagcaggagcaggcgagcagcagttgctcagacaggcccactaccattcagcgagagcgagagagaccacccatcgtctcatcgtcttcgccttcgcttaatcggatttattagggatcatcatcaggg

SEQ ID NO: 575 - DNA, 1461 bp, Zea mays
ccctttgttytatctgattccagggcttcatctgtatgctaaaactgcatgattataaaagatgttatcctggatctaaatcgcctaaatgaaaagtattaacttaaacctgaattggaaattgatgttgcgatagtttttgaaaacttcactaattagtttatttatatcttttctcactccggatctgtgcagtccacaaatctcataaaatttacaatattgctagactaagttcattgaatctggacaaattcatgattatgtatctgctaaaataaatccatgctatttagtaaggtcattatcatgttgcctcttgcattacatttagattatttaagattgtggatgcttgtgtcatactgtaactgtaactgaaacaatagctgtgcagaaacatagaaaggttatctgcaactgcgagacacaagcatttcctatggcatgacagggacacgtatttgggcagtggtggttcatggccgaggcacagttccacgaccagggcgacgtgcacaacatcgccatcgagtgcagtggtggtgtgaggacgtgataccgatgtggaaattactattgccatcgacgacgagagcactttactagatcttcttaggtaaatttcttacattctgttggttaattggttggttcttatattgtttataatgttcagttgtgtgacaaatgttgtagcataaataaataactataaacttctcccctgattactatgtctaaagaccatcataaattatgatatttaaaatgtaattagtcaagaaagtgcaaaacctatcatatagctgccttaacttctcaagaaaagcttaaaaaatgacaggcacaatgcaggcatatctgatatgagaagtggaggacgtcctgggctcctaaggatttctgagtgcttgtttatgaagccttcatatattgttgcataatacacctacttctgtagatgactaatatctttttttccgagtggcaaagagcttaactttaacattatgctaggataacttactaatttgttctttacaagttgttttgttctgactgatgttataatgatccattcaacttatgttaagctacaagcactgaagcaccaccatatagtttcatgaaaaaaaacttcatttgaaatgtttggcatctttatttatatatgtctaggtcatctatagatcattttcactttagatgatcgacaatctcttttttatatagcatacaacagcttttggttgaggggcctattctcgttcatgaaccaaatccagtagttaatgcaattacaattggtgttggttttgttgtatttcaatgagtttcatgttctcttgcctgatctcatattttttatatgttgtggatattgtgagataagaagaggaaactgaacgatgggcacactgcgggtgatcaggtggcagcgatgtgaggacggtcagc

SEQ ID NO: 576 - DNA, 208 bp, Zea mays
cggattgggctctcttgatcatatgtaatttttgtttcagtttcgatgtggtgtgggtgatgatcttgctcagcaagatcctcatcttgtaggattttcttttctctctaatataaaatatgggacgcgttcgagaaaaaaaaacttcaagagctaaaagaaaggcttctatgtatagttggcgaccctggtgtctgaattataataa

SEQ ID NO: 577 - DNA, 136 bp, Zea mays
gttagtctctgtgcgctgtagatagagatcagatgtagcatgtaaacgtgggaatcaagttctggaacgacaggcgtcgtcgtcgtcgtcgtactatgaacaatcgacggaaaacgaaaacgatgaagggatcgac

SEQ ID NO: 578 - DNA, 385 bp, Zea mays
acccgcaagatcaagagagagaaagaaagaacaagtacggcgcggtgagggttttgaggagcccggtgctgcgttgatgcaagcacccactcatcgtccacatgctgcaacaaccgaggcaaggagcaggacacaagcaaacacctttgagggttttgtggaagaaagagaaacaagagagagactggcagtgtgttagctgagcctcctcgctcgtctcctcctcgccgatccccccgcactcactctgcgttgaatgcatccattcttccgtctccattgagatcatcgccactcccaggggcgggcagcaaggaagcaagccttgcttggtgcttggtgccattgtgcaccgcccgagcccccaaacaccgcgcactttttc

SEQ ID NO: 579 - DNA, 1500 bp, Zea mays
actatttgatatatgaaacttttacacaatttgacaagatttttttatcgaatcagcaagtaattgtaatatatttggctctagatgattgtatactcaaggagaagcatcaaatttgtcgagcgcataataactttagactgaaattcatggattttattattaacgacgaatttgatgtttcaaaatgcgatacttttttacttgggtagacaaatttattttaattaaaaattccatatttcatattaaatttgtgtgtatatataaatagttcgggagggttagaggggtcaaggcctctgccccgtccccttggctccgcccctggttgatcgcagattccaagtagtctttccgtattgcaaagcagaattgtatcaattatgtctttttaaaatctcactcatgtgaaaagtctcttataatttttcttarttttcggtaacgtatttttctttttagagtggaagttgccttgtcgttgcaaaggcccatctatcaaagcccgcatgcagcggaataaggaatagatggagcttattttttataattcgatcctgttgtcaattttttcaacttttgtttaagggagttgttggagtatagatgataatttatctctaaatttttgtagcaaacaaaaaccaaaggcgacaaaacaaaccgtactggttctagtgttctaccgcagccccgcgcgatgcagagagacgagatgaggagacaagggatccgacaagtcagagagctagttagtggctgagcaccgatcgcggacgcccagtgcgcctccaccgcaggatccaggctgaccgtccgtccccacgcgcgcacacgcgacgctgactcacccgtgccgtgtagctccgagcccccatccccggccaccgcgcgggcggggcccatcgccgacacgcggcggcgtaaccgccgtgcaagcgccagcgtgcatcccggctccaccttgtcagcctcgcggtcgctcgtcggcacgtgccctcggggttgctgctgagtcaccccgcccagcgcgtcgcccgccccgagacgccatctctgtcgcgtctaggcgcagcgcaccagctccgttttcataccaaaaaaacaggcacgcgtgggcctaggcctttcgccggacccacatgtcatgcatttccaaaacgcgctcttcttttgtaccgccggctcacgctttctcaccgtgggtcggctgctgttccgtccgcgcctactgggactttttcttctggccctcccgagccttgggtcactgacaccctggcgccacggtgggcataacgggaattttgaaacggccgccgcctggccctgtccccccgtgtgtgcagagcgtggctttaaagcgacgccgtcgcctcgctagcttccttcccccatttcctcgcagtcgcatcgcatccgccctccttgcttcacacgcgcgacgcgatttttctattctttttttgggtggtagttggccaggtcggcgtaggg

SEQ ID NO: 580 - DNA, 385 bp, Zea mays
gtgtttaccgactgttttcatccctagacattgtaacatgactaacatcatcgatctaaataataataactcaatagttttccaacaatttcatctatatactttgttaatcacaaataatcactgatacagagcgtgaaaagttcggcaacatgtatcataacgacaaaaaacgaccatcgtgtgcgaccttttcgtgtttccccagctaccaaatctcttcacatcgtcaatccctcttccacagtttctgaaatcagaagggaaacacaggaacgacaggcaattcgaggctggcaatctaatcgtctgccatcccgtctcatcgttctcccaaatctgagagcgttcccaggacctagggttcttgagatccagccccagg

SEQ ID NO: 581 - DNA, 674 bp, Zea mays
ccgtatagtgttccatcgacaacctcaactttctaaaacttggttgttggtacatatttgtgccaccctcgaacttgagtggaaccgtagcgtagaattaggcggcgagctgtgcatattgagctatttgcatgaaaggaagagcatcgatccctctgacctggcaaccatttaacagaaagacaagctggcctaaagccccgatactttcttacgtctgtcgaataaaacgtccgccaatcagctcgctcatcggctagctacctgccattacaagccctcccacaacttgcacttcccgaccccggcctttcgcattgagctttagcatgcaactagcttcttacaataatatatagatagatatatagtagcatatcatcacgactattattatgctatgcaggcagatcaattcttgcatttgttgcagctacatgcgtcatgcgtgtgcatgggaatgggaggtgtgaattagacccagcatgttgcgacaaaagactttctttgtccctctataaataccatcagccatccaaatcctcggttcgaagcaacacaactaagcaggatcgacaactaagctagacgacgttggtcatcagtcatcacctggcttgaacaagagtgtagcaagaagcgagctgtgcgctgcggctgggagagaagctatc

SEQ ID NO: 582 - DNA, 468 bp, Zea mays
atcggctatttttgaaggacatgtctttcgcattttttcaattagtctatagagatcctcaaaagtccctatattaaatgaggttacatgccctaatggccttctcttatgtggcgtagtctctaccctgtccagatcatcatctcatttgctgcgttgttttgtttgccgcgcccacagaaataggcgccagttcatycgcttccattcctagttctcaccacccagaagtccacctccttgttgccttcctccaatcccaaatctcacctccttccagttccagctatcgcttctcgtgttggctcgcctcttcctccattcagtggctccttagatcggctcagggacacaccagctgatcgtgtcggcgccgaatctagtggcaatttctcgctattgttgccccggagcagtggtttggatccaagaaagcggccgaccttcttggttgtatatcctcccgca

SEQ ID NO: 583 - DNA, 95 bp, Zea mays
tgacctaggaaaggtgttgaaatcctctgacgaatcactaaaaaaatcacaggtttttgcggttgttatccagttttgactggatcttttcaccc

SEQ ID NO: 584 - DNA, 1500 bp, Zea mays
ggcgtagagcagcgggggcggggaggtcgcccagtcgtcgccacgagagagagagagaggacgccggctgaacgacgcaagataaagaacgggtccaaacagccagttcaccctagtgctggacgctggtttcgaatttccgctggacggagtggacgccggctggttcctagtgctggttcctgggacctgggtgtggccgcgtgggattagggagtagggacaggggcagggcggcgctggtggtgctgtcgtgctggagcggtggagcctggagctggacagcctgggcgtgggattgccggagccggatcggggtccggggagaaggcgtcaggcgtcacggcgacaaggatggggaatggggggcggccgccacgacgagaacagacgggtgtagagtttgctgagagcctgagaccgagctagagtttccagcagatatatatcgggttcgcgggtatacagacacgggttaaaatattttatacccacggaagataaatccattaggtataaatttaaacccgtactcttacctatagatataaatccaaactcaaacccgcaccctatagggtttgtgcccgcgggcacgcgggtaatctgtgcccattggcatctctaacacggaccctagaaatttgccccacccggatcgagggcacagtatatattcgtaactaggccgcaagtttgtttttgggccaatatgaacgtgggagcgtgttgctccacaggaatgcaggactagtataaatgatgcactggcgcgtgtatatgattttttttaccgggacagttgagcagcatagcagtggctagcgggcacacgtgtagcctgcgggcaacagcggtcgccgcccacgcatgtggctagatgtgaagcaccaacggctaggatttttcacgtgacgtggatagtacgaatggctaataagttgcattggtttaataagaagaagtaagtgatttagggacatcttaaatatcttatattaggagatttatttttgatctctcggagatgttgtatacatggtgtttaatcgaaggaggcgcacgacacagtgcgccggccctgcctaccactgtctcggccccacgcgccgaccgctggacgctggtcgacccagccgctgccctggtccaagtccagcacggtagcaacaccactccagctcaaactgcagccgctggcccgcagccgcctctcttggctagttggcttcagcctctccgctgccccggtccaggtccagcacggcagcacaccagtgacatcactccagccgcagccgcagccgcagccgcagccgcagccgcttctcttggcttcggccgctcccctcctcccccaactatccccactaccaaccatccccaaaaccccacgaggaatcccgtaaattcgtcctgtttccccgcagatcgcaccatccgcgcgcatttccgtccaattcgacccggttacttggcttctttgattggggaggggag

SEQ ID NO: 585 - DNA, 1500 bp, Zea mays
ctaatcccacgcggccacacccaggtcccaggaaccagcactaggaaccagccggcgtccactccgtccagcggaaattcgaaaccagcgtccagcactagggtgaactggctgtttggacccgttctttatcttgcgtcgttcagccggcgtcctctctctctctctcgtggcgacgactgggcgacctccccgcccccgctgctctacgccaggtgcccaggtcttcgtcgggcccttcgccgaagagcagccaacaggtatgcgcaccccttctcttcccttcccgctgtgcgaagctgaggacccaaaccctagctgacactgttttggctatttgcgtttggatcggatctaatttcaggtgtatacgtgtagtattatgctttctaacttgattttcttgcaaaataaaaacatgggtccgctcatcttccctactgggtccgcctgggcatatgtaggaattttagctatcttttagccgattgaatcaacttctagaatcactacattaacttgtattcgttgagatttacttctttaggttggtgacatattttgccagattactgggtatattgtcagctatattagtctactaatggatgttgccttttcttggtggtagctttaactgcgatttcggttgtttgtttcgtttctatcagatattaataatctaaaatggtgtgcagcttaggttaaaatcaaaaaaatttgtcgggcggataatacaaggcctacaccagaaggaataccctttgtgcgacaggcgaacagctgtctctctctctgcagtgttatttggtttattatatgcagttgcaggggagaaaactaaggcatgttcactgcagctagaagcacagccgcagcagatgcagcaggcttcttatacagtatttgcagcttagaagttggagtggcagctgcagctagctgcagcaaacactcctaacaataatagtggagagagactttcatgctgtttaaatttaggtgatttttgggaattaacttgcagatttattaattattatataggtaaaaagtgtagtatcagttactaggagcaagaacttgccctgatgacacagttattttggtttttctcctaatatttaaccttttgagtaagtgtgcagattaggtcttaaaaagggattgcgattaagattttattgccagagcctgagctgtagaattttccatttacacacgtgactgtacagggggtaaacttgcaggaatattacttggtgttcctataagatacacatgctgtgaaccctgatttgttttagctgcttttgttcgtttttgtctacttagccttgcacactgaggacctttattgaggtattccttgatccccatggttctagataacaaaccatgagtttacatcattatcccctctatctcaccttatattgaacatggtttttgatactattcttctttgtgcttgaaggttgccggtctgcgagttgaatc

SEQ ID NO: 586 - DNA, 658 bp, Zea mays
ccccccgagggcctcagcccggctcacggcctcggcagcttggctccaggatcctggtcatttgtttgtggaaccaccgaaccatgaactattatgaagttgtcctgttattctgaaagtaaaagagtgcagagatcatatgtaatgtgacagatatttagtatcaaaatagtgtacaattgtcttaagatgaaattcgtatatatggggcatcttcattcacaggtcctgctgtatgatgcttgctcatgccatggtgattgctaatttgtgtgttttagttaacacttgttctattcaacatatttctatctgaaaacaagtgtggtctttaaaaataccaaaacttgtgaattccgtgcggaatactgaaacctatgattgagggggtgtttgaatgcactagagctaataattagttggctaaaatattgctagtagaattagctagctaacaaataggtagctaactgttaactaatttactaaaaatagctaatagtttaagggcctgtttggttgggctgtggctgtggaaaaagctgttgaggcctgtgggctgtgagctgtggaaaaagctgctgtaggctgtgtgctgttaaaaagctaaaaaacgtttggtggaaaccactaaaaatcgttaaaatttcttcgatat

SEQ ID NO: 587 - DNA, 1267 bp, Zea mays
gcagtcgtttcttatcattctttgtttatcgctctatgtgctcaaatgccaaaatgcgctgactagtttgtatcatacaaatgacacttctacaaacaacacccattgctgaaaccgcaactgcacaccaaaattaacatcacagcagcccattaaagaagtcagcaatgatgttgtcacatggaaaatgcagtacattactttgacacaggaaaaagaatcgcctaactatggatctgattagcgagtcatgtttagtggaatggacatatcctccgtttctccgagaagcaatatttagcattgatttatgacgactatttggatgttattagagtccaagtgggcctgcccctgcatgtgcaggcatgtgcatggtctgcctctggcccttctgcccatcaccccaaccccatctctccttctaacgtgtccccccacagaaagtgtaccctttctcctcttcttttccttttttcccgtaccatctttcttacttgagacctcgccttttgtttcttactccctaagtttatttaattgtttggacacaaattttaagaaaaagatgctctctccagtggaagttatataaccgcttttgacagttaaaatgaccgttcggagttggggacgggtgggtcctctgatttatcggagatattttcgctttgtgcataccgattttttttacttaatttatttgaacacaacgtgtattgtcttgggaaaataattggcccctctattataaaaagagtgcactttttagtttggatctaagatgattttttataaaaaatactaggtacgcctataaatattattatcaacatttatatcttcagatcagtgattagtgtaatggttacttattcagtatcgtaacctctccacatggaaccacaatattcatcacacacaaaaaaaaactagatagtacagtactaaaatgtccacatcccaaacagggccctttgtttgaataaaatccaaatggatggttcaaagcagaacaatataccctgcacgctgcgcaatgaatagcagctgagcaagaccacatgcaactttcttgggctctcacctagctagctgctttatattcacataaacctctgctcttggagctggagctcctacagcactacaaacccatccatcacctttttctcctactcttccttccaagaaccaattggaagaaaaacagaaagcgaaggaacgaacgaagctagccattgcttgtttgtcgcgattgacacca

SEQ ID NO: 588 - DNA, 589 bp, Zea mays
ttttgtcccgttgaggagttgtgtcctctcacattctatataagtatcttgtctgcagattaaattctgcgggctgctagaatgtacctggtagacacgtcgacgatgggcctgattgggccaatgatttgaagattcggcggagctcggttctacacatgcatgtatatgctgcttgttcaaacgtaggatcatgtgctattttttcgatccatggctagtgtcaggttgggtccatccatggctattttttttcggacggtcgcttcgggtggtcaacggtgctagtagctaccccgactaccgagtgccagcaagcgacacttggctggagcgcgcgtgattgccggcgagcgacactggctggagctgggtaccaccaccgcgtctgccccgacagcttcgtcccggatggctttccatttccgtcagaaaaaaaaaatcgccctgtccttctgtttaataccccctccgttccagttctagtttctgtagcgtgcatttatacagctcgtgtgtgcgtccgctgacaagccagggcaaggagagcagccggcagagagcaggcccggcaccgccaccgccagcc

SEQ ID NO: 589 - DNA, 1136 bp, Zea mays
gaggcgatttggctaaattggttttagttgtcttgtttgcataatttgggtcacatctaataacatgcaggggattgaatctttacttccaagcttgcttcacatataggacctgatttccttatattatgtagaaattcttacttgattcacctattttttagactcactgattttgaactattttcctacatgactttgactcccacttagcgctcaacctgaatataaataaggtcgtactctgaattttgtgactgggcttgtggagcttagacgatggctagtttgtgccgttctaatatctgggttatataagaaggttcaagttctcatttttttttctcctaggctacctttgatagtaagccaagtagttttaagaatacatctcagagtgagggacaagatcttgcttctgatgctactatgaactctaccttcatttatttgctcatccagattattggattctgcattcagctcttttctgtgttcatcatccaatttttatgcatagtgctatctttgtgtctcaataacttcctttgttgttagttatggtgtcaacaaacacctattattattcgtgcgcacgttctggagccgccttggcgtctctgtcccggacgacgcctcttcagaacgaactctgtgatcttcgaaggcgtgcacccctccaccacttcggtcctccgccagtgcaagatgaggccgccctgaggcgtatcagactgcaccgcgaggacaccgccgtggctaacctttggtgccgtgcattcaccacggcgatgctctgatcaaaccctcccccctctttgtatattacaaattttttcagctagcctacttttgatctgattaggcataacaccatacaaataagacttttggtttattctgatgactttaaatccttgactttcttctgtcaaatcatttattaacagtgaacttgtgttccacttgtacacttacctagaaatataatgcttggctcttaacaaacaatggtttcattttcttatccattcatgttttaatattcttccctgtgtgctagtgcttcttttgacttttgttcatggtccaccttttatgtgcatatacatttcaggctcaggttttagtgggat

SEQ ID NO: 590 - DNA, 52 bp, Zea mays
aggtgaggcaccaaccaagcaaccgatcaagaccgatgcaaacacaccatgc

SEQ ID NO: 591 - DNA, 1500 bp, Zea mays
ggcacgattgccggagagcaacagctaaccgtgaccgaaaaaaacaaacatacaaacaaacaagagagttactattatgaataataaatatactgcccgaaagaaaagaggaacccacctactcctactactatcgagtctcgactccagtgcttgctattgctactgaatcgagcgtcgttactgccgagcctcagagtactaatccagctatcaccgcacgagtccgtacacaattacagtcaccacgagtagacgtgtggatgttggcaaaaaaattctccccaacctgcaaaacagaaaggccgcgcgcgtcgctttcgccgtgctgctcttcagtcagccggcggccggcgcaactcgcgcgcgacggaccggaccccgccaaaaaaaaaaccaaatcgtggaacaggagcacgcgattggagacggaagcagacgcacaaagcacggaaaagaagcagcggcgggccggcggcttttgagctgagccgcctgagggctgaggccagcccagcagctctcctctctttcagcttcgccatcgtcaccccccacgaagtcctcgtccggtctctgactctctgtgcgccggcacaggggcaccgggcaccgattacccaaaaggtccagcgctgctcgtgcgggacacgttctcgctctgcgccggcgccgcagacaagttccaccggggtggacacgagtgtcacgcggttcgtcggacttccgagttagctcgacggtcgagagcacgcacgctcgcttgctcgtccacgcttttgccttctgctcagggcctcaggggtcgctgagtcaggcggccaggataccctgacgatttccctttcctgatcctgcagcaaggagatgagattctcagtgaagtgccatgtgccactgcttgcttgacagcggagtacgtataccaggcaacgatccgagcgagcaagagagattcccgatctcgcatcccgcggcgggctactcgtgtcgaaccctcctcaatatcaataatacacggacggacccgtttctccctcccgcacgttatttacacctgccggtgaccgctggtcagccatctctgtttttaattatactagtttttttgtttgtttgcttgggaagctccagctgcattctttattggcggggcaggaaaattgtgttcccccaaaacacaagaagttaaaaaatgtaaaatactaatgacagtctactgtcaacagggcggggcgtgacagatggagttatggagaggaataaatggaggtggcgaggggaggagagacggacgaaacggacggacgccacgccctgcccgccggggctgcttgccactcctctctcttcctcatccatcctcgccccggccccgcccccagaaccaaaccagcctccctccccagcagctcacgagagagcgcaagcaagtattactgcgcaccgcctcgcccgcgggcgtcagcgtgaagctgccgcacagctaccccgcgaggc

SEQ ID NO: 592 - DNA, 47 bp, Zea mays
actgacggaacagtagctaatcctacatctacagaacacctagcacg

SEQ ID NO: 593 - DNA, 184 bp, Zea mays
atacacaatatacaatgtagtatcatgcatgtacattacattgatatttgtagccaagaggagcacacatttgattctccttttaggtagggacatactctcgacgatagtgaaaattgtctattaattgggatatgatttgggagctttatgtccttagtttatacttggaataaatttaaag

SEQ ID NO: 594 - DNA, 1500 bp, Zea mays
gatacgtggcatgtgtttgtttgttaacttgcattgctaatacctgaacaagttatatatataaccggccggtcgtcaaccaccttttcagtccgattttgtgtcgagggtagggagtaaaactgggacaacctcatgtcatgagcgaaaaattaaatctagatcttaaaattcattgcagcatgaatctgaaatccatcgtgagaggcagggcagtggcggggcacggactctgacggatgagggagaggacgcgatcggtcgagggaggatccatggagagagagagagagagagggaagagattcatagagttggtgaagtatcatttgaagagttttaatctgatcattattatattcatcaatttgatgaatctagatttcatggagttattctatttgaccattttttttaaataaaggtcggctgtttttggtgaacgtaagtaaagtcgatgggggctgtacagtgcgagagcgcagcagaagatgcgaagggcagagtaatccacgtcagcctcaggtgagctgggacggtggccgctcctgcccttttctatttctgagccctgcgcggcttccaattccgacgagccaaaacagacggacgcacacaaaagcgaaagggaggagagagaggggcagggcagagcaggagagagaaattcgatagggttcccatgccccttccccaccggccaccacttgccaagcgaaagcgggagtgaaggaggggagagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggggatttctcgggggtggagtggcggccaggacctctgattgggctccagtgcgcgatctttgaacgcagatttggtgcccgcaatctgccatggatttggtttaaggtgacctccttttccttattttggcgtcttgcttggctggcccggattcctgtcatccgacttatcgccgagctgagaaagagattttggttttttttttttgttttcttcttcacagatttggtgagatcggtcgggttcgcgctgcaagattagatttttgtgcctgttttattcacgaggttcgtgctccccagatctcacgtcttcacctgttcttgatccctttgttcccgttgatatcatccccgcttatttttttttctattcgattatgtcgcctgcagatcgcaacaacgatattgctaagcaagataagatttcaactttttttcccctggatcgatctcagattaggaggagcaaataaagcaagaatagaaagatttttgggggagaaggcatg

SEQ ID NO: 595 - DNA, 1500 bp, Zea mays
aaggatacgtggcatgtgtttgtttgttaacttgcattgctaatacctgaacaagttatatatataaccggccggtcgtcaaccaccttttcagtccgattttgtgtcgagggtagggagtaaaactgggacaacctcatgtcatgagcgaaaaattaaatctagatcttaaaattcattgcagcatgaatctgaaatccatcgtgagaggcagggcagtggcggggcacggactctgacggatgagggagaggacgcgatcggtcgagggaggatccatggagagagagagagagagagggaagagattcatagagttggtgaagtatcatttgaagagttttaatctgatcattattatattcatcaatttgatgaatctagatttcatggagttattctatttgaccattttttttaaataaaggtcggctgtttttggtgaacgtaagtaaagtcgatgggggctgtacagtgcgagagcgcagcagaagatgcgaagggcagagtaatccacgtcagcctcaggtgagctgggacggtggccgctcctgcccttttctatttctgagccctgcgcggcttccaattccgacgagccaaaacagacggacgcacacaaaagcgaaagggaggagagagaggggcagggcagagcaggagagagaaattcgatagggttcccatgccccttccccaccggccaccacttgccaagcgaaagcgggagtgaaggaggggagagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggggatttctcgggggtggagtggcggccaggacctctgattgggctccagtgcgcgatctttgaacgcagatttggtgcccgcaatctgccatggatttggtttaaggtgacctccttttccttattttggcgtcttgcttggctggcccggattcctgtcatccgacttatcgccgagctgagaaagagattttggttttttttttttgttttcttcttcacagatttggtgagatcggtcgggttcgcgctgcaagattagatttttgtgcctgttttattcacgaggttcgtgctccccagatctcacgtcttcacctgttcttgatccctttgttcccgttgatatcatccccgcttatttttttttctattcgattatgtcgcctgcagatcgcaacaacgatattgctaagcaagataagatttcaactttttttcccctggatcgatctcagattaggaggagcaaataaagcaagaatagaaagatttttgggggagaaggc

SEQ ID NO: 596 - DNA, 1500 bp, Zea mays; identical to SEQ ID NO: 594

SEQ ID NO: 597 - DNA, 49 bp, Zea mays
ggtacgtgaactgtggaaataattttacttttcataaattgtattttgt

SEQ ID NO: 598 - DNA, 684 bp, Zea mays
cctgaaaccaagataaaatttttgttggtcttggctctcagatatactgctcacccagaagttggcacagttctcagttttttattggacaaggattatattaagtttagaggccaaataacactactgtttggtttgagcagctattatttgttttttggtaggtttgtgcattttggagagaaagtgaagtgccattgcgaagcagtgaactgccagggatacctgggcagccaaataaagaacccaattcaaagcattcttgccactgtagcaccgcaagtgcagttgcgagagtattcgcccatgcaccacgaagctccaagattgaagccaataaatcacttgttaccctggaccaactgtatagaggtctcttttaacctgagaagcaaaaggaaaattgaccggctatgctgggcccgcaagaagaagagaacatccctcgtgccatcttcaacaagcatgccagcatcgccgagtgaagttcctgccgcggatttctaactgcccttcgttgaagagcaagcctgccctgtataataatttcatggtacattctttacatgcattggttggaaacgattctttcacattgctcatcaatggtgttgtaacctgcaacattctttatttggtttcatagggcattcagtcagtttacgggtggtagtttgtcggaac

SEQ ID NO: 599 - DNA, 546 bp, Zea mays
tcagctccttataaacagggtaacgaacattctcatccagtttttttcataaatcattttttagaaatttgggacagaaactgatttttttaaaacagtggtgcttataaacaaaccctaaaatacacgctcgcagaaaaaaaattgaaaaagagatgaagcagtaggtagacccaagggttcaaaaactaaacgccataattaccgtacgggtcttcgtcccgtggcaggggcagacgcggcggcgggcccggcattactctcccgctataaatcctactccgccgcacaaggcagaacagaagaggcctccccgctccgcgttccccagcgccagcggtaaccccacccaactcctctgagctgtgacacagctgtcctcctccccccactccaggcgctcacacaccctccacttccctccacaggaatccgccgccataatctcctccgctccgctccactccgcattgcaggattgcgccgagcacgagcaccctcctccccgaaacctcttcttggctctgctttcggtggtatggtggg

SEQ ID NO: 600 - DNA, 1489 bp, Zea mays
agatagcttactcatttgacatacatatttgcctgtcagaatgtcaatcaatttagcaggctaccctgggtcaccatagaattttaaagcaatttttggcagcctaaaaactagcgcttggctgtttataatgtaatatagattcttattttcagtggttcatacttttcgtgaaatccttttgagtcatgaaattaagatccaacacgttggttttcatgtgttagcctagcgctataacatactccctccatttttatttatttgacgccgcttagtgcaattttatactacacagcgacaaataaaaacaaacggaggtagtaatacaatggttgccggacttttattatcacaattcacagccaaggaaggaataaatgacgagacatctaaaaaatttgtaaccgttgctttgagccacctaaaaatggcgccgggtggcttttcgaagctaaactaattttgcatttgccgggtgatttttgtcatggatatagagatagtaatacaaagtcctttccttaatcggtggttcttactggttactacgactccataattattcacaacagcattgtgctccacaccacattggcccggtccttaattaacacaacgaaaacgagtaaaagagtacatcgcatctatctatctatctatctatctatcaaaagcacagtttttataacgagtacaatggttggtgttcttggcgctaatttgagagccacaaaaccgaagtagaatggaggagctaaaatcatcttcttattcaaattttaaataagaagtagactctagaccctctaatcccctccggttttgtagctcctaaactagcctctaagattttgtttgggtactttagtattaaactcaatccatatgtgttaagctggattgaaatgtaaattaatttaagttacactacaatcaacatcaatacatatgtattggtcttaatactagagtatctaaaggttttgtcgccgacaaaagctcagtagccacttctgctgcctacagccgccagacagcagtgacacatctccatctagcgagagatcttgcagctacactttttctgttctttctactctagcttgcaatcgaccgaccaacagcggagaggcggagacggagagaccaaccagacaagcaacccatggggacggccggatgggggtgggcagtgagcacaccacaattcatatccaagagcacaggcggcagggcctgcagggcatcggccgcaccgcctccgatcctccgcaggccgcgctcgtgttcccgtgctccgccacgccaccagagtgggcagcaccactaagacgcggatgatcacgtagccgcagcgcccgccgcccgccgcatgcagccacagcagccccgacccggacgtcaaaagcttagggcgagcgctccccatcgcaccgatcagccgcctgcacagcgcgctcctagctgtacgtatacgtacgtccac

SEQ ID NO: 601 - DNA, 352 bp, Zea mays
tgcgtgaggctttgcaccttgcagcgagcgtcggaagtatatgcgtgttcgccggaatcctgcattcctacagggggaaagtgccagggccaagggcgaacgcggcggaatgcgcagcgcgcagcctccagaggctataaaaacctgcctcgtcctagctagctagtcacacgtctcattcaagcgctctgccggccagcctagtgctctcggctttctttcatctccctccttttgccacttgctgtagctttaatttgcctggcactttgcacgttgtggccggccggggcctgtgcttccattggtcggcagcaagcaagcaaggctagctagcgtccgtggatcagtc

SEQ ID NO: 602 - DNA, 1500 bp, Zea mays
tataagcaaatttctgccgtttattccacgggattgtttttagcgttacgcgatcgccttgtaattgtaaggcgggggctgcagttgcgctgagctaactggggaatggccagcttgtggatgatctggcatggttttggttggttcgtgatacggaaatagggcagtgagtgtactcttgcagggtgcgacattgagtgtgatgtggaatgagcttgctctgaattgcatatctgttgctattcctgtccgcatctggtggtatgcctttctgaggtgtgtctggaagaatgagttatgagtatggcgtgaatttagtaccttccatctaggttgtttaataacgaaattgttgggttggttgtgctaattagatcatgatactacctagtttcacactactgatgaacatatacgcttatgatttcatatgctgcctatgcattccattttgaatcaacactccgatgagattttaagacttgatcttgagagctgtaacttgtgacccctagcatactgtgctctgtggatgaagaagcatggcagagatacaaaaagaaagaaaactccaaaattaatggaggggagaggatttctttctttctttttgaactgcaaagaaatcttgcattggctaaggttccaaagcacaaacatgcatattcttacatccacgtgcagcagaagtagaaaacaaaggcagtggcagctagatttattctttcttctgtattttatatcgtggttatcgatgctttctccatataattgaaattcttgcatattccatccgagcagctgcaacataaatcccttaaatgatctccatgatagaatcttaatatgcacctgatcgcacatttgccttaatgtgtcttcatttgacagccttgatcatatgttttagggtgcaaattcctacagaaagaactaaccccaagccatggagatggcatgtgattggactgttttacctattaaactgcatgtttgagaaaagaaaaaaaaatgtcagccctgatgcaatgcgtattcaagccatgacatcttttctggattgcatatcaccttaatctatgttgtacctaatagtatacttatcactattcaaaattggagcaacattctgttctagtccatgtattgaaaggagagattctggtagaagattcacatatgtaccctgtctatacactacaggaatacaagtacacaagttttcattcacgaaagttacaatcaaatactattctaccaaattgtgcacaaggaaaactaatatgatgttgcagctttgtggttgcatatttctaaatagaatgtgaaatgctaaaaatttggtctaaattctctctagctgtatttgaattatgcacattggcatatctaatttatctgcatcgatgtccctggcaggctgtgcacctctttttcttctgctactattacatttggcatttgctagacctctctttcctctaccgagtaagacaaaga

SEQ ID NO: 603 - DNA, 329 bp, Zea mays
attccagccttttgacgacatataaaaaaggatcaaaatgcccaagaaatggattgaatatgattccagcgttttgagttttgacgatgtatataaggattaaaatgtccaagagataggtgaattaagatttatataaggggcgtccgactgcgcgtggtcaacggctgcgcgcagctcacggctccttctcccagcgttacaagtcgatggatgcccggagtcggacgtgaaggcaacactactatgagaagccaaggaccttagaccctggtcgataagccaaacagcaggatgaactcactgtgtatacatatgacatttctgaa

SEQ ID NO: 604 - DNA, 1500 bp, Zea mays
cttgcattggtggtatcttttgaagaacaaattggataatttcgtcggaggcatgacccaataatcatgacgagcacgttggtgcttcattcgacatgagatttggacccctcccaaaagatcttgcgtgactcgaaaggcatgtctgtacgtggacttgcttggctggacacggggagagcgccccctgaccctgatgatgatttgtatcgcaccgcgcaccacggaatctgttctaggctgtctaacttggcattagccagtgtggtttttagagccaatctgttcgtgcaccggccgggcaaaagatatcttccccaaaaaaacgcagctactcgtagtactccctacggacgtgtgcacggatttgcacgggacgtgcgggcacggtgcacgcatgcatgccgcgcgcggccgccgaaagaagcgctggtgttgtcatagcttgacgccaccgagcgggtacaccgtacacctgcatttaattgacacattatgttacggccctaggagttacttaaacaggagcaaaggactaatcccagttcccggatcaagctcgagccggaaatttccgtgccgagatgcggaaccccacacaagcacagctcgcgcgcgcgtccgaggattgtcaagcacacgtgcggtacaaccgttgacatcgcggccgcactacgctcgcgtgcgcgtggcagtagacacggcacgataccaacgtggaaaccagcgagcgggcagcgacgctgtacgtgctctgtacgcctgctgctcgcagtcgcagcctcgcactcaggccacacgggctcagcataaaagaagggaagggccgaaggggtcagcaagggagaaaaaaaaaaggagactgggccaggcgtctcggtcacgacttcaagaccgacatgcggaccccccgatgctgtcccccacacggctcattcccgccccgcacgtgyggcggcagccttatcggtagaccccaagtcgggatcgtctgtgaccctaacgacgtgttgtgcctgttcctactgtgtttctgtgaacaaactgagcacggctgctgctgtctcccgtgccctgtgcgtggatctctggttccacgctcgcgcgtttcggttcgttctccgccggcttctcacttgccacacgtactactactactaggacgaaagggaaggaggaaaaggaaccaaccaaagttaaactgcaggagtaggacggtttatgttgttgctcttcaaccacagaagatccccgcgcaactgctggccacctttgccaatggcactcccgtagatagcttgtaagttgacgcccgctttccccgctccgaaactacacgccgttcagccccttatcacaggctccgacgctccgtgccgttgccccgctctttttcaacagcgacgctggtaacgcactaacgcccgtcccctcacccacccgcgcagaccgcagagagaagagagcgaggcagcctaggaggagcaaccgcgtgagtcg

SEQ ID NO: 605 - DNA, 579 bp, Zea mays
atacaagggtattctagagttgatggcagcacgtgagtgcaagggaacacgaagggaactagaaacaagggcaaagcatcgccccttcccaaggacacaaacaacaacccgccagcgttggtgatcagatcacgcacgacatccccagtgccggccgtctccgtccgcggcacgggcacggcaccaccccctgcttctctcccagcaggcccaggccgccagccgcctctcctgttctctttctctaaatagcagcgcccgcccgcgcgggacaccgcccgccctcccgcgcctttttccgctagccaacgcacggctgacggcaccacaaggcaagcccgcccgctctcggctctcgctctgctcctgccccccttctctctctctctctctctctctctcggtctctccctctttcagcctgcagcgctagcgagccctcgccttcccttccccattattcccaggattccccttgcgactgcaccacgccccacccaaacccacctaccgcctccgctcccctctccagcgagtcgggggcacggacgggacgggacgggaccagacgaccaggcc

SEQ ID NO: 606 - DNA, 305 bp, Zea mays
tgacaaaacggttggatagagatccgcctcgttgatcagaggccgtccatcgcggaaccaacggtggatgctccttcacgcggttttgaacacttcagcccgacgaattgttcggttcgtcgacgacaacctccatttgttccacaatccacattccccaccccccacggcccccgggcccacccaccctctccctcttcttcctcactcctctctccctctctctctctctctctctctctctcgtcctgcgccacacgccgcggccgtctccgggcaggaaggaagggggcgggaagatgatg

SEQ ID NO: 607 - DNA, 229 bp, Zea mays
gttcagaagttaggatcagtaatatccctcccccaagtgttgtaatgcatgtgttctacccctttctgtggtatgtgtaaaaggctagtagctcattggatgaggattcttgtttaatttattggcttgatgaaaccatcgggtactttgtagtgtggacatatgctggatagttagcatgtgatgaactgattacaatctgtgggggtaaaagccgtcgtctatgtaa

SEQ ID NO: 608 - DNA, 1500 bp, Zea mays
gagggcaacgagttcaatatggcccgagagcrgagcaggtaggggtgggcattcggtttattagggtaattcggttcagtctattcggatttgtgaaattttgggttctgaaaaataagaattgttttttcaaaataattttaggaaccgaacccaaatagactcacaatttcggttcggtctattcggtccaccgaatagacccaaatagtagagagactagtatcttttgttaaaatatatacaccgaataattaattggaagtactattattacaagtttacaacgagtgactataaaaaataacatacaaagatatatatatatattatatcataatttttagctaataagttcataaatcatacaataataccatcacatattaagatcttatatattttgggttattcggtctattcgggttttgaaagttaggaaccgaacccgaaaacccgaatagaccatcaattcggtctattcgggttcggttcggattcgggttcgggtttcggttttaaaatgcacacccctagaagcagggtgcgagggagggaaggcgtgtggggactcagcaaaggtgcctagcggcttggatgggatgacgagcgggatagagaaacgagcaagatgaagagtccgttggattgagattttgttgtcatttttctatttttttatcaatgctaattgatttatgatctgtttggttgagttgtggctgtgaaaaaaattgttgtgtgctgtgaaaaagctgttgtgggctgtgagctcttaaaaagctaaaaatcatttggtggaaaccactaaaagccgttaaaagttcttcgatatatgtctttatagttctatctaaaagccactaaaagcaggtcttggtgtgctttcagttttagactgcgaaaaaatcagcttttacaaaaagctactttttagattcaatcctttgatttggtttttagcttttataggataaaagtcaaagctaaaaatcaaaccaaacacacatccttagctatgctgctggagttgttctaattgacggacggctggcttatgtggtcgtgggcttctggatacttctacctcctacgagaacgtactagttgccactggacatgaaggactgggccacagatggaaactgttgggccagccgtgatagggaattccttcctcgaccaagagattgtcgaagattccagatcaatctaataggtcaagtccactacgtaggatacagtccatagcaagtcgagtgaattctagcccaactgtgagatctagtaggttctagcccacgctggggcacacgagaaacccacagacaggccctcccgtcgcttgctataaattgagccccccgcgtcgacgctcgccatcacaagccagaacagccaagaacagagatacccgagtcgccgaagcaaccactcacaatcccaatctcccgcgtcactcaaaacccgaagtaacaaccgtcgtcggtccgaccaaca

SEQ ID NO: 609 - DNA, 1500 bp, Zea mays
gatagcgtgcatggctgcaagcttatattgtctgtatatgtgtatagggctgttagaatgagttttaccggataccactgcaaatagcctaagattacagtggcccatcatcaaattaatataaccactagatctaaaaataataaatcatccaataattctagtaggaggtggctattaaacttcgggtgagagccatgtttttcattcatccgctcttttatagattaatttttttacaagcatataatttattacacgtactcacatgttagctgtttactaaaagygtctctggtcctattcagctccatctctataccatttctgatatccaaaaaaaaattcactatgcatgctaattatattatcagttctgatcttataaagccgagaaattttggattaaaatatgggagatgcattatcggatcccgtctgtttccattactgaacttttttagggcatgtttgaatgaaggcaggaactgttgcagatgatcaattatatcatataaattagacaatcatttcaggtgcaaatcgtttcaatgaataaatcctgaacaaacgaacaaaccctttggtcttatttgacattagtattcaccgtaatctatgtgtattaaggtggattatggtataacttaaactaatttacacctcaatctaccttaatacatctaaacatgggacggagtattcaaacatggccttagtgaataattggaacgtcagttgccatttgtcttcccagctgagctggtgaggtcgattggctaacggagatgatgaattgatggctcacataataaggaaataacacaagtaccagagagcgaggtttgcatatgcatacacaaattcaaaataaatggaagaacacagcgatttaatttaacagcacgagattgttaattccatgtgaagcaagcaattacagaatgttcagtctacaggtattaatagcctgttacaatcacattagcatcctacgactacgaccatgcatgtcctctcactctcagccctcttcgttcaggtttacaaaggtgcccgctgcatttggaaagttataccgcgtgatcgtccatgccggatctcctcgcattaattgcgtcgcgagcaatccagcctccgatccgagctcagctcagacgatcacctccgggcaatcagctgctggacgcctagctgcctaggcaatcatcattacagaaaacccgttgaaagaccgtgagagcgaactgcctaggcaatcggtaatcgccggaacatgcatggaagcctacgaggcctagcccctctagcccctagccatgtctcgccccaccaccgtgttgcgtttgatccgccggccgccgcggcacgcagcgcctcctatatacacgccgcctcgcctctcctcttgcctgcatcgccagactcgcgaactactcctagctagcatccgatcactagcacggcgagggaacagggaccgtgcggaggaagatccca

SEQ ID NO: 610 - DNA, 126 bp, Zea mays
tgctttgctagctgctagctctgcaccctctctactagcattccccagctccactcgactgaccgaccccctacacactctgagaacaaacttgtcatccagtatagagcccgttcaaggccctga

SEQ ID NO: 611 - DNA, 795 bp, Zea mays
tgtagctacgatcgagtaatgtttgttttagagcgccggtgaagatgggcaaaccgctgcttggcgctcctcgaagaagccttagaaaaattgctgttggcaagccatgcgttcatggtggttttgtcttgcctttatccgcttctacttctggagagacgagaccggcgcatgtgctacacgagtgacaccacgacgagcaggcacggacggtcatctgacatctggaaggcccgaagaattcaaagccgcgccgcgaacgcaacgccttcgcatcgctcgcggctcgccgtgacaactgtgggggtgttgggtttagtctaggaactaatttttagttattttattttattttattttaatctttaaaatgttaaatatagaaactaaaatatagttttaatttttatatttaataatttaaggactaaaatgaatagaatagagaaaataaaaattattcaaaaaaccaaacacttccaaagagcttcggagctttcagctttctttcccccactttctcagtcagtcagtcaagactcaagacgttaacgccgagcccaaaccggaaaccgcgccgcctcatcgtcccagcgccgcgtgtcgcgctgctcattccgccgcgtgcccgcgccatcggcacacgtcaggcagggcccccagcccccacctccaaactactagtacaagtctacaaccacgcttcccagcccgcccgccaaggtccctactacttaaatagttaaattccgagccaaggtccctcctcatagctagctaccgcgatcgaccgcc

SEQ ID NO: 612 - DNA, 384 bp, Zea mays
tgtcgacaaaaaggtcgttccacgtgactgctcagcgaagcgacctcattcacttacccgagagagacaagcgaaagcgaaagaaaatggttcatctcaagagataaggccaaataaatcggctcgggatgtccaactgattcaaaatccacaatcaaagccaccagtatcatggacacctccacctagttatgcacctatgtagagcatgtatgcaacgtcgacagacagtcccttgatctcggatatgatgactttatgttaccaccctgactacattgttcgactctcgtgaaaaatacaataaaccgttgaagcttgtgcagaagaaggtttcatttgcattgcacttgggggcacgtggtaggcgtggatcagaggagc

SEQ ID NO: 613 - DNA, 1500 bp, Zea mays
aggcaagtggcaacggtttacagagaccttgagtggatggatggtctgcactctgcacaaagccctttctgccaagtggatagctaggtacaccactcacatcacccaagcctgctgcaaggtggttgcggttggcggttgcctgattggccactgaaacttgagtaccatctgacgaggtgaaaagaagtgagaagtcactgctcgtccagttggccttacccttacgtggtggcaggcacgcgacggaatgcgagatgggcggcgtgtgaaagctaggtagcaaacggcaatgcaagctcacggcagacaatccgtcagtcccacatggcggtgccgctggccactggtcatagtgctgtggaagcatagctgcattgcatggatctacccacgacgaagcacgcaatgagcggccaccgacggccaggagggccgacgacgcgacaaggccgtcgtgtgccggactgcggacgtcgtacgctccacatgctgcgctgacgcgaccgcgcatcgacgccgcgccgggcgcgccggtgaccgcgcgacgcgggtccgtgcccacagccggcgtgtgtgcgtggctggctgcgtgcaagcaactgcaactccaatgcccccgtggaggaacgagcagcgtcagtacgactacaagcggctttacctaccccgtccgtgccgtaccggaccgggcaaagctacggagctgtgacgggcgtgcgtgagaggtcggtcgggcgcgtacgagcgcgcaggcgtcgtgacacgccgcgacgccaacacctggcccagcgacaacgcgctctcggcgtcggcgctcgctcgcccacgaatcactcgcagtgccgtggcgtgtcgcggctcctgcgcctccagtcttccacctcggcatccacacgtttcgcgcctcctcgtcacgacgtcgcgtcacgccacgcgcatgtacccctccgcgatgccgtaatccgctcagctagcgcgatcgatcgagaggacctgctcagctcggtccgggttcccttcctcctcacgcagaggcagagtagttagcgccggtaccccacggtccccacccccactaatcaccgcctcgtcccaagtgaagagtgaacccaaccgctccagccgcggacagcaacgtctgaccgcccggcaccccacgggcccagcgcgccagcctgacggcggcccacccatcgcgtgctccaggcccctctcgaagtcgaagccaggaattttacccgcgttccaaatgagctttagcggtcgctgtcgtggagcacagccgcaccgcactcacaccatttcaccatctctccgcggaagcagatcctctccgctcgccagcctccccctcctgctgctgcctcctcgcttcaagcaacacccgaagcggcaacaaccaccaccaccaccaccaccggacctgcctgagcgaccccttggcttcccactccactgaagcagggcgagagagagtaaggaggaggaggagaagcc

SEQ ID NO: 614 - DNA, 615 bp, Zea mays
gaagagtaaagagatgctactaccagctcggtggctggtggcatcagtttcacacgagtctagaggtgtttgctttctaaaaactaatttttagtctattcattttattttattataatctctaagttgttaaatacaaaaaactaaaataaacttttagttttatatttgataatttatctattaaaatagaataaaatgaaaggttctctgtaaaccgaacaccttcttagtctgctgctcattcgtatttaggtacatatattagatgtaacaatatcatatctgacgacccttattagtgccgtatattactcgtggtgagagcgtaagagcatgtaccaacctttttctaactagacaacacacaacttgtcaaaaatgtgttgaattatctcctgctattggatcacacaaagggcacttggttcggatgaacagatagagagctctagtttctctctgaaatataagcaagctttcaccgtttgggctgctaacatctttattatctgtactggtcagttcattgcagagcctggagtcggccataaaatcacaatcgacatggtgaaggcagcaagcgaatggttcgatcgcttcctgcatgcatga

SEQ ID NO: 615 - DNA, 398 bp, Zea mays
atgccatgccctgcacggacgtgacawtttcaaaatatactgataattcctgggcgtcccccccaatgggtgtgggcaagggacggcttggtacgctgaatgttttagccggccgcttctgagtagtaatgtgatgtgacggcgggtgtaatcatatcgcccgtgcagttgactggagacccaatgggtgttgcattgcatgaaacggtgtcagccgcctgacgtatcttcaaacgggttgaagtgtatattgaatattttgcgactgttcggcgaccgtggtaggaggtgagcggttgccttcttcttatataaatagtgcctttgcctcttcggtttcttcacacctctttgctgttctccactgcttgctttcttcttctcccctcgtttccacc

SEQ ID NO: 616 - DNA, 1500 bp, Zea mays
agcctccaaccacttcctagccattggctgactttgctgtcgatgggcttaccggacagtccggtggtgcatcggacgctgcactattcactgtccagtgcgtgccacgtcagtcgaccgttggggtttgragctgtagaccattgaagtcttttgtcttcttgtggcactggacagtgaaagggaaatgtgcctttggaccatttctataacgttttggtgattaagtgcccaacacgtttaattaagttcttatgtgccaaataaagtaagaagtgcaaatcaaggcaaaaggtaagtttctagacttggtgaattgttttatgtactaacatggttatccaagtgctagaaacagtgactaaagaagaagagagaagaatggaaaagcttggctctatgcagccaatcttctgcttggtctggcacaccggactgtctggtggtgcaccggacagtgtccggtgtgccaggctggttcgcggtgaactctccgctctcaggtttcgacggcggcgtacgactataattcaccggactgtctagtggtgcactggactgttcggtgagccaacggtcgccagcgccaatggtcggtcgcgaaatctgcgggcgacgcgtggcaactccaacggtcggcggggggcaccggactgtccagtgtgcaccggacagtgtccggtgcgccaacgggcccggagctgcaacggtcgtctgtgctcgatttggaaggcaatcgcacaacggacaggttacagtagctgtccggtggcgcaccggactgtccggtgcgccactcgacagaaggcaaggatggccttccaagtttgcctccaacggctcctagctgccttggggctattaaagggaccctaggcgcatggtggagaaaacctaagcattcactaagcattctaagtctcccacactccgtctttgcgcacttgatcgattgtgttagtgatttgagctctgttctagttgtgaactctttgtgcttcattttgagctcaagtcttggcttgtgtgcgtgtgtgtgctgcagatttctatgtgtttctccccaaccttactcatgtgctttaattgtgatctttgttgtaagggcgagagactccaacttgtggagattcctcgcaaacgggaaaagaaataaagaagaaaagtcgtggtattcaagttgatcattggatcacttgaaaggggttgagtgcaaccctcatccattgggacgccacaacatggaagtaggcaagtattacttggccgaatcacaggataaaaatcgcgtgtctcttgtgtgctttatctttgattatttgtgttcacaagaactcgcttcaagctacttagccgttctaacttacataacaaagttttgtggctattagtgttgaattttacaggatcacctattcacccaacccccccccccctctaggtgctctcaattggtatcagagctgttctcttcatctaagggactaatcgcccgaagag

SEQ ID NO: 617 - DNA, 134 bp, Zea mays
agtaactatatagagagccacgggccttctccacgtgtaagtggttatcacacccgggtttcggggcaccaagacccgggcgcgaacataatcaccaggtgtgctgggaccaagtctcacacatatgatgaatc

SEQ ID NO: 618 - DNA, 60 bp, Zea mays
tctaatacttgcgggacctacccacgctacgttctaggaccccatcatggtttcttggac

SEQ ID NO: 619 - DNA, 795 bp, Zea mays
attaatgtataagctgtaacgtgacgtgcgatgccacatatattataaaaaaattgttatatcaacaagaaatgaaacaacggcttttgtggattgtgtccgtctaataaacgcatttcatgagagaatccttcttgtccaccctactcctatatataaatttgcacgcatctcaaagtaataagtcacaaaattaattaatagttttttctctaattactttccagtaggtccacatgggtctagccttgctctacctctagtataaaaacagattgaaatggaccgagaaacatctagctagttctggctaacaaaaattagttgaataacgtttctgttcgctaaaaagcataccgttttgaaacgtatacaacattgaattactttataatcaaactttaaccaataataattttattaaattaagacacggaaattgaacacagaatacagcattatagaaaagccccaagtgggaggagagaatgcatgaaataaaagaaagccatttgcatggtgggtaaattccgtggtttaacaattcaaggagattaaaactcaagtattgaatttaaagaaaaaccctgatcaacataacattacagtgtttgcatgactcgagtagctagaggcagggtttaaccaggcgttccaacaagtccacaattgcaagtggttgctcaaaaggcagctaatttagaagtcgtcatcctcctcctcagccatgtgcttagccagttcttcctcctgttgaagcctctctcggcgcttctcggcgctctccttttcctt

SEQ ID NO: 620 - DNA, 184 bp, Zea mays
tcggtacccctgctatataaacgggcacgtccccggccattcggcgccacgattgcagagccagagcgagacgcgactgcttttctgcttcatccacattggtagctagctagcttacacgttcacgcatcgctttccgggccgtctccggtggtttagctcagcagagcggggaaggaagaag

SEQ ID NO: 621 - DNA, 800 bp, Zea mays
ttgctcgcgtgcgtcaggtgagggcttcgctccttctcggcttgggtgatccattttttcagtgctgcggttttgtgagctcaaactcaaggggtggggttgcctggattgatatttttgggaaactaaatccgggttttttgtgggttcaaaactaggggggtgattggactctgtcgtaagttcgtaacctaaccgaatttatgagtttgagcacagtgcttttagtatctctctgaatgcctctctctcacacactagacatgtcattgtggctctctgcaaatttgtgatgttgtttggacttcgaagaggtctctgttggttcatcgcatcattgaaaccgtgcagtagtgtttcatccccgtaagattatatatcttgtcactgaccagcatcaaactggactagagaaattgagagaacttcttttattctggttaaaggactagaatgtgggctggtagaatatacatatgtttctttccaaattggacaagcttgatttcttttcgatgaaaaacagacacagaagttccatagcatgcaatcttctgtatgtgatctgttcttcctggtttgttttctttattgtcttctgtatgtgaatagctagtacttgatagtttagtgttaccaatttatatgttgaagcttttccctaaaatgttgggtgaaatggcttctgcatggaacttacgagatttattgatgcttacatcaaatatgcttgcaattttttttccatttgaagagaaggaaggaaaagaagaactaggagcagagttgaataggtcatt

SEQ ID NO: 622 - DNA, 1028 bp, Zea mays
tggtttagaacaagtcaaagtcgccaagataaacagactaagatatctttcactagctcgttcgttcatccgccatatataagcctagattcctctgaccgggactcctttctcaggatatcctaataatttggcaagacatgccagtgtatgcgacaggtggcttgtcagcaactagctagtctgcatgcatgattaattagtaacagtaatacagtatacagtacgtaataattcatgagtaagatatgtctgacttaagttttcatggttacaatattatgcaacgggacgtacatacacagtattaatcctagttacaacatgtatgcaaagggtctatttagaaatacaatatttttctagttataatgatatttaagcataccatattactttattagatattattttagacaaaaaaagatatttggaagtgtatctaaaaactttgtattttaaaccatgttcatcaataccacaatatattttcagggtctaaaaaattcgatgcgtggagcaagggttgcagtcttatcctttctcttctctccggcgctagcgctacaactaaaatattgtgtctctaaaccagcgttgaattggattgatctatatatagtaatatactatagttgtaccatgccactctataatatgtggttttagaaaaacaatgttcttaaacaggtcctaagctactagctgtgtgtacagcaatcagactacctagaatgaaacaaatgaatgagaaagtgagcacaagatagccaaccgcggaccgcctctcgccatggccatccatccgatgaggacggaagggaccatcgatcgtcctccatcagctgagctggagtcgcctgccgtcaccttgctttcacttgggcttttaattactatacaaataaacaagctagacgacttcaagtcttatttgctcccagtcccaccactgctctctgaatttctgctccctagctagctagctctccagtctccactgctgaaaggcgtccgtcgtcgtcgag

SEQ ID NO: 623 - DNA, 112 bp, Zea mays
aggtttctccgctctcatataggtgaggccccaaaccccctgcccctctgcgttctctgcgagcttcggattgagtggcgctgaccgcgtttgtgggggatcagawtcagat

SEQ ID NO: 624 - DNA, 1091 bp, Zea mays
ttgtcccccagcggagtcactaaaaagtgtattggtgccgatctgggcgccaatcactatgatgctctctgtgataacatggacgattcgcggccgagggccgaacggtccacgacctggcgtagcggctagggtttctaccgacgaatcggatggcccgcgcgtgcgtagaggcaataaagtttgccaacaacacctgagtctcgctcccgggagggaccccgtcggggaggagagatcctaggatttgtcttagaatcggcagaccatgcgagacgcctctatacgaagtagagtcagagaggggtgaagattagagagagaaagctacgttaccgtctactcctaggaaaaaaatgtaaagaacgaaagataaattaattattgatttgattgtttgttattcaatcggatgtatcccttcaaatatatagatgatctagacccgttcctaggtgttctccaataactcccgcgagattaaagggataaacacgtgagaagataggagtttaattgccagatctaatactatcacgaaccgtccacgtctatgatcgggctgtccgcaggccggaccttcgagcctcaatgccggaccatccaaccatacccagtgtctcaaatggtgctcaacacatttttttgtcagtttcataagcctactagaagcacctctataatatatgtcgttaatggacaaaaggtaagttgaattccatctcgaaggagcatctagcgagagtggttgtgttcaatccacactcctctacgttagattactatcttcgttcttaaatatttatcgttcttaaatatttatcgtccgttagtttatttctgttaatttattttaatattaaatcacaacaaataaaaaagaactgagagagtatgtctgaagccctcagtcccaatcactgtccacagctctgcgggactaatcgacgacgattagcagccgtcaacattgtccatccaacctcgccgtcacaaactcacaacccccatgtcgtcggctccaaagcaagaccctgttcagccacacgctctgtcttggtcggtctaggtgttgtcctcacggattcgcg

SEQ ID NO: 625 - DNA, 91 bp, Zea mays
gaaggcaatcctgtcgcacccggccacgggtgccttcgtgacgcactgcggctggaactccgtgctggagtgcatcgaggcggggctgccg

SEQ ID NO: 626 - DNA, 293 bp, Zea mays
acccctgcacgccatctccgtgtatgtgagcaggatactgaccgtgcgcgagacgttgctgttcgctgccgagttccgcctgccctgcgcgctttcctcagagcggaagcgcgtgggcgtcgaccagctcggcctcttctacaccgccgacaccatcatcggcaacaggggccaccacggcacgtcctcggcagcggcgacctgtacgcggtgtgtgctggtgatgcaagtggcggcgtgggcgtgggcgtgggcggcctatacgaggtcgtgtacaacaacgtcgttagtct

SEQ ID NO: 627 - DNA, 537 bp, Zea mays
cgaggggcaacgatgacttttaccgtaggtaagaaaaggttacagaggccgggacattaactgtaccaaaatagcgtgagggtttcgtccataataccgaactggcgaagcacggctgcggagttacaaagtggcgaagccgcgcgacgatagtgttacaaattcaaataactcgccttctggtctgtttctgggccgtaccaaggtatggcgtgggccataccggcccctttgccacgcagagttgtatctcgtatgggcggtaaacagttaaacatccctcgggcctcggccacctcggcggggagcgttaagcgtcgcccgcgaagggacgaggccagcgtcggctccccgtctccctcccttgagtcccttcctccagatctcggcgcgagttcaccctgcagattgactctacaatacatcggcgaggaagaagagctgcggttcggaagagtaaactctacccgccgtctcgcgccggttgaccggcgcgaaggcgagatccgggcggagatccagggcgcggcgccggcc

SEQ ID NO: 628 - DNA, 92 bp, Zea mays
ctgcaggaagcaccaggccaggcacgtcgcttaaccacccgacccgagcttccccttacaccaccaccgcaagccaagaggcacgtccacgc

SEQ ID NO: 629 - DNA, 1500 bp, Zea mays
gccacagctgatgatcattttgttggatggtgcaagcaagatagcaccacacacaagtccatcacaactcacaagccttagtgcttgctcccatcacggcgatatcagtacaaacaccagcagcaggtagctagtcgatcgatagccggccggccggccaaaaccacctctccctttccttcttctctgtcccccttaattctccagccaatacagctttctggggcttacaccgcaggtccagagcccggccggtcgtcgtcgatccacatcaccattactccatctcctgataccgatcgagagctcctccctcgctccgggctgagtcgccggccggacggactcctccgatccgtgcggcgtcaggccggcccgccagctgggccatcgtcccgtttgattcatcagccgtagtaggactaggagccatggtcgaagctatttgatctatctctgagctgagctgagctgggccggcaatttgatgatgcttgtaagtggttcttaaaggatctaccatcatctacaattctacatgcagcagctgcccggattttagtttcttctccctcactccgatccccagctcttgctcctttttttttaacatttactccacaattttatttcaacacgtactagcgcatacgcgctccacacactcccttgtttttatgtgtgcagtggagtagtgtagttagtgccttctgtcttttggggaaacgtaatcacgttttcttttagtgtcgtatatgtgcttcattctacctgcagaacaaggaaagatacactggaacccagagatgcagctcaatctgatttttcatggcggcttttgattttgttcctcatctatctatatcgtccccgttaattctagctccctctggtttctaattttctccagtatctcttgctaatcttggatatataggacttatatactgtatggtaatttgatactgagtactgacacattgctgtgttgaatccaaatatccaatgcaaagagctcataaattaaacgccactaaagctaatcttttgttaaccaacatcatattaatataattcgtctgtttctttaataaacaccttcagatttacattgactgccgcttgtagagtagtaagcaaaattaaagcatataaagagggctacagtccactgtatccacaccaagttcatgtttcagtgccatatctttccgtgattcttcatgtcttttaccgaataaggctgctctgtgctcgtttaccagtggacaacagtggccatgccagatccatccattcacaattccacatgctgctcaccagcacgcactgtggccaatgcgccatcgatctcatttcatgcatgccgaattatttccccccggcccctgcacgagtctagagtctagacactagactgtcttgttcagttctgacttattatctgatgatgatccgttgttattaggtgtgtgtgtgatcatgagtggataataagag

SEQ ID NO: 630 - DNA, 578 bp, Zea mays
gctagaaatcaaaatcatatcagagcacaaaatcaggacaaagctagttcctacagaaagaggcaaatggatcaacacaactagcaaaagctccaaatggctcaaatctctccccctgtcaaagcactctcctaaagagaaaatatccccctttgatgatggggacagtagaagctcgaaatgcacaaaatctcccctctcactacacgacggttcacttacagcgacctacggttggttgctaaaacggccttcagcgacctaaggttggtcgctgtaagtgccgtcgctaaaggctttagcgaccgacatctttttagcgaccgaccgtctgttgctaatattgtacatttagcaaccaaccgtgggttgttgtactatagatttagcaaccaatcgtaagtcgtcatactatacatttagcaaccaacagaaagttgcccctaattatagtcgttaataatgataatataccattaattagcattcaacaactgttatatatacagaagcatcacaaatcaccaatttttatacacataatcacatagatatacaaatttaattagtattgcaca

SEQ ID NO: 631 - DNA, 576 bp, Zea mays
agcgactgcgtagtttcgtctcttctgccgattaactcagtggagaatctcgtgctgataacgtgtgagtatactcagtggtaacgagattgagagagaaacaaatgacagaattgttgtcctttattgcagaggagcagtttatatacaagtgtatacatggttccccaaggggtgtgacccttgggtagtaactgctaatggatgggcttgatcacatgtgcataatgttttgtaacaaaataaacagggtctgtgatccaaagcccatggaacgcggaatccgactatgtgagagcccgcgtggccgcctcacccaacccaacgagtctgctgtccctgcgggctgcggccctgtccgcgaaccggagcgcgcgaagaccacatcttcccgccacactgcgcgttaactcccgccaaaacgccgctttcacccccacccttacagttaccccaatccaaatccggtcgcctgccgcagccccattcccgcgccccgacctttcctgtaccatccccgctggcccgctcgctctcttccggcctcgcgttccgtctccgaagccgcaggcagcc

SEQ ID NO: 632 - DNA, 1500 bp, Zea mays
caggcagcttcactttctctccagtgccagacaacgctccggtgcttgcttctggttgtaaaaatagcgaagcccacgtacggaaggagggccaacgggatggcacgcccttcagcgtcggcatgaataatgggacgtactaatgggctgaagcggaagccggcacgagaaaccaaaaccctcgacggccggccggggcaggaagaaatggatgcaacgtctaccaaacctctgatgtcaccggccattgatgatgatgcgtccgtatgagatgatcccagtcgaatgtatgtaatgtatgacaaaattaaactaaaacacgtgctttgctgcgccatgagctgatgagcatatggcagggcagagagtcagaacgagctgttgcccgtcaccagtcaccagtagtcacaatcgaccagaattcaccaatgcaaactaatgcagggtgtgccagcgtcaggcgacttttgctgcgcgcggcagcagaagatagcccagaaggattatgtggctgaaaacagaaaccgtcaagggtcagaggttgaagtgatggagtaaacaaaaacgacaactttttctttcaaaccaaaccaaaaaagaagaagaagaagaagaagaagaagatgcaaacttctttgcgtaccttgtaaccggttgtttcattgagctttgaaaaaggatgcacgatatcaagttcacttccatccaaatgcacgatatcaagttcgttcccaccgtaccagccacactgctgcttctgacacactgatccacgataccaaattctctgttctgctcaagtggcttagcataattctcactagatattggaccttccttacgcccgcgataggtaaatggtttcccagggccacgggcgagcagcactgaagtacttctccacagattgatctgatgaatctcccccctcttgcgcctcaatcccatggttctcggatcaagacggtgtgcgtgcatgaatctactgcggtattcggacgagaatgcagatgcgttgatcctagttgcggctacttacctggactcgcgacgcttcgcctgcgttggattcagatgcgagagcaggattggtcgattgtttcggtgctttcgcttcgattgcagacccgcagttgcttggtctcctcatccaagcgtcgggcaaggcaaccggaaagaagaggggttcgcccctgcacctgggctggatcgtccttcagcttaaagaaaattatggcccaaccgaaccttaatgggccagaggcacggataagcatcggccgcgcttttttttagtaggcccaaacgaacaggacggccccacgggagatctagataactctgctggcatcgtagggattcatcctcactcggtcactccacagtccacaccaccaggcactcggctcaagacagcaccgccagccaccagccaccagccaccgagctgtatcgccggaacagcgccgattatctagcactagcagaggtacgagacca

SEQ ID NO: 633 - DNA, 375 bp, Zea mays
tctctcctcctcctaaatccaaatcaaacaaccgtcccacggtacggctgcctcgcccctcttctatctgcttcgcaatttgcaaatacgagctggaataggaagagccgccggagaaaagaaatagataaaaagagttttatgtggatcctacgtactgtaacttctaaaataggaatgcgaatcagatattcaccggagtcggtctaaggaaacatggcccaccatatatttcgtaaaacactttgatgttccaaaagataagcagcatcgtgagctctgcagtaacactagtcaaattttacgtaacttgcgtggttctcttcctgcgacggaagcaaacactgcccgagacatagacagcgggacgtcgag

SEQ ID NO: 634 - DNA, 1500 bp, Zea mays
tgtagcctaccggaatatttatcgatgtgctcctaggtgatacagattcgttgcagatgaataagaatgccagtgctgattgggcccaactttaattgacaggtcctttttcagatatcgctagggattggtgagttgtacggttcagagcgcttctacctgagttttctggtctttgatcagctgtgtgtaagggactaaaatttggaaagtgtcatccttcgaagttgacaaccaaccaatgtagcatgtttgacaggttgacaaaaaaatatttcacagtttcaatctttgatcaattgttctacagtctcaattgtacctttcttgcacttacgatgttaccataatttgtcatttgggcatttccctctatagaatctgaatacatattaaatactccctatgttcgttttgatttgtcatattttagttaaaaatgaactagtggacgataaatattcgataacagaggtcatacatgtctagcatcattctcgcgcgtgtgtgtgtgaattcctccttatcatgtgaatacgcttaaccatatactctactttatgctcatgcataattgttatcagtttgttcgactaatcacgattagttgggctgattgatggcatggcgatcatcaattagtcatgattaatcacgactaatcttgattagttgggctgatcagtgccatgacaactaggatctatcggacgaattgataacattagtctacttgccatagctcccacaaaatcaaaatacatcaaagtttatgagaacgtaagttgcttccatttttttggggtgaaatggtaagttgtttccagttaaacgtgaggttgtaggctcactatatgaacatttactgtatrttataataatcgtatggtttgtgtgttttgaactgaaaactgagaccaattttatgcctaagcattatccaataatcatcctagcctgaagctattatttactgatgtaccctcttcaatgttcatcaagcaagctgcccattctgtaaaataaaaatattattattctgcctgctgcccatagaaaagttaatctcatgaattcaggaattgttttgtactgaagactgtcaccaattttatgcccaagaattatgcaacaatcatcctagcctgaagttattaactgatgtaccctcctcattgttaatttaagtaagctgcccattttgtaaaataacaatactattattctgcctgcagcccatataaaagttgatctcatgaattcgggaagaacagcggcatccaacgtttcctgttcagcgggaaacagcggcagcttccctccctgcctccttccaggatttcttgggttcccaattgttttcgtcaatttccacttgttcaaggccattgttcgcagccctgcatcttccgttgtcttgggaatgtgtggaaggagccttccttaaattgtggcccaagacttcctagtcatcttgcggaatctcataggttctcgaag

SEQ ID NO: 635 - DNA, 464 bp, Zea mays
agcttcggccagagaggactgtgtaaatgtgcttcaatttctttctccaaaaaatagaagttgattactctgtgcaaactttttttttctctctttgatgcaacttacactatgcaatacctaaataaaaaaaagtgcactcgtgacgtgttgggcctagtcgtggtgggcctgtggattagcccaatctaccacctcgtctttcgtggcgcccaagatgaacccctgaaaagccaaaagccgcacgcctcgcggtcaagggtcaactgatcaagccaaagccgaacaccaccaacaaggcagcagccgaacaccaaacaaggcagcagccgccaccacttcattgcgcgaatcggagcccgtggccgtcgcctccgccttcgcgattcgccgccgttgcccacgagcgaggcttcctcctcttcgtcgccgccgtcgcaggaggggaaagaggataaactgcc

SEQ ID NO: 636 - DNA, 127 bp, Zea mays
ggtgagcacgaactgccgcgatagatcgattattccagggtggttgtcgctcggtgatcctgacgtagatcctgcggtttgccttggtcggatcgtctgatcgttcggtgattgtgtggtttttttt

SEQ ID NO: 637 - DNA, 413 bp, Zea mays
ggtttaaggttaggggcgcgggcgagttgattggattgaggtgttttgtagtacctggcacgacgattaaatgctattgctaccatgggtgatgggtgtatgaatcatacgcccattatcggatgcataagcaattaattcatatggtacagaaccatcgatttggtttagatgatcgtttggatctggatcattgatcagtgcttacactattcttgctcccaaggattgcgtgtgtgaagcatgtgggagctgaaattaaagttttcttaaacgtatagagctcctttccaaacggctctcagtacaactgttttgatatgcagtagattttttgcgtaagttacttattaacaataaaatctgcccatgttaccggattctctaatctagttgctctgtctatgatgcag

SEQ ID NO: 638 - DNA, 378 bp, Zea mays
caggtgaaatcaactatgagtgtgcagcccatccgaggccattttgacgcaggcctagctgggccacaggtggttggaaatcatgtaggctcaaaggtaaaagtagtccagttcatagccgagccgcaggagagaagagaagcaccgcaaccctaggtcgccgcctcttttcctctccactcgtccgcgggacgcgacgcgacgacaccggaggtattcctctctcctgctcctcctatacatgatctcttatttccccatcgtggatcattcgttgctcggcgaaaccccagcccagggaccggtccgctcaccgtttggtttgttcgtagggttttctgcggggatttgtttgtcgccaactcgccggcagccaag

SEQ ID NO: 639 - DNA, 473 bp, Zea mays
tggctggagtagaggaggaagctccagccaggtgcggctatgagcagctcagggcgcgccggcagaagagctcgcgcgcgcaggagaagcagggaggaaacgtcgggaaagagaggaatccagggcgcggcgcgagcagagggatgggttggagggagcgctgccatggaaggtggagctcggcatcagggagatgggagacgagcacgcgagggaggatgaagaatgagcgtgcaggagatcagggagatgggcagattatggcggcccgcgtgctttggcccggcccggcccgataaatgggtcggcccgacgacggcccgcatatttatgtaaatactaaatatgtaaatatatttaattctctcataatatgtaaatactaaatacgcggccaaacatatataaaatgcatacataaatataaaatacatacataaatattttgttgtcttaatatatatataaataat

SEQ ID NO: 640 - DNA, 47 bp, Zea mays
tccccttacaccacaccaccaccgcaagccaagaggcacggccacgc

SEQ ID NO: 641 - DNA, 594 bp, Zea mays
tcatcttttcttatattaaataattacaactatgtcttcggctttttaagaacaagaaccttgaaggtagcttcggaagttagacaaataagagtttgttgccaaaaaaaatattttatacaagatattgttcatctatttatagaggagataaaccgcctttgtacaaaattataaatctctactactattatgtgaatactgtaggcgtccacaatcgcgtggtgcacgttctgccgctctgctcacgcccgcggccgaacctcccccgcatcccgcagccgccgacgctcaccttccatcctccgcgcagccactcatcccgcagccgcgatccccgcggcgctcaccttccatcccgcagcgcgcaccttcatcctccgccttccatcctccgcacagccactcatcccgcagccgcgatccccgcggcgctcaccttccatcccgcggcgcgcaccttcatcctccgcgaccgctcgcggatctctcatcgacgtcgatgctccgcgattaaggggatccgaggccaacaaacagcatggcgctccccgcggcgggcgggcgaggaggcatgcgcggatactcggcagg

SEQ ID NO: 642 - DNA, 1500 bp, Zea mays
tttgaattacaaacagggtaacacgcgccattcatgtagcacataaatatctttctcgtatagacaacaatatagatattttacacataaaaccatattagcttaattgatatgtgtctaaatcatggttattaaaatggaattcgatccaaaggatccaaacaggcctaaactgattctaaacacatatatctagatcataaacaagtatagaacatttttagaaaaaaaaacagtgttagttcatattttcttgatttcaaatagataaatcttaaaattttatacaataattcatatttctattatttataaaaatataaaaaccatctttataaccagcatggtgattaaatttggtctggttttaacaattgaaagatgtttgttacccggtttcatagtttaaggttaaaaatttagactacccacaagccaagtttgatgggggaaactttacttcccataatactatatgtatgtgttgcataccttaggtcgttatagttttgttctggattagacttctctgactccaacttatattatatatatgcgccaacatatagaacaccaaattagggcttgttcggttattcccaatatatatggattggatgagattggaaaaagttgagaagaagtttgacttatttgggattcaaacccatccaatctcactcaatccacatggattgagagctaacctagcttctttagaaatatcatactccctctatcttaatttagtattcgttgtagcacttattttgtttatatctatattcaaattgatgatgagaaatctagatacatatacgaaacacatacattaattatcgtatgaatcattaaaaggcaaaaacaaattttaatttgggactgagggagtaacatatatcttggcagtgtatttattaggtattatatggacgttagtgtaaatatctatgagcttagtaaactgtagagaagcttgcctcggaacattttggaacgaatgagtatcccagaattccatgctcgtctattaacgaacaacagaatgcaaatatatcttaacattagcagctgtgtggaaatgaacgttgcattacggagcgagcaacatttagtatttagtcgcaatatacattctcgacacacattttggtcgaaaggtcaagcagtaatggacgctttatcgatcaacaaaatccacatcaagtttggcagcgtaaatcggatccagtgcattatttgcgtatagcactcctatttaggatttagcagacgagcgtatatatgccatgccatgccagcaagacaaagctacgactcgctatccgtttttccttgccaaactcgtggaagcttagaaactcggcgagaaaactgtagcacgcaaatgttgaattcttcacactaccacagctatatatagacatcatcactactcagcagcaagacagttggagggggtaattcggagcagctagcagacagtcacagacagacgaa

SEQ ID NO: 643 - DNA, 739 bp, Zea mays
ttctccttgccacttaagcaccaactcaatggtttggtccaggtcactctgctttctgttgggcggtagtacgtagcactcacacatgcgttcagacttgcccaacgaatgcaagttcttggctgaggattcttgctgtctaaattcacagtaaagtcgatactggcccgagtgagtaacaatctcgcaaacgagtaaacctcggttctaatggcacgtataaccttgagacggtaattcggtttttgaaatataaaagaccgttaaaagaccacataatagtacaaatctaagactttatatcataaatgcagctaagagacaatatttatgaagagtcgtatagagacatgcatgctctttaagaagtgtccatcttttatatatatataattagcctcatagaaactctatattaaatgagggttatacaattcctaatgctctctctcttccaatgttcaccgacataaagtacagatcatgccacgtgaacatgaacacagtgcccgctccgctcccttgatttgctgcctcggcaatgtcaacgctatcgcgtgcgggcgagcgtgtatccagtattctaattggctgatcctaacgagaaagcaggcatcgagatttgcccaaccagtacacttgtatagggatttgcacgcaggagaaagtaaacgctgtttcattcatggcttcgtctgcaccagcaggagggaagtcaccggccgtcggcggggaggag

SEQ ID NO: 644 - DNA, 1188 bp, Zea mays
cttttgagcttcaccataaaacaactccagcaaattgttaaggtgggtttcagaagcgtttgacttccacatgaactccagcttctatagtacaattgatttgtgtgagtttccttgattaccctttatgattagtgggttgtcgcgagagaaaacgtaagttatatattgcgtaaccagtggcatggtgggtaatttttgtacaacttcatgaggagatataaaaacggtgtttttgtagcaccctctaagagtttcatgaatttcatgaaattgacctctagtttcgatttttttaaagctagagctcgtggagctggaccagtttaggtggaagaagttggaatgaagttgaaatttttgaagtgaagctctctcaaatagagcgttaatctacattattaatatttgacttctagataagcgagaatggcactctttagaatggagcaactgggcttagctacatttatgatatggaggttcttagttgtattatgtagtttcttagctaccttttatatttggaaaaccgaaccagactctggattgtacatagcctttgaagaattattcaagagttaattaagctgtaatgccactaatattaaggtttaatttacccttgtattcaatacttaacgttatatattctctataattaaacatagtccaacttaaaaaatgatttttgcaaagatagaattatatgttttttgtgagggctaatagtttaatgaagttatcgatgtttgtatatttcacgactataaccttcacctctgaccgctaatgcttgtttagaccatatttggatgttgttgtattaaaatattatgttattaaggaaccattgttttagcattgtattcaaaattatgaagtttttatatgcaaatgattcactcgaaaaaacaaaagtatcaaaatcatagtattttctctctctaaaattccaaaaatattttacatctaaagttgatgtcttggcctcccgcgctgttttaccttcctcctctggacaccaaccacaggccgacaaccgagtaagccggtcaattttggtatcctgctcatgactcatatcaggcggtagccgagcagccgcccagctttctcatgccagagcaaacccataggtccagtccaaatccaatccctgttgccatcagaatttcaggggcagcc

SEQ ID NO: 645 - DNA, 404 bp, Zea mays
tgaaaagaggtgtttggcacaacttttgcatgagccagagccgaagctgataaataagccctaccaaaggggccctaaatatcttcggtaagggtaactgaatgcccaggaaaaaccggtagaacaataagcgaagcgccagtcatccacggccgaaatggatccagtccagtaaaacacggaaacggttagggcataaaatcaaaaccacccacgcacccgatcaaaaactacagggtactatatatataaaacgaaacgagcagatgaaaaatatcccccacccaaacagaccacgcgagagagggggaagagagagccgcgccgcgtagctgcgtagagttgcctgcctccgctgccggccgcactacctaatcgctgcgcctgttttttcccaccgccag

SEQ ID NO: 646 - DNA, 1500 bp, Zea mays
gggaatcgtgcgacgccatgtggccggccctccggcgcgagaataacgggcgtcgccgaagcatgcaaggtgttcgacgaggcctcttcgtctctgcaattacacggcgctccgccggcccatggccggtcccgtccgcgattgatgctcgcacgtgcagcaatcagattgttttattaatttgggcatcttgcgccgactcagattgttcggacttatcatcaccatctggccgaggcaatagaatagaagcagccatcagtactaattttaatcgtagtactgcagtttccttgcctgccggccatgctgtttgttgggaaaaaaaattctttgcatctagaatataaataatctcttttagagtccctcacattcactaattgatggtccatataaatagaaaaaatattaaagagttaagttgcaaattttaatatgtttttgtgggtctataagtggtggacgggaggagctgtttggatacggttcgtatagattttttttccctgtttcttgaacagtgaacacgcatgcaggatgaattaccatcccacagcccacaggggattgtcagtagcttatagcttttggagcgggcggtgcaaattaattaattaacgcatactactatacgaatatgcaaagcgagctaggaaggaccaagttggaaatgaaatgagtgagcacagaggcccccacccatgcccaccttaaccaccctcggacggagccaccagaatttgatccaaacgaaacgcacacttaacttcggccctactcaaaacacgcacgcactgtgcaacgtacaccactcctccctccccgtcgtcgtcgtcgtcgtcttctttccttgcgttcaaaacaacggccataaccaatcgcgcgcggggccggagaggggccctaagctacaactaaaacaagaaaactagcggtggccggcgcggccaggccaggcccaggccatcatggcaaggcaaaccgtcaaccgaccacgccccgatcaatcatcctccgcctgctcttggcctatggcctccaactccaactcctcctaccacccgccatcgtccgaggaggctctctcctcgtctcgtcatcttcggcgacaaggaacactccccatgtgcatgcaatgcgaagcagtagtactgtaatggcaacatgcttgtcctcgtccgtgttttcttattaatgaattctgagggccctacactctgttgcgttgcattgcatgcctgcctgccagccctgccttgacgatggactcggccggtcctggactttaaacacacgcacgcttctagttctagagccagcctgccaggaccagccttgtgcagttgtgccgcaactccctccagtcccctcgtcgccctcctcgtcctatatatattaacaccccagccttggcaccacacgtccacaccacagagcctgaaatcggctacacacacgcgaattgaaccagccgctagccccgcgccttttgcggcc

SEQ ID NO: 647 - DNA, 290 bp, Zea mays
ggccgactgttggctcaccggacagtctggtgcacaccggacagtctggtgaattttagccgtacgtcgccagtcaactcccgagagcggccagttcgctcgaggcaacctggcgcaccggacactgtccggtgccccagaccgaaacagccccttggctgtacacagccaactcttctctttttctcttcttcctgtttctgatacttagacaagtatattagtacacaaaaccaatgtactaagacttagaaacatacctttgctctagatttgcactttgttcatcc

SEQ ID NO: 648 - DNA, 230 bp, Zea mays
ggtagagtagcaaacatggttcatataagagtactttttagattcattctgtctgctaataaccaaatgtgtacttgttttttgagataactgaatactatgtttttcgaaggaacatagtagactatgtgcccaacctgaacaaattttattactgtctttgaaatcattcatttgcatgattcaagaaaaaaggaaaatggagattataaagtatctattgtaatcgt

SEQ ID NO: 649 - DNA, 809 bp, Zea mays
ggtagtaagtcggtcgcctcttgtccgtttcgtcatttccttgcagcttcacaacgtacgtagtacggttcttccaggaaggacgtttcaacaggaagccgtaaagtcaagtagtccactcaactcaagtgggaccggatccgcgtcctgcgcttgcgccatctcaatattttcgatgggaccaacgaatttcacccattgggaaatatatatttcattcaggttcgcaactcgcctggtttcttagctagctacaggttgcacgtcttttcgtgtatattctactaggagattgttccaaatggacgagccatatgtggactcttcatatttggggacatccgacgtttgtttagcatgcctgagaaatttggcaggtgttcattggaccacgttagcattgatttcttccacttctactatctatatgacgagagaaaaagagagccatgcatatgcccggggccctgtcgacgagaaaaaaaaatgataaagcttagccaaccgaacaaggttgagccgtcccacatagtacggtgcaccgtgtgtcacaccgtccaactcaagcgagcctgattgcccggccatgttccacccaaaaccgcgctggaatctcggccaaaacgatcgaaatccaccccctcgatcccacacgcacagcagccacagctcctataagacaacccgcgctgtcgcgctcccttgccaccagccactagctaggacgtcgctgcttgcttccacgcctccttacggtttatccaagcacagcgagagacctttgcgcgtgtgcgctctcgttcggcggc

SEQ ID NO: 650 - DNA, 805 bp, Zea mays
cctccgccccaccaacccttgcctccccacacctcagcatcaaccactcgtctctttttctccgccccgcccgaagccgaggaggagaggggagcagcgagatcgtgcgcgcctccgagatctccacgaaggttggtgccagacctgctgcttgtgtcttcccttcctgatcacgttttcaattctgcttgctaggaggtaatgccgaagatctcgatcccgctgtctcgctggttccagatctgtcgtagaatgagggtgcgcttgagccttgtgcgagcgcgtagaatgctgctcttggtcgtgacagtgacatgttggctgttcggattattgtcgccgttcaggctattgaccgtcggatctcgcctcccgctgtttcgcgtgctaatgttgtttttgtatcgttaggaatgattttttgtgtaaccagaaatggaggggagtgttatggtctgcgtcgtagatctgtcggcatggtataggtctgtgatgttgttggcttggcacggtgtggagttgtagataatcttttgggcggtggtttggctgaagcgatcgcatctttctctatcagtagtagaccctttttcataagatctaagtatttccgttgaatgaaataccagcgagacaaaatgacactgtacatgtagtcgagagctcattctctgtcaatatatcatctggcgtttctttgtactcagagtctcctttgttggttttggttgccgtgccgtctatgtaatgttgttcacgaaatgctgacaaccgttgctcaacgatattcctcagttgtggtaac

SEQ ID NO: 651 - DNA, 1130 bp, Zea mays
aatggacaattctgctgtttcacggagcacatctgcacatggcgaggcatggtcattttgaccctcagacgatcattgtttcattggaaagtatcgtatttctatgctaggcttttcagagagattactctctaagaaactgatccgatattaagacactataattggcattggcactagtagatcgtttactgagtaatgcagtttattttaatgtatcccaattgtgttgtaagatacaactatgcgtcggaattacccattcaatttgaatctagatacgtagtttttgttatatacttatacttggatatatattgtttaatacatggtaaaagtaacatatcaagaaaaatattttataatttgaagatatgtgtttttgctatgtacattgtctaattctttcttattaaaacccgctggagtttccagcctcctccgcgtttccggtcatccggtgtactgagacgctcgcgggtgcgaacacgtggccaatctctatggccactccggacctcaaaccttcatctaaattccctatgagctgagcgttcgattccgctttgtctcggcctctctctcccgtagtgcttctcctctacctccgccgccagcccgccactgcctcgattcgctcccctccggccctcccgttgcgcgcgctctgcctcgctggccccacggtcgcccgcgccggcaggctcgctgataggctcgagtccctcgacgccatcgcctagattgtttactagctacccccccccccccccccccccgctcgccgcgaggtggtgcctgcggaggtggcggcgatcgtgcctgcatggtgctcgacaacaaggtgctctacgagacgacatctgcttccgtgcgcacaagctcaccatgcgcagcttcggtgacgtttagccacctcatctccgccaccatgagcggcgtcacctgctgcctttgcttctccggtcagctcaactccgatctccgtaggctagccgtcaacctgaccccattcccgcgcctgcacttcttcatggtcggcttcgcgccgctcaccttccgggggctcctagcaataccacgtcctgactgtgccagaactcccaaaatagatatgggacgccaagaac

SEQ ID NO: 652 - DNA, 826 bp, Zea mays
aatggacaattctgctgtttcacggagcacatctgcacatggcgaggcatggtcattttgaccctcagacgatcattgtttcattggaaagtatcgtatttctatgctaggcttttcagagagattactctctaagaaactgatccgatattaagacactataattggcattggcactagtagatcgtttactgagtaatgcagtttattttaatgtatcccaattgtgttgtaagatacaactatgcgtcggaattacccattcaatttgaatctagatacgtagtttttgttatatacttatacttggatatatattgtttaatacatggtaaaagtaacatatcaagaaaaatattttataatttgaagatatgtgtttttgctatgtacattgtctaattctttcttattaaaacccgctggagtttccagcctcctccgcgtttccggtcatccggtgtactgagacgctcgcgggtgcgaacacgtggccaatctctatggccactccggacctcaaaccttcatctaaattccctatgagctgagcgttcgattccgctttgtctcggcctctctctcccgtagtgcttctcctctacctccgccgccagcccgccactgcctcgattcgctcccctccggccctcccgttgcgcgcgctctgcctcgctggccccacggtcgcccgcgccggcaggctcgctgataggctcgagtccctcgacgccatcgcctagattgtttactagctacccccccccccccccccccccgctcgccgcgaggtggtgcctgcggaggtggcggcgatcgtgcctgc

SEQ ID NO: 653 - DNA, 626 bp, Zea mays
gccttcgtgcttttttttctttcccgtgcagcgagtcgaccaggggccgacacacgtgacacaaacttctcatttacaataggatcaccactcaccataggtcacgcccccaaactgtcgctttacaataggtcgcgtcgactgatcttctcttctgcccctcgatgtccaccaccctcaaccctaccgtcacaatatctgatgggagcatgccaacaaaattagattcaaaattaaactattgtctaaatataagaaactattagagacccgattattttttacttccaataattatttagcaacttgctaagcataaatttaaagagttttttcgaagtgaaatttaaatctgtaacattaaaagattaccactttagatatatataccagatatatataccattgttatcttatttatatatgaattcacatgagtaaataatatatatctaaagttataatcttttaaaggtataacaattattcctttttcgaaccattggagtcactcttagtcaacggcttcctttcgttctcagttccctatcggcactctttggtgcgcccggcgcttctccgtccgttcgccggcgttcgtggcttcgcgacctccgtctgcaccc

SEQ ID NO: 654 - DNA, 503 bp, Zea mays
ctctgctctgcgcctgaccgaagtgacccatcctctgcgacgactgcagcaccacaccacctcagcccagggacagggctcaggtttttcccagtcccagccaaatcgcgcgtcgccatacgcgcatggtggctgatgaggaggagaggcaagtataacagacgactgcaagtaaaatgtacgctgagtgaactgtaagtataaaagaagatggctctaagcttacattcagtttataaacaaatactgtatgagtgaactgaaactttcgtacatgccgtatcgagctgatgctccacgtcttcccgttcccgagtcctgacaccggcacaaacctgtagaactactagtatcggagacccctccatttcagtcccatctctcatttcccttgtaactggaagcgaggtctcggcgccgccgccctctgcctcgtacgtcctcggcgctgcgggagcgtgcattgttgagcgagtgcggccaagcaacgcgggctcgaggag

SEQ ID NO: 655 - DNA, 962 bp, Zea mays
ggtcaagcccagctggtagggcaaggataacctctcccttaaaataattagtaccactataatgttcgtatcactcaaagaattttaaatttaactaaatctatataaattattagtattacttgtttttaaataaatttgttgtaaaaataaattcagcgagcaatttaaacaatacgagtcatatacaataaataataaactttttatttatttgatcaaaaagaatgtcgactattttataacaaaagaaataccagtcctgcctcttttctttattattattattactactattattattactattattattattattattattattattattattatcattatcattgctatcaccacttctaagctctaacttgttccgttctggtctggaaacaagattttgaaccggtccggccgaagagagrgatatttaggtaaacaaatactatataatacaagtagcccaagctgtgagattaatgacggtgcttatgcaataaacaaatacgcgccacacaacctccgaggccacttgtacgcagctcaggctccggcagtgttgagttgggggcctcagaagaaggcgcgcagaaatttctcatcaggtcgcccgtcggtgggcgcgggcacgtgacagcgatacgcccggaggccaagataatctttgcatcgttctcggtctcggttctggagagttttatatggccgcgaggtgtcaattattaatggacttctctctcccgccccttctctcttcgtgatgctcctctgcttgccttgccctggtgtggtggtgtctagtcaagtacgcttccgaattaaaagcgctctggcctgcaacctgctgtctgctccgtcctcccacggccggccgcctgcccgcgtcttcttcgccacccctcttctccggtcccgcacctgcatttcttgaccccttcctccaccgcagccaaaca

SEQ ID NO: 656 - DNA, 629 bp, Zea mays
ataaagatatgtgcctcttttttctgtacatcctagccttgcctctagtctacattgtttatatagcagagtttgaaaccagagataagaatgagtaggctagtgtgtctgtgcataattcatccgcaccttagaacacaggctatatagattttacagatggaactgagacgcagtgattatatccatattgctgttggagccttagtccaacatcaggatcagctaaggccctgtttggttcctttagttagtaggtaactatgtgcaaggagattgtttatgtatgtgagacagtaattattaattcaatgaatgaaatttatggtggtggtctgtctctctcctctattttgtgtggaggatcgactattttgtgtgcgcctggctgcctgccaagatcctgatgctgtccagttcagtgatcagtgggctaacttttatgtggctgtgacggccgaaacaggatagtgaggataaggggagggactctttcgttgggccagcgctgcatgcttccttgcttgcttttttgtcgcgcctgcttctcccccctcctgcctcttcgtgctgcttcctggtaggggaagggaaggagaaggctgtgtgcgtcctgcgccgataacgcg

SEQ ID NO: 657 - DNA, 1199 bp, Zea mays
catagtcacccagttagatgaggagttcaacatcacggactagtgtcataaacacaaagtaacttacccgtcctttcaatacttgataaatacattttaatcatacctgtttcaaccatttcttcatagtttaccttcggcacaattggtaggatcgtcgaggaacggcagcagagactgaggtcccctttagaatgcaggattggtaaaatacgggaataggaaaaacggaggaatggagttgcacgacaattacaatcctacatgaattaaaaatacagaaaaacttcttaatagagtgtttggatgcaatacaggaagaacataagaattagaggagagagatagacaaaaaggaaagtttccaagaggttggacgtcttgttagaaatcttctaaaatctcactacaatgagcaatccaataggaattttataggatttgtgggaactcaattctttgttccaaaggactacaaataaaattttcctatatgatttcaattctccaaaattcatttacttttcctttgttccaaaggggctgaactctaaaactgtgaaacactcacctgtgtcagggactgggaagctgcagaatcaaggcttcaacatatggtggaggataaggagttggaggaggccaatttgcaagccggaggccccgggccaaccacgccacttgcccggtgaaacgagaggataagaaacgctgccgcgaagtagcaaagaagctgcgggaagatggaagtaatacgtgcttgtgcagttgtgttctggagtaccatcttgtcctatctgtcttggcccggcacgcgccccggtcgcgtggaccgtgagagaagccagaagaaccaaagcaaatcaccgtgagagaagccagaagaaccaaagcaaatcagcatgacgcgatcccagccgacgccgcgcgcgcaacgctctcgtctccactctccagtcctctcccaggcggccacgccccaacctttccctccacgtcaccagctcgcaaaaaccatcgcctgcgggctaccataccatacattaccaccctagcccacacatattccccgcccttttccccacgtctagtcatctcccaccatccgaaaacgccagaacccgattccattcttcggcgccatctgttttatagctggtggagctgccgatcgcatcacccttttgtagcctagaagc

SEQ ID NO: 658 - DNA, 1326 bp, Zea mays
ttcatgcatggtaaagaagttgttaccatatatttagcgtttttttcgaccgtaagacttccaataaggtccgctatcgagttcgctaaaatagcgatcgtccttggcagcggctatatttggaagtgtgtcgtgtgttgtgtacccaagcatgctgcacctttcagttgccactcgctggcatgcggtcctttttttattacgttttggttgttgtctaaatgtgaccaatataatgatgtagagagagaagagataaaaagatgagatatagacgatggattttggaggattttgctagagatattcaagatatatagaaggcgaaatttcttagctgcaaaagataaagacttcgaacggacctttaatttagccccgaccccgaacagtccatgatgggctataaaggatctcgaatgtcaactcttgaaggcgccttggcccttggatatatttaatgtatatatagaattttatttatttatttaaaaaataagtaattaaatctaacagaaggtaatagattttctatcaaaaggttttgaaatgtaccatcagtgctgccaaacccggtgaccactaccgcgcgaatctggaaggggcgctgtggtacggaggcgttgcactactggccgcttcgatgtcatgcctgctcggcgctgtcaggtgatcgccggccgtggtcatgccccaccgctgtcgcgccagtatcgtttaaccaaccggctccaggcttcagccaggtacggctgcctatccaatcaggggaagagaagaggagggccgaatggagggcgcgggatcgccggatcggagcagaggcggaaaaaaaaaaccagcatgcatgcatgtattaggccctacgtgctgctgttcccttgtcgggtccctgtactagttgtactgcacccctttgacggcgcatgcgtgggagcggacgaaaacatgcaggatgcattcccattcccgtccagcggatctcgatgacaacaaaagctagctaggtggcctacatatactctaaacccttcgctcggtcgccggaaccacgccccacagagagagagagagaaaaaaaaaccctcgtttggtcgccggcacacaagacggtagtaggcggcgatcgatcggtggacgacggacggaactcagctaagcaatctcgcctcgtcttctccggcggcgacacacacgcgccccttctacgtcgagaaatcagttccccatcctccatcatccattccgattctccatctatcgctggtgcggcaggatcgcagtagctagcacgcgtccgtcgtctcgggtccgtccggcggcgca

SEQ ID NO: 659 - DNA, 214 bp, Zea mays
atcccttgcattttagttagctagaagaaaaattattacaggaaggatgtctgaagtggtctctggttgtagccaactcggtgactgaagtgccagagcgcaactgaagtgccagagcgttttggaagtagaaaatgcgcaaagttttggaagtgaagctagcagtgaaagttttggaagtacaaaacgtacaactgctagagttcttccttct

SEQ ID NO: 660 - DNA, 473 bp, Zea mays
ggtgcgtactacactcccatcttatcagcactactccctgcatgagttctgctcttttcgtcgttgatcgttcgcatggatatgattcggtcgccatgccaatcagtcgcaaacgctgacagtaggctatcggatagatgaggtgaaattttctctgtataaaattaaaaagaggaacgggtgcgctccatctccatcctcaattcctcatgagccacgcatgatcactaaacgaaaatgtgctgttcttcgattcctccctccagctgctggtattagtagtacctgtactgtacaccaccatatgcatgacatgagagacgacgcatatgctgtgttgcttgctctttgtttattccttcacatcgtttgcctcgtacgtacgttcctggttcagtattagtagcagcagcagcagcattattgttgcatgctgttgagctaggaagcggaccgatcgaggaattaatctg

SEQ ID NO: 661 - DNA, 1500 bp, Zea mays
ttgaatctttgatcaatttctcttggaatacctttctctatgcctcaacaagtgaatttgacttagagataggaaattgagtttgatttgcaaaaacaaaccaagtggtggcaaagaatgatccaaatatgccaaatttgaatcaaaacaaattcttgttctcatttgcattgatgttgcacttctatatgttgctttttgttgtgttggcataaatcaccaaaaagggggagattgaaagggaaatgtgcccttgggccatttctaagtattttggtgattaagtgtccaacacaaatggttatgtgttaaactatgccaaatggtggacaaagtgcaaatcaatacaaaggtatgattctagacttagtacattggtttttgtgtactaacatatttgtctaagtgctagaatcagagaaaagacaaatggaaaagacttggctcgagcagccaagactctgctcagtctgggtgcaccggactgtccggtggtgcaccggacagtgtctggtgcgcgaggctggcgctggtgaagaggccgctctcaggaattgaacgacggcgtacgactataaatcaccggactgtccggtgagccaacagtcggccgagccaacggtcggctgcgcaattcgcgcgtgacgcgtggcccgaccaacggtctgatgggggcaccggatagtgtccggtgcgccaacggctccaaatcgtcaacggtcggctacaccagaataggaaagagatctgcaccggacagtgtccggtggtgcaccggactgtccggtgcaccagtcgacagaaggcaagatttgccttcctagattgctctcaacggctcctagctgccttgaggctataaaaaggacccctaggcgcatgaaggagcacaccaagcatactttgagcattcttgatcattcacacttcgtctttgcgcactcgtttgacattcttagtgatttgagctctgttctagtgaaaactttgtgatattcatttgagctcaagtcttggccgtgtgtgtgcgtattgctatgaacttgtgtgtgttgctcatcccatccttacttctgtgttcatttgtgatcatcttttgtaagggagagagacttcaagttgtggagattcctcgcaaatgggatatagtgaaaggaagagaaacactgtggtattcaagtgggcatttgtaccacttgaaagaggttgagtgcaacccacgtccgttgggacgccacaacgtgggagtaggcaagtgttggacttggccgaaccacgggataaaccactgtgccatttctgtgttgatctctttgtggttatcgtgttgtgcaagttctcctctctagtcatttggcttattcgtgctaactcctaatcaagttttgtggattaagtttcaagtttttacaggatcacctattcacccgcccccctctaggtgctctcaattggtatcgaagccgttctcttcaagaaagggactaatcgcccgaagag

SEQ ID NO: 662 - DNA, 825 bp, Zea mays
atacttcagaacaagttggcttggtagtttatgccaccaatcggaatggtgcatattggattgtgcatattttatgccgtcagcacataccatacccattcaaaatggttattgcgtgaaagctctgaaagaaacctgcatatcatatgcccggtgtttttgcatacgttttgattagatactatgtccatatggctgttagtatcgtgggcaattttttggtcaacatcgtgataaattttcctggtactttacccttttgcatgtaagcagttctcatgaaaaacgatgttacaagattgaagaaaagctatttttcggatcttttcttttgatttctatatgatcccagcaaaccgttgaaatgatgcctattatagtttgagtaaattgtttccatttgtgtgtttttagagcacactactcgaaatggttactcgatttattgaaaatctgaaactgaacattcgcttgcagtcagcttaagaaattgtcataatattttgttttagtgctccattattgttattgatagcacctgatgtttggatatggtttcaggctttgaggtggagatgacactaagttgaaatttttatcacacgaggaagcaagaacaggaaaaaaaatcacatttcagtgttgcactctgtggagggttcattgttggtccaccaaactactgcagtgctggagggtttttgttgaagtyctcttcatgttcaccatttctaaattgtcataggctcatagcattgtagctgatcagtcttcaagatcttcctatgagtacatagataaatcatcatcgtatctgtgttaagt

SEQ ID NO: 663 - DNA, 640 bp, Zea mays
tgaaaaaaaaagatgtatccgatacatatcggttcggatcctgaatgcgtataaagacaacgtagggtaggacgccggaatggaagtcaaaccggagtccaccgtgcgcagcaaacaaacacccaaaaccgggacgtgccgtgcgccccaaaccaaaaccaccgccaacccacacgcgcsgaatccactgaaacccacgaggcggctacctcgcgcgcccttcgttacaccgacgcgtggggcaaccacgcacggcaaccctgtcctgtcccgtcccacgtctcgcgagtgcaccccggccgggcacgggctctccgggctccggccttccccccmccgtccactgcggttgcgcagcccctggttttcgccgaaagacgacggtttctacgcgaaacgcccccgtgattacacgaaaatcccgtgcacacccctctgcgccacctcggtataaaatgacaagtgttgtcccctccgccaactcaccgaaccaaacaacacacgtcaaagcggaaaacctcagaaaaccacaataaatcatcctcgtccaccactgcccccgctctgctgcaactccactcggcccggccgccctttccacccaccttgatcctctgatccgttggtgcttgaccgatcc

SEQ ID NO: 664 - DNA, 1500 bp, Zea mays
agtttgatttgcaaaaacaaaccaagtggtggcaaaggatgatccatatatgccaaaattgaatcaaaaccaatttgagtttttatttgaagtgattttgcacttgttccacttgctttatgttgtgttggcataaatcaccaaaaagggggagattgaaagggaagtgtgcccttgggccatttctatgaattttggtgattgagtaccaacacatgtgcttaaatgtgaaaatatgcccaaggatgaacaaagtgcaaatcacaagttaaggtatgtttctaagacttagtacattggttttgtgtactaatatatttgtctaagtgttagaaacagatagaagaagagaagagaagacttggctgtgtacagccaaggggctgcttcrgtctggggcaccggactgtccggtggtgcaccggacagtgtccggtggtgcaccggacagtgtccggtgcgccaggctgcctcggccgaagaggccgctctcgggtttttctccggcgacttcggctaaaattcaccggactgtccggtgtgcaccggactgtccggtgagccaacggtcggccagggccaacggtcggccgcgcaatccgcgcgggacacgtggccgagccaacggtcggaagacggcaccggactgtccggtgtgcaccggacatgtccggtgcgccaacagcgccagatctgccaacggtctgcaacggtcgtcttcgccgtttaaggaaacaaatcgggcaccggacagtgtccggtgtgcaccggactgtccggtgcccccgacgacagaaggcaaggatggccttccggatttgctctcaacggctcctagctgccttggggctataaaaggagcccctaggcgcatggaggagatacacaagcaacctttgagcattcttgatcatccacactaagtctctgcgcattcgtttgtgtttctaagtgattcgagctctgttctaagtgagaactctgagatagtcttgtgagctcgattcttggccgtgtgtgtgcgcttttgctgtggatttgtgtgtgttgcttccctcccttactctgtgtttcatttgtgatcatatacttgtaagggcaagagactccaatttgtggagattccttgcaaacgggatagtgaaaggaaaacaaaacaccgtggtattcaagtgggtctttggaccgcttgagaggggttgattgcaaccctcgtccgttgggacgccacaacgtggagtaggcaagcgttggtcttggccgaaccacgggataaaaccactgtgtcactctgtgcttgattctcttgtggtactgtgttttgttgagattgttgagacttcaccttagccacttggcaataatcgtgctaacacttaacaagtttttgtggcttaagtttgaagtttttacaggatcacctattcacccccccctctaggtgctctcaattggtatcagagccgttctcttcaagaaagggactaaccgcccgaagag

SEQ ID NO: 665 - DNA, 1500 bp, Zea mays
gctccttttggccgttcgcccctttactccttctttgtttctttgtttctttttttttcctttcttgcatctgrccgctagttactctttctctctttctgttttttttatttcttgttcttgaatctggcgctatttccctcgccttgcgcgggcaggtcttttccttcaccagagttggtcggccgattatggggcgccgtctttaacctttcgaaactcggatctagtccccgtttactcgaatcccttattgtgtgtgaatgaatgtatgagatggatctaatgtaatattcgggatcgagttatgagctgataaaacgtagatccgagaccttgcgttatttctgttattttctgtgatgattttctgtaccatttctaatttattctgtcatctaggccacagatttaaaatacctcgagccactgtgatctctgttgacccagatttaacacagattagggttaggttattaaaccctaactctaatacatcgatctgtttttactatctcagatttcatgggttttgccgagatagtctctgtcagtggccaaaaccctagatttagggttaggtaaaccttaactcgagagataaaaaatattctttctattctaatctatctgttcaatcatgttgatccgagacttttctgtgatctcataaaactaatacggattaggagatctagggttcttaggatgttctgataccattgttagaatctatactgtctaggatcgattcctaagtccttagaaaaccaatccgtaactgaaagtaaaatcttgatgacgagtagatctgatctactaagaggaataggaaaacatacctttgttgttgttggagagttgcagttgccgtcttcataatgttgccctgcagagaaacagcacgcatcgaatccgagctgctacaggttgtagcgtttccagacactccgacacttaggcgatggggcctctggggactagggttttggggcaaggtactagcgttagtctttcctgcgacctcttagtccaatatatagcgtcgtgtgtctgggggctccaaccgaggttagcgtgggccctcccgatcaagggcccgattaaaggaacgatagttgggttaagcccaatccagactctattgaccggctgtagaggacacacccaacagatacaataaaaatggagaacgtgcattccaaggactatcaattctaacactatcatcacccatatatgttcgggaaacatggtctctgattggatctagatggctagaggacgtgaatagcccattaaattaatctaatatcatggactaataacttaacggataatagatcacacacatcaagggatgtacgtcagtggtgacgtgcccaccgttgtagcctgtctcgtcgtctgacgcgttcgcggaggatcaccggcggctccggccggccgccgcgtatcagtctacaaaaggcctactcatacacacccgacctgagctgt

SEQ ID NO: 666 - DNA, 396 bp, Zea mays
cactcttatacgtagccttctatttttaacttatataaacttctatctttagtagaaaagggtttgagatgaatttgtcttacagtacaatcaaagtgtaaaataatattttagtaactttaagttagcacgtcctatgaagctatgataaataaagaaaggggtgggggatttgatggaaaaaaactgtcagtttccagagctaagaccccgcaacagccgcaagaatcgcgagcgccatctgactcttcatcgtcgcctttgcccacctcccaagcttccgcctcctcccctcccgcgctttctccgattcttccacgagcttccagatcgcgaaaccaccatagccgcagtcaggcgagacgagtgcccacccgcgccgcgggattcatcgga

SEQ ID NO: 667 - DNA, 999 bp, Zea mays
gcgtgatgattgatgatctctgaagcagctagcggtgaagcgatagtgtgaaggtgcacggtaacctgtacaaagatatcgtcctgtttcatagcctctatgaagtgaagtgcggcagagcggtggacagagttgcgtgatgcggcagagcgatcgtgtgaagtgttgtaatttcggtggctaatatgtgtgtaaggcccagttcgttcgttagctccctaaccatggctgagtgaattcccaggcagcggtccctcccgtcgtaatgctaataaaatctctttagggaaagatggtttgctcagtttggttgtgaccgtttgcgattcttccgaaattgttgtcagcgcgaaagctatccccatagatagcatctatagcactgtgctgagctgcagtttgatactggtaaatcgtgcagcttcgtgcactccatattttgcagaataacagatctagtttaaacatttctcagtggatcggactttatgatctactgggccgggccgaccgacaagaggcatatacattcttcccgagttgagagtgctagtgatttcatggagtccgttttttagtttagacattgctcagtggatcggcattaacaaatagacgagcatagccgttgaacaggacccacatcgcttgagccgtcttcagcggaccgtatatatagtcatacaaaatttatttttataatatagagtgcactatttaccgtatttacagagtagagtttgaaataaaatatagaacacgaggtgtggttgaaaaactgacggagacaaccttaggcagttagggcaatatccaaactatagggcaaacacaacaagcaaaaagaatcaagcctcaacctatttcttctgcgccatgcaaatatgatgaggaattccaacaccaaagcttccgatctgctgcatccttctcttcatttatcaccagtaggttggctccatctaacatcagcagagtgatctgttctacgacaacctg

SEQ ID NO: 668 - DNA, 291 bp, Zea mays
ctcggaagctgaaggccccaacaataagctaagccaaagatcttaaagacaaacaacctccattacacaactggaagtggaaggagcctgtaaagctctcgtcgaaaatccatcgcctctgccctgcctcctgaaaagcagctccactatatagcgcgaaggagcctgtaaagctctcgtcgaggatccatcggcccccaagggccagaacgcatctcaaaaatcaragctcagccccccaatccgactcgtagaagcatcaccaccggggcgagtggtgaacgaacggag

SEQ ID NO: 669 - DNA, 535 bp, Zea mays
cctatttgtatacaatcctgattatcgacttactctgccgctctggttttgctggagatacgtatcatctgatcaagtgaatatatttgagcaaactgcgtgaagtttgtatcgttgtggtggtagtggcctctttttcggcactctgaaatggtaccttcctacttttggacgcaataaattgttttctgaaatttcctttccttggttcttttttcctttcaatccattttatttaggaaaaaaactgtttatgctgggtgtaaaagtaaaacccaattgaccgcaaattgtgtttgaaaaaaaaaaactgttggcagaagatgagagcttaggttcagtggggtttttcgcaaattcggcccagtatactgcaaatagccgagccgggcctggggaaaacgcgcggcaggcagagcggccacgacgccgcccgtcgccgccgatccctttcgaccgctcgggtctccctgctccttcgcctttcctcctgaaatccagcgaccgaatccgatcgccttggcgcaggcgttcg

SEQ ID NO: 670 - DNA, 687 bp, Zea mays
tctccggccggaacgcgccgatccttcctctccctcggttcgcttttttcgtgggggtgatggtgggctggtggcctcgtggttggttgggtggtgtctggctgcttgagcgcgcggtggtggcgcttgtcggcctggcggttaggccttggcgttgggccgtttgtagtggtagtagacgggccggacgcggccgggtttggttcgcaccgaaggctccgctttgctgcagctggatggttcttttcgacggcgttgcgtcgctgctggtgggccatggtaccgaatcggtgtgaccgatgtcgctgctagacggaccgatgacaccagttcgccgtgccgcatgacggcgtcacgaccgagccatggccgctgcccgttgcacgcttcccaagagcaaagtcgaccacagagctcccatttactgcgccatgccaacaatggcagcaggagcccggtgccacatttactcactcactccccaatccacccaccaaccaacccagaacctctctacattcctcttcctcctctatagtctatatacacacaccaagagcaggctgcagcaggctcacgccgcaacctagctagcctgcacgcactctcactgaccacgaccagcgctcagccttctgctccggaagctagctctccggccagccaccccaccccgtccacccgaca

SEQ ID NO: 671 - DNA, 869 bp, Zea mays
tgaaaacgctaagggcttgttcgtttcacggttagtccatgtggattggttagtccatgtggattgggtggtattgagtcggtttaaatccataacaaatcaaaatccattccaatacacttcagtccacatgaaactggaataatcgaacaaggtctaaagagttgtgatggaatggagtttagagatatcgtagtatgttcttttataaacttagtcaaaactaaacaagttcaacttcaacttataatgaaattaaatagacgaataagtacattgctaatgctggtcttcagagagtgcgatggtttgtttcatatgattcactatgatgcttgtatcatatataattaattcatgttccgcattcagtgacagattattgggatgatgccacaaactcctaatttctgttacaccggatacttctgttcccatttgtttgctgaaagacagcttgccccggttgcaattaagttcattgctttaaatctgcagaactgagggtactgtacaaaacgaggacgatgtagctgcccagttcttcgaggacgctgatttcttgtttaacgccgatgcctccattaatccgcatcacgtcgatcataacaactctagcgagtcaaattatttgtttgtttgtttgtttgtttgatcttttattataaaagacgacgaagagagaagaagaaaacgccagcaccatttgtaatctcgatccccgccgcacaagcttgatcggacggtcggacaccagacagtctgtcagagacaccaacgcccgggtccgctgccacggtgccaccgctgtttcccatgccggtcggcggtcgccgctccagttgaatttgaaggagcctgacggatcg

SEQ ID NO: 672 - DNA, 1500 bp, Zea mays
agcgcgaggccgtacccgaattcccagctcgccggccatggaggggatctcatctccgctggcgccacaccaaccgccgcgggatcaaggagccgcccagggagcggcgcggcaggcctgaatcgagcatggaagccgcgggccaggcgagccaattggattacccgcccaaaccctagagcaatggaggcatgatcccgggccccggcgagctcgtaactgctggatctccggcgagggagatggcgcgcccggcggaaccgaatcgaatccgagaaacagcaggaattgagctgacctcgggaggggagcaattggggttggcgggcgggagcgggacggggaccagccgaagacgaattgccctcactgcccaccggcgggcgggcgggttgctctctcggcggcgttgctcgggcgcgtggcgaggcggctgcctgctgctgctgctgctgcttcgtgggttgggatgggctcgctcgtgtgtgctttgctccttgcttcttcgtgttcgtctcagttttgggttctccctgtttttttcttcttcctttttttgttttcctctttcagggtttttttctcggccgttgaatcggatttgatcgcgcaggagtgcgcaggagagaaaagaggcgccagcagggcggaggacgaggctcggactgtctgttccctcattttattgctactgcagtatacttgctataggtgtacatttggaccgccagactcgacccggctcaagcccgaaaatgcccgtattatttgaatttcgggccgtgctgggctgacccatgggctaaccctcggccaacggcccggtccgtaattgcttaaacgtgccgggctcattcagggccggccctagggggggggggcaaggtgggccaccgccctgggcccccaaaaactatggggccccaccccaagtataaatgtacaagtaatatgccgtatatgatacacagtgactcagtgagtcagcgacgtataggggaaacgaatcgccgcagccgcgtgggatgcgatcgccttctttcgcccaatcctgcgtgcgtgccgccgccgccgtggacgggcagacggctggacgcattcgccaggcgccagctcgttcggtctttcctctctgcctgaatcgccagatcgctatctcactgatcgccacgacggcacacagttctgttcctgaatcgctgctactgctagcctgctgctggacgcctgaactggacaggctgtgttccaaattccaatgtgagtttaccgctttccagagatcatcttgaattattattagtttattacacaaacacaagtccggtggattgctattagtttactatacttraatgccttgatgtttatatatttttttaatcttgcagactaacggttgatcttgatatattttaagtctgaattttcccaaactatcttactccgggaccaaataattatgaaattgactctactttgaaacaaatagaagatata

SEQ ID NO: 673 - DNA, 149 bp, Zea mays
ctcttcttttgaaagtcaccatggccgcggtgcgcgatcagggtttgcagtgcgctggtccgtagcctagccgccacactcttgcgcgcttggcaagctaggcttcacgctgccgttgcgacggccgacggcgccgcttcccagagacg

SEQ ID NO: 674 - DNA, 1500 bp, Zea mays
gcaagattaaaaaaatatataaacatcaaggcattyaagtatagtaaactaatagcaatccaccggacttgtgtttgtgtaataaactaataataattcaagatgatctctggaaagcggtaaactcacattggaatttggaacacagcctgtccagttcaggcgtccagcagcaggctagcagtagcagcgattcaggaacagaactgtgtgccgtcgtggcgatcagtgagatagcgatctggcgattcaggcagagaggaaagaccgaacgagctggcgcctggcgaatgcgtccagccgtctgcccgtccacggcggcggcggcacgcacgcaggattgggcgaaagaaggcgatcgcatcccacgcggctgcggcgattcgtttcccctatacgtcgctgactcactgagtcactgtgtatcatatacggcatattacttgtacatttatacttggggtggggccccatagtttttgggggcccagggcggtggcccaccttgccccccccccctagggccggccctgaatgagcccggcacgtttaagcaattacggaccgggccgttggccgagggttagcccatgggtcagcccagcacggcccgaaattcaaataatacgggcattttcgggcttgagccgggtcgagtctggcggtccaaatgtacacctatagcaagtatactgcagtagcaataaaatgagggaacagacagtccgagcctcgtcctccgccctgctggcgcctcttttctctcctgcgcactcctgcgcgatcaaatccgattcaacggccgagaaaaaaaccctgaaagaggaaaacaaaaaaaggaagaagaaaaaaacagggagaacccaaaactgagacgaacacgaagaagcaaggagcaaagcacacacgagcgagcccatcccaacccacgaagcagcagcagcagcagcaggcagccgcctcgccacgcgcccgagcaacgccgccgagagagcaacccgcccgcccgccggtgggcagtgagggcaattcgtcttcggctggtccccgtcccgctcccgcccgccaaccccaattgctcccctcccgaggtcagctcaattcctgctgtttctcggattcgattcggttccgccgggcgcgccatctccctcgccggagatccagcagttacgagctcgccggggcccgggatcatgcctccattgctctagggtttgggcgggtaatccaattggctcgcctggcccgcggcttccatgctcgattcaggcctgccgcgccgctccctgggcggctccttgatcccgcggcggttggtgtggcgccagcggagatgagatcccctccatggccggcgagctgggaattcgggtacggcctcgcgctctgcaggaagcggcgcaagccctaatggtttgatcctacggcgtgctatccccaattcgttggtttctctactccgggtctgatatcggggtttgctgcggtggtaattgc

SEQ ID NO: 675 - DNA, 1500 bp, Zea mays
cgaaaacccctcagttctatatgtctcaaagtattgcattatatcttctatttgtttcaaagtagagtcaatttcataattatttggtcccggagtaagatagtttgggaaaattcagacttaaaatatatcaagatcaaccgttagtctgcaagattaaaaaaatatataaacatcaaggcattyaagtatagtaaactaatagcaatccaccggacttgtgtttgtgtaataaactaataataattcaagatgatctctggaaagcggtaaactcacattggaatttggaacacagcctgtccagttcaggcgtccagcagcaggctagcagtagcagcgattcaggaacagaactgtgtgccgtcgtggcgatcagtgagatagcgatctggcgattcaggcagagaggaaagaccgaacgagctggcgcctggcgaatgcgtccagccgtctgcccgtccacggcggcggcggcacgcacgcaggattgggcgaaagaaggcgatcgcatcccacgcggctgcggcgattcgtttcccctatacgtcgctgactcactgagtcactgtgtatcatatacggcatattacttgtacatttatacttggggtggggccccatagtttttgggggcccagggcggtggcccaccttgccccccccccctagggccggccctgaatgagcccggcacgtttaagcaattacggaccgggccgttggccgagggttagcccatgggtcagcccagcacggcccgaaattcaaataatacgggcattttcgggcttgagccgggtcgagtctggcggtccaaatgtacacctatagcaagtatactgcagtagcaataaaatgagggaacagacagtccgagcctcgtcctccgccctgctggcgcctcttttctctcctgcgcactcctgcgcgatcaaatccgattcaacggccgagaaaaaaaccctgaaagaggaaaacaaaaaaaggaagaagaaaaaaacagggagaacccaaaactgagacgaacacgaagaagcaaggagcaaagcacacacgagcgagcccatcccaacccacgaagcagcagcagcagcagcaggcagccgcctcgccacgcgcccgagcaacgccgccgagagagcaacccgcccgcccgccggtgggcagtgagggcaattcgtcttcggctggtccccgtcccgctcccgcccgccaaccccaattgctcccctcccgaggtcagctcaattcctgctgtttctcggattcgattcggttccgccgggcgcgccatctccctcgccggagatccagcagttacgagctcgccggggcccgggatcatgcctccattgctctagggtttgggcgggtaatccaattggctcgcctggcccgcggcttccatgctcgattcaggcctgccgcgccgctccctgggcggctccttgatcccgcggcggttggtgtggcgccagcggagatgagatcccctcc

SEQ ID NO: 676 - DNA, 1500 bp, Zea mays; identical to SEQ ID NO: 674

SEQ ID NO: 677 - DNA, 112 bp, Zea mays
atagatggtgcctttttacttcacattgaagttctgtaccaatgtgcttcttggtgcccatccgatgtacatttgagttggaagtggcaagattgcaggcacaacacagaat

SEQ ID NO: 678 - DNA, 210 bp, Zea mays
tgcctgcagcgcaccgctaaagccggtattgatccccggcgaatccgcctgatcttctccccttaaacgttccgcctgctttcgttgcgctttgttagcgcgatcgcaatttcacgatcctcacgttgacttaatatgcgccattaaataagttggcgcacaacctgaaaacgttttcaggttggcgggaaaacagtttaaggagcggta

SEQ ID NO: 679 - DNA, 1500 bp, Zea mays
atcccatcgatgatggtgaacaatcgcactcgcatgcatgcgtgcaaagcagcagcgacgacgacgacggacgccgcccgctgtccgacggggagggaagaggccacgtcgacgtcgtggccaattatctatcggtaggtaaacgagggtagtaccgccggaattttttcccccaaaaaaaacctcatgacgtcgacttttaattgcctcggctaccgcaaaccctaacgacaagagtgaagtgacgtccggcgtaaagctcagcttcaattgccagtacccagcaggcgggcccggggtaaaaaaacggatagaagaagcgcgagcccaccgcaagtccgcagaggaaacgcgcggcaaactgacagttggctggaagcgggcccagggggaggaaaggcccaacagccggtcgcacctgccccgtgggtcccgcttcccagggagcttttgttccttccgctggagccatcctcagccatggccggccagcttctacggttactgttctccggttccgtttcgtttgcaccgccaagcgccaactgtttgttaccaggctccattattatcgtttccatcattttagctttccagattttttttaaataatgtttttttttcattctcggcgttgccattttctctcgctgctgcttcacgccacgcacctttccttcctcgcaagccccagctcgtaccagctttacattactgcccatgtactcattagtattaagctaagcagcggctcggatttgagcgggcaggctgacagcggggggtgattagattagagaacccgagcacggagacagagatgggcacgcagggtgggtgataaaagaggaagggggaacagagacagagagagataggctcgatttgcatctcgctttcgcattgcacacaccaccatacaccgcactgctgagtgcagattgctgacctctactacactctactctactctactcctcctagtccttgttctgtacaaacctgttttcggcgtctggctgtaccgctagccttaacccctagagccagacggaggaggcctgcggaagcgggagcggaagaggaggaggagagtgtgttcagaatttcagaagcaaagtgctgtcttgccatacccctacagtgctactagcctgtgctgctgcagagaagccaatcgaggcggggcactcgttcctccccgttacaaggagaggaggaagatttaggggcggaggaggtcacagactcacaggaaggaaagatggactcttgatccccgtcgcggtcgcggctggtttgttgtgggcaagccgaaccattttgctgctataatactcgagcagtcgattcgcggctcccggggccagaatcttgctctgagaggcggaatttgtgcgggatttgagctttctttcctccaacgaggtgccctgaggaagggagggagcgccagttctcccactgctgtagtgcgtggtttcagggaggtatgagaca

SEQ ID NO: 680 - DNA, 1486 bp, Zea mays
gtcttttactgaaaaagatatatagtgtgtgcgtgagattaagcacaatattataatatcgtttcatacaatattacgcaaaattttattggtggacctttccttcagtctaatcacaacaaccattggatgcattgtgatattcacgtcgcaagtgaaaatacattacggatatatatatggttccagttggcccgggacacaatccaaaaccgaaacggatgaagttttacacgaagaaaacccaatatgctgaaaacaacaacgacttaaccaaaaggtagacctcacctcagatatatacaaactgaacaggtcaccatcccggtttgccttgatgtcttttcttcccatgtaatacaatatatattccatttaagggctagtttgaaaacttcattttctcaaggtattcctatttttccaaaagaaaatattaaattttcttaagaaaataaaaatattatagaaaaatggggttccaaactagccctaaaatagtcacacaaggaatattacgagtgtcgtatatgcatgctagtttatgtgcatttattttaggacggaagtcgtctatgtttttagtccaaattaataagtaaaactgaaatacattcaatatatatacccacaacttcaggcccaagaatttgtagggttcagggacgacgagcagttccaaaaaaaaattggagctttagttgtgccacaaacagtcccctatccctatacatacgtccaaactaaattgaaggacttcgagtcatcaaattgatcgatcgatcgatcgccctttattggagcgatcgcagtagagctgagatgatatatatatctgttcatcaatcacacgcgcacataggcactagtaccctgccacagggaggtagcagcagtggcggtggatcgatgagagaggcgcgtgattggatggacgcagcactccaacgtccaaccatgcgccccgatcgagatgatatgagcggcagggtgactgttcctttcccttgaggtgtacacttgcatgcatgagcgatcgagcgggagaccgatcactgtacaagggttaggccggccgtgtgcgcgtcttgcttgtctcgaaaagatttatggtgatgcaggccagctccgctcgcctgatcgtcgctgcgtggtaggtctcgtgtgtacggactaccccatgtgtgcgtggggcccaggcattattgcaggaatagaaaccctaccaccatctccgctcgtggcgtgctccactgattcttcttcttcttcttctacctcccggccggtctcctcccctttctttgtctgcctgtgcttattagtatctcgcctcaccacgcagctagctagcagacagccagacacgcgctgctttcagatatctcaccggaccgtcgtcgtcggcccctccgagaacataccaccgcgcccgccgccgcgcgcgccaccacgtccacgtacgccggccggccaccaagcaagc

SEQ ID NO: 681 - DNA, 1179 bp, Zea mays
ttaggtgtaaaataatttagtcattgctcgctatttgagcttacatcacatccgagagtttttaattgagatttgattctccaataaatcatctatgacagagcgatcaagtgttcgattggtaggtgaagttatctgattttaagtcaaattaaatatagtttaaaatattagtctcgatctcgtttgagttcattctgtttgtatcttatccaaaatacgattatctctagaaaatcctccctcatcacacgtcatcagcccatacagctgtcgttccttatctgctcagccgtagtgatcaaaaatctacactcatgtacttatcctctccaccatccctatctctattatcctcccacgtcatctcctggagaattccctagccatctctatcttctaactccacgccacctcctttctcaagcatcacgttcaatttctagaaattccctgctatcgctagcttctaggacaaacgttgctggcctcctagtttccatacgtcggctccctgtggtcttccccgcgtccggtctcatccttatccccatcgcccttatcccctggtctgtgccgctcgtacttggagaaaaatctccagccgccttacctgctgccgccgcttcccatccgacagattatttgtttgcagtcactgatcttctccctcgctcagccgagtggtcttccactcctcccagccgagctctccctctccacgcagctccctcgcggtgctccctccatagcgcccgagcgctctgtcctcggatcggagcttctctgcgtgtcgcagccaagcttccttccccatggcgcccggcgcccaagtccccagccgtgaccctgccgagctccgccccgactccacgtctcctggtcgggctctcgttctatgcctgatgccgctgttccctggtgctccctgctcggtccctgcccagcgcctgactacagctccagctcgcggcgtcccctctgcttagccaggattgtcgtgcctctgctccctggttttccctacgcgcgagctcgctggcgttgcccctgctccgcttggccgcgtccccctcagtccaccactctgctcggccatggaagacacgccgcaccctggttccagctcgcgatattccctgcacgccggagtcgcccagctcggccacctacctccct

SEQ ID NO: 682 - DNA, 763 bp, Zea mays
gatggcaaacagatgtctccggggcagttaattacacgttgccaggtacaacgacagcgtcaacatatagggcagactacagcatgcatggttactactgtacagcaggcagggttgcgacttgtgaagcagcatggaacaagttaacgtgagtatggatcattgaagcataagcattcatcgaccagctggcgtaggttggggttctccaaggctgctgcaaccctctccttgtcgttcagttgcttgtttactgtcatttcatcaaccaactgtcatacgacaaatttgaaatgccatagttgcaatttgtattatgtgatgtcaatattctgccgatggaaaagtctagtgtattcttgtaacatgttttgaaaaaaaattcaacaatgtattcttgtgtaaacacaaagaaaaatatgcgctgacatgctataattctactcatatctcaatctggtacattattaaaaatagagcctacaagttacaagttagtctggatagaatggcatccctattggtaagctgcaacatatcatctcttaaaggtgtcatcgatattctttcgaatatgtctaccaaataacagtatctccaagagttctcaaaacactaaaaatctaggattttaggcaagattgaaaaaaacacatctccaacgactcccagccatagctcccaacactaaaaaaccgagcctcccgtgtggaaaaatacgcactcgtggtcacccgtatccactactcccgcggccaccgga

SEQ ID NO: 683 - DNA, 1481 bp, Zea mays
agaaaaaatcgtctagaaagtatttcttgagagatgactatcaaacaataatggccgctagatatagagagcaagcgaaaattgactaatcctttggcagtttggatttctggcactaaaaaaatacaaggaaatttctgttggtttggtgtagcgttcgctccgagctagctctgcggcgttcgctagcaaacacacacacaggcagcgaactgcaaaatatcaggcacgaaccacgcaaggttgcttcgcgatcaacgactaggcgtcacgggtgatagtatgagaacacatcgtcacatgcaacccagctggagtagtgtgggactgcccatacatgcgacttcaagccgactcgatcggttgatgatttcagagtcacacttcttcatcatttcgcaactaaatgtatattaattagcggagaacttccatcagatccgatcatgcacgaacatcggtgttcttgctagcacaaccggcaggcaaaataacgaaataatcaaccagaatcacacgacacacatctgcatgatttttattcartgaatacgaagtaatcaaccagaatcaacaagaacggaaagcgggtagcgttttgttcaatcgtctatatgaaaggtcagtaaatacatgattttttattgaccaccatagacttaagaaaactgctagtaaagatacatctgcatgcactgatggtttatagtagccatgggctcgtagttttcatttctactagtgcatgtatattataaactgccatttaaaaatcgtaagtgccagcgaaaatcaattgtgtgctagctactagctagtagtggtgcttaagttgatcatacattcattcagtgaacaccgaaacatgtgaaagaagagcgtcttaacctatttacaggtcaacagcgcatacctctaaattaaaagtaaacctgagatttaccaaaattcagtgtctacgatatgattttttctacctcgtaaarttataatcagtgtgatagatccttttatatccctttatgatgtacaccggtaaggcaattaagtaaaacgtgtcaagtagtaaatatatataagttggcaactcacgagatgcatggcaggagtcctgacccatcacgggctatagctatagctcttgttacgtgaattcagcatgattgctcaacttgattctgtatttccacatggggaacaattggcatatctcccgctaataactggcgcgttcagatacaaccatgcaatgaccagatcgatcgaatcacacacacacatgcattggagcattcatgtgcgaatgccgccaagcacgaaagcatctccctccacaccatccatcagctataaaaaccaagccaaacaccctgtgaaaaccatcccaaagagcacgcagcgcagcactgaagcaccacttcctgcactcactgctagctgctcacaccgtgctagtaacagtccatcaccagtcaccacca

SEQ ID NO: 684 - DNA, 1500 bp, Zea mays
acccatggattcggggacgagacagactcattggaatccccacggaggcatatccaaccagtccccaggcttttttaagctcttagcaatacaactaacaagtggaatatagtattacgctacggtggcccaaaccactctaaacccttatgtgttcttgtgttcgtccgtctcatcgggcaaaccctaggctgcccctgttcttaggattaggaggatgcgctccaccaaccggctcgagttttctctccgacagtttcattttcgtagtttcttcatctgaggtcctttacaaaatttgaatttaaaatttgaaaagttcaaacgtattttctttgacaagatgatttcaaactaaaacgttggcaactacaaagttaaaaaacttttcgtgacctacaacttccattttggtgcttttgccatccaaggttgtttaaaaaaattgaatttaaaattcaaacatagttttctattacaagattatttcaaatcaaaaggttatcaactacaaagttttataactttttaagacctacaactttcattttggtggtttttccacccgaggtcatttttaaaaaaaatcaaattttaatttgttaaaattcaaacatagttttgttgacaacatggcttcaaatcaaaagttgccaactacaaaattctatagcttctcatgatgtactcagtttattttaattgtttaatcatttgtttatccaacatgatggttctaacattattcacaaatcttatatatctctcttgtagtttcataactacaagagagagtataagttttgtaaacaaatttactttcattttatcatataaagaaatggctaaaataaaaattgtacgtctcgataagttatacaactttatagttgaaaacttttttatttgaattaattttttgctttaaaatatgatttgaaaattgtctttgcctgttgtcgaaaagacactcagcaaataaactctttgcctagtctaaaaaaacactcgacaaataagcttttttgcttagtgtaaaaaatatatgacaaaaaaaactatttgccaagtatattttataaagtgtttttaatttggcactcagttaaagaccttcccccgagcgctccgaaaaaacattcaacaaagctactttggtataaagagcccggatttcgtttgtagctattaggaaaaataagctaaatttcacctatacgtttccgtgggaattatattagtttgaacaaggcaaaagctgttctatgcatgccagaaggatttagggtattcacatatgttgactgggtacacaaacacagtgacacgcacacacgctatccccccaactgctgcacatttgcactcttcgcctgtataataaatacagacccagccgcgcaaatctttcatcccctcaactctacgtctctctctacctactctcggtcaccacacctcgctcgaaaacaaaactgatcaacagcattgttggtgacg

SEQ ID NO: 685 - DNA, 493 bp, Zea mays
ggccgtgatttttggtgaagttgctgtttttgttagtgacgacaggtgacaggctgtttggtagagcgtggagctggataggacgtacgtatagtcctagctactaatggtagttctgtaggtcaccaaattttgcactaaaaaaagtgaggtggctgatgagctactcagtgctaggaattaatacaggtttgacgtctacatgcatactggaactgcatatatgactatatacatactatatataatgacagtgcaaagaatttgtattgtattgataagtgataattcatatatattgcatacggggatacgtataaaagcacatttccatggtaaggttacaattaattaaccggcgtgttatgtacaagtttcatggtagcacgctgtgtatttttgtacgcttggcaaacaggaagaactcagtaatgcatgcctcagctccaatgcaagaaacgcgtctagctagtactcgtcgtggcggcggccg

SEQ ID NO: 686 - DNA, 471 bp, Zea mays
gtttgggtactctagtacttatttttagttcctatattttattcattaataattaaattgctaaatacaaaaaattaaataaatttttagttttcttattaaacaatttaagcattaaaataaaataaaataaagcaactaaaaaaaattaatttatagaaactaaaaaggatagtactaacatcgtggcgcccactgcctcagtaacaggcgatgacccctgagcactgttatgttaattaacaatccgctaactaattacggaagcgaaagaggaaaaaaaaaccctgtccttgtctcccacctcgactctttccatctcgtctccctcgcctcctcatctcgttccgcctcctatcggcccagctccaaaccctagcccgccgccgtgctgactcccctagccaggcacgacgtcgaagagagcagcggcggaggcggcaacctgatgcccagccccccgtgggggcc

SEQ ID NO: 687 - DNA, 745 bp, Zea mays
tcgaatgatccaattttgatgaaactcaggaaagaattgatgcttaataaatttgaactattgtttaaagccggcgagcgaaaacttccttttgaaactttttccaaaagagcaattcaaatcgtccgcagagaacgcacctcgacattcagagtgagcaatccaaatcgtcaaacgccttgggaagaagacagcgaaggaccgcaaacaacggagggagggaggcwttgcggtcagctcttctctttggtcgttgcttctttccacacgcgcgcgcgaaatcaagtaaaataccaatggctcataaagcagacagtttttaaagttttgctayatctatatggatagataaataaatatactttcagagcatatctgtatggagtcatatatataaatgttaacaatcagtaccaactcaatccattcatttcgcaacagcagtcatatctgtatggaatcatatataattggagtggagacccaacagcagcatttcatatatatatttaayataataacacgaccaaccaaccgttaattatttcatacaacaacaatatcacatacgatatactcggagttctgagtatcctaaaccacagcaacagagctgttagttagttagttagtacatgcgtgctgtgtgtgtcctaggaggaggattcgactttgtcacagagcctttatccacccaaccaggcaacaactgctaccctactacccgcggatcgagttgatatca

SEQ ID NO: 688 - DNA, 258 bp, Zea mays
cgtaagcaaccaaggactcgaaaatctatagaattggtaaaacatatatgttttcccttataacaagattgcattatactaacatatcagtaactattgatagtgtatctgtatggtgttgtacattatttctttccatgaagtatagggctcaaagcacagggtgttttcctgtacctccctgttttattgctattgtctagcactagcagttgtagatacatctaacagctaaagctataccaccatacacatgta

SEQ ID NO: 689 - DNA, 130 bp, Zea mays
gctttccattccgtcgtatcgtgtgatccggcctccggtatgaatgattcgcgtattttgatttcgatctgatccgtcgcactgttagactcgaccccggccgggtactgagggatccaaatccaacgga

SEQ ID NO: 690 - DNA, 64 bp, Zea mays
ggaggaggaacttatcatcctatatgctgaacctcaacgtacggcgggaattttctcctacgat

SEQ ID NO: 691 - DNA, 1500 bp, Zea mays
aaacgtacggatgcatgcacctgaaacacggtacagttgtgtctgtgtactatatatgtcgtagatcaaagtcatcgggttcaaataattagtttgtgaacatatatagaggcggtaatacggaccagagactcgctcggagagcacaaaatatgtatgtacaattgtacataaaaaaaaagaatgcatggacctcagacaacatgatgtcagcatgacagcacggacacacgcaacgccagcgagtcgtaggtcttccgatcaggccgcgcgcgctccattcatttggatcatctcgcggttcgatcgtgaggtgacaactgaaatcgacagagatgtatgtagttaaaagagcaaggaacgactctcatcccggccgtgcgtgtgtgttgacgatagatgcatgcacactcagcacggttccgcaggatgatgatgcgcctcaataatcatcccagagattaatttgcttggcgcggaaaaatcgcagcgcacacgcgcgttcgatcccatgtttctctagtactactccaaaatgtgaacatgcgctgacgacacgtcgatgatcccatcagaagtcgcctctccggactccaacgaggacatctagatctactctactaccgatcgtcctcctcatcccgcgcgcgagggcgaggcgcgtggatggatggatcggagtcgtgcatggaccgcaagagaggcaaagaccggcgactcttgcttgcttggtgttggtgggctcgtacatacgcgacagtagtgctcatcgtcctccctgcgtgctgtgtgtgtgctagcagctagctcctccacgagaccacgaccacaagcatcagtaataatcaaacgaaagcggtagctagcatcgccttgattgatgatgcatgtcaacatctcctgcgcccctttcttccaggaaccttctgtcttgcgcatcaatgcgaggcccccgtcgatctcatctcacaccaccagctctcgcaatcgcaatccacgctcagcgaattaaaggagccgccgtcacactcacacagtagaaaattaattgcggtatgtataattctccatcggcccggccgaaacaacaacaaaaaaacccgcatgtgccccaatatagtcccctcctagaaaaaccactgcagattcccggaacccgcacggggccagtccacccccaccgccgcagcagcacagaatcagatctcgtctcatcagccaggaacagaagctagctatcacctgccctggaatggaagagggcaaaaagaaaacaggttcggcgcgcacacaggcgcagcctatataaagcgcgggcaaccagagacccggccaccatgcaggggcggcggcagctgctttatttatttggttccaaccaattaaccaccagcatcagcagcgcgcagcttcacttgatccagccgccgccaccatatcatcgatcgcacgcacgcacgtactatacgttcaacggataacaacaagctagctgagaac

SEQ ID NO: 692 - DNA, 411 bp, Zea mays
ccttcttgtctgcagaacgatgtggggaatgattgccaggggcaacatggccatccagaagttgaaaagttagatcaggtcgaggtgaatgaagatacgatgacacctgatgtcaaattatcagtttgtagggatacaggagagtactctcctgtaagtgaaggtaagagggcggttccatggcaagaccggttcgcgttgaagacctaggccctcagttgatgtggctaagaaataagctgcttctctgacagctagttttgctactgtatccctcaaatgctcagtagtgctctgtacagaaacaatgggacatgatacttatatgcatgttacattgcctgattgacaaactcagatgtttgtagcatgcttctaagcaagttagacaagtgagttgtgattctatga

SEQ ID NO: 693 - DNA, 181 bp, Zea mays
tgactttctccgcacaaacgtcgatgttttcgtgtggagtccctcggacatgcccagcataacgaggcatgtcgtcgagcacttgctggatatccgagctggagcccgacccgtgaagcagcctctgcgctgattcgacgaagaaaagcgcagagccataggcgaggagatccacaagcta

SEQ ID NO: 694 - DNA, 689 bp, Zea mays
ctgcagctattttgctgagggattattcattatttggatagaaatcgtgtaggaatttaatattttgctgagggatcatttggatagatagaaatcgtgtaggaatttaataggaatcagttcgattaatagcgcagattttccacgtttcaagcaggccatcaaagaaaattaagcatgtttggtttgctgtctaacttatcacactttgcttaacttttctgattaaggttagttttttaatttgaacgactaactttaggcaaagtatggtacagttaaccacgaatcaaacaggtccttcatccttgcaaaagaaaatataatttccgtaggcgtcggtcatttcgactgatttgttgttgccgacgtttcgtcccatgataaaggaaaggcacgagttgaccactagaatagtagagaagtagttcagtttagtagtagttttgattatgacgaaatgtttcgctattttttttacgagtgttagttagcgctgggcctgggaaagagaagaaaagggaagggccccatctacgcccgccctcgtgtacctggagccgtcggcttccgccagcgcccagctggaggtctcgctgttcccttcacgatacgcccccccaaagcggatcaaaccctagatctcgtcttgtcgccccgttcctccgatcccatcctatccgatcctc

SEQ ID NO: 695 - DNA, 1500 bp, Zea mays
tttttttgaaaatataacagaaatgctgaaattataaaagtgacaaaatttctgttaagcaatagtagtgacagaattatttcagataattttgtcacttctgttatacgtgtgattcacgtatttttttataaatataaaatacttataatttcaacatttctgttacattttagtaaaattggggtctcaatttcccgcatagttgttttcttcagcttatatataattgaatgttgagatgcacttgctcatctctgacaaattatgcattctctatgatcttcatccttcctmtagaagaatttctcattgacaatttcacctgccacctgaaacggaaactgccacctccggtaatcaggcttcactacatgttttaaattatggtcttagaatgtcttgaattatcattggttcattactcacgatactactgaaatattactcagaaaattcaaaatgtgttcctttattttcatcgtccaatataccgtgccatacctgatactttgcacgtaaataaaccaatgtatatcatgtatacggagatcctttttgtctcattgaaccataatcacaatgtttcaaccataatctagaaaaacattttccttttttgtctcattgaaccataatcacaatgtttcagccataatctagaaaaaaagtttcctgggttagacttaagactacgatctttcaatttgcaaggcagttttcataatgattgaaaattaatagtgataacacttttaatctgcaaccagtacaaaataaactttttacttaatataaagtcatggttgaattaagcaattctgaagttgtatcatatatagcaaccagatttgtctgctccagaacaagctactattctatcttttgtatatacatatataacctacaatatatatataaatagtttgctaaattatcatttatattatgaaatgtgtatgtacaacctcaaaccaacgtaatattgttatgacttatattactgttctttctcacacgcgcaaagcgcgcgccatttactaatatataatataagatataagccagagcacgtttacgcctgtctcccgcggctattgtaatatcattaaatttcgtatacgcacagcctgatgccgtgactccgcttattttaaacaacgtactacggtgacgtaaggttgacgtaggatttatgtatgtccatagaaattgtcagatccatgcgttgattatcgctgttgtatcgctttcaggcaatcgaaaaaaatctactgattgcgtcattgggtgcgtgctttactgccacaggactagtacacgtctacacctacccctttggtcatattgactggatcgactgacacgtcactagtttctgttccctttttcgaggaacggcacgagccacagcaaatagtcagctgtactgcactgcagtaccagcaagcggtgggctagagcgtaagcgtagaagcaggcagccaggcaacgatggag

SEQ ID NO: 696 - DNA, 1371 bp, Zea mays
ttgacacctggggtgttacaattctattcctttttgcacgtctcttcacttataatattgatctaagttaacactcatattgcgagagcaattaaatgaagaagttctctcctctcccgctattcattcaaacatggttttgattttactaatccactttagaccaagtttgtttttgttgagctgtttttacaggatcacctattcaccacctctaggtgctcacaaatattttttttctcttgtggatgcgggtatgaccaccttatgtgtctattgtgtatcttacctactgccatcaatattggtggggccagctattgctaggtactatgctgttagtgacacgatacaatgtgggtgtttgacgaaatgccaatggtaacgcacataatcaaacaaaaacataccacatgtttggttgtcttcgtcaggagaactatactccttccatgcattgactatgataatacacgtgtttagttcgttccacgtatacgcgaaacggaaaatggtcgtatcgggcggactaagctcacgtgacactggctccgtgcatacatccatccaataagatcgaccgtccaattagacggataaacgatgcaacaaagtaataaagccaaccaaactgtaccaagtatttacacttgtgcaagcatagtctcgtgtgagtagctatgcattagaaaatacattgaaagatatggacttttaagctcgtagcaatgctcggcctcggatatagtttttctgtgaattttctatgatcgaactagtttttagggtttataatttcttaatttttgataaaaactatgtggctaattttttgataaaatatttattgtttgatctacctcatgacttattaatatactagtatcccgtgctaacactacgattatggagaagagaggtccacggcgacgcgagtgagggggaggggtataacttagaaattgccaccagcacaccagcgtggggatacgggctacaggtacaggtgattatgtcgtgatttggcattaaagcagctcgattgagcagacatcattacaacgctgcctgcctcatttcctgcgagacgaaggtacactacactgtacacggtgcactagagtcgtagcattcgttccgttggggttggttgctggcggttgaccggcgaatttgaggcggtccgccccggcctcccgacaaactctctcctcctaccaaacccagccggcctagctgctacctgctacatcatctgcaggcatgcatgcatccccgacgaccctagcctcctccctagctcaggcctcatcctcttcgtctgatactagtaatctatagagagtgattctcagcatcatatcgtcagcc

SEQ ID NO: 697 - DNA, 601 bp, Zea mays
tttggtggattttattttcgaacagcccctaataagagattttggggggaaaattttagtgctcttttggagctgctcttaggctgtttcatttgtacctatcacgtgatgtctattcgaagaaagcaagcaagcaccgaaaatgtgtgccaccgaaataatctcgctattagtcttcgaaaaggtgtgcatgttcggttcgtggctaactttgtctaaagttagttgtccgaattaactaaccttagatacaaaagttaaataaaatatggtaagctagacaacaaaccaaacatacataccgtacatattgtgaacttctggctattatccgaggaacagaacttgataagctttcgcggttccagatctccaaagaagagtcaaccatcatgaagttatccaggcaactccgaaccccgataggtgcgcgtaaatgcctctgaagtccgtacggacatatataagtcggtcgctcggtccacataaatacgactccctagtccctacgcagatcgccagcaccattgacgccccggctcgcagcgacagacaccgcaaacctgtgactcaatcatccttgcctgccgccgctacgccg

SEQ ID NO: 698 - DNA, 312 bp, Zea mays
tgcagttatttcaattgtacgtgattcatgtatggaaattacgaatgcggctagagctcaggcatatttcgatcgtgattcatatatgaccggtagtaaaatatataatgttctactacactggctcatatatagataataataaattttgttaaggtaacctcgccgacgctcgacgatcgacccctatataatagtcttccatatggcatgcgcatcctaaataaagcacacaacttgtgcaagtgcaagctagctaggtagtaaaagctagcctcgccaacaacactgactgtgggcagctagctgatc

SEQ ID NO: 699 - DNA, 324 bp, Zea mays
acggtacggtatacgatcgaggaccgctctccaccggcggaaatgacgacaacggcggaagcagtaaaaagcaggctagctgttgttcagaacgacaggccggtgatgctagcttgcagcctgcgtaggtgtatttatgcccttggttttactgggcctgtcgttctgaacaatatagccctatttatttaccacccaattatatatgtgtagcctgatgcagcagtagcacaatatattcttcttcttcttctgaattgttttctatagcaaaaggaaaaaacatatatagcttttttagaacagaagatcgatcggatctcc

SEQ ID NO: 700 - DNA, 157 bp, Zea mays
ggcgacgaggattgtgctagcaataaccttgtcatcattggcaaggcgcggtttcttgagagtgagcatggcgcgcgttgcagcgaaggtgggaagggcagtggctttggcgatgatgtcggtcatgttggaaaatcgagggttgagagttgagacc

SEQ ID NO: 701 - DNA, 781 bp, Zea mays
gtgatctttataaacttgttatactgcgaacttgtaatctttgtttactttttatattataaatttgtgatccttgtgaacttattatattgtaaacttgttatatcatgaattttgaacttgtggtctctatatttttttgtcaactttgttatattgtgaagtttgatatgttaccaatcgtattttagatttcgaccgttaccggtgtattttctgtaccaaattttttattttcgatgtttttgaaataccgatatcgtttctatttccaaagttaccgttttcaattttgttttcattaaaaatatcaaaactataatgattttagtgtgtactgaacgtttctctagtggcacggcagacggcacaacctaccggcttcgcggtttcccttttgttccgtttcgtgcacttaagccgtccgcacgccgtcttccccatctcgcgcagcgctactgccggctgtccggagtcccgaccaccgtcctcggctccccgccgtgaatccatcatcccgtaatggtaggtagtcccatctcccgctctcgttctcctccgttccttctctctctaccgcgcacggacagcgctgccggtctcttgatctgccccgatccatcgctcctagatctagccttttgtggtgggctaactcgttcgttctcccctcgcccgtgtccctagatcgggctgtccctttttttctctttgctgcaagctctatgggatctgcgaatggttgttgcctcgatttgttaaagggttgaacctttgtttg

SEQ ID NO: 702 - DNA, 1500 bp, Zea mays
gaacgtagcatgcatatgaccgtttgaattcgctgcgaaaatcttttcggcgtcgtggtttgacgggtcaaatagtggagtagtggaccctggttggcctaatctggcaggtgactgatggatggcttgggaccaaacccaacatgtgcgcagattcctagacatctatccagtcaggcagtcacccacgtcgaggcatcgaatcgccgaccgcagaggatccgcggaagcccgggggaattcgatgagcggcgacagctgtgacccggcttgcaaccaagaaccatccgacctggccaattaaaaaaattgcggaagacaacaacgaaaccagccgcagcgcagaattgctgagacgaggcgaagcgggttggccgaggtcgaggccgggaatggtggcgggtggcggcgtggcaaaagctactgctctgctctgctcgctgcccgctcccagagtctgatccaaacgcctcgctggtgtcatgctgatgcgccctcccctcagttaactattctactcttctgctctgtcagcagaccacgagacgcgcgcgcgaaactcttctctctcctttgcgcacctctttcgtcgtcgtcgtcgtcgatcttcctccggtcagttttcaccgcttttactttacagtccactcgtacccgcgccagccatttctctgtttgactgccgccttccttgcgcccccacccgtttctcttttgtttcgcacccctccatccttcactcctcgctggtccagccattaatgccaccacctgctatacatcactaccttcctcttccctcccgcagtctccgacctctctctctcctctctctttctttttctctctctccctcgctttttctgctgtctatccccgcgccgcgcgaggttgctgccttggccytgctggtactatctctgtcctgattcagagtttctagctgggactggggggaagtgcacgatgattcggtctctcagctccgcggggttcttttttcctgtttcaggttctttgcttgtgggatgagtggaaggaaggccggtcctcgctgcagaaagaggttcatgctttaaactgtcctctcgttttattctatcgagcgtcggtatcctgatgggattggggtcacgagaggacttggggaccttttcccctttcccctggctgtagaattcagcatcctgtatgcatcgatgaaaggagaggggcacaatcttgggccacatctaatctctctggctgtggcgcttgtaaggaacagagagcgttcgtagtttgtcttgatctcttgatttgcaggagcggcgaagtctccatttgtttatccactgatttttttttgcctcgaacatgacgttttaactgcttggctcgcgttctgcagggagaagacttcatctgcacgtgctgctgatgtgcattagaggatccgtgctgataatatacagctgacacccacaagatcgactggataagttcgagcctgacggcatc

SEQ ID NO: 703 - DNA, 145 bp, Zea mays
ggagcgatggcaactcctcgctgcgccccttatccttgccaatagtggcctttcatctaactgtcacattccagacatagagtgttcacacggcctcccgatacttggccccgatccaactatccctatctgctaggagcaaggc

SEQ ID NO: 704 - DNA, 220 bp, Zea mays
ccgaacatcggtaaaacaaatcaccgtgttcatccacttgttttcatttgatttgtttttcccctctctcccggactagtttttagttctaacgctaacctcggcttgtattgtgtgcttaagtttataaatttcagatttcacctattcacccacctctaggcgactttcaattggtatcagagctcggtacttaattagagtctaacaactcgaagtg

SEQ ID NO: 705 - DNA, 1500 bp, Zea mays
tttgactgtgatatgtttaattgtatcactggatcacaactttagcccaatccttgttacaacaaaaggccagcagtagctttggcaggtttgggattgctggcatcaggtagtcaactcaggtggcataagcctcttgataagcatgcacctgggaggcacatgtgtggtgcaggggtgcagggctgcgctgcaccgttgacgccatgaggagttagtgcttgagattatccttgctgctgacaccaacggcagatgtagaggtggtggttgtggccacagcacaaaatcttgtttctgtgtgtgctgctttccactgtactcgcgcttactcctgctgcttgcccatgcacgagctagcttcccttcttcctgattccacgctatttacccgtcagccagcgctgaattggacgcctgtggcctaggcgaggtgcattccacacataagtgcttaaaagtacgtgtgtaagcgagcgtttagttgcgctttttaacactgctcaaacacataacttctgtgctacaacagcaagactcacaccagaactcatgtaaacacaacttgcatccctgaaaactcgacagactttatttgttcaaaaggacagcgcaccgagagatggttgatgggctcaccctcctgattgtagagcattcaaatagcagggtgtggcagacttcttaaagtcaagcgatccgctggctgcaagctgtatgaaaaagcgccagtgtccaaatagccaggattcccagaatgtgatgagctatgttccttttaaaccacaccttgtccaataagattcaggtgttatgatccaaaatgcagtgatcaattagtttctcgtattttttactagaattttgtaaacatatgtgagaacatgaatgtctcactgaatcttttaactggttggtatctataaacttgatgcagagaaactcartggagcggtaaagtgacaaacttagtttagcacactgaattaaatgctaagtataatttcttctagatacagattaatgcacctcatatgaacttctccgaaacgcttcatgaaaccttattttgttcttagttgaaaaaaactgaaacactaggtctaggtagcacatcttccagcaactatatgttgattcattggttcgtatatggtatcttgttcagtggcaaaactgtaccatcataaatatggttgattcatttcaacaacaacaaaatcccaaacaagtttacctagtctagggttgaactcaacagaagacgcaagtcaagatttagtcacgtggataactgttttccatgtacttatgttcaaagccaaatctttggaaatatttcatcctttcgagccttctttcaccgtatgtttgcagtcatctaaggtgcccttgtccttttgagtcttatttaatctcgtggtaacaaaatagagattttggttgtattttctgatctggtgtatctctcccttattttgtacagttatatggtgagtc

SEQ ID NO: 706 - DNA, 404 bp, Zea mays
cagcccttagaggctagctttgcttctcggtttaatatatagaaaaatatatagaaatagaaatatagacatggtggtaattagcaaatataagttatttcattcaccagtacggcaccgcagatgctcgaaagaaatacctcttctccactccacctccgcgtccccaccttcagcgtcacgcacctcgacgcgcagcgcatggcgactcggctctcgtccacgggcccctgatctaggcagccggaccccgatcggttgcccgtgcagcgcgacccccacgaccaggatccagggagtcgggccacggtcctcggcaaggcatctcatcggcgaacgttttttcgaggccgggctcctgctcccccggaatctagggttcgcctcgccccgcgtcgccctcg

SEQ ID NO: 707 - DNA, 330 bp, Zea mays
gttcaaaacagcaccttaattttgccagactgacagtaatattctgaaacaaatttaagtgagaaatttcataagctatcaaaaaggtgagaattttacctttttagccaccggggaccgagctggaatgctaatttatcaaatcaaacgatgaaaagttgaaaacgtccagaagaggaaaggtattttccaattatttcattttccacctagacaattccagtaccgcttctgcccccagcaggtgccagcgccatcgccgttcgcctcctctccacactccgccagatcccatccctctcgcccacgcgcgggtatcggagtcggagc

SEQ ID NO: 708 - DNA, 403 bp, Zea mays
ggtaaacatacaaaaaagcaaaatttcctccattattttctccgtcttacggcttcaagccttcaatccacccttcttgcggggccgtcttcacttgacggccctacccaattcggtggtgcttgtgaggatcggatgggcaggcttcgtgtcctggctaaggccgtggtcagcagaggtgtatatggccgtgcagaacgctgttttgcacatagagtggagtttgaaataaggagtgagatatgacgtgggatagggaggctgctagagagggcctaatggtgattgcctggttggagtggactgtagccttacctaattgttgggagtggagatcagcagggttgtctgagcagagaggcagtatggatatagaaaagtcgcatgttgccgttaatttttc

SEQ ID NO: 709 - DNA, 1500 bp, Zea mays
ttgaaagaccgactaggcttttcatttctaactaatctagcgacatatggtcatattgctttgataccacttctgtcacacccggttttaagggcaaaaccgaatgcatagcacatgtgtgctaggatttatttccacacatatgttgacgtcacaagtgtaatatatcaaatgaataatgcacaaaagagtaaatcaagattataataacatattacacttcgagcagacataatgtcttaacctttattcatcaaagtacaccaaaacatgggcatccttacataggaagatgaccgagggtatctgaaagggaaataggcttacatcttttcctaattgattttggtggttgaattgcacaacacaaataattggactaactagtttgctttagattataagtttacaggtgccaaagattcacaataaaccaatagaaagaccaagaaatggttcaaacaaagagagcaaaagacaatcgaagtgtgccctggtctggcgcaccggacagtgtccggtgcaccagggaacctgacttcaaacttgccaccttcgggaattctgggagccgctccgctataattcaccggactgtccggtgcgcgagcggagtaatagctacacagcgccaacggtcgtctgcaagaacattaaatgcgctacagtgcgcgcctgcgcgtgcagaagtcaggacaggcgccagaaggcgcaccggactgtccggtggcccagctgccagaagctccaacggtcagaacccaacgattgggtggacgtggctggcgcaccggacagtgtccggtggcgcaccggactgtccagtgcgccatacgacagcagcctccaccaacggtcaaattggtggttggggctataaatacccccaaccacccaccattcattgcatccaagttttcagccttcacacctcatacaagagctatagcattcaatacaagacacaaacaagagatcaaatcctctcccaagtccaaagacaattccaatcaaatagtgactagtgagagagagatacttgtgttcatttgagctcttgcgcttggattgcttttcttcttcattctttcttgattccaactcaattgtaaccaaggcaagagacaccaattgtgtggtggtccttgtggggacttagtgtcccgtttgattgagaagagaagctcactcggtctaagtgatcgtttgagagagggaaagggttgaaagagacccggtctttgtgaccacctcaacggggagtaggtttgcaagaaccgaacctcggtaaaacaaatcaccgtgtcatccgttcttattcgcttgtgatttgttttcgccctctctttcggactcgcatttaattctaacgctaaccccggcttgtagttgtgcttaaagtttgtaaatttcagattcgccctattcaccccccctctaggcgactttcaattggtatcaaagccccggtgcttcattagagcctaaccgctcgaagtg

SEQ ID NO: 710 - DNA, 1500 bp, Zea mays
acaccggccggaccggtagttagcttcatgcatcaaacgaaagagcaaaatatgcctctgccaacgattcttaaacgtgccccttgtggagtcgtattccacaggcccctataaaacttgttgttgttaaatagagtcgtactctgttaaatacactaattcaggcgcggacttcagtctaaaaatctccaaatcagcattaaacatgcatgtgacaaataatcgacagttgggatttggaccagcacatgctcatcctaattagggcatggctgcatgctttggcatcgaatgccatatacacgtcaactttaattagaagcactaatccgcaattaatatgttgccgttgcattggacattgcttggcgacgaattcaagattgtgaccgcacctagaggtcgcaagaatttaaaacatatgagcgagactaacatgggcatcgatcgaccgcgagcatgaaaaggatagtaacgtgattattagcttctaaagtactatgggaattgaagatatcaaagcacaatccaccatttccttctggtgaacatctctaccactttttttctaaatctaaggtactgttccacccatacaaaccaaataaagtcttgttcggttaaatatggattgaaagagattagaggggtccacttcaatattcctgcaaggtctaaatgggttgtggcctgtgtggcttgagggattttagtgaataagatacaagacttaaatatattaagttgtataaatgagtttcttagatgtatgtagcgtttggagaaccgtagcatagtaatacatatctaggttgtacatgacctaatacaataattcattataataacataccaagaggctttacgtggacaaggtatacaaactgccaaaatagaatccttggaatggcagactgccaattttgggtgggagcatcaacaaggattccaaccacccaaggactatgtcaacaacagttattagtatggctttgcacgcactattttacaactttttgaaagaaaaaaattcaaccgtgtatctataggtgactcaatttgcgaaactccttgtcaagctgtggtgttttcggactgtaaataaattaacgtcccgtttagatcattgaaattgaattatattctaataataataatttaggcatataacaattaaactaattcagttttatgcaaaacatatcaatatactattattagcaagatgtttaagatatttatatattatatttttattatagatgagtgagtcgaaaaacgtcttgtaagttacatagcagaaataaattctactaataaataaaattatttcttatcctccatcacatgaatttatgatagatttatatctgaaatttgaaaagtggtggaatgtcaatttagccaaaaatcgtttctgttgatgattcctgaaaaaacgaacggggcattataaagctcacaaacctcccagttgctcagctaaagtaaacctactcg

SEQ ID NO: 711 - DNA, 1500 bp, Zea mays
gatgtggtattctgcggggaaagatcgccgctcacaacaaccatgtcattgtgtcgtgctgaagctgaattatggagatgcaggctgcgacaagaagaccaccatatcgtggctgcctggtgtcgtgtttttgtgtgtaacatagcataattccattgatgtaacccccacccccatgttgtaaaacacagggcgttttggccacaaaggaatgaaaattcaggtggggaccctctcccctccggtggcattcaaaaaaaaacaaaccatattctgcctgatggatggttgtgcttgatgttctacgtatcgcgatttcctagacttgagaatcttcactttcctcaactcttgagaccacattttagtgaatcaaagggaacagcttatattcagagttgcaaatgtgttgtagccatacaaatgtcttgctcgtgcattcgttgtctcgctcgcctcctccactcgagtccatctgtcgttggctgactggctacagaataatttatatgccattgttcaaaagacaaaaaccaataacccatcgatatggatatgccattgtaaaggttgtttgatgttcaaaaaacagtaacaagtgccataataatcagtagactacgggcgtttcatcgtctgcaatgtgggctgtgttgacgacggtgtgatgggaatggggggaggcgagaccacagatggactcgccggtaaacaggtaaggaaaataatagaaataccgagaaaaagatcatggtacatagacataaaaaaacacagacaatctataatcacaaagtcatgcacacttataaataattatagatgcataaactaataattaacaatgacataagtacatgacacatgaaagttcgggtacttcgggtacccgattatggtacccgaattatccgaaataaatctgagttttacacgttgctacccgaaattctcgaacaaaattcaggttcctggtattttaggtttgggttcgggtaattcgagtttgggtttcgggttgcgggttttttttgctcagccatacttgaattgtccccagcgtatgtgaggtcctgcctgtcgtttgttggcgtgagcagtgcgggggcatgaatggaacttcatcgagtttagggggtgtttgacacaactcacctttaaaaaatcagtttagctttatgaacttcagagttagacaactttgtttcaaagttgcggagtttttaaaaatgtttagcttgtagaccagctttaacttcgctgaaatgagattttgtttagaaaagtctcttgtacccttgaatgatgtatgtagctgtttttatttacagcttcaatatatatacttgattttgcttcaaaaaaaatatatacttgatttaccaataaccaacaaaagaccttccataaatcggagcttcacaatggaaattagcaaacttgtagccacctgattgctagcttagttcatctaaacagcgtatcaagtatctcaagtag

SEQ ID NO: 712 - DNA, 713 bp, Zea mays
gcaatgccaccatttgggaaccggatacaaatgacaccttagcagctaaccaatcaacttgtggaacacatggctagcgaagttttgttctttcgctgttgttgaagcgttggtcaagttctttattcgtacaaccatgaatagaatggaggtcaatcacatgaagtgtagagcgtacggactgagtacgaaccatcggaacctgctgtagccattatatataactaggattacgttacttatctatctattggttaaaataatagggacgatgaattctttgtaagacgtactgaagcagagtgtcccacttacaggaatccagttccagtttgtagtttctttacctaagattgttcagctgtacctttattttatttttagcagggctgtttacaaaatctgatttttttagttttgaaaagttagcaggagcattgcttatgtttgggtgggttcagattacatgcagtataaactttgaagactatatatatatataatagaaaaaaagaagtgcgagaaataacagaagacgataacaacaggcgagtggccacggatgctcgagaaaccggactagcaccatttccaccgtatcactgcacggccgcgcgaaaatgtgcagcgccacaagtgcattccggccccgtgagtaatcgtaacagaggatcgctagctagtgtgctaccctgtacggcgcaggcgcagcc

SEQ ID NO: 713 - DNA, 1500 bp, Zea mays
atgctgtaagaaagaaaacaatagaaccacagtaggttttatatagttctttttttgtttagttgattttgtacagcatgaatcaatacgtacgaggtattattctcccattgcaaccgcacagatactcatcttagtaaaatacaaaaaactaaaacaggaaagagtctgtcttgaccttttgttttcatcctattaacacgtcgttaaaacttactaaaaatttagtgatacatggtagtttaggctatttttaacgatggttttattcatatttaatagtgtgccacatcatcagatttttaaacatggcatcatatttaagaggattgagttttatgggataaaattagttttatagagatgaaactatgtcaactcgtttccaagatcttagaaactatatgaaacatccattaagattgatttatttcatataaatataattactaacttctattagccattgagttgcgacatttaattgatatgttatcctataaaatagtaacataaaatagtattgagagacatttttaattcatagtttcatcgcatttatgtgacagggttggaaatacttgtgcacttgcccgtagacccaaattcgggcacgccttgtgttggttcctagaaaaactacagtatagtaaataaggctggcttttgcgatgcaaatggtacaaaaagcgaccgcacacagcaaaaggctaaagaggtcgggtccaagtttgaccgcaccacgagcccggcatgcgcacgcaaaacaaaaacaaagaatatcaccagagttccaaatctgccccgacatcttcgtcggaatcttgccaaatcatcccgactactcctgctccatttccgggtcatttttattttttggtttcgtccggccggcacagcagcctgctttgctcgcgatcgaccagtgttttcctggttgctcatcccctccaccccaccttgtggccccgtgtccggctctccaaccgcaacggcgacggcgaggagttccaccccttggccgcctatgaaatgatgtgctcttgatgcggtttacggccacgaagaaattactgaaccgaaccaaggttggaattctgtatctgtctcacctttcttttcttttcttttctatataagataacaagtatacataaataacttccatttggttttgtcttgctagcatttctatcgaacagattgcgggcagacttacttgctcatagttgagcagttaattgcatatcggttttgctttgcactcacgtagctacgtgtattttctatctcaaaatttcacgaagtgttcaaatgattccgggcggaggatattgattatttaaataaaaaacaaattcggttctttcgcatgcaggcgcactcgaattccctcaggattaaccccgcttcgatgtgaagcgacgcagagcagagcagagcgccaatttatggtcttctccttctccccatcatctggacagcaggaagaaggcatcc

SEQ ID NO: 714 - DNA, 334 bp, Zea mays
agttgtatatcaaggagggaaaaagaagtaactccacattcgattattaccaaagctcactgaattagatctgaaatcatgtggcttaactgaaattcctagtttcttggtacaccttgatcatatcactatattggacctttcttgcaacaagatatttgggactattccaaattggatatggcacacatgggaccatagccttaggaatttgaatctttcaaacaacgcattcacaaatttgcagctcacttcatatattctccctaatagtcatttggaatttcttgatttgagttccaacagaatccagggtcaaatcccgattccgaac

SEQ ID NO: 715 - DNA, 470 bp, Zea mays
tttggcgccaagtaaaggatccaaaaatgatattaaaattttttagggttcaaacgtgaattttttctgatgaaagaccaaaatgcaaaaaaattcgctcctcttccccttgctaacggcgtatctttccaatcgccgcgctccacgtgcaatctccgtctcccgcgacgtcacagctccggcagatgccgtcccacataaaaccgccccacctactcctcacccagctcccaattcccctcccgtcccgtcccgtcccctcccctcccctccgctcccgtcgtctaccctcactcgaaaccccgattcgaaaccggctgagttcaatttggggatttcggcacctcgttccccgaaattttctggatctgagtctgtcggccgttctcgatttgcgtctggagtgagcctgcgagttttcaggctcgatttggtcggggcctcgggggtcccggtcttcgatttcgggg

SEQ ID NO: 716 - DNA, 178 bp, Zea mays
accaatttcatccctcttgcaagcaaaccaaactcactttcatgtatttgtttacgatgatcgattttgggtgtctgtactctagtatattttcatcacgtttactactataatactgtctgtacttgagaatgttttgcctctgtaaactgacatgtagaatttctgtaatatattt

SEQ ID NO: 717 - DNA, 586 bp, Zea mays
tgcagcatgcagaggagtaaaaggaaggagatgaaaacacgatttagtttactagcattttttgccattgttaaatttcctgattgacagtgtgtaagctagtggtctggtgttataggagtctttgttgagagattaggctatagcaatcggatgtaatgcatggtaacttcggtaaatatgcaatcaattgttatgtatgcttccaccaatgttaatgcaatgcttccaccaatgttaatgcagcattattaggcatgattcgtccaatagtggatacaagcctatcaactatgtctatgtgttagagcagtgctattattcgactaagtagccagcacaattccattttattatttgctaaataattctagtgcaagagatttgttgggaatttggcatgcaagaaattttttgaattggatttagaaggcatggaatatagcctcattatggatgtaatgtgaaaatcactctcatccaaccctgttcagattcatatatcattttctaaacatttaaaatccacggccgatgacgattaagtttatggttatttgttgcaggttcatttgggaggggtaag

SEQ ID NO: 718 - DNA, 1500 bp, Zea mays
cctaaagtaggccttttcttctatatggataaatgaattggagcgtaagcccgtacgacaattgagatattgggccgcccgagtggcattaaaattctacatggcgccgagtgggattaaaattctgtttcagaaagcaaagtgtatgtttatagataaaataaaattaagggggtgtttgaatacactataactaatagttagttggctaaaaattggtgataaaattagctaactaacaaatagctacctaactattaactaatttaccaaaaatagctaatagttgaactattagctagggcgtttggatgtttcaactaattttagccactaactattagttttagtgcattcaaacacmaccctaagaaagtgtttggtttgagggcctagttagacagagtggctttgttccagattgtaaaggggtgtttggttccaaggggatgtttggttcctctgactaaagtttatcgtgtcatattaaggccccctttggcagggctctctcggtggctctttttctggctcttcgtgaagtcataccaaacggtcttaaaaaatggctcctcaccaagagccatcaaagagttagagccgttttgctattgggagacgaagcacgagaaaacaagcttctattggctccttctatccggcacacaataatgtttcacgaaattacagtctctgccaccgtctcctcgtgagaagctgtttttccaaatgaattgtaaaacggcttgactcctctagagaagccagaaaaccagtggagccaaagccagagctgttttgagaatagtcggaaccctcctaaaggaggcctaactcatatggtatagtctacaaaggtggaacaagggggagaaaaagatctccaagtatatgggaaccttagctctgctcctggttcgcttcggagcaacgctgagctgatctaaagggagatgtatcttaacaagaaatgaagaagatgagggcctgagggacaccggattactggtagtggtagcagcaataagatagccaccgaatgacacgtgagcacgatcataagcctgagaagcctcgcacgcgcgcgctgctccggactagggaatagcaccaggccccgggcacgcagtgtggcagagcttgtctttcgcctttgcatcagaccagcagaaggacagaggagcatctcagtttccatgcagccaaagcccagaatctgagaatcccccgcccggcgcgacgtcagcgttggcccccacggccaaccaaccagcaccagcagtccagcaccgcgggacggaacgcctgcctataaatacccgcggcgcgcttgctactccacacctcaggcgacaagagagcaagcaagcacactgctcctccctccccagccgcagcacagcagagcagagccgagtttgctgctgctgacctgacaccatcgtgtgcccctctctcggtccagaaggacgcgaaccgcgctcgtagagtgtggcagca

SEQ ID NO: 719 - DNA, 185 bp, Zea mays
ggtgcgtgtagaacgacggaggcattccatttccgactgagccgtgtgtgtttggatcggatcggacaacccctgccaaaaccgcgtgtgccggcgctgttctgcctctgatcgtgtgtgctgctgttggttttggttttggtttggctagggaaggaaccgtgggagggaagcggacggacatg

SEQ ID NO: 720 - DNA, 1500 bp, Zea mays
taggcgtcacgtacgtcacttattatatgtacgtcacttattatatataataggatcagcgatcctctgccccgcgcgctatcgctagaggatagcagattaaagacaacagacagtgcatcaaaaacttttcagccgctatcatcgttgtcggattgccattcgacataccaacgatatccaagcgatgctatatagaggcacatctaaaattattattctgttttaaagtttataaaataayaaatgtaagatatagtcaaaatcaattacttcttatctggtaccattaaaaatatcttctaacattttgtgatataaagtcatcgattatattattgagatcaatctcatccaacaatttcttttcgacacatagaatcgccaagtcatttaacctcttttaagttattgttgaccttaaatagttcaaaaaatattttaattttaaaaatcttctctccgctgatgcaatcatcatgtgtatagtaaataatactatctctatatcaaaatagaattcgttttgcttctttagtggattcatcatcatctagttaaatataaacataaaaatgaagagataaaacaaatactattttagaacgggtggagtattcaataagtaattgagacatcagtttaacaatataaacgagactggtcgataacgcatcgctctttgcgtatttttatctaatatacatatgtttaacagaaaagtgctaccatccggtggttagagggccctctgtttttgtttttgggcctgtgcgatcgcacccttggcatccccctcaggtacgatgatttcaacgtcttcaaaaaaaatgttaattaagatagcgatttgggccatgataaagaatggtgcctctgtcaacgtgcgcggaacggagattgagcaggactgcacggcacgagcccaaggccggcgccgcttgcaagttggaagttggaaccgagcgacccaaatggcgcccctgtcaactgtcgaatgggacgcggggcgtcgtgacgtcggaagctgccgtgcggccgcagtgtcgttcggttcggttcctcgcaacgaaccacgccagcgtggcggtccgccccccaccgctcttccctcctccgccctcactggctcccgactatttctagcaccgccgcgccggatcgacacttctcatgtcataccccggctcctctgcttctcggttcccgccgttccatgtccgccacaaggtgcccgccacaaggtgcccctgtgtcctccgtccctctctacctggttccatgtccacggttctcatctcatgctaggcttcttgcttcatgcagggcagaccggcggcagaggttgtaccgatcgctctggcccacgtcgccggccggaccatcaaccaccgcgcggagcatcaagcagctgccattccaaagcccgttgaagcatcgaagcatttccagccgtgagcgtgtgcgcgtgtgcggtggcggcgcggccgggtcgccggg

SEQ ID NO: 721 - DNA, 70 bp, Zea mays
actgcttgattctgatgctgcacagcgtctaatccctgggctgtgtactccatttgacttcgcagtttac

SEQ ID NO: 722 - DNA, 927 bp, Zea mays
aaacaaccaatgtaattcatacagaatgaaaatattaataaaaagaaaaccggtgattattgaactttatcgtataaatgaaaccaaatttaaagttacaagtagtaactagaaaagtgaagttagcataatttaaaaatattaaaaatttggtgttgttggagagtaaggttgattttattcccaatatgtatttagcaatttactaaatctgagtttatgtagttttttaagggaattaatggagatgctctaagggccgcccatggagtatcttgcttagccggaagccaattatcgtcgttgaaatttcctcccccgcaagaaaacgtaatatcattgtgatgattttaaaactagaaggcggatccatcgaatcttacctaccatctaaacttacatctccgcatacattaatcatatgcgaggtgctcagcagcgttgtttacatcatcgcacgcgacaaaaaacacactccacgaatggtaatgtgcatcatcgcatctcgcggcaaattaaagggcacggccggccattggtgaatcctgcggggcccgtcagccagccttggcccaccagccgatctatagaggacctttaccccgggacactcatctagccttggaacctakatccgatggctagcaccatggctgacgcggggtcggggcccacgctgactcggccggcgcagcatcccgaacggataagctcctcccgcgcacggagctcggcgaagcgacacccgccgcgtgtccagggagcgctcccgccgggtcgcagacgcgaggtcccgragccgcgcgccccgcctataaaaaggcagccattctcgcctggttcccgcatcccagcacgtctcgtctccctcccaaaaaaaaaaaaaaaactgctcggttgctgctcctgctccgccgcgccggcatc

SEQ ID NO: 723 - DNA, 540 bp, Zea mays
ggtatgctgtagtaatttctccctatagtttttacattggttgattatcagtcggttacattgtaaatgtgatagaacatgaatcacatcacacaactaaggccgtgtttggtatggctctgtcactctatagtagctctactaaaaaaccttgggtggagctgctctactccagggttaaccagtggtgggtcaataactctaaactgcatgtctaggttgattttttaagatttcggagcagcaaaagaggtactycaaaactgttgtactgcagctttgaaaactccatggagtttgcaactctagagttagggtgtttggcatactctggccagcttctttttggagttttgctctgaagccataccaaacacgccctaagggtgaacttttacctccttatacacaaaagttccaaacattctaggttgattacagtatcattatagtttgtgattggaacttttgcataataattgtactaattaacacttctcagggattgttggtcgaatatctccaagaacttgggcagct

SEQ ID NO: 724 - DNA, 355 bp, Zea mays
cgggttcccttccggaaatctgactgccaaactagtccttaatgacacagttaaaacgaggaatataacggatacgcgacctgcggcccacctcagtaacaaaacgggccgaagataatgatccacggaccacggaccggcccatctcgtcctagcggcggcggcggcggcgtccttcaccgctccaggtccaggtgggcggccgcgaccagagtcgtgcccgagcccgactcgagccgacgaggagagagctcaggaggcggcggagagaagggagaaaatccccggtagggaggggggaaggaagccaaaggcccaaaggtctcggcgctgccgtagtaccggctgaggcaag

SEQ ID NO: 725 - DNA, 805 bp, Zea mays
cggtactacaaacaggcccgggctcttctctttgctcgcctacagcagctgacaccttactgaacctatccgctgtggtgctgcaatagctggcgcacaagtgcgtcgaggatggcggcgtcccagcgttgctgctcctacctcggcgccggtggaggtcgtgtgcctcgagcaaccaccgtcgttgaccaagtggatcgagttggcttcctggaatcgttttgttgttttcccttggatatgttttgttgttttttcatttgattaatgtttgtttatatttagaaccgggaaataaattattaagagctagtttgataatttattttttaagagatttttattttctaaaaattatttttttaaaaaaaggaagttgccaaactagttttwattgtagaattcgttttgaaaagaaagagttggtagctgtgatagccggaagaaaataaaccgtttatcaaataggtagtttggagaaatgactaattgtacgacacgactagagactatagggtcatgtctagattggtgcttatacatatttgcagtcacgtacaacatctaacgatagctttaggactgatttggtaataataaattccaatttactggtcacatttggctatcgcgagttcgcgacactgtcgccccccactcccatcccaatcgtggcgagctgaccaaaacccctctcaaaccctcgcccaccccgagcctgtataaaaagctctgcgttcctccaccctctgaacgccatccgttccatttcttatcccctcccagtcccagccatcgcctcccg

SEQ ID NO: 726 - DNA, 472 bp, Zea mays
gaacgaagtaggatttttgctgtccaaatgttaggttctcgatccaacaatgtgttaattaaattctttatctgcatggctgcactgcatagaagctgtcaaaatccattactacagctggtacacacttcgagcgtaccgtacgtatattccattgtgtagagcagtttggtttcctgtgagtataaataaatatataacgtttactgtttcgtcgtgtaataaaaataaaataaaagtcgtcttgccgcgccgttgacgtaagatttgcacggcgccttccactctgcccctgtccctactataaaagcgttcgccccccgtcattttgataaaaaccatgtaaaaatatatctaaataaaatataaaataaaaggctcgacgtcgtcgtcacctctctcgccgtccacgagtcacggcgggcgggcggcggcggcggccgggggtcccggttgcacacggctcgccacc

SEQ ID NO: 727 - DNA, 1500 bp, Zea mays
aaatcccaaatatctcacacttgtgagagtgcgtttttcatggtttcgtgcgtcgtgccgggcggagctgtcgccatttggtagaacagaggccggagcgggtggataagctctgtgtttttctaacaatagcctataaattggcgtgcaaaacaatattttgtattttttctattcttttttatttatcacgatttagtacaaaaatagactaacgatcgataaatattcgagaacagatgtagtactgtttataaagtagagattgaaatagagagtggaatatagaatgtgatatgaaggccactggatataaccttagttagatagtggctctatttcaattctaaggatagaatagttctgttctagttaaaacgaaaacattatgtttttgtttggttccaaaataaagcaaaacaaaacgactttattttatgtttggttttatagataagtagaacagaaaagaggctaccgacaaaaatagggagaggggtgcttggctcgcgagcgcacatgttcgattgtttttagggactcagagatgcaacatattagatgaatattttacttcgggagcagcacgattccacctataatcaaattaaacatgctataggctggaacggaacaactcggttctacctaactctataaccaaacattacctaaatgctccctttgcaatcctaatcctagtgtgatgagcacacgtagagtgctcccaaatcccaacaatatgaactagtactacatagcttataaatatgggcgagagacaatagaaaggagttttctatatcatgttgtgatagaaagatatgtcgtcaaacatgtaaggccttgttcggctattactatctcatgtagattggatgagattggaaaaaaactataaggtcccgtttgtttcctttcattttaaggaattggaatcttactaatggaaataagctatttttttagaatgtgacatttcaccactttccaaagttattatataagcttatctcaaattcatagggtgagagatgaaaattgattttatagatttgcatgctatttttccaatgctcaacttatagcacactcttctacttactttgttataacataaatgtagtatataactatttctctcatataatttaggataatatataaatatattatatatttaaatatatgaacttaattagctttgtataaattataattattaaaatagaatttaattccaacgaaacaaaatggggcttagaaaaaaatgagattcccaaacaatcgatgtcagtataatttatgttttgtgtgctgtcgcgtacggtcattttaccccttgcactgctggagcgctggcgtagaagaaacggatgctcggagcctgtaggcaatgcctttcacgtgccgtgggcccacgttcttctaactctaattttccctttaaaataaccaagtaactgcacttctccccgattttccattcgaactcgcatc

SEQ ID NO: 728 - DNA, 1500 bp, Zea mays
ttcccgattaatttccttgtccccggtccgccgccgccgtgaccgaattggctcgcacgctcaccggcaaccgccaacgccaaggccaacgtcacgtcacgccaacccgtcaggcgtcagcaacaaccaacaagaaaaagaaaaagaaagctccaatctccttcgacgcgagcgaacaactgcgcgccgccgaaagtgaccggccccacgcccgcccacatgcgcgcatgggaatcctctcgtcagcgcggggtcggctcattcacgggcttcacttcacatcacggattcacggctcaccaccgcccgccccaccaccgccagccacccgccgccccgccccgcgctgccgcgaccgcccacatgcgcctgtgtccgcccgcccgcacggagacggagccccggacccggacacagtaaaagcacgggacgggaattctctcgtctgcgcacggctcaccagtcaccccggacgacagtgcgcgcccgcgctgccaacacttaccccacctgacagtcggatcgagctgcccgcgcctccgtcccgtcgctttccatgatcgacggcgccgccgaaaggcccagggaatttaccccaatggcggggaatttcggcgtcaggcggggcggggtaacgagggaaacgaaggaggaaaaaaaaatcggggcccggtggggtcgtggcaagcgctgggattggtcggcgccagctcggccactagcagggggcaacgtggtggtggttcccgtccttctccttcccttccctcccccaccgggccccagtccccttcgcgctgcctgcccccttcgatctcctgctctctttccccttctctctctatctactgttcttgcttgagctgcgatcctcttcctgaggcgcgggcgttggatgtgatacgtggttggctccgcgccatctcctccggtggcgatgagctccaagtccacctgctgctgcttatgaggtatggtgcttgcgagacttgtccatggttgcttgcttcgttttgcttagagatgctctcgccggggcagccagttgggctggtatccaagcaacctaggattggtagaattcgagcagtttctaccagtttccaagctatgtgattaaatcattaaagtgccttttcaaaattatcttctccatgtagagatagagatgtattttcagttcatgagttgtacagttcctactgaagggagacctacaacgtgctgaaattctgtgttcaagaccatgttttttttattttattatatcaactataataaatttgaaattactttcatggaagtgatttagtggagtaatctagcatgagggttagttccagtggaaattcatcaggagtgtatcttgttgggatcaagtctgtatttcctttcggtgagcgtttttttccggtccatcatctataacaacctacgatcttgtttcagatcttgctgaatgaattttgtggtttttgagccatcctggtaaaccttggc

SEQ ID NO: 729 - DNA, 72 bp, Zea mays
agatttgggaaatgtttatttgcctgctgtagtgaattaagaaattttcatgtccctattttcttatttgcc

SEQ ID NO: 730 - DNA, 184 bp, Zea mays
agatttgggaaatgtttatttgcctgctgtagtgaattaagaaattttcatgtccctattttcttatttgccatgtttataataattatgctccgtctccatactgatttctcatttcttgagatgaatccgttcgccatggtcaacagggagccatatcctctagacatcagaggagaactag

SEQ ID NO: 731 - DNA, 544 bp, Zea mays
cctgcagatccaaactaagttccaattagttcgatttttatatgctgagagaaattacaattctgttaattctgttaatgtttggatcaaaactgaaaactgacggcaacccaattggggccaagctaaaaaaaatgagaaccaaacaatgtgccatatgggcctagctcattttgaccaggcaaccaaatattttgaaccgtctctatagatacgggctctcttgagcctggttctttcaatgagcctgactcaggctgggccaagcaaccaaacaaatcctacgtgtcccggcagataacgtggtggacaaaggtccaggagactcgatgggccgacgtgctctgctggaccaacccatgggcctactgatgggcacaaacacgggctggccttctggttgcggatgggcgtctgcagctgtgctgttcctttttcctctggtgagacttcgcgattcgtgaatgcgcctttccgttccaagagaaggaagagaagccgcagcctccgcgagggcgagacagctcggcggcgtggttcgggg

SEQ ID NO: 732 - DNA, 695 bp, Zea mays
tgcagatttagctaacaaatcctaaaagaaattcggaaccctaattgtccgcatgctagtttcggtatccaaccgtgactaaatctatacaatttgggacatggtctagaagcccattgtaggtagaattcatcatgataactgacgaacagtgtttgtgcagccaaaaggggggggggaaagaaaaaaacactgtgtttaacgaccgaaccccaagtgagaacagacggcgtctccacagaagaaagcatggatttagaactaacgcgctgtcgacgtggtgcgtgtttagaaaagttatgaaatgtaaaatagaaatcgagcgcgggtggcagcgctggacaggccagatgcaccaaccacggcagagaagcgcaacgagccaacgcccgtccagtagcggctgccaggtgcaccccacccgtctgccgcattcgttaggttttcccgcatccgtccagtaggcgcgtacccaccccgaaatgccaaaaaagcgaagctttgcagcactccacaccgacaccgcgacacgcgaccgcactgcctttaaactacgcactcaagtaccttcccggactactagctcacaccagcggtacccagcccacaccggcagatcagctgcgagctagtagacatcgaccggaccgaccaacaggagcagcaagccgggctagctcgctcgctcgctcgca

SEQ ID NO: 733 - DNA, 1402 bp, Zea mays
gagcggtggagtgacggcggtcacctcggctctgccgagggcgcgtgtcaggatagaggtgtcaggccacctttgcgttaaatgcccctgcaatttggtcagtcggtgtggtgatttagtcaaggttgcttctgagcgaagtcaaggccttgggcgagccggtgatgtgtccgccataaaaagggggcctcgggcragacggaagtctctcgaggtcggctgcctttggccgaggctaggctcgggtgaagcgtgatcgagtcactcgtgtggactgatccctgacttaatcgtgtccatcaggcctttgcagctttatgctgatggggttaccagctgagaattaggcgccttgagggtacccctaattatggtccccgacaagagtggatccagctggttcactcaaacctggtraatttacgttactatggctaggattggagataacataaggctttgttccggaccatggagagaggagaaagtttaaaccggacctattttgcttccagtttaaagctaaacgaacggttgaaatgaccccaactaaattccaaattagatcaatttatttcaactggaacgagcctcraaccaggccaatccggtcgatacgaccgggcccttgcgtgggttttcagatggactttgaccgggcccgtgcgtgggttctcgcggcgcaagagcctccgtcgtcccgtccgtcgctgctgtcatcctcatccgcatccggcgtgcagtaggagtgtaggacgctaggataggattaggaccacaacgaccgcatcgagaaaggcgacgagcccatccgatcgctctccgccgaacaccgtgcattttttgctctgttcgttgtatcgtgtgcaacgtaccccgcgccatctagatggatctcgatcacacatgcatataatgctatgcaggcattatataatgttagcagatgatgatctataatgttagctgatgatggccggttttccatctgcatgcatgcaggcagatgacgatcgagcggatcggatgggcagacgccaccaaccccgcccgcccgacgtgaaacacggtgtcgatcagcagggccgggtgggtggttgttgtcccgttcgcggggcaaccaacagcagcgggcagcggcgcagaggatcccatatcctatcctgacggacgccgcccatatatgtcatgtcgcgcctcgtctccctctctgtctgtctctacactatacagccgggccgcgtccatacggcacgtggtggtgcgcctcctccacacgtacgtactgtacgtacgcttccccgcccgtctcccccaccgcttccaggcaacatatatatctgattcgagagcaggcggagttgcggattagctgctggtccgatccagaagctcctagacg

SEQ ID NO: 734 - DNA, 55 bp, Zea mays
actcttgtagcagcagctagccacggaaatctttgatggttcctcgttctcatcc

SEQ ID NO: 735 - DNA, 936 bp, Zea mays
ttgttttgatgttcaaatccctagcctctcggtttagtccatggacactcctctataggctttctccataaagcttgatatggatatccatggtgtaaatattgatattgacatattattttagaggcgcgattgttgaaaatatgaccatttgttgtattgtttaaatgtcgttgagattgagtttcatacgatgaggctaaagttttcacatgtgaggatttaacaccaggttattgtgcataaaaaccaagaaacattgagagaagtgaaatactacatatgattgttgtgatgctaatttgatggttctctaataaggttccttaaaatagtgacctaaaaactaaatactacatcatttaaattgtttaggatattaaaagcaaattgagctccgtctaacagttaagccataaatcatatattgtagaaaatgaattacattattagaaaagaaaatattaagaatgatatagaaaataaagagattggcactaatctgatgtgtaatatatttagatcacttcacggtatgcatatattttacgggtttttacatgttgcacctcctcaacaaatcaaacggtctgaagagagagagagagaagtgcgtagtttagggtttgctgacggtgtacgtatggcatgtgctagagaatcgaagcttgcgtcaggccggagtcaccgtcgttcttgcgttgtgttgtgccctttccttggctgatgcgtagtacctaactttgcgttcagccggagcgatcgacgccggttgcctttgtctcacacaaggaacatcgcttcatatgcggccccgcgccccggccctatacacatgcatatatcgcctggcggcagtgcctatgcatgtgcacgcacggcaaacgtactacttgtccgacatcgatccaaccgtcataaatcgagcgggactcc

SEQ ID NO: 736 - DNA, 103 bp, Zea mays
ttgaacgcagggcgtcgtcgcgccgggcgtctgccagcgccgtccggctagccatcagtagctagtacgtagtaccagtatagtttgcagagtcgattgcgcc

SEQ ID NO: 737 - DNA, 819 bp, Zea mays
ggcaagatcagagtcagactagaaagttgaagcaagagtaaaggagaaggctaattatctgtggcttgatccatacaggagggaagaggaagagaagtcaagcactcaagcctcggatcctatctgttagtaaagctgacatgaacttccacttatagatccctgtgatgcacacaatgcaagggtgtcaatcgtgtcagtatttgatgatcatagaagatttatcaacgaatttcttcaatcaatacaaggaaactcacttttgcaggcatatcttcgtatctttgccttctaccttcattcgttgcaaacatgcttcaacctctgctcatctcagttctcaatgagtttttttttctttttctcatrcccagatgtaaggaactcatgttgctraggcaagtcgtagttatatgagttggccagcggatgctttgggatgagtccttttgcagctcaccaaagctccagctttcaattggcttcctaatctgtttaacatggctgtcttttcaaataagtatatgttattgactaatccgtttgcggtcaatggctgtagtgtggaaaaggatgactatattgcaggactatacaagaaacatcccagaaagtccaaatcaccaagccgcaaagctagaaatcttccaccacggttatggggccatcacgacaaataattggtggtcattgattccaacaaggttttaaatcttgtagacgcaaccttgctttgcctgctgccattcttctgccacgcaactgtctaatttgtttgctgtagctttggtgctctcatttctcaactatggaatcacg

SEQ ID NO: 738 - DNA, 174 bp, Zea mays
catcgaaaatacagtcaaacatgtttgaggacttctgttgctctttacttagtgcagactgttttttctctagattttctgctggttatcgtgggcagaccttcctatgcagtccaataatatagtgcagtttatcttctctatttccatggcttcggagttaggagatggctc

SEQ ID NO: 739 - DNA, 1477 bp, Zea mays
agaagaggatgtagaggagatgagagcgggttcagaagctagcggagctaaagcctaaagtcgagtggtgttgaacagtgaacatgagcatttgttcggtgtcatggacccagttgggctgtaagtggcgtgtgtgtgtgtgttgaggagtttgggccagcctagtaagggtgatatatatgcttgtaaccgacttaagaaaggggttaagaaaataatagagaactcgcgacatatcgtcgtgttgccaatccattgcggcgaacgcgtgctcacgttgcggcgagctccctcgccggtggccaagagccattacaaaatagttttatgacaaatctcaaattcaacagtaaagccgattatcttagatctattttttattaatagagctatttcaaatgtaaacatattttatgctcatcgaaccccgtgttcatatttgcactttaaatctggtgcattcgtgagcaattcaacattaatgttggagggggtaaataaaagtttactatcaaaactgagaaggaaaggtggtaagtgaaaaattacctcgaattactcacatacctactagattttaattgctcatatgaatagtctaatatgagtacaaattacgttcccatttcaaatatgagaacatatgaagtgcacataagcctttgatgtacatggtgtacatattaaaatcatgttcatccatccgaatccaaaggtctcctacatctatacttttcatgtatataagaggataataatggtcgagagtaatagtggtgggtgtttgttttacaaaatatatagagcaacaagtaatgttggacccaaaatggggactatgtgtaccaaagccttggctcatttggaatgcatgaatttcagagaaatcatacaagaattttacataaataattttattttcactagaaaaaacatagaaagaaaacagggaaaaaatcccgtatttcaaagggccctttatgtgtacctcacatattcctttcaaacagaccttgtagaggccatttgaattcctgtctggctcgtcgtctctttatagattcagacagagcaagaaaaacgaggcctgatttcttgcagggcgtgcggcggcagcgcatgcgggttctctccttccccccttcctctccctctctccggacaacaccctcttcccttcttgcaccctcgttgttgttagattagagtaccaatatatagttccccacatcggccaggagcccaggaatcctcgcatcccgacatccgatttctctccctctccctcccttcccttcctctgcttccggggaggaggagaggaaagagacgaagggcgcgccgggaaggaggaccaggaggggaggcacacaacgcttcctcttgcacgcgggagtcctcaagcctcctccttggccttggctccaattcggggtgccataacacgacctctgccggcggccggccaccggcaccc

SEQ ID NO: 740 - DNA, 621 bp, Zea mays
tgcccaataataaacccacgagtataatatttagtctatatatataccctaatggagtaaatacctatcgggtatcaggtcgcgggtacccattgccatctctagatatggataagacttctatcgtaattattggtgtccgctatatctgacgcaatattgtggatgcataaggatatagagagctatagcggaaaccgttgcacatatttttaagctccagttacctgtatgcgcgtttaccggaaggatttctgtaggccagtgcagataccctaaggaaagggagagatatttcggtccaacagggatacatgcccacttatcagactagttaaacatccggatgtgtattttgacgaagtgatctactcgattgacctatttttacaaattcattgtagagtgatctattttggtaaattcaatgtgccggagaggcccaaaccgacgagggggggttctcagctctgggcagtggccgctttgagtgggccgggccgcaccgcgcgaaacgatgagatgggatgagccgatgaggccgcatcggtgacgacgatccaattccaatcttagccagacccggaggcagcagcgaccagcgagcgacgccggccggcc

SEQ ID NO: 741 - DNA, 241 bp, Zea mays
ggtacatactcttcacatgctcccatgttcttgtgagatcatgatgcaatttctatacctccaaatatttataacaacaatctagtgtgctatcgctgcattagtactagttgcttgtagatagaggctactaatgtgcagatatctttatttctatggtaatgagttaaactgaaatttcttgtggttgtgtatcacttgagtaggtaagaaattctggaacctctttcacttgcagcct

SEQ ID NO: 742 - DNA, 1050 bp, Zea mays
gctcagtttgggagcaccggacagtgtccggtgcgccaggctggctcgagcgaactggccgctctcaggaattcaccggcgacgtacggctataattcaccggactgtccggtgtgcaccggactgtccggtgagccaacggtcagccgggccaacggtcggccgcgcgatctgcgcgggacacgtggccgagccaacggctagaagggggcaccggactgtccggtgtgcaccggacatgtccggtgcgccaacggctctctgcctgccaacggtcggctgcgccagttaaggaaagaaatcgggcaccggacagtgtccggtgtgcaccggactgtccggtgcgccacgcgacagaaggcagggattgccttcccagattgctctcaacggctcctagctgccttggggctataaaagggacccctaggcgcatggaggagtaacaccaagcattcctagagcactcttgatcactcacactccattcctgcacacttgtttgacattctagtgatttgagatccgttctagtgtgctagtctcttgagctcaagtctgggttttgcgtgtgcgtattcgctgtgatctttgtgtcgtgtgtgagttgctaatccctcccttgctctgtgattcttcgtgaacatcttgtgtaagggcgagaggctccaagttgtggagattcctcgcaaacgggatattgaaaggcaaaggaaaacaccgtggtattcaagtgggtctttggaccgcttgagaggggttgattgcaaccctcgtccgttgggacgccacaacgtggagtaggcaagcgttggtcttggccgaaccacgggataaaaccactgtgtcactctgtgcttgattctcttgtggtactgtgttttgttgagacttcaccttagccacttggcaataatcgtgctaacacttaacaagtttttgtggcttaagtttgaagtttttacaggatcacctattcaccccccctctaggtgctctcaattggtatcagagccgttctcttcacaaagggactaaccgcccgaagag

SEQ ID NO: 743 - DNA, 975 bp, Zea mays
tgcgtcgtaataaacacaacaaatccattatttggatactactacaataatataataktgtgaactatgcattattcacatgcattaataaaatgtgaatccgtaatagtcaaaattgtgaaaattcaaaactaggttcaagttggtaagaaaacaccgacaagaatagaaaaaccagtagttttaccaagtaataagaattgcttagagtaaaaggctacctctagttttgggttgttgttggggtttagaaataaagattaaaactraatgtcagcaattctagatgcctaagacctcataaataaacataagcaccagtacttcaagctatggctatgttcatagtaaaattaggtcacaggaacgcaaatgtaaccccatcatcttagtcaatttgtaacctatttaccatccgactttttcgtgtactaagtttctaaaagtgaaccgatatacgtgtggctagtgactagacatgcgtacaccgatcatcatcgtatcttgaagatttgctatcattaatttctctcgataaatccaaacacaaagatttgttgagtgtgctcgttgcttcgccgctcttcaccctccccattgcctcgatcctatataaagcgacaaccgaagcctgtttgattcatctcaaagcctttagtgccttagaaaaccttcccataaaaattagatagtgctataggaaccgaagcctcatcggtctttggtagcctacaagcccttccatgagaatgggcaagaccatgtagagaaaccatagggtttttagatttgaaccccgagcaagagcgccacattcactccaaggacaaggagggcctgcccctcaccgcatcactctgactcaaactacagtcaactcgcataaacaaattatcttctaccggtctaccctaccctccctttcacagaaggtcaaaactcctgatcccaaaatccaaagcccaagaaaacaaa

SEQ ID NO: 744 - DNA, 95 bp, Zea mays
ggtataatacgaccttagcctgtatgctcacgattcacttccaagtgttctatagaatgtaggtatgcttgtacattcgagtttaatgcgatgcc

SEQ ID NO: 745 - DNA, 1500 bp, Zea mays
gggtgacccgatgggtgactcatacccacatgggtatgggtatggggataaatccatacccaccagtgtatatgggtgacccggtgaggttatttttatgtcgtgattatgagtatggagtagtaatacccggtaggtatttatccattgccatctctagtttcgacctgttcttcgatttgaaatgatggcattcaagtcaaactcaagatctgagtctctgtactgtgaaagattgacaattgttgtcctgttcttttccagtgaataccagggatgctgcattgctactggtcatcgtgttgcccagagagaattttaggccaagaatccatgccaaactaatggtttggttactttttttgctgggccacatgtcacagggtacaaaagtccatatcagtgtgttgggctagattcgagccttcgaaaccgacccagaacaaagatgttcgttcggcccttgaaatagccatttggcgtttgcctccacctttcccgtctcgtcttcccccttggccagaaatggcgagatatgacagtatgacgcattcgctgatgccataccatcgacggcgcgtcgtccatccttgccacagaacgaactccatgccgaccggtgaaagcgcaagtgccgcaactatacgtcgagagagatagagagagagagatcgccgcatctgcttgccgtgccttttccgacgcattgtgcttagcgtgatagcgtcttgcctgcaggtcatgtcatcccaagcttttccctttttttgccgttttttccattgcagagatctttttcctcagcactttgtttttccgctggagatatctctctctgttctcatctgccgcgtagctgggggcgatcaccgatcagatgggaagcagatgagaagttgagaactaggcgctggaagacgccgaaaaggtgcggccttttctgaactgcatcttcacgagacatccttgagcacctttactctctcctccggcatatccccacgctctggactctggagtcaactacaccagcgcttgcggcttgctcctcaagggtgcgggagaggactcgaggaggaagaaggacaccgtctcctcctcgtgcctttatccgctttcgtgccgtctgcatcctccaagaagctagctagcagcgcgggcagcagctgggtacgcatgttttgtggatagggtagctaccccgcagtacacagggttgttatctatctgggagttgcttgcatgggcgtgggagtttgggatcttggttagcttatgcgtggtgaagatactttgctttaatttggggtgtgaagacctgtaattaagcatcgtgagtgtggtggtgacggcggcggcgcagcgagcaatgccactggcggtggcgcggccgtcgtctggcgtgtcgcgacgccatcggtcgtgctggtagtgcagcggtaccgtcgccggcatgccgcgcgcgacgtcgcgcaacgagtcttgatcctggcgccccac

SEQ ID NO: 746 - DNA, 835 bp, Zea mays
agcggcggaggagacagctcaagcccgagtacacggaggtccgcacgtggatggcttcaagatggcttcaagtttggttacgctaggacttgaggtttattagggctagaatagagttagctagagtcgaactctgtatcctaggggggtcataaatatgaggcaacccctgttgtaaccatgagacgacatggcggctggtttaggcggtggcgaggctgcgagatcatcacggcgtagctgctgttttatgggaaggagcggcccgtagtcctgccccgaggattaggcatatcgctaaacctcgttaaaaaacatcgtgtctcggtgtcgtttttgtttgcatatttgcttctatgatggttgtgcttccgtgtttatcggttactagatccggttaagatattgtcatgactcgacacgatatataacagctgcaaagagaacaaaaatcgaaggacctcacgaagctggtaaacgaaaaccatccaacagtgctttgagcatggcatatgcatcatgcatgcatatggctctttattctagaaaaaaaaaaaaagagagagagagagaccgacgacgaacaagagcaagcaccgaacagagcggccggcgacatttatttatctatttcttctctgacgaagctggaaactcgacttggcatgcatgcttgcagcagatcgacgtacggcggcgtcccatgcatgccgtacgtcagaagaagacaccacccagcaacgccgcctacggcgccggcgcctccgggcagctggtctggcagaagtttgtgagaacgtcatcacagcggtaggtgacgacggggccggggccc

SEQ ID NO: 747 - DNA, 1072 bp, Zea mays
gctgcatcccatggtggccactgcagtcacggcgggactggcgggtcctccctctctccggtgagtgttcgtctcgttgtggggctttctgatttatgtgacatgcctacgaagcattgaggtatctttgtggggctacgaagcatcgtgccgtgggcgtgaaggcggatcttgaccttgctcacctgctagaaagccgctcgcttagctccaccggtcccagctgctagcaccgccaacctgctaggcactccctcgagccgaaggtgagggccatgccctacccattttttggttagatctaaatttccatggaggtgagcgtggatgaggtcaggtatgtcgcctccttctcttcctccaccggcttctacacgctccaggctagagctggtgttgccggccattccttgtgctcgacctcgcgtctgcgttggactccgcccctctgccaccgtctccagcgccgacgttgaagcccattgtccctgctcaccctggcgagcaggctacacgccagctttattacattctgacctgtgggagtgtgggcagtgttttattgagtagcacccagaatggtgtgatgttatgttagttgggtcagatacgcatgcagcatccttgcaactggatgcagtcttggtttggagccctttcttttctctcataaagcaaatccatttgttgagaaaagaggtatatgattggagatgtagttgactgttactgaatttcactactctgagcttgtatattgtttcaactcattatactaactactccctccgtatttcttttttgtcgcggtttagttcaaaaatgaactagcgtgtgacaaatattcgagaacggaggtagtattattttctacatcttctccctctactcattgatgctctcaattctgaatagttcatctacaaactttgagttctgctatataattaccatagtgtaatgcaagtctcccttcttgaattttgtaatttgaagtgaatagcctgtttatctagcctgaagtgtacagacttatttgatgcatttttctaggcagtgaaaaaatgcatca

SEQ ID NO: 748 - DNA, 395 bp, Zea mays
tgcatgcctgcagccagctcctcccgcgctgcatcactggacaggagaacctccaagaaaagaagccaccgtttctgaccgtcgaagtagtctgagatcatttcactgctgcttggatgtgctgtccccgtcggcgctttgttattagttgtctgtgagttattacagactttggcatcatcctgctactgtagccccgttccatccacccatcaaagtgatgaaagctaaatttcgatttgatgggttgaaaaacaggtccagtcattactacgaagttttccttttgaaaaagaagtattctaaattccacacgtccagtccaagtgttcttcatcgtcatctacacacacggtatttccttcacattgtgcttccattccaagcagcctcga

SEQ ID NO: 749 - DNA, 890 bp, Zea mays
ggataaatcatggatcacaagtgaatggttttttagggagacaaaggtttataaacaaggggtgaattgttttctagtttttttatgattttttgagtaatttaaaaaaagtgtttgttatttatttacctttggaatgatttttgattgcttataattgattttttggatatttaataaacatttcttgttaaatgaaaatcctagtaaattaataatataattattagttccaaaaataaatattttatttataaatagttttgagttaattgttataaattttatggttatttaaaattatattttgaaattagaatggaattagaaaagaaataaaaaaactaacctaacctaagcccatgaaaccggccatgcccccaaccctagccgccactaccctgctccctctcccaagccgccgccactccttctccctccccctttctctctcttctccttctccctccccctttctctaccccgagcccccacccgaccgcgcctggaacaccgcccaggcgccccgcctctgcatccgcccgccctaggccgcagaagggagcattcgccgccccaccctccgtttcccgtcgcctcgcccccgcgctccgtcagccgcccctctccggtgagctctcagtcgccccctgaccttagccgctttcatttgagagctttgctcgctgtgaccgtggggtaggaggaggcacaaggccgtctgcttttgtcggcatggaccactcccttccactgtctcgattgaagcttgatgcgtgactactagctcctagtctgattttgcgttttgtttgcctgattttggtttacggactagtttattgactgccaagtcagctgcgggtttatctactttttatctaggagaa

SEQ ID NO: 750 - DNA, 95 bp, Zea mays
tatactgtcatgatcagttttggttcataagattggaaaaataaagttccctcaaataccatgacctaaatgagagctaaaccaaaatttctgtg

SEQ ID NO: 751 - DNA, 788 bp, Zea mays
accttccgtgagaacaactctcgctcgcacaaacaattccgttactgacaaaaaagtccagatactcgaaataagaggaaaggagacgcaactttacaacacggcgagggtgtgttttggcctcggtggccgcagaaaacacgcgctacaagataatccgatcctgcaggctcggatcttgacgcttgaagggagcggcagcaccytcagcgtcgacaacacyttcggcgaggtccgacctagcctcggacggcgacgcggtccgaggatctccactctgaaggacgacatcatcaccacgcccaggccatcgctgccagggtcttctctaggaatctggctcgagcagacggctcggccggtcaccccgaggcctcggccagctgtcccccgaagacatcagcacggcccgaggcctcgacaactcaattccggcgtcggtcccgccagtggacgacccgaccaggctctggccgaccaagtcttcttttcgagccaactctgcccctgtccgtgctgacaccgctacccctggcttcggctcatcgaagagcggccgaggggttcctttaactaagcaagagaagcctcggacagcaaggccgaccgagccgagggactcctacgcctccgggatacggatacctcactcgtcacctttgcacggggcgactcgcgcttggtgaagcggttcagataaccaacaggtgagtcttagtgctcgaaaatgaggaaaaaacacggctccgcgccaaaaatacatacatgttcaggccccgacagccaca

SEQ ID NO: 752 - DNA, 1500 bp, Zea mays
ttaaagaaaaccgaagatagattgggacattgagtaggttcgagaaaaaacttgaaaaacaaatctattgaatagagatacttgaaaaacaaatcctttttatttgcttgtgaattggcacattctaatttatctatctgctgcagttagtgataggaagcagaacactatttacaggtctgagaataagattaaagaaagagagggatttttactgttggagagttttaaagcacaaatcwgattttacccatttgtagcagtgttaatcatttagaacaaatcatgtatgaatgtgtcatacatgatatgtcgccamttgaattgttcttaaaaataatatacttgacagtgtgcccatgtyagtggaaaaaacatctctttatctttatgcataatatcagctgcttggaaaatagctgcattctcaagctatttgtaactactattactacatcaacccccacgcttctgcttcatcattagcaatatgtatgttcatcttctgactttggctcaacaagctaactatattcagacacaatttcagtcatccaaccattaaaatcacaagtgtggaaccaatagttttggttcgagaaaaagaaggaatccatcgttgtttccgagaaaaaaggaacccagcttttgctctttttcctgtaacccttgcttacccaaatttcatctttatcactcacacaatacgacgtatattgaaaacttatcactcacctaacagaaataccatcaacaaaccaacagcaatggggttgtacataaaaaacagggctacttgtaaaaggtgcatatagcacctacaccactacatgcacatatgaatgcatgataacttcaaagttagcaagttaatactgaatagagcattttgtaaaaggtgtcacgtagcaaatatcagaaagtgataagaacagtaaacagaaaccaggggggggggagaagagtatataccaataagcatgaaatcatgcatagaacagaaacacctaattacagggggctagagattcattagcaagtcatgcctgatatggttctttctagattgtgaatatctctgcgactgccatggtcggttacctagctctgagcctcgcctccccatggcattcaagaagcctcgttgccagggcggccaacaacaaccccagatacagataccataccattacgtactagtagggtcactcactgcgcccagaagagaagtgcaggggcccgggccagggcgaccgacccaatccacgacgcccatttccgattcttgccgttttcgggcaggcagccagtccctttaaagcaccactaggcaggcactaggccggtagtatataaaataatgtcctactcctaccccgccaccacgccgcggcagcacaagcccctctccgcccccagccagccctcctcagatctcaatcccggcgctccctccctccctcctcgcctcgggacagcgagcgccgccgtccgccgtcc

SEQ ID NO: 753 - DNA, 463 bp, Zea mays
atcgcttattccattggccgtgttgtaccataacatattgcataaagtaaataataacatcagttagccaaataaaaaaatattatacgtaaagtagaaataatcaataaaaaattttacatgagtattgttgtaagccgtcggactagcagcttactcgtaacggtaaagccaccgacccaactggtctcgtagccgaactgcaagagggaagagaagcatcgcatctctgagtctgaaaccctagccgcctgtctccctgtccggtctccactcgtccgggcgacgagacgacgacggaggtattcctctccacagctcctattctggatttccgacttccccacagcggatccttcgttgctcgtcaaaaccctagtcccggattgatccgcttcccgttcggtttcttaatagggtttctgcgggggatttgtttgtcgctgactcgccggcgaccaag

SEQ ID NO: 754 - DNA, 598 bp, Zea mays
gcacgacatgaagatatattatcgaagctacaattgaaggagcttcggcataacgacatgcttaagacaaaggatggcacctacttaaagaggaaaagactaccgagtccctgataatttgtgttatagttgtaattgatgattagggacacaaatgtaattttgtctgggctgcgccccatgcctataaataggtgaacaatactctcgtactgttcacgctgattggtaaccattcttgtgtcacccttgtacttccatcttctgtaaaggcgaaggtacaaatgtcatataaacattatcgatgtttattcatacctataaaatgtcaatataaacaattgatgatttaatatgattgtttatattctttttatgcttcatatgtttctattcatatctttgctcgtaaaaatgaaggtatgtcattcatggccttcgtttgaagatcattatatccagaaggagataacgtttcgaaggacgaaggtctcttagcattaaaaattgtgttgctttgttcttggtgtatagcatccgagaacaaggacaaacattggcacccaccttcggtgaactcacttccactgttatgacg

SEQ ID NO: 755 - DNA, 505 bp, Zea mays
tcccatgtgcaccagatatatatatatatatatatatatatatatccattgttttgatcgaccttgttgtttctctattttttccctgtaaaataaaatctgtatatgttcctataaaacctccccattgcaaacgggccttggtcttatatcggccgtgcatgaaatgttgcaggagaactggagaagcaacgcggtggttgaagagatgtttggaaggatggctctacaggtaactgactacccgggctctggcccgaacgatcgtyacactcccaaagcaccggacccatgacgacgagacagagacaaagagacagcagacagtagctgcttacagagatttcaggctaatctgggggtcttttggtctggaaggaaatcgtagtagggacgacctgtgcaagtgtaaatatactgtacctgtgctgcctgaatgcccacgctttctgtttgtgtgaatgaaaaaaataagctgctgaaaattccttgaaaagacaccgag

SEQ ID NO: 756 - DNA, 374 bp, Zea mays
ccaactaaaagcaactgcttgacttatccccacatacagctagtctactacagccaaacaagatacttgctgagtatgttgatgtgtactcacccttgctctacacaccaaacccccccatccctaggttgtcagcattgcaaccactgctcaggcgaagatgaagttgtggaaggagacttctaggagttccaagactacgacgagttctaggcgtgggttagcggcaacccccagtcggctgcctgtgaaggccgcgtttatctacgtttctttttcgcagtttgatttcttgtaaagattatgtggatgtctcagacatatgatgtaatcgactattatttccctttttaatactatttgagcactgtgtg

SEQ ID NO: 757 - DNA, 267 bp, Zea mays
cccgcttcacgtgcccctcctctccctacgcttccccctccccgcctcgccgtgcgtgatgcgtcccacatgacccgcggttgccgacgccgtcaatctcgccgtcacatgccaagccttctattccgtcgtcgccttcatcttccgtcccttgtcttgctataaaacaacacaacgaaacaaggcgggggagaagagaagccaatcctccatcaccgccaccgcccgagccccgaggcctaggccctgatctctgcctaccaaaca

SEQ ID NO: 758 - DNA, 1471 bp, Zea mays
tgggatccaattgacacaacatgtcaagttcggggagctcaaatgacacaacattttaataagttcggggacccaagtaatggcacacaatatcgacgtctgatttaagcaaaaccctatattgaacgattttgaatagcccgccaagtttcagcacctgtttttcttcgggtttcaagagttcaaggaccgatgtgatacaacatgccatgtttaaggaccattgatggatgttactttttgaaaaaaaagtacttccattgcctcgtatcaatgcaagtggtatggtgcgtatttttgttctaaattatttttctctctctaattaataacatatttagttcatatccataatttgcttggaatgtctaacatatttagtcctagtgagcaacgtcggtagacgaaatcatttgtagttaggctatttcttactgtgtcctgttttatcaagtcgtttaattattaagaacattatttatgtaagacgtattattatcattcggttctaaaaatatgggtatgtatatgatttgatacgggttaacttagatagtgaccctagatgtcaaaaattacaagctccgtcaccaaaaggaaccatgccggtggaagaggctcgtgtatgatggagcagaggacctggggtccgggtggacatggtttcttgcgcgttcagagtgaaaacgaccgcaatagaaaatttgagggactcaaagcaaggctaataatatagctaattgctaattgtaaagatttttacagcctatcttttagcacatctgtatagtagttaacttttcactgttaatatatgacttatttgtctctttcacaaagtttattggttcttatgtcaaagccagctataaatttataactcgatcgctttttgagttttttctcctcttctcttctctacctcagtattcagagtatgtttacaacatattattctacttgctcttaaggagactcccagaccgaggagagatgtgagggttcacttaaatttgatggctttagtagagatatttattggatttttttttcttttgagggactagttattgactttgcaagagttgctcttgtcacaagcagatcactagggtccggagagcatgcatgtcctcgtgcaggacacagggcgggtggcaacttccatgtggtgggcgtttaggtgcacccattcggcgccaaacgtcatgtctcgcgctttgttggtcagctaataacagagcaacccccaacacgatctgactgaccagtgcctgtagctcaacgcccaaccacctactactatactcactccgatcttgtacctcccgtcctcccctataaaacacccctcccacaagcctcacttgcaccacgcaaaaaacaaacacactcgaaggcagcgaagcccgagccttcccttccctccaatcgatcacccgctccgatccgctagctagctagcagcgcg

SEQ ID NO: 759 - DNA, 1500 bp, Zea mays
tgtaattgctgaagttgttgtaagactgtctttaatggatcgagtaaaatagggatacaatattttagataatattgtttaacactgtttgtagagtaaaattaaaaataggtaataagataagagtagtatgggactctgggttgctgctagcaggttttctcaactcaccatatgtcccctacttccccttgggttgggttagcaatcctagtcgggggccatgtttgctccaccgttgccgcttggcccggcccggcggatgcagattgtgtggtgcgaggcccacacgtcagtcgcgtagccgctcagggtccacccggtggccggtgcggtgccgactgctcctcgcctgtcgcctcgcacaccggatctcgtcgccgccctcgcttctgtagtttgttcctcgcgagatctcgtgcgccgtccgtcctaccacgctgccctctgccgccaccgccaccgccaccgccaccatcaccacctgcgccggcgctcctctaggacgcagttcgcctccgaccccgactccaggtaggaagtcgtcgcctccttaaaggtcaacaacggctatggaggcccatggtcaaggggtcgtcgttaatggtggctgtctccgctgcctgtctctcgtcctctctcactattctgtttgggggtcgggctcttcggttatgggattggtggagatgagtagcgaatcatttcctcactttggggctccgatgatctcagatcgattacgggccccgatctgaatccccttgtccttttgatgtccaatctatttctatgatcatttgccacgtcttagactctctgaatccccttgccacgagaggagcactaatgctgcttgctctgcgcggttattctgttagcctgaccttgcgagcgatgtctgggcacaagggagcctggcgcgagatgatttaaggcattgccaaggggattcagtcctttctgctgtacattctaactgctgtaccatttatgaacaattcagtattcattttaggtcatgcctgtcccctacaggcctacaaactcttaggacaagctggattaaccccagtctatcagttggcaccaggcggaagcctcagttgttgtgtcggaacacaattttttcggcctctcttgttttgtaccgatataccacagcctagaaatttacttttgttaggtttcatatagctgcgagaagttatttgtcttaggacatgtgacactgtttactgaagcgagcacgttaatttgaccaaaaccagtgcttgctgcttgtagcatagggcaaaatattttaagaattcatcttcagttctgtgcactatccatcaattatatgtgtacagctgcacacacatttgcttcgcaaactcctatcagtcgtagcatgagctattgagcttactgacttgtgtccatgtgtaatggtcttgcagattttacatgcttctctagtagtccattggagtaattaacatcgattacacggtc

SEQ ID NO: 760 - DNA, 1500 bp, Zea mays
tcaccgagtcacctgctgtccaaggctccaagcacccgccaatcggccgctgccgaacccgcaaccggaacctgcctccaggctgcttccaccgggcgagggcgagggcgaggcacacgccgcaaaccgcagtaacgcacacgccggggcacgccgcacggcacacaacaaacaacgtgccctcgtaagcgtctcctcggctcgccttctcatctgctcctattggattttgcggggctgggcgtgagcgtgtgggctcttgtagcgggggatccatgagcagccaaccctagcttgcctggacgggaactctctacagctgtctttcgcgattctcctcgggcgtgggttttgttgcaggaggtgtttcaagctgcattgagccaccgtgcccggagtttcctgtctcttagtccttcgttcagttgcggatttctttgctgcgttctggagtggaggatcgacgtgctcctttcgtggctgtttgatgcttgttgagttcgagtaggttcgtattcctggttcggaattcagtaaggtcagtttctcgctgcttggaacttgatccgaggtgttagtttaatttctgagatatgatcgggaggggatcagcggtgctgcattttctcgggagattgtacggcgcgcccgaatcctgctctgcactgctgtttcctgaagtgcaaagagtgggtgtctattgtcttgttgcaatgcaactcatgtgcatatccagttctctttctgtccctaatgacttgtttgttttcgggggtatggttgccatggttgattgcgatatatggaaatggagggtggaatttatctctctactatctgctgtgtagtgggccattgctgctgttgacactcgacggtaggatcggccgttgccctatatatttgtgttattaggtctgtataggaggtgatgatgtttgtttaccttattactcgccgttagcgggagcgcgagtgcaaacagttgttagtctatcgccattagactccctattttaaactccactttataaccaatatcgtctacagtacaaaacagtgttttgcacacccgtttacacacccgctggagttggccttagcctcgtcacatctgttctacatttgtgtgcctgaaactctgaacctccctactggttactactcctattcatggtgctgtatttaaaaaaagaatctgagacgtcactctaacttgagaaattaggaatagagaactgctaaatctgacatcgctcataggtcttctgttttctgttctccctttatatggagctttatgtgattgctcatgattttcttgcttagtagtgtatctaattactgatatatgactgagacttcttgtttgtcattgctaggccctgcagtctacctggttctattgtgccccgacagaagatcctgagagctagagctgtttttttccctacatatagttaagttaaattatctgcacagccgaagatgtccgcgatc

SEQ ID NO: 761 - DNA, 1500 bp, Zea mays
cctctcacctgctcaccgagtcacctgctgtccaaggctccaagcacccgccaatcggccgctgccgaacccgcaaccggaacctgcctccaggctgcttccaccgggcgagggcgagggcgaggcacacgccgcaaaccgcagtaacgcacacgccggggcacgccgcacggcacacaacaaacaacgtgccctcgtaagcgtctcctcggctcgccttctcatctgctcctattggattttgcggggctgggcgtgagcgtgtgggctcttgtagcgggggatccatgagcagccaaccctagcttgcctggacgggaactctctacagctgtctttcgcgattctcctcgggcgtgggttttgttgcaggaggtgtttcaagctgcattgagccaccgtgcccggagtttcctgtctcttagtccttcgttcagttgcggatttctttgctgcgttctggagtggaggatcgacgtgctcctttcgtggctgtttgatgcttgttgagttcgagtaggttcgtattcctggttcggaattcagtaaggtcagtttctcgctgcttggaacttgatccgaggtgttagtttaatttctgagatatgatcgggaggggatcagcggtgctgcattttctcgggagattgtacggcgcgcccgaatcctgctctgcactgctgtttcctgaagtgcaaagagtgggtgtctattgtcttgttgcaatgcaactcatgtgcatatccagttctctttctgtccctaatgacttgtttgttttcgggggtatggttgccatggttgattgcgatatatggaaatggagggtggaatttatctctctactatctgctgtgtagtgggccattgctgctgttgacactcgacggtaggatcggccgttgccctatatatttgtgttattaggtctgtataggaggtgatgatgtttgtttaccttattactcgccgttagcgggagcgcgagtgcaaacagttgttagtctatcgccattagactccctattttaaactccactttataaccaatatcgtctacagtacaaaacagtgttttgcacacccgtttacacacccgctggagttggccttagcctcgtcacatctgttctacatttgtgtgcctgaaactctgaacctccctactggttactactcctattcatggtgctgtatttaaaaaaagaatctgagacgtcactctaacttgagaaattaggaatagagaactgctaaatctgacatcgctcataggtcttctgttttctgttctccctttatatggagctttatgtgattgctcatgattttcttgcttagtagtgtatctaattactgatatatgactgagacttcttgtttgtcattgctaggccctgcagtctacctggttctattgtgccccgacagaagatcctgagagctagagctgtttttttccctacatatagttaagttaaattatctgcacagccgaag

SEQ ID NO: 762 - DNA, 1500 bp, Zea mays; identical to SEQ ID NO: 760

SEQ ID NO: 763 - DNA, 1500 bp, Zea mays
acatagtggagaaaccgctttctgacggaccccgtttttccagtgtcttttttttcaactagatatggagacacacgtagttcatagcatatagcatgtatagtggtagtccatggcaggaggaatttaaggaaaacgcatcggatgttgacgacgacgagctagagcgggagcgggcccccgccggcgcaccgcacccggacccgggcaaggttgaacgcacctggacaggaacaggatagcatgcatccaggaccaggaccaaccagtgcaggaggcaagcaccaagctggttcatcggcaccacctgctgaatgccgacttctctttatctaagctgtttattaataataaataaaagtggacgcatgagaccatcatccatcctcgtatgaacgaacgaacggggcaagctatagattggaaagcagtgtgtacatatatatatgctggcttggcttctgaactttttttaaaaaaaaaatatattccaagcatatcctttgttgtcgacaggcagaggatcctgcgcctgagatgcgtgtgaaagccagcagttgacaggcgaaacagtagcatctgtcgtgatcgcattgataccgactgaaacacacacgtcgctcactgctcacagcacgttttgaatcttagctgttcatcgatcggaagacgtggtgcgattttgtcaattcaaatcaaggcactttccctaatttttccatagactggaactggaactggacgcagtaatgccgagcaccaaacctgcagatcaaaacagtccttggaggacgagaaagccagggccttcatgcccggaacagcggcggcggcggcggcggcggcggcacaatgcgcacgtggcggcgccgccaccggcccttggcgcgcgccgagcccatcgcccactgctacgcagtcaaaaccacggagagctttcacgatgacgaccggggcgtcccattcgccgagatcgctcgctcggattttagtacatttcccggatggaaactggcgagatcccctcgacaagcttttgacccttgcgggagttgggcgtcgcgcgtgggctgcagccgtcgtcggccaggcaggccaccaacggcggtggagtggacaggacagggtcagagccttttccacgcgggaaccttcgcggcagcgtcgcccccatcctcatccggaggagggcacggggccacgccacgcctggaccgcgcgaggcggcacgagctgggctacgcagcgcagcccatataaacgcgctccgagaccctccattcgccttggtggccaaggaggcaaggaaacaggcagctctccacggacaacgcgattctatttatttatctggctgccagccagccagccgcctttcgaaaccgagcacgagggagccgacgtggtggtctctggaacctggttcgagcgagcgagcgacccatctatccagccgcctgccgggaatttctgtgacgacgacgaggaggaggagggggt

SEQ ID NO: 764 - DNA, 564 bp, Zea mays
ttttcgaaatccgatctttctacatgaatgcaattgcgctttcaaagcaatcaaaagaaatgcaaggttcggcatggtgcatcaaacaacataaagtatttagggtttttcttacacgggaattccaaaccgaatcccgcttagaactttggaaaaggtcaaggtttagcgaagggaaaaagaaaagggaaaggtaacgcccgaattttggcgagtaaagaaaagaaaaaaaattcaactgcaaaattcggggcgttacacctagcctagggcgcaggccagccacgtcaacgggaagcgccatcatcaccctaccccaagctgactcgggccgcagggaacaagaccggtgtcccatctggccagctccgccagataggcaatgatggcgcccccgcacgctctgtgacgacggcggctcccagctctcttacggaagcaggtggacgtcagcaaggactcgaccgctccaacagctgtccctccgccaggcaccgtcgctcctccgacggccacgacatcacaccagcagggtgccaagatctctctggctgccacattggc

SEQ ID NO: 765 - DNA, 764 bp, Zea mays
tcggtacccctgggatatttagaaagtataggagagggtgtttgccgctcaacatttgttaggtcatagcgtcgtgcttgtcgcggccgattcagtatcctcaatatgctgtttcgtttaggcagtttgcttacacttggaatgtctagctccagtattaggtcctgttggcaaaatttcagtttcatcaattttattgcatcattgattactgtaatggcaacaatgtagtgaagtatttctgctagaaaacgtgcctcctaaattttctgaggaaaacagtactactaaaaggtgtaccctttataacatctgggcatctgcattgtttttcattctttactagtgaatcagatgttgctgtttatattggcatgttggcatgatgttgtttatattaacatagggcatttgggacagatgtattattaactccttttctatacttgaccgtaatcttgctctttgcttaattcacaaacggctgttttcagatcatttcaaaccttctagatatccgttattttttcatgctactttgtaaagcaccatcttcatcgtctctattgtgcacataagaaatctatgtagatccagattaatatcatgtcaagagaaatgtcaaaggtattgtcttctggtttatggtgtttaacaagtctttgtagatatgggacactgctggtcaggaaaggtttcagagtcttggcgttgcattctaccggggagcagattgttgtgtcctagtctatgatgttaattct

SEQ ID NO: 766 - DNA, 409 bp, Zea mays
gcatgcctaatttttagtagctaattattagttttaaagattacaaacaaagttttattagctaattattaactctaatgtatttaaatactctgcagtattgtttctgtagtattgttgtatttaagttgtttgttgcagtcctaatttataggacaaagcccgctatggtaatacttatggacatgtcggctcgcatgtcttcccgtctcaccaaacccccatatgattctgacggtaatagtcattcgccgccgctcctaatcctcaccatcatcacgtgcaattaacaaccctctccgaccaatccccgtcataattacaaggaagaccttgcttcccgttccccctcctctgcgttcatggtgctggtggccgtcgaccgccacctccgctgcgggggcctcta

SEQ ID NO: 767 - DNA, 434 bp, Zea mays
tgctcgcagtcactcaatggaggtcatacctgcaattggccgagttcatcatatacaccgatcacagcagccttacacagttgaattagcaaagattatatacgccatggcaacaaaaagtatataccaagttgattggtcttcaatacaagattgagtaccggaagggctctgataatactgcaaccgatgctctctctcggttacctcaacatacagctgattgtcgggccatttctcagtgttctccaacctggttacaggatgtgatcgacggttatgctaacgatccaacaacacagaagctcttgaccagtttatgtgtgcagtcagatgcctcgcgtccattccaattgcagcaaggtgtgattcggtacaaaggcaaggtttggttagctggaaattcagagttgcagcaaaaagtgatccatgca

SEQ ID NO: 768 - DNA, 1500 bp, Zea mays
aggcttcacgacgataaggattcgaagataccgctcgctctcctccttggtgtacgctaaggaatgaggtcgatgaaatcacggtaacacaatcggtacatcacatatttccaaagcaagtgagagaggaggaaatagaaaagagtattttcacgtgtaaggaagcctaattcattcagggcctaatataggtgcagctgccaatagaatctgtattaaatctcaacggtcaaaagattaaattattgaaggatacgagtggtaagaattgacacgtgccaagtcacaagtcacatggtattagggtggctatctttaacagatctcctatcccaactctatagttcagtgtccccctattttaagcaatctactggtgacagtcttacacacgaaaaatacgcggaaacacgcgcgtgagtctagccatgctctctgtcccattattttatctattcagacatgggaacgagcatagctataaaagttggtttgaaacatcttgagctagcaatgtgacactaaaaccaacagccactttgctttgaaatttcaacaaatcgggtctactcaaatgggctccaaaaccatcacacccaggtctcacgatttgccatttccgggaagctgcaagagtggcatgccgtaggacagcgaaggaagtcatatctatttgctgctttcgctgttttgcgttgaccagttaggcgattccgcgattggttcactagatcctggctcgtagtcgtgcccctgcgcccgcaccctggtccttctacttgtacacagcgacggttgctgcgctgaagctaggataaagttaacttttttccccagcgacggttgctccgtaagaacagaaaaaaacatcatcccatccataaagcttttttttataaaaaaaaacaggtagctataacttattaaactgttgacgaagatgtgccaaataggacgcactcgcagaaatgtgaattgtagaaatgtcgtcgagaatagacatatctatcagacaagacaagagcgttgcatacatactaaaaattgcagatactgtactgtatggctgcgccgcgaaccaacgcagcaagcaacggccaacagctagcctgcatgtgttgactggatcgcgctcgtgcatgcgattgcgtacttgttcactggctccacaccaaccaaatcaccacacgccaccataccatctcgttaatcgaccttctctcaccactcacctgcatgcgacctgtcgcctgtctgtttgtctttttcctacgtactaatatattcacacgtacaagccgcttgcaactcgtcgccggccggctgtgtgcagtgtgctacgtacgacgaacgcaagatcgattgatggagctaaaagtcaaggacgacacgcctgtttcctcaccagccgctgccaggcgctagctatagccatggttgccggcctagctggatctggaagccgaccaccgcgctctcccttgcgctcccggtcccggc

SEQ ID NO: 769 - DNA, 203 bp, Zea mays
ggttcccaatcttgtgatgtccaggtgaaagccatcttagctccggttgaagattaacgtgtttagcttcttactttctggagttacaccgaccttggcgagatgtggttttgtgcatccccaggttatttttgccagcacaacccagatccagttttctgcagttttttggaggctcatcagctgtgatcaaagatgtgaaa

SEQ ID NO: 770 - DNA, 1500 bp, Zea mays
ataccaagagagttcatacacacacgcgcgcacacaaatagtgatgcgaagctgtactacgagtttattcattccaaaggaaaaaaaaagagagagcatctgtgttaggtaagcttcaatctcttcgtagtatcaaaatgcaaagatgccatgtccaaacttgtcacctattaaaatatgcaacttcctctctctttgcgcctatgggcagaagggtaaggaaaaagaaaagaaaagaaaagaaaagaaaagaaagcaagtcccaaagtttagtttactaccggtccaccacccgtaaataaactactccatacaaacatctgcgtccagtggggcagtgtttttccatgtgagagcgtagcaacagtcaacaccagcccactttcacactgactcgtgcctttgacatttctgacccccccaccaggtcaccaagtcatcgacccaactggtccccaccagccaaaacccatccccagccgtgcgtcgcctcccagatccatcactgacggccaggatcggatcaacggtcacgccttttctaatctaatttctaacccggccccgcaataaaactactcccgagggcgcggggctttttcaaagcggggaggggagggacgagacgagggacccggctgctattttttatttatacgaaccggcgtccgtcctcggccgcgaaaacgaaatgcgaatttatttgtttatcaccttttgtttttggggttttcttcccccctcccccctcccctcctctcttcgttcactcctctgcgtccggtcttcttcgtcccctccgtcgccttcacacctgcttgccatttgcgatttcaccgtcccgtcccgtggcgcaacgaccgccgccttccggccacccggtcgcggctcccccggattcgcgcccaccgcgcctccggatcgtctcggaggtgagctcgcggctcgggcgattgccccccgttttttttgagtgggtacggattttcgtggcggtttggtgcttgccgcctttgtctggccgcgagttcctggcgtgcgaatctttggattattatttagggcgcgttccgtccgtgcggtgggggttctcctcgcgtccgttttgatgcgtccgcacgcaagagatcgtcgccccggatcgtttacttgccgcggccggcgaccgtcggtctcggcgtccgcgcccgccgcttctgggatttcttgcggagacggctccccctcccgtcgtcccccgtgatccgctccgctcaagacacgagctggctagctctactaataggctttctccgatgcctgttgcgtgcgtggtgtactggtgttgcgataaaagagctgagcttctgagccttacgtaggatctgagtgattcttttttttttacctgctgtccagatctgccgctgagggagttgcatataatctgagctggtgctcctcaagtgttcggaagaggtccctgttttattcgtttttgttggtgcgattgcgagtgta

SEQ ID NO: 771 - DNA, 388 bp, Zea mays
ctgcagcatgatcacacgttaaccatgcatgcaacgacgtacatgtaaaccctagagaccgccagccaatttatcataaagcaataattatcggagtgtcagatcaatcgaacaacatgacccatgtaagcccagcccacgttgcccctacccagatatcgacccagcccagcccagccctctttggagccctataaaaggcacccatcatctccatctcagcctcgtgccagcttgagcattccactttgctagccagcatatacttacacgtagctagcttaataatcagcagctggtgcagcaagagtaacagctagcgacgacgaccatatatatggcggcgaagcaggcggtcgtcgctgctgctgcctccggccaccccaag

SEQ ID NO: 772 - DNA, 139 bp, Zea mays
tgaattaagccattattatcagtaagtttggttttttgctaggtgcaccaaggagacaagatatctagctaacccatcagattgatcacggttttttgttcttcgatttcgttgacttcggaattttttatctcacatt

SEQ ID NO: 773 - DNA, 656 bp, Zea mays
gaagggacaatgtcacccccgtctcatgtaaacaccgggagtaattatcgattttttaggatcatactatcaccaaaaattaatttgatgtttatacatctcaaacactataaaaaactgtgcccgccccttacgtccctcgaaccaaacgcactgcttgtttcgcccctgcgcgtcgcgacatgttggtggtcaaactgcagtcatgggccttcaacggcggaaggagcacacggcatgcttccaaaaaagggttttgttccgtctgaggtttcttttagacgaggaagaggagtccaaacggggaagtcatggcagatgatgacagacagccatggcagcgagcgtgcggcacacgatcgaatccttagtcgccaagacagcgtttgcccaagtcggttcgcggaatttttgtggagttgtttattgtatcgcattgtcattagcagcttcaagaagaggatggcgcgttctcgtccgtgccgcgtgctgctgctgcggctcatcgcaggcctaatccaagttcgcttccacgtgacaatcttgcttcctctgccattttctgagcgaataaggtcagtgggatgctatgctataaatcagggagtcgctcgtgatgccatgccatacggctttacgctgggaaagaaagatca

SEQ ID NO: 774 - DNA, 354 bp, Zea mays
ccgcgtcctggtgcgaggcgcggtggtgctctctgcgcaagggcggactgtccgcggcctaaggccggacggtccgcggcctggtgcgcggctggggcttctgcctgacggccggacggtccgcgctctggggccggacggtccgcgcgtacgcagggacggcggaagatcgccgacggcgcctggatctcgctcccgggagggaccccgtcggggagtagagatcctaggtggtgtctaggctcgggctggccgacctagactcctctaatcgacgtagagtcgaggagaggcgaagaatttggggattggatagataaacctaaactagactagaactactcctaagataaa

SEQ ID NO: 775 - DNA, 896 bp, Zea mays
caacggtcggctgcgcgatccgcgtgagacacgtagccgagccacgggtcggaggggggcaccagacagtgtccggtgcgccaatggctccaagcctgccaactgtcggcttcgccaaataaggaaggaaatccgcaccggacaatgtccggtggtgcaccggactgtccggtgcgccaggcgacagaaggcaagaattaccttcctggattgctctcaacggctcctagctgccttgggactataaaagggacccctaggcacatggaggagatacacacaaagcattctttgagcatagttgatcactcacacttcgttcttgcgcacttgttcaaccttcttagtgatttgagctctgttctagtgtgaaactcgtgatagtcttttgagcttaagtctgggtcttgtgtgtgcgtatttgctgtgatctttgtgtcttgtgagagttgctaatccctcccttactccgtgcttctttgtgaacatctttgtaagggcgagagactccaagttgtggagattcctcgcgaacgggatatagaaaagaaaagcaaacaccgtggtattcaagtaggtctttggaccgcttgagaggggttgattgcaaccctcgtccgttgggacgccacaacgtggaagtaggcaagtgttgtacttggccgaaccacgggataaaccactgtgtctacctgtgttgattctcttgtggttattgtgtttcgcataagactcttctctagccacttggcaatactgtgctaacgcttaaccaagtttttgtggcattaagttcaagttttacaggatcacctattcacccccccccccctctaggtgctctcaattggtatcagagatgttctcttcaagaaagagactaaccgcccaaagag

SEQ ID NO: 776 - DNA, 1493 bp, Zea mays
tgttctttatgtgggttccactttggtctttgatatatgtataattgacgtgcgcatgcaccttcattttttatacaactttagacccttttagcatgcgccacattttcagtttccggagatttcatatgttctctagagaggccttgctatatgggagatctgacagatgacattgaaacagaagtcaacggtacctggacatcatggtggcgtgggtgctttccccgacgacgaaagtgcactggtttcgttttaatagattactacctccgttcttgaatacaacattatactttcgttcttgaatatttgttactcgctaatttatataatacaattaatttgtgtgagattccttaattacctttgatgatcagcgagtggagaaagagacatcaatcgataggtcatataaccaataacattggtggataatttttatgcaactttataaggtatgaaaacagtgtttttgaagcaccctttgaggagcttcgaaaatttcatgaaaatggtctctagtttcattttttaagctagagctcgtggaattgaacytgttcgaatagaagaagctgaaatagatttaaaattcttgaagtgaagtcatcccaaacatggcctagcaaacattattcatatctatgatctaaattatttttgttgcattttatagttaatttaatatcataaatactgccactttttatctataattgatactaaaatataacaaatgatagaattgtattatttctaagacaatacattccagtgatcatgtggctctctttcacttcaactgtcggccctatgccagaacttgcggaacagccgctggtcaaatcattttctcgaacacgcaggagagttacatatcattttgttaaaaggagaagaaaaaggtggtacaaaaacacacacacccatgctcaggcaacaagggttcgtgcctgttacaaaagattgaaacacaaccaaacaacaaaaccacctgggctaaacaactaaaccattaaggagttcaatttgagctgtcaacaggcctagacccttggcgccagccgaactccagcaccaaatttcattaccccctgtgatcaggcctgtaccaagatgcccatgacattttacaagtatcgtgctacaataagaccatatcttgtttagcctgcacttgtcacttgcacattcatcagggtgccagtgcttgtgatattcatttcgctttttcaatggagcagaatagattccttgaaagcatatggacttatgaacagatggggtgctcaaagtatacatgtatatgccatgatcagcgcaggacaagtatatttcttaggttcagctttagcgaacgaagatcattacagtgggacaaatgaaatgaagtaaggagagggcaaaaacacactttctatttcttctttccggcttttcgttccttccttgggacaacttcatccatatatctgataccctttccctgt

SEQ ID NO: 777 - DNA, 1291 bp, Zea mays
acaaataaaaagaaacggagggggtacttgatactgtttttataccacagaagacgtttctaaccgtctaagagtacggacgaaagttacagggttagattacaatataaagagtactagtaaatatttataattcatgaaaatatacccaaaagtaattttaaaaaaaacatctagctctaayaaattgagacaaatatattaaaaagacaggaaactaactaacaatacttttctaatcaatggataaccaagtttataactctgcattgtgaaattaatatatacaaccagcatgaatgtcacatacattgatattaaatgcatttatgatggttgtgtcttttggttatgtaaagtttttcaaaacatgctagaatgttattagaatgaaatttatatgctttagattttttttttgttttcctatagataaatcttttttaaaagtttttaaaagtgttttcatgagctctagatattttatttcatcccaacctatcttaagacttttattttacaatgtttaaaagtttagatgtttttttgttctaatatccttatcgagcttttatagaaagtaccgaaaataccaaagttgtcttcaaaccccctttaaagtagggcgaagaggtgatttgaatagtttcgagaggccgatgagtaagatatttgtttttagaggttgagagtggtagactgtgacgtaatccagagaggtaaaatagacctttttttcatacaaacgcataaaacataatacgatccttggataaatctttaagattcatgtgcagatgtgtttagattgccacgtgtcgcaacatatttgttaagttcaatactgggacgaattgaaatgcatggcatgattgtttgataaatttttaagtcacaaatcatctacataactatataaaatatgataaatatcgttggaaggtacgaacttgtttatttgtacgataaaaaagctttgatgaaaaaagaagggccggtacgtgcttttattcttttattaggccggacatatcatccctattggaccgatcgcgtgttgcttgtgcggtatggaccgattgggttactgcttctctgccttacgtgttgggcctttccaaagcccataattgcccagtcctcatgcatcgcacgattccgggctgcgtggcgccacgctggccacccacatcatccttctccagttctcctccgcctctccgggtttgactctgctgcgagcccgaacccgaagcagcagagctgcaaaatctagtctagagcgaaagaa

SEQ ID NO: 778 - DNA, 660 bp, Zea mays
tcgcgcgcctagcggggtgaaaaaccgaaattttgtctatgcccatgtcgatgcggcgccacagcagagcctcgccgacggctacacgccgccacgtcgtgcacacgaactctgcgcccagcatgatctcgcggggcccaagcttaaggaagacggttatcaggatgtcctgaggcagcgccgtccagtccctcggctcgctgggcgctggtgaatgcgaggaggttctgctctgtggcgaccaccgtggcggcgggaggaggacggcatagctacggcctgtgaaacattagccatacgaaaacgttggtgaggccgcgagcgggtctgtggtgtgagtatgatttcgctgccgcctgcattttattgacgcttgagctgcgagtgcgatgcataggtgcagaagacgaagggtcgcctaggtggaatttaaggctgaggtgaccgatgcgtctataatttaaatttcacttaataaatgcataacagtatgttacgcttgtttcgatgaagagcacaagcgccttgagccgccgaggccagtggcggctgagctgccacctccgccggcagttgagcctgtcgaggcgaaggctaagacgagagcagggaatgtgaggatgcggaagccctaaggcgagggagcctaacaagagggag

SEQ ID NO: 779 - DNA, 392 bp, Zea mays
cttcctcctgggatggggattttttccaggaatcgtttgagtttttttttaaccagacctaaaagttatggttgtgccaaataattttgtcggtgagttcccgattttagcgtcagatagtcatgtggtgttgtagggaattcattacatggacattagggtgtttctgccttgctgccatacactgatacactattatttatcatattgtcaattgtctttcgatggaaatgctcagtctattcatcatcacacatatatcatttgtgcactgtattttcgaatgagcaagctggaattgatctgattcgcctattggtgtcctgtaggttgtaatgagaagctggacctgttaggccgaagagttctcgttgcaagtctgtgcctcagcg

SEQ ID NO: 780 - DNA, 237 bp, Zea mays
gtttatactcctaagtttggcctttggtaccccaggggatccacttttgattgaattggatattccgatgctgattgggcaggatgtaaaattaatagaaagagcacatcagggacttgccagttcttgggaagatctctggtgtcttgggcttcaaagaagcaaaattctgtggctctttctaccaccgaagctgagtatattgccgcaggccattgttgcgagcaattactttgg

SEQ ID NO: 781 - DNA, 1165 bp, Zea mays
gtgctaaatctagagctaatccaataatctagattagtccacagtttatggttgagcttgaactatccaacggaccactcaggatccagctaataaaaagctactaactgcaactttcattagaattttcgtgggagggagattgttttgttaacaattgaaattttttgggatctcatattcataatttgtacaccgtcgcagcgcacgagcacataccataaactgtggactaatctagattgtttggattagctctagatttaggagataaggacggcaaaccagttacaacatctatcatttacaaatgtattcttgcactggtgtgcttttaaatccaagcagactgctatttttgattatttgattaagtttataacttatcgtaatatcatatgtccccgttgcaacgcacgggcactcacctattagcatttaagaaagaaaccatccatactcacacagacaactcgaagaaaatctcctcgcagatgcaaagacccccaccctcacccaccataactgctgctcttgaggcgcagtctccatcagttattttctttttctcgccatctttttgcatggccgtttgaatttgtttttccgcaaacgtgagccgcctctcccaacactgccgctcgctcccccacccaccaccactgggtctttctgttgagttctatttaaaactcgacaaacgtgcaggcccaactgaacccaagcctaaatcatgttcaaatgatagcggtccttttaggctacaagaggaatttctctctctctctctctctctctctttaattttcaaataattagagccaactcatcactcgctaatgcgtgcgtgggggcctttttttttccggacggcgacgcgcgtggggacggagcacgcacgagctgaggagtgaggacacgcgggccatcccctctccatcgatcgatccagaacccaaccccaatccaacggctgcgagagctctcgtcgcgccgccgccgccacctgacagtctcctctcccctgcgcgcgcacgacgagcgccgggccgggacagccgccaactccatccaacttccttaaaccctagcgccagcagcaggcaaccagcgccgacgaggaggaggagcgcggagtagaggggctccggcgaccgcgtcggag

SEQ ID NO: 782 - DNA, 1420 bp, Zea mays
gggtgggacctacataaagacatggttgtgaagtacaagcgaggttgtttcggaaggtatggtatagaagatataaaagacctttatataggcaggtttatctgttgcagtggatatagggcttgtttagttcgttttttccttctgacgagcttctctgagaatctggttgtggaaaatctgactgtagggagagaagttgacttagaagaatctgagtgtttagcaacaaagtactttagcgtcatacgaacacaaaaaaaaatttcacaaagtaatttaaactgacactgcataggttccacaagtaaacatgtctccgctcactagattttcacgaacgcagcctcccaagcgcttctaacttcacgtagaaagcgcttctccaagaagctgggccaaaatctgaccgtttggcattctatttcataaactaaacaaaaaaaatgataaactagatcattcgttaaaccaaacactctataagttcttgtccatgtcaacatcatgttatcatgaggcaaagacatgacgccacacacaacaccgagccaaaagtcctaaaataaaaaaaaattaaaacatagtctcaatgtaagtattcttaaaaaaacaggcgaacaaataaaaaaaatcagtgcctgtgagacgttgatgtgaaagctttgttaaaaacacacgcgaaacccccaatcatttaatactgcgtccgcacatgttaaatacgttaatttgttaacaaaactaacctctatgatgtttttcatgtatcagtttctaacacgagtatcttgaaaataatacggaagagttttatttccttaaaacctctttacttttatgatttttatcgtatatttttcattaatacagtgataaagctcatgaaccgtgttgaaaccgaccaaacgacacgcgccgtaaaagaaagcgttagtccctttccagctcgtaggcgaatcccactcgccgtcgccgcaacggctagtgttgaaaccggctcctcccgactgttgcgatacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagag

SEQ ID NO: 783 - DNA, 146 bp, Zea mays
ccccccactcttcaccaccgcagcgccgccgcgtacaaggcgattaggcgaagctgcaccggaaggagaaggagagaagcgagagtctccccagccagagcaagccgaatccgaagctagcggagaggagagagggctgagtgagg

SEQ ID NO: 784 - DNA, 1500 bp, Zea mays
tttacaatttttttctcttcagctagaaaaaaaaacaagcaggaaaaccgaaaacataaagtggaattcgaaatagaaagtagaataaagattataataaaaacatcctcaagagactagctaaataatttgtcaagctaaattttagttacttaatagcaaaataactctccaacaaaataactcttcaatagactaactatttaacttgtcaagttattcagctctctaaattaactcacacactaaccaaatttggctagccactctagctagtcaaactaactttcatgttagaaagtttattgaaatgaaatgttatatataaaatttaatctttatagatagaccaataaaaaattaaatagagagtttggatgctctaagagcatctctaagagacactctattttcgacgctctatatgacactctatttacatcttcataaagattacattctatatgtagcatctcactccaacagactctgtatttagtttggctagtcagcggctagccaaatttggctagagagggagccaatttgaagagctggatagcttgacaacttggatgactagtctgttgttgtagagttattttgctattgagtagccaaaatttggcttgctgagccatttgactaatctcttggagatgctctaactgtagtcaaatttggctagccactctgatccaagagactctttattttttactctcgatttaactatttatttgtctctccataaagattaaactctatatataacatcttgttccaacatataattagcttggctagcgagagttgctagccaaatttggctagtgagggagttaatttattggcaagttaaatggttagtctgttgcagagctatttgctattaagtaagtacaatttagtttgacaagctatttagcttatcttttagagatgctcttagrtagctatttattagctactaattccacaacaaatttttagtcaactaattattaattatggttcattcaacacccctaaataagaaacctgtaatatccgtctaatcccattacgccctaggtgttacatgcctatagagggaggctagaagcctggaaccaacctaattttattatttctacctcccttcacgcaaggatgacctacccgctcctccggaaacctcccaaacacgtcgaattcgccacgcgtcaattcccgactggccggaccatcggaagctagccttccattggcccgacgctatggcccacacccrccactgtggcagcaacccttacgctcaccttcattggacccagccgtcagggagacaagcacttgcggtgagcccaccatgcaggtgagtggaaaccgtaaacccacccacaccccctgctccttttaagcagccccgctcgctctccgcagtgaccgatagaacacgacctggggggttcagatcggatcggaagcttccataagtttccatcgggcttcgccggt

SEQ ID NO: 785 - DNA, 54 bp, Zea mays
cagcagcggaaccccccgccctcgttcctcccccgccggcgagagatcgacgag

SEQ ID NO: 786 - DNA, 1500 bp, Zea mays
ccaagacactatggacaacacagcattaccargataaaacacccggttttactatagaatactaggtccttctccagaaagccaccggcggtcgacacctcttaaatctttaatagaaaaatgagtggttactctgctatctgattattgtagtcaaagtgaacatttccgcttgctttgttagacatgctgaatggaaatataagtataattcaagtctatcaatgcactaattgaatcctatcgtcacatggaacgacgttgctggaaaacatttcagttgtcctcgtgtgagtgttttttcctcgaaataaaacatttagagcatctctaactatttttttctaaaaaaatgccaaaaataatgtcttgccaaaacctggcagaccacaaccatttgggagagagaaaaaaaaacagtttactccaataattactaagttttggtttacaatagaatatgtgccgttcttttccgacgagcaaaactttgggaaaggattgaaatctgttgattggtttttcttgatattggttaaaaaaaattcgagacggtttgcagggtttctccgaaatgctatggtcctgattaaattttttataccagtgataattttttagtacaatgatagtatgaatatatactagccagaacttgcatctaaatctaagaccctgattgaaagtatcttagttttaagaaactatttttttatcttttagctagggaagaccaatttcttgattttttaaaaaattaagaatataaattaagttataaatgtatgtttgggaccggtttaatttttataaaccagttttttaaaactaggtgctttcaaacatggcctatggcctaagtcagagagagtccatcttcaaatgtttttcgggacttgatttgtaaccaaaatactccaaatttaaagacgtcgatgaattgaattccattttttgggtaatacatatgattttttccgccacggttggaaggtagaattttgcgcatatctccctccatcagtccctctattttttctgcagaaaagtgtagtaaagaaaggtaaacaagattctcgtcgatcagttaaacgcatctgaatctcggcgagtaaaacatttctatttctatccgcagttctagtagagctttcaactcgaagaacagcagctcggtagaactagaaccgtagaagtaaaaaacctctacgtgtatcacaatataaagaattcagcaagtttccaacagagataccataagaacgcacgcgagtggccagtgggaaccaggaaacaagtgagagggggaagctgcggccgacggccgagctcttgccgtccctatccacccctctcggctctcgccctcctctctgtctttcgctccgtccagccgccgcgtaaaatccgcggaaccagatgcccttatccgccctctgatcgaatccggccagaaaggccggttctttgtcgtcgtcctcggcatcgccggcgaccttg

SEQ ID NO: 787 - DNA, 156 bp, Zea mays
ggtatgagctaactccagcttatcacatgcctcacaacaaatactagcctagctggttgtctaaaggttctctcagcaaaaactcttgttctgtagcatttccagcggaatattgtacgaggggtggaaggtttcattgcagttagcaccaaacag

SEQ ID NO: 788 - DNA, 286 bp, Zea mays
cattcctgcttatctgtagtttgatcgcttccttagccgagttaacgccgagtgtttagccctcgaggtgtgcgcaacctcttcgtgtgagatatcggtgtttcagtctgcgcataacccggacgtccgatcattgcctagcacatgttgggatgaagaaccttcataagccttttaggggcgagcatattttgggactaacgaatgtttgttttgagaaagacagatcttgtgcagcttgccaagtagggagcaagttggaggagggcatcacccaaataatgtg

SEQ ID NO: 789 - DNA, 1500 bp, Zea mays
ggcttgcagccagccgaacacgcccatacttgttgttgcagtcgggatcgtgcctgcctgcctgctcattggatctgagcgcaagaactccagatcgatcaagtgatagaagcagaaggaagcaaagcagacaacacagaacacatccatgatgagaatgaaaagcaatgggaagcctacctcctactcctacgccgccgagctaaaaacaagtccaactcgaaggggagtccgttggtcagaggcagggctggccgacgcacgggaacacgtgtgctaatgtcacccaccacgcggcagcggcagtgaccgcgtccaggtccagctgctcctgcttcgccttccctccgcaagcaaggcgccagcccccgttccgtttcacacgcctccttccttccttcctagcccttccgtcctgtccagactccagactccagactccctccacaccagtagggactagggaggacgccgccactgcgacctgccggcagacgtctgccccctgcttccggcatccggactcccctgcgccgcagttacgttacgccggcgatctcctcggctcaacccggggcctttctctctgcgccccgccaggtccgttcgcttccttcgttccatggcggctccgtttcatttcatccgatcctttcggaaggggagtggtcgattttacggtgatcgcccgctgctctgtaacattcgatcttttttttccccctcttcttttgcttccagctggtcgtgcgcggcgttgctgtcttccccgattcattcctttggcgttctgttctgttgctcataatctggcccgttttagtagatagaaaaagttgggcctcgttgcctataggctggggttggccgttcaatttctcaccgtgtctgacaagtcgcaagtcgcattctttgtgtgcgactgctactggtatttgtgcgcgtttttttgttgttgtcaaaatctggtcatccagaaaactaccagtggtcacctgaagaaaattagacagctcgcaccagctccaacaccgtttgtttcttcggttggtaatccaccaactgatcaggtttcgaactgtgttccctttcgttttttagcatttcttctgttggagaccgtttatctgttccgaagcgtacgtacgttggtgccgatatttcggtgtctcattttctctctctcgtgttcaaaattattcaaagctgtggttgaaagctgtggttttggtgagtttggctttggttttatcagacgaatcgcccgctttctctgtctcggtctcgaattctcgatgaaatttctgcctttccctttgtccttttctctctcggtgttagatgtaatcaatttcgttttctacttctcccatgtttttttttggattgaggtgttcctttttttttgacgaggcggatttgtagttacagtattcactcttggttcttgttttgcatctgaatcagcccagctgctagcaacccagcaggtgaaggaga

SEQ ID NO: 790 - DNA, 419 bp, Zea mays
cttgcatgcctgcagcagctgtgtttcataacataattagaagattaaatggagatgatatgtggctagaacaacaaccaagtcatattcaaccagcagattttattgatttgcccgatggagatgacaactatcagaatgatgtagagtcaatgaatttacaaagcagccagggaaatattcttagagatcaaattgcaatgcaaatgtgggaccaatacatccaagatcgggcatgaaagctggttagtagttggttgttttgaaagctgcatattagttattaattttcagaattgtttagtagtttttgttgtttttcttgattgctttttagttagttttcagaactgtttagtagtttattatattgaaagctgctgattagttggttattttcatagaactgttgatcaatt

SEQ ID NO: 791 - DNA, 1130 bp, Zea mays
gagtgggcgttcggttacaggttgaagtacgggctgtaccacgtcgacttcgacacccaggagaggacgccccggatgtctgcgaggtggtaccagggcttcctcacggcccgcaccagccagcgcgacgaagcagcgcaggcacggagagcagactcgtgatgaaccactcccatttccaccgatatatatcatcgaacgcattgctagacagccgagggtctcataactcgtgctcatttccgtcctcgccatatattggaataactgtggctgtggtgtcctaatgtctgtatatgcatatatatcatatatgttgacctcaaaagaggtttagatcacacactatagcacacctgaggtcgatacatagtattgaacacagcgagaaatctagagacctgtgatagattagtttaaattgtttgcaacatctcagttcaattcaaaagtttaagctcatagaaagatatggacaatttacctatattatattccaacactactcctcacgtcgagcctcttttgagtctcagacgtggaataaaaacgaacaacaatattatattccaacactcccatggctgatcaattgaatgttgggtacgttaatctgtcttgatctttcattattgtgttgaccaaatcactctttcacaaatctccactgaagctttgcaacaaaatcctcattcaaagttataaattatagacaatagcataaatcaaagttataaattacagccaatagcataaatcgagacagtaattctatattcttacccaaggtttttgaagctgcatttcttaagaataatggcatataacatattacacatataccagaacgcactagatgcaaaaagttcttccattgatatgaaaaaatgtaaattagttttttttaattgagatgctgggtttgtcactagaaatgctggatgtttcactagcagatatactatccatcgacatatatcatgtgaaagccaactacagactttttggctgcacaaagaactgcatcaacttgcagcaacaactcttcactgccaccaagaagtctacaactattctgtctgtgtgggagtagctggggaatatgatgtagttgtagtcgccgcatattg

SEQ ID NO: 792 - DNA, 941 bp, Zea mays
tgtaagttaaatcttctgaaatctggatccaacatttgtaccatactggtgaatatccttgctttacttttgagtcatgtttgaattaacctttctttccccaccatgcaatagttccgtttgatgaactcacgggaatggtgatgctcattttctaaaggaccggtcccctttttgtttaatttccaaaggtaccatgattactaaataatgatttattagaaattaatgactgatggggtcaagatgtgtgaaactgttaagagcttgagatctgctgattgaccacacccaaaagggaaaatgaaggtggtcttttgaagatttgatttactttgtaaaagggcataattttgtgataactgggaatcattcctcaacaatactgataaaacttcaagtttttccttgatgttgaactgctacctccatgcctccattgtgccacagtggatatccatttggtgctctgtccctatcatctagttgtggtgatggggttcaggcattccctagtcgaaccccctcgctcacccacccaccctggttggaagactccgttgtgattatccataacttttggttgaccttacatctctaattatcgtatttcatggaatgtgtatgctattcgtactgggacatatatataaagcagtgagccagtgaccactgttccatgctctactgaagtgcccttctatgttttcccatgtttatcatttttctgcaatcaattagtgtattacagtgaaagtgaagtactaaaattaggagtattggtaccacttctttctgtgctcatgaattagtttattttggcaatttaatgaggcttgtctcatgtctgattacttcttctgtttctttccctggaatcttgcctcttccaggtgtagaggacattcagttttctccagttctccagttcctggatagca

SEQ ID NO: 793 - DNA, 370 bp, Zea mays
tacatgttaattctgtgttcattcgaagcttagtgtataaaaaaattagacgaaaaaaaagagaacactttatttagaaacagaaggacctaccttcaaatttaagggataacctctacgattgtagggtgccgctgaagttagagattctgcacccagcataaaaaggcccctcgtcacctgtcgattatcatgttgatcggcggcttgggcgctgtgtgatgatagaatggagcgcattgctctcgtctgcacgccgttctggcctcgctcgccagctcgggcggctccacgtctttgtcctgcagcagggggcagtggagatgaccgatgaggccatctcccgcttccctgtcagctctggaatgag

SEQ ID NO: 794 - DNA, 342 bp, Zea mays
ggatttgtgaggctagcacgtgaaagacttgttccttgtactgaaaaaccctacgacatcactcttttcaaatattccatagagtgtaaatcatcacttgcagttgaagtgcgttccgcgccgaccggaccaatgcctgccaccaatgcgatattccatgtggaacttgtgacgttagattaagatggaaacaatttacaattgttgccagcaacggagggcgtaaattcccagcactactaacgactgggcctataaaatgggaagccctctcgtctcctgcatgctctgcaaacgagcttctcttgtcactcatcagcacggttagtatagctagccacc

SEQ ID NO: 795 - DNA, 130 bp, Zea mays
caggccattgtttgcctgttaggggggaaacaatcaatatttgggccttttcttgttatgcatacttctttctagaatcacatttttttatccaagctcatgtatctctttatctgtgcatttctaggcc

SEQ ID NO: 796 - DNA, 1500 bp, Zea mays
gcggtgtgcgagagccgagaggaggaggatgcagagctggtgtgacgccggccgctcgctagctgccacctcatgattggaggccctggatcggttgaacaagtcaccagagaactcaactctcagcagccgcgcgagaaggattgcgatgccatagctgaacccccaattgaataataatcgcgtgagagcacgatcgaaggagtcgccaatgcaaaagaagaagaaaaaactatggcttcgtgttgcggtggatgtatggaacgcgtgatgtctatttccatccaaagaatctgcggttggattattggatctgtgtcgaacacaccaagccgctgctaagcaatatatatgacagcgtcaaaaggttaatttgacccaggccaggatatcatatcataacatatcatatctagaatagaaactagactcactctactagaagaagaagaagaagcaatgtaaaattctgaagctggtagcgacgtatatcgttgattcttcaccaagcaaccgaatacgacgacaagtcacgacctgaattaccacggcctttactcctgtctcctagcctgacgtgtctgccgaaatatccgacgcctctagctagattcttttttatcggagtaggcgcgggcagaagaattccgcccggcgcgcgtgtgcagctgtcaacgtttaacccctcgatagaaacgcgcgtgggatggatggggatctgccgggcgggctccgccgtagtccgggacgagcggccactgcactgccatgcacgcacgtcgcagttccagggcactgttgccgcgcgtgggcatgacggcgaaccgagctctgctgctggtttggttctcgactccaaccgaaaccacgcaccaaccactccaatgcatgatgatatgcgtacgttaataattaatgcatatgctacttctcatctaattcccgaatcccgaacgaacgatgacagatgaggggacgacgacgatccatcatcaaaggcatggatggatggatggacatggcgatagttggggagacgtcgccgtcgcacgctcgtcctcgtcttctcaagagagcagcttgtctggctgtctctcctctcctctttgtttaagttcgtcccccgcgcgcggtctccacgccttgctcagcctcagccctcaggcctcagccagcgtgcgcgcccacaacccctcacgtcgtccccgccaatcacaccgcacgaaccgaggacgacgggacaccaccgtcaccgcgacgtagtagtagtactacatgcatagcatagcctcgtggagtcgtggtagtagtagtttagttttgctcgcttccacaccgcaccgccgttcccttttttatatcccgcggatgcgcctgcctctgcctcggggtcgggggggcagctggtgacatcggattcggatcaggccgagaagatcgaactgctccgatccggcgcttaatttctctctctctctctcgggctagctgcccgggcaa

SEQ ID NO: 797 - DNA, 535 bp, Zea mays
gaatggtggacacgaactagtagcagcaggaagaacctgatgaattataccaggaaaaaaaaagagagatatgtatgacagacaacatatgcctagtagccactagtagtactattagctagtctgcattattcacaaaagagaaagcattcagaaaaaggagaaggaaagaggaacgccatgaaagtgaaagaacagggaaagggaggaggacggaggagggggacagagcataaagtctaacgagcactgaaacgcgtatactcctccaaaaacatatcaatatcatcaccatcgaccgaccgaccgatcgatcgatccgtatgcattgcatgtccaaacgaacgaacgaacgaccaatccgatccacgaatcactggttccgaccggctactactcgatcgcaggcgggagccaaccatgatccttcgatcatcgatcggtcgaccccggccggcctgcgtctaaatcctaaccaagaagaagaaaaccctagtaaatattattgttgttcttcgatccgtcggggacgagc

SEQ ID NO: 798 - DNA, 1086 bp, Zea mays
tgctagttcgtgacaggatgtggctatatatatgacaaaccgaagatctcgattcttatctaaatcttagagttgtaaagtcgaataatcactgtcggttcaacaaatgaactcatcgattcttatatgaaccctgtaatgtctgtttcgcgttacattacttgtgcctgaacagaaaccccttacaccttcttaattaagccctcgtatagtgtcacaacacatacgaattaaaacccgccccggacgccatatcacgttgccgtcgccgtcgtcgtctccaatcatacgtgagctaaaccttaaaaggaaccacttctttttctctctctctctctctttatctccttgtccgcggatcacgcacaaagccgcgaactgactcaaacgccatggtatcgtgtagcgaagaagataaaaaataaaaagcgaggcgaaaaagggctgccggtttcatcgatctctcgcgttccacgtaggataggagcatacagctactgtagcagggagagcggttggcctcgaggctctcgccatctcgggcccatgacttcccggcggggatgggataacttgcgaggcgatccggatccggggcgcgggcgcgggcggagcagttctcgtgtcacaagcatgaggcacggtggcaacatgccgtcgatcagtggcgttggaatcttccacctcagcctggcgcgcgtccgacgtgacgggcccaaggaggaggaggaggaggagatagcgacggagctagctccccctcttattgcctctgcctggcaacggggaatggcacacagcggtttcttttgccagccagcccctgtgcccgcctcctggcttctttcctcccccctataaaaggatccgggaggagaccccagccacgctcatgacttttaagagtgtcgacccttggcttgggtccagccttcagacttcagaggcaggctgcaagagagttcatcgatctagctagctagctagcgtgtgtttagggtacctagctagctagcttcaacatatatatcttagttgcacacacagctcaaaagaaaggaatcatcgatcgatcggcagggaggg

SEQ ID NO: 799 - DNA, 256 bp, Zea mays
ttgacttcattacctgcctttttgaagcatcgggcatgttgcagtcattttacatataacaatgtcaacattggaatgccctatcaaggttattaaatcggctagccatcgctagtcgccctagtaccgaccaggacggttagtcgataactaggacaactagtcgtctatataatcatcttatatataccaggacatatatgtagggtatatatacaatagtatatatagtagaaatcgatcattaagactatct

SEQ ID NO: 800 - DNA, 1361 bp, Zea mays
tgctcactggcaggacagtgtaaagcgtatgatccacatccatgtacgcatgatgacttccgcttcaaatgtttgggaagtattcattcacacatgcaatgcagcgtagagtgatgcagtctctcttgctatgtcacgcttgtaggccgctagggacggacaaaactgacctacgaatgatagaaatagaaggggaaaacattttttattgcttcaactgacaaccaccaaggcaccaatcaggcaatcattcatagcctccaaagaaatgaactttacctttaggaaaaataaaacaaaaacatttgtattgtaaaccagtggtagtaggtgaggcgagaattcaattttccatttcgagttgaggctgacaaatttctaggagataaaaaaataacagaaatactactaatcaaacatgctggtgaaatgaaaaaaaaaagtaaaaacaaaatgattggagagaaaacgttaggtgaagtgggcccagcgacttgggggttggtggctgtgaggttggtgagaggacgacaacaaggctacagctaccgtcccccggctcccagcgccagcgggcggcttcccccgcgacgtgggcggcggggccatccgcgcgcgatgccctcacgagtcacgtcacgtgcatgcctgcccgactagccaagtggcccgagtagtttacttcccgcaccgcaggcccgcagccgcagcagtacccgcgcgggcccactccccctctcaccggttccacgcccagcgccagcgccagcgcgggcgcggctataaatggcgagccccagcagccccgagaccccgtgccacacatccatccccgttcgcctcttctcctccctcctgccgggtccttaataaagagcagcagcgcaaggtgagccgccagcttgccccgtacgtaccctgctgcttcttctccctcgttggaccgttcgttcgtcgtccttctcccgaggttcgtgcgtggttcgccttcgcccttcgggagatgctgcgaaccttaggcctttccttgctgcggacggggtaactgatacccatgttttgctgctggtggccgcaacgggatggcggatccgagtgtggggttcggtgatcagccggtttctctagatctgggatctccaaaatgtgttttttaatttatcgtgtctcagtcggcagtggagattttttttaaataatggtctgtcggcgtgatgtcgtttgcttgagggaagggagggttctctgattttgagatctgacggcactatttgttggccatccaattcgaacggtttctggttgtctgaattggtttgaacaaaattgcagaggttggtagagcgagcgagaagaaggca

SEQ ID NO: 801 - DNA, 843 bp, Zea mays
gttcagataagaagcaaccaccatcgagtaacaaaccaacaacaataaagaaagaggttgatctgaatcggttccttaatttgattagctggacgaaataaacaccgcattgtcaatgctctcagtgcgcgtactccgtgcaaataaatcaaaatcctgcaagaaagccataaatatatacatgcaagactcctacttgctgataaagaacaggaaagggacacatgggacaaattttttttatttctcctctctcatgaacacacacatggggtatgggacaagcaatttaaaccacctctctcctggcctctctcacgccaaacccaactactagtccacatagccgatgggaatcttcgcatctacgtggagggatctactactcaaattggaatattattagtatatatatggtctcagggatcccaattgcttgcacttcttgtttggctccaagcacaagagagagagagagagctatatatatgtgcctatatataaatgtatagagatagggagggagagaggggggcagatagatagatacatacatacagatgtccacacacaaaacttcagtctatagatacctttacagaacctaaccaccattgccaggcagcatatatagctagattgcttctgatgcattgttccttgtcttgaccagcttcacaacacaaccacggtgtcgtgtggtcgtcttatgcaagaaaggccagggccactgcgcgcttcaccagagagagcaaggctacaaccaagaggtgtgctggaattatacatctccaaaagctagctagaagaccttggtgggtggtgagcttggaggaggagctc

SEQ ID NO: 802 - DNA, 1191 bp, Zea mays
tcctgttgttggttagggggtttggctacaacgaccagcgtacgtcatatgtcatatagtcatggcatcataaaacagtgaattgccatgcatgttgaaactttaaatgcttatatataatatatcatattactgtaaggtcatggtgtatttgctatgttaagttgaatgtttggagtggttatatgcatcggtattgccgattttaattactggttcctgactgttgccgatgtgttcccgatcgattgtaaaatttaccgtcatatctttacaccctcccgtttcgttttctcaaccgatgatattgttaccttttacaattttgaataaaaatatgctttgaaagtgtttggagagttttcgtgaccattattgttcgttttcatccctacctgtctggtcttcgaaggtcggtgctcatatggttagggtttttgtgtgtacgttcataagattgattgttatgagcgtctgttgtactatgcgatctcaaaagaaaattagtgacgtcgataatttggtgacggaaaacaaagtgtctctactggactcgctcgtcttctttgctgagtgtccaaggcactcgacaaaggcccttaaacagtcgataaacgctttgtcgagcgttgcaatcgataaagaacccttgctaaaaaaatcattggtaaatgatctttgttaagtgctatttgtcagtcattcggtaaagacttaatcaagtatcgacccgacactcggtaaataaacgacgtcgttctgtatttactagtacttttatttttagataatgaataaatgaatgaaatgacgagttatacatcagatagttggcatgcagtctctctttgttggcaaccaagctaggcttgcagctggatttccactcgagagcagagatgaaggcaaagcatggactcagtcactcagctgatgagctcctgtatggcctgcatggtggcgggcgagaagaggaagctgccgggggagagaaggaaaccagcagcaccgcctggcgaaggcagcggcggcggcggcggaacatgctggtggtgcccgagcgtgagcaccaggaggtcaccagcagccgtctgctgcgacgacgctggcggccgaggcacggcctcctgaccgccgccgcggccggtcaggctctgcacgagggccttgaactcgtcggcgcgcgcgtgg

SEQ ID NO: 803 - DNA, 284 bp, Zea mays
ggaagcagtgctcgtcgactttctccacgcaaacgccgacgttttcgcgtggagtccctcagacatgcccggcataccgagggatgtcgccgagcactcgctggatatctgagctggagcctgacccatgaagcagcctctgcgccgattcgacgaagaaaagcgcagaggcataggcgaggagatccacaagctgatggcggcagggttcatcaaagaggtattccatcccggaatggcttgccaaccctgtgcttgtaaggaagaaagggggcaaatggcgg

SEQ ID NO: 804 - DNA, 1500 bp, Zea mays
attattaaagtaaccttattaatattatcattattattaaatgcacaaacaatcaaactccagcatgatgcacatgttatttatgtgtcctttgttttaattatccacttttaaatgtggcttttcacatgttcaaataaatggaggcaactcatataagtagatcactctattttattaattacacttttgggtattacagtaaatacttatacgaggctaatgcaactagaatgcgtcaaaatgagttaaaataaatgagttatgcatttcccgaggttttaggattgagaacatatctaatgcacatggatgtttagtgcatatgatgcacatattaaatcatcaccactcattttagatctaacgtctctagttgtttgatacattttgccaaggacacactctaacatggtgagatgtagtggtggaagatgttatttatgaattacaataattaaacagaaacgttagatctgatatggatagtgatgatttaatatgtgcaccatgtgcattaaactttcatgtgcaacatatatgtcctcgaatgatgctcaatgtataataacggtaaagacattgtaatagtctatagtgtgatcgatagctgacgttatagacggtataatttaatgacatcggatcctgtgtaacaaaagctcaagctatcaagctacgagactagtagtgaccgatttagtgttaaatttatagtgccacaaatagggatcagcaccggttttgtttatatcccattcagatcttggcaacggtccagaaacgaagaagcccttgctgtcgtcttctcttcggcaacgttcacgttcagttcccgtgtgctggcactggcactggtaggcagagtgaggacggccgtccaaaatcgcagccaaagcagacaaggccgcatcggagatgacgatcgctgcagcatctgcaataggggatggggcgattggtttcctcgtgatccgcgcgcgccaccactgtgtgacaatgatggaacaagacccgtcgcccggcggatcctgtgttcatttggctgcagtgcgcgggcgcggcggcctgcaacggcaactcgtcgtacagtgtcccggcgttcggctgcatcgttttcggtttttggcggagctgagctgagaagggggacctgtgtggcagtctggcagaggagggagcagccgctgaggcctgctgggaaacggtaacatgtggcagccttgtgcgtggggtgtgggaacctttttctcttttttttagtttttaaattaggaggggctgtgctctcaacggccaacggctccttggtgcggcgggcggtcaacgtctctctcgccggggcgctctccatgactccatcttaaaacccacagctttcttcccgtcttggcgtcttcccacatatgagtatatgacatatccccactctagccaagtagccagtcctctctccactctcctctcgcaccaccaaaaaaaccggccccaccgttcgcc

SEQ ID NO: 805 - DNA, 540 bp, Zea mays
cacaagggcaaccttgcaacttcaagattagtaatcacacagcttgtccgaatacgacattcaacacctggcgcaactaaccaaaacagggaaaagccaactagcgacacttaaaaagcacaccaacaggccatcttaaccttgctgtaattcctgcaaagctcccaaaccttagccacgccaaaagcattcagcaagcgacagaataatacttaaaccttttcctacaaccccgcaaacaaagccactgcgcagcattttgcgcactgacgcaggggtgcgatttaaactctattacgacctccctatttaacccgcgtgtgcaccgagcaattaaatgcacacctctgcgcaactaaatacgccatataacaaccaaaaccatctcgtttgattagcaccccagacttatttagcgccaaccccccgtatttattaatccacccactttcaggcacgcttcttgtagtaacagggacttgcccaaccggtgtcatgatcggttgggactacctcttcaatcagacaaggaaacccgtc

SEQ ID NO: 806 - DNA, 991 bp, Zea mays
aatcaagggcttaaataatttgtgaaaaaatttggatcatggttcattaccacctctagtcatatactctatcctaaaatctcttaggctgcctccaacaaaaagaagctaggcattcgatcttttggctgttactaatgatttaggtggtcatccaaattgtgagtgtattcaacagagaaaccattttatcttctatatttatactaaatagtactggtattggattggtgaatggtgagactattctgtcattgaaacaggtataaaatagttgccctccttgctagcatacaatttaggttttctcttttatcttattcaaaatggttgctccttttgccttccctggtggacacgctacactacctatgcggcaactattttgctttggatgcccatctagctgacctgttgaagtaagccttatcaaagagttagaatttttaaaatttaactaaatatatacacaaaagtactaatatttatcatatgaagtaagcattgtcatatgattataaagatcatgaaattatttttataataaacttatttagagatataaatattgatattatttttatattagcagttaaatttaataaaatctattttttgggaaacgtagtgtgcatttattttgaaaggatacaacattgctgatagttcgtctcccgatcccgaatgccgaatatgagcattttcctttgatcgtgaagggatgttctttagttccccgtctgaacacgggcccgacgaatcgctggcccaaacaaaccggcccatgtgatccacactcgcgattttgtggggtggtttggtggaacgggaaaaaggtcgagtgctggtcaattcaggcgaggccgacgggctcgcagcgcccgcggggcatccaagagcaggaggggataaagcagccctgcagcagctccctccttcacaagcgacgcgaagcaccgaggagaggcggcgagagttcttggtcggctag

SEQ ID NO: 807 - DNA, 163 bp, Zea mays
aaaaaagaagaggaggaggaagaccagcagctagaactgaacatgacaagacgcactagaagatcgaagcagagaagacgagcaggccaacaggccgcgggcagtgagtggatttcaagcatctctagggtccaccgcctccggccgtttggccagcttcacc

SEQ ID NO: 808 - DNA, 545 bp, Zea mays
tgtaaagttttggattgtggtactgtattgcccgtttcgtttgagtggcttgaattgtcctgtgcctgagccctgagcggctgagccctccttttgggcttgctttctttaccctgcggccaccgggcactcgtgctcccttttggcgtctactcttttgctgcgacgaggtgcgcgaggggaactaacatttgcggtcgtaggttcgccgaacctgcccatgacacgcggggggcgcgcgggaattccgctcagaatcctcggttttctccgagtctggggctgccgcgcgccctgggccgcacaaaattcggttggtgagaggaagtgacaggcagggcagcgcgaaagccagccacggggacggagcggctagcgagcaagcgaaacagcactatacaagtcgtcttcttctccgtcccttgggccacctggtgttcttctataccacgcgtccacgccactgctaagctgctccccgttcgccaggtcggcgaccaggcgaaacgtgctgctgcaagaagaagaataggtacacagacagc

SEQ ID NO: 809 - DNA, 1500 bp, Zea mays
tggggttgctctgagaaaaaatctagcagccagcaagatgcaacataagaatggtttcagggctgcatataacattaggaagccctaaattacgtaatagtagctgagtgtggatgtcaattagcagaattagtgaaaaactaggcacaattgtaggctgaaaattctaagaaccccttttactaaaattcatgctactaaacagaaatggagcagtttctatcacatttttcctgtatgatccctacctctcttgtgttactaggggtaactctgaatacacaatgatcatgtagtatatacttctattgagccattttctaaattagaaatgccagtgtgttgaccattcctcacctgagtttgatatgtgtctttctattcctaatttgaattcatgcttctattcatgaatgataataagtacttatttggatcagtacttgtagtaataacatatatctgtcttcctagtttcaccatgatttgttgatccaccggaggtacatttggattgagcactagaacaggccagttgttagtagcataaagttagttatttgtttggttctctctgaactagcaattagctgtcagtttgcaaactttcgtggtggatatgcagagggacttttgactttgtttatttaagacataaagtaacatatgttgtagcttttaacttatttctacccccctgtactaacctagcaaaaaaggatatatttttccaatgctaccacattctgtctatgaactatttgataaatgcacacaatctgctaaaagaaaccgaatgtcacggctgctttgcttatatatgcctatgtaaagcaattaagttgtataattctactgaggctagtttcacgaatgcagcagtatgttactaaatgcatccatctatatctatatttcacgacactacaattatgatcaccactgtatggaaaacagcagggttggtcaatgcctcacggagctgcttgcacaacttgcatccttctatatttcatgcagcgttggtcataattgttaagagttatggaattttgatggatgcatttagttttatagtgctgcattggcatattagaatggattcagtttatttttgcagattgcatgcattaatcaagtagttcatagttagaaggtggcagtattgggaaaacaattttttgctaggttagtagacaaaaaaggaataaattaagctataacatctgacaccttatgttaaatgtgaatgctggtacaaattttatgaaagttttttttgtctgaaagctagcttttacttcttagttttggacatgttgtatgctgtgtaattgaatagttggaatgacataaataaatcattttcaagtttgtattgacaggtacagtgatttgggattctatactacctagctttatgattgcaagacctggttattttcacctgaggttgtgttcaacatgttagtggcatgaaaattgcctcaattgggggca

SEQ ID NO: 810 - DNA, 581 bp, Zea mays
aggcgcttatccatttgggcgagcctgcagtcctgctcatgccgcggtgccgcctatggcagggagcagcaagaagccaagaacgtggagttcatgggttgtgcaaaacagctagggcctgtttggtgacaatgtttctcaaaaccatagttttacaatactacactttgcagttgtcattaataataccgtagttttggccagctccaagaatactagctattgtttggagatatcgtaaaccatggtatttaagcaaaagctagtcctaccataaaaactttgttcaagtggagcttcactccaaaaataccattgtatctagaatgccatggttttgaaaacacagctttccggaatgcaaccaaacacatggtataaaatgctatgacattcctatagattatgatactgcctagaaagtataaaaaatattttacttcgcgaaagggcctctagcctagcggttaaggacttccgagtagcacctccaagtcctgtgttcgattcctatcgggagcgaattttcaggcttggttaaaaaaattccctcgctgtgccccatccgctctcgggttgcg

SEQ ID NO: 811 - DNA, 501 bp, Zea mays
ctcgataaaagcatcacctcttaaaattgagtggaattagaccattctaaatttcaattcagtgacatctaaacaatagaattgaaattacattttatttcaatactatgactgattcggtatagaactcaattcaattttatgtccttcaatattgacatctaaacggagaggtactgttatgggcttatggctagtttaaaaacttaaatcctcttatagattctcagggtttgagtaaaaaatgagctaattttttacttaatctaagaatccttcccaagaatcctgaaaaaaatttaaattttcaaacaagtccttacaatatatatatatatatatatatatatatatatatatatatatatatatatatatatatatatggaaaatgtccttaatcgtcgaatctttttgtaacccgcactacccaagcaaagaatgagtggaaaacccgcgtgaccggtaaccgcccgaacgccacacaacacaaatcacaaa

SEQ ID NO: 812 - DNA, 376 bp, Zea mays
gaacgatttctaaccgaattgcttatctaatttatatatactttgattaactggaacgatttcaggtgcaatccgatacaaacgaataaggtcttagggaaaaaaaactttgacaaaacaactcactaataatttcgtgcatagcaaagagagaagtgtgtgagagagctattcttcgagctgagaaactcgtgaaccgtgtgtcaatccatacgatcgtatctaaagatgccagttgcgtctgtctccctccattcttgcccatctttacctgacacggcgacagatcgtcagttcgtcaccgcccaatcagtctcccagcatttaccggctcctccgcacctgctgctccagttccagctctcccaacaccaac

SEQ ID NO: 813 - DNA, 62 bp, Zea mays
agtgaggaaaagaaattcatttaaatgctagagccaaaaaatgcttatatgaatctcttagc

SEQ ID NO: 814 - DNA, 1500 bp, Zea mays
gctcggaaagatccggcccgtttgtattttaggccggcatggcccgcaattattatgggtcactccctatggctcggcacgtaattggttaaatgtgcctgtctcatttggagaggcctgaaattcacatcagagctcgaagttcaaaaagctttaaaaaataaactacctttgttttaatttagatttcgtttgacttttgaatccaagtttgattggctcgtcttattaaaaaatcataattattattaagttttactatgatgtcgtttatgatataatacattttaggcatgccattaaatttttccttttttacaaaaaaaatgaataagacgagtaggtcaaacttggtataaaaatcaaatgaattataaattgaaaatgagggagtaaaagataagacaaaaaagttaaccaaaagaaaacttaatatttctattaagtcaatagagttgtgcaatgactacctcattaaaagctcttttgtcagaaagaaaaagagtataaccagctccagatagagttcacaagttcagtttattgtctaatgttcataacaatagtaaaattatatgatatcttctaattcaaagctacaaaagaaacatatgactaacatcatctctaactttgtgttctctaacatcatctccatctttgtgatctctatccaagtacatgaaagtgtgaaataaagtgcggttttaatgaatatatgagtctttgcgtgcatgccttaaacaggtcgtaccgtttctggcggcgacctcggccccagactggcactaaatatttttgaccatgtcaaggctaggtcgtgctttttttgtgctctgtgtcagcccatcagggccggcccaaatgtacaactatagatttagtggaggttatggtgtggcattgatttggttaggtcaattttgtaaaatttaaactagtggattatatagtgatatagactatataatacaataatatttataaggtacagctcacgagctaagtcaagtcgagccatattttgagctggagccgcctcttttcccgtcgtaaccatagaaactaacttggtcgatttatataacagttgcaagggtgacgactagggaaaccagcttagcctgacttggtcggtccatatcagggcttgttcggttagctctcaatccatatggattgagtgggattggatgggtttgaatcccgaacaagtcaaacttcttctcaattttttccaatctcatccaatccatgtgttttgggaataaccgaacaagccctgactgggcagctccctagctcaactcacaccacatccacaccagccagcaggcaggcagccacagcccacagagcacaaattaataaacctgctggtagtagccaatcctcgataaagtgtacgtgcaggcagctctgcatgtgccgcacacgctagcttagctaaccagcagcagcgcatcggtcgtgtcgtctcgtcttcgtgtttcttccacc

SEQ ID NO: 815 - DNA, 208 bp, Zea mays
gtagcagcctagcaggtactacgaagaatgcaattgcattactgcactctgctgctagctagctgtgagcctgaatcgtccattgattcgctgtagctcaactagtcaactactgatcgatgatcaacctagcttagctaggtatcctcgttattgatttattaattaaatgatgttttttcatgctctcccggggtgatctagctac

SEQ ID NO: 816 - DNA, 92 bp, Zea mays
tgcatgcctgcagcacctgctcacctctcactaaaggaattattgcgttggaacatgtttcaaccaccacgctcattatcacgctgatcatt

SEQ ID NO: 817 - DNA, 922 bp, Zea mays
tgcagacctggtttatagattcaggattagaataaaggcggcggcgggaaattcttattaggtgctgtttggttgggttgatggagtggtaacggtaatggcaatggttgccggcgctagctgctgcgtttgattcattagcgccatttgtttcttttttttttttttttttgctgtaacggtaatgaccttagctgttgtttggttcattagcacctgaggttttattttggtttgattcatctgtaaggtgctgtttggtacggattcttattagagagatcggatctttctctctttttttgctggggttcaaaatagccgggtgatggctttacacaaactgcattcagatcaaatcagattcatcccctacctttcaccttctatgtgccttctattgactgtcaatgaatcttgctgtcgtttcttcgactcttctagtttgttctcttatttgtatacatagcatacacgatcatgatttttagatttttttttttggcgaagcccttgcttggctggctgattttgttggcatccagccggtccttactccttacagtagttgacaaaatatttctagccttttcatgtggtcctccagttgcacagtcgagtctaatgatgccttttttttcctctgtgtattgcagattacaagttcgtaacaagcaccaacaaaagcatcagggaatgctgaaatatgtgcttgcatagaagatacttgagcggtctggtggctcttgcgcaaggtctgcaggcctgctcgtcccttgacttgagcggcggtcaccttgcctgcatccactccacccccttcagagtccgacgccaccgacccataaggcgcagtccacctgattgacaacagaaagctagccctgtgcgtgatcacacagttttcatcaagataaaagat

SEQ ID NO: 818 - DNA, 1500 bp, Zea mays
caacaactcctagtctccttggggctataagaggcatccctaggcgcatagagcaggcacggaaaccatcacaagagcatacaacaaactccgagactccaatcacgctttggttcattcgagagagatttgagcgcattttgagttgagactatgtcgattttcatttgtgctctcttttcttcacttgtgtgcgtggttttgctggatttgtgctcttgtgtgtgttgctaatccctcccttactcttgttcttgattgtgatgatattgtgtaaggtgtgagagactccaacttgtagagattcctcacaaacgagaatatactaataaggaagacaaccacaacactcaagtttgatctctagatcatttgagaggggttgagtgcaacccttgtccattgggatgccacaacgtggaggtaggatttcggccgaaccacaggataaatagacgtgtctcattgtctacttactttcattgtgattttgttcttcctagctctccacttcactttcgttattgatctagtttcaatacacatcttgtgagagcaattaagtgaagaaatcctccttttattctcaattgaacttggttttagatttcactaatcccatttatagaccaagtttgttatttttagttaagtttttgcaagatcacctattcacccacccttctaggtgctctcaaattggcacttaatcgttttcttgcaatccaacccagtcaaagaggatgtaaggtattacgctccaacaacctgaatctatctaaaaccctagtctccctcgcattgctcatgtgtgttacccatattaggaaattggcatttacgtgtttgacctagggtgctaatataagtttattggataatttggtgtcttacttgcattaggaaattagcccctacgcatttgattatagggctgcaatttattttccatgtaatattctatttgagcaaagaaatagatcttggaaaagtgtcaagttttgtaggatcaaagcaaaaccatattcttgtgtgttaaaagtttgtgttttcttaacttcttatagccaagtacttctacggcgaagttcaaagggtcctaacacaaaataacacagaccgaccaccagacgccatgaaacaggctcagagatcaagactagtctacaggtaggaagacccgatcgatgattggcgcccaaagcgcactggaaccactgcatgcatgcgatcacgaatgaatccacgttccaaccgccgcatgcagcagatagcgcggaggctcccatctgtccatctctggatcacaccagcgcagtcatacacacacacatacatccataacaagccgcccgccgctatcatatccatccccgctctcctcctcgccgtcgccactctctttgcgcgcgccacgccgaaaggtgagctgccgggcgtcgtctatagacgtagagcggggcagagggccgtgagctttgggagaggaggagataatta

SEQ ID NO: 819 - DNA, 375 bp, Zea mays
tgtgccaacaaaatcatccacaatacaatggttgtgctcatgctctgctaataacatgcaaatgtagaaaatcctagccacttgcgcaaatttctgcagggaataaatcttatatgtgctataatacttatggttgcaacttgcaaagcacacaatctagaaaaattagtattatgccgcaagtccaattgcaacaacctggtgatatattgaaatttggtgcagataaacctccaatcgaggaattacatcagtttttggagttccagcttccaaggcagtgggcacctgtttacagtgatctcgctctgggtcctcagaggaaaagacaaggcagtacatcgttgccagtaaatttaatcggtccaaagcttt

SEQ ID NO: 820 - DNA, 76 bp, Zea mays
taacaccgtcgtgctcgcgctggcatccttagcttgggcaggtcctcctccctagctagctagctcgcacgccacc

SEQ ID NO: 821 - DNA, 1500 bp, Zea mays
tagctaattctactagtagatttttagccaactaactattagctctagtgcattcaaacaccccttgtatctatattatcatcatcatcactatataatccactagttttaactttgcaaaatccacacaaccaaaccactccacccccataacctccactaaatccactaaacaaattgcacatacacttaacatgtcatcaaaatcataattcaaatcgttggataactctttatcctctactgacttaaatttaatagacaatattatttaaatcatgtatcatccctcctcgcgaccaaatgaaacataacaagaaggcccacactaccacgacatgggaggcgaatgtgaagcctgccactgtgttgcgtgtaacagcttcatcatttatttgtttgtgggggccgggcgtgcaggtgggcgccgcaagtggcaggaccgcttcctctctcaccactgagcggagcagtaatctagaagagcagaaacggacggggatgccgccggcccgccgcgtacggccgtgcgccggcagcggtggaaagctggaaccgcacgcacgagtgtcatgcccatgccatgcggttccgggaaccattaaccaactaacctacgcacgtaccgcgcgcttgaactggacagcaaactggaggcgggcgcggcgccgcggactcaggtcgacgtcccgatcccggcacggcggtcggcagcagagcacgctctcggtgtatttcggcctcatcggcagctcagcctgctctgccgactgtttcgccttccccgcaaggccgcaatgcaaaccgcggacgcgccgttcgtgccttatcctcctcggctaagctggctcccagccactgacaccgggggctgtgacgtggacgcgagtttattttatcatcagtaaagcactgggttgagtcagaaaagctcttcttccgtccgtccgtccgcttctctctctctctccggttctccctctctcccccaccccgcgagaccgccggcgaatttgttgcagtgcactgaagccaacagctgcaggacaggaggaggaggaggagctgtttcaacaattatcccccgcgcgcccaggccagccccgcccccgcccgcccactctcccgaggtgagcaacgcctttcctccagcggctgtctgtttaatttgggtctacagctcttccccccctcgtggtctcgtctatggaattcccggttcaatttggacttgggctcctcccttgtttactgtaaccgtgtgcgtgcgagtgtatgtgaagaaatcccagcgtcgatcatgtagctgcgcgaggtctctatatgatgtatgccagataataatggttgttgtatgatgatgatggcgcatggcggctgccaacgcctgtttttccccgctgcagtacctttgcttcactgatattagcaacctctatccaggattccaggttctcaacacaacagacaacaccgctcaccgcatatatatatatatag

SEQ ID NO: 822 - DNA, 510 bp, Zea mays
tcctatatataccagatgtaaacactatcttttacagcctatcacattcacatttagaggttcacaaagatagatcaaaatttataaaataatcatttaatattttttttattttatttatatggataagcagctggtgtatgtgaggagctgtaaaagatattttttacatccgagatgtaaagattttttttaactcaatgctggttaccggctgggaggacgatgataaagaaagcatctctcactgcattccgggcccactactcaaacgttcggcacgccaggttggcaggtagccgttacatcgataggcactcggccactcgcacgcagacaccacaccagtgtgctcagtgctcactgctcaccataataacgctgcacctcttttcatttcaccatctcctgcccccttaaaaaaaagactcaccgtcgacacgccctcccgtcccgagagttctgaatcgaaaccgtcggccacgagagcagtgcgaggcgcccaccgcg

SEQ ID NO: 823 - DNA, 536 bp, Zea mays
ggtaaacaccgtttcctcgatcccatgttcccatggcatgtacatctttttggctttgtgaaacagattgctgcattgctcttgttggcatttggtaagtgacaggtggataagatggcctaggctaggcccctagctaggtgtgggcaattttcagtgtttggtgtttgctaattcctttgccatcaggtcaatacgtacactgttctgtttgactaactgctaatagaaattttgtcgctaatggttctgaattagcgagctcaccattgtacttttgacatacgcgttgaacatacatgcatgcagttcttgaaataaataaatctgaccatgcatcatcttggtagtgagttgatgatgttgactgtctttactccatattgtagtatagtatgacaagtagtgcttcctatacgacggcagttccatttgtctctgtattctactaccaaagttattattccgtgcgcatgtagctgcaaggacattcaggaataagattagattattggctgcttcttgaagtaactatt

SEQ ID NO: 824 - DNA, 1500 bp, Zea mays
atatgtttaagaatactcctccagtctcctttttagttgtttctcagttttcttaaaaattaaatgcactcagttttaattacatattataaaaataataatatttaaaacaacattacatagattattaaatctttttttataataagtttatttggacatagaaatgttagtaatattttctataaatctaattaaatttacaaaaaataaccagcatgctctacagttaataagagctataggaactaggaagcatatagtatttttaccatgacagtcctttattttgcatcagaaacatataaatttgagtgtcgaatcaggcctctccttggtattgtgtaccacgcaagtattccaaaacactttgagggaataaaatgcaaatcatgtttttaatgtgtggtgtaaaaacaaagacatcatgtcttcatagagacatacatgactctattttctaaacctaagacacacttttactagtacaacccatataaatgggtcatatcttaatgtagatacaatatattgtacctacatgtgtcttaattgtgtttcctacttaaaaactgcaccatagtgtcagggttatacgtgcctttatgtgttatgctaaattaatgatatgatatcctcattgtaaaataaaaacggaaacgttgatttcttatatacacaaattaaatctgacgtgagatgcgtgcaagtattatatgttgccgaatatgcttaagtcggtggtacctttgaccatgatttgaaggcgacataaatcaatttctatataagtcgaattatcttagttttaattatttttatagaaaagggcaatacaaatgaacatgctataaaactatattcttcgatgtatttaataatattaatataatattataattatttatttttaaaattttagttaaagtttaaaattttgacttcaactttaaaattttatttactcggtgacagagaagtagatggaagtcgtcagtcgccaccacctgtccatgtaccggtcccacggaagaaccgttacaaatgccgacagcccaaaagctggcgcagtgtcttcggcaatttctcccgtaaccccgtcaaagagctaaaccaaataattagcctcacctcctcttctctctgcaacctgggcccagcgctacgctggccccgcctccggcaagacgaacctatacggccgcgaaccaggaccactaatccggatcaagcgggccaacagggcgcctacctagcccacatgtcagcagctcgtgggtggccacccgtcctgtagcatggccaccgctggccacgcctcactgcgtagttgacacacgcacgcccgcgcccacgctcctaaataaagaaggcaactgcggaatcgctcgcgacgcaggaggtggggtgagttcgcgggtcgagcggaggagaagcttctggtggtggtggctctcgtcgtcaagcaggaggggagagaggagccggcggcggaggtga

SEQ ID NO: 825 - DNA, 205 bp, Zea mays
ggtaccctatcctaccgtcgccacccgtgtttctcgggggggccgtgtcccttctctcgtctataggtcaataggtgcgatgtcatgttgcgccgggggcgtctgcggcgcctgatttggatgtacggttggtcagatttcgctgcgctggtacacgagttggcttgccattccctcgagcggctccagggtgccggttcgatcc

SEQ ID NO: 826 - DNA, 1500 bp, Zea mays; identical to SEQ ID NO: 824

SEQ ID NO: 827 - DNA, 775 bp, Zea mays
tatgtcttgaatgtactttgtttggctgatgaaggtatcctctataaaatgaggataaaatttcaacatatgggtcctatgttcaggacatgagacaccgagttatataattatttaatattttttgtgaaataagatctctgttgtagcaggtttttactgtatggttctatattttaaaatagaaccttgattaggactcttttacaaattacaacaaagtttaggacactcttacaacatatattttagaatatgtgctagagggagctagctggtagtcgactaataattagtggtcaatctttttatttcttctcttctcttctccaatttagcagaaagatatgagaaatcattggaaacttcattttcgaaagagatttctatttttaaaagtaaaaataaactaatttttcttagaaaaatacaaatcacttaggaaaattggttcctaaactagttctacattgctttctaaagtccattgatatgacatttcgttcaatgattggctgacagaggtgatagccgacagcacagtcgaggactcgaggacttgaattggaagatggccgaagaaacctcatggtttgaccagagcggcagatagagtaccccaaggcccaaacccaagtgcccatcacggagctctcgctagcgacgacgacggcgcccgctcgattggtgctacaagatccctcgtgcgtccaccggtttgcggcgtggggatctcggctctgactgaccgtgcccggagccggagacaggcgcg

SEQ ID NO: 828 - DNA, 118 bp, Zea mays
ctgcagtgcggctgccgccgctgctccatcacgacgacgccaaccacctcagctcactagctcccgcggacccgcctgagcgcagccaaaaccggggatcccaggcgcagcagctagc

SEQ ID NO: 829 - DNA, 135 bp, Zea mays
ggtgctacatcagctctcactttcccttgtatgtcttatataaattctggacttagtttagtttttttcctccacctgctgcaggagctagcagagtggaatgccagatacagggagaagtttggcttcgtcttc

SEQ ID NO: 830 - DNA, 249 bp, Zea mays
gtttaattagtgctagttgtattaccattgttagtgacttaattaccctcacgcgaagcaccttacctctgctagtcctcctaygtctcttctcttcgcttaatcttggtcggtgatttgattcttcacttcttgcgcgcattgcagagggtgctcggtctgcagctatcttaggttaaccagtcgtgtgtggtctatcgatttcgatatagtactactgctctgttataatcagcgggaaggaggaag

SEQ ID NO: 831 - DNA, 886 bp, Zea mays
ttcatataattttcataaatatattagtaaagacttaaatctaatatatttatgggaaatttgttatacaacaatagctaaaataataatcaaactgcaaaaaatagaaacatctttaaaaaaattggacttggttgttggaacaaaaaagtcgaccacctaatattatttagcaattgagggttgaacttagtacctaatagaaccatttccaaggtcacaccatcaagtcaaatgaaggatcatgcttaagatacaatatgattttattttaacattccctagccatttcgaataaaaacaattataaattttgatcaaaataattcaaaatatggtatggagtaaaagcttgagataaaagtttcataaaagggtgtctctttttaggatacttagggtctgtttggtttgtggctaatatgccacactttgtctaagtttatcgttcgaattgaagaactaacgttagacaaaaaagttaggcaaagtatgataagttaggcagcgaaccaaacaggcttactattctctatagtttaaatgcctttcgaaacaaaaaaataaataaatactaaatatgtttaaaataacttgatatagagttatactttaatcttatgtattatctctttttattaaaaaaaatatggcgtatcctcgccatggatggcttcacgggcgcgcacgcttcttccttctcgtgtcatctccgcttgcgccgcccctagccccaccatcgtcctccccatgaagccgccggttgagccgccccctcttgtgtcgcctccatgtccgcgcagatatgcctcgctcgccaccccgccgtgttcctccccgagacaccgtggccagcctctagcccgcgctcttcctcgtcacggcg

SEQ ID NO: 832 - DNA, 1500 bp, Zea mays
atgatgttaaatagagtaatgcttgattattgctgtcaagtggttgtgttagtaattggaatattgttggagtatgtttccctttatctttccattttatcatctgtcagtgctcgtgactttatggtctctaaatttcttagatagttcatgtcgtaccatgaaatgtgtgtctgcaacattggtcaaccatattgttcatgtcttcaactctatttcgaagtcacaaactgatcacaagttttggacgtgaagcatcgacaggcatcaatgcctactttagcatttcactgtacataagtccatcgacttcacattatactcttctacctaacaaatcccaaaattgagctacacatctttttgatattagtatgttaatgttagtcaattgttatcaggcagcgatgtctgattatagatctcaaaacaagaccgtcatttccccttagttcagttagtatagttgcttaaattcagtaagtctgaatacttcaacaaggcacaataagggaggttcagcacgtaagttagtatacgaccatgtgtaatctatttaacagagaaaataggcataaaaacgactagcctgcagacgtgcggatatttgaatataagtgttctgatgggcgagcgcccttgtgctttctctattggctaaaattcttgaaaagcatgtaagcttttcgcaaggttcgttagcagtgactatctgtttgtagtacatgaacattagtattttactttccttagttcacctttcttgtgcttgcaatacaatacattattttttacggtgaatttataaaccatatttggtaagttatgtttatactagcctaatgcactcgactcttatatttagattaagtttggtgaataatttatatgtttgtgtagcgaaagactcatatttatttagtttttttctagtcaaggatagaacataatgtggtgctttgcttgtgtaattatgtctacacacttaaaaatggcactttccttacgcattggtacagtgcttcaataatgagtggataaatgttctatgaagttgatcttatttttttgcaaattcagcattaataatcatgtgccacattatccaaagcttatggtattctttatatgattttagtgctaataatgttgtgccactatagggcggtgccggctctgatctggtttataaagtagcaaattttgaatttgttttgttggctctaaattctgtgcgaacacttattagtctgctttgtttattatttagtgcttcttatattatattgtttgctctgttgaatgtttctaggtctgctttatcccttgctaacatgtaccatgctttttctaagccgattactgtagttgcaactccaaatttagtttctaatcccatctaataaattgttttgttagtggctttagtattgtgtgatttttacttgcgttcctaataattgattcgtttgattaacagtttaagcttcacctctagtc

SEQ ID NO: 833 - DNA, 175 bp, Zea mays
catggggcccgggcctggacggggctgcccgggcaggcccgtttggctatgtctacaaataactcccttgccctcctctttttcttcctcccgcttccccaccccctcaaacccgaaaggaaccctaatcctagccgcacgcgggaggcagctaagagagcttgaagcaccagcc

SEQ ID NO: 834 - DNA, 886 bp, Zea mays; identical to SEQ ID NO: 831

SEQ ID NO: 835 - DNA, 1500 bp, Zea mays; identical to SEQ ID NO: 832

SEQ ID NO: 836 - DNA, 1456 bp, Zea mays
ttaacgagcccaatatcattagcacactctatatcatgaggggtggatccagagagaggtaaaatgggtcatgactactatcatatatagaaaaaataagtttctgggcgtactaaaacaattatatcgaagatcttcttgtcggatcaaaccagtcctcctcattgatccagttctcgtatctatccatctgatctcattctttacgacgctgctcgagcgagtctatcataatactccactcctgacattgttcgcccccgccccatccctaacctgcgacgttgtctgccccaccctcgcctcgttcgtcgtcgtcacgattgcggcccgttcgtcggattcgatctcgctcgttgcgacaatgtgatttgtccttggccgccgacgagcttgacaaattagtaagtcccagctctcgaccgaaaatgccgcctgacctcgctccttttctagcgtcccccacccttcgaagagatcgccattcgacaaagtatgatagttttattctttgaatttgtatcgtttattgtaatttgaattctatggaacgttatgctcgtttggatgtcaatgttggagggcatgtaattgaattagattcaatgccaaatcaacggtggtattgaaatcccccatgcgtcggaacgccgagatgcaagccaagcctttccggaacaaggcgcggcgtggaggtgcaagtagggaaaggcgaggaggaatcaggaatccgcaccgacccaccgaacgcacgccgtccatcggccaagagcgagatgccggtgcgtgctcctccagctccctgcaccagcccagcccagcctgcacaggcgtccagctatgtcctcgcaggcgcgcatccgttaccagagaagcatgtccccggcaaggggcagaggtgacccgacagcacgtgatgtgctcgttcgttcatcacagggcgcctgcgagctccgaggagataaattttgttttgccacactatccagcgttcctgtcctgacgcctcgaaccgtcgcaacagccggcaaaaaggccaagaaacggcagtaaacattcaggcaatcaggcgacagggcagcacgaggacgtcggtgggtgaactggaccaatacctgggagtttggagtgctgtgcaggctgtgtcgtgcgttacgttacagtctcccggctggctagtaccgcgaagcgacggaggaacgtgaaatccaatctatatgccctctccggaatctggataacgaagaaacacagccaaatgttgcgagttttgcaattcatcagaacgcccggtttcagatctcttgaaagatgcaggtgaacgaacagatttgactccaggacggtgcttcctatatttacaggttttgtccaagcatagcatgcggcccagaataaaattctggaatttcaatgccgatctggttcgttcgggcatcagaagcccgggctgagg

SEQ ID NO: 837 - DNA, 884 bp, Zea mays
ggaggcaatgccgccgcgtggtcggtgaaaggaggcacgcagcgattgaccaaataagctagggtgtttcggcctgcccacgccggtgcatgagctgtgtatttcgtaagattttattcccaacgaatacagctaaagaaacccaaaaggctaggcaggttgcaagagcaggacggacagatcctatgaaaagcaactgggaactccaggattggatcggtaggaatctctctcgtcacacaagataactgaataagcaactgcagaagattaagtagaatatttgcaattttatactacatcctttcttttatatatttgtcgctgtgcagttcaattttgaactaagcagtgtcaaataaaaaaaacgaagagagtacaagggtcggggggggggggggttccattacatgttagcgtcatgctggcaatctgcatgccccgaatcctgaaagacagctccgatcgagggtcggagtcccatgacattgtaaacttgttttagttggaataagaataatgtatagtagtagggatgctgttcgtgtttctgcaacagaaagaagaggtatgtaaatcgaacagatgatatggctttgcgtgtttgtctgccctttttcgagcaagctttgcctccgttacatggtcgttggctgtatgttcgctgtatatgagccaacgagaaaaaaacgaatttaaacaaagaaatcccctttcgatctcaaccctgagaaggatcgggctacgttgatcgatggaccgatcaatcgatctgtacaaaaaaaaaacaagtgaagcgatcctctaaaaaataaaattatccaagaggatcactactgagcagttaatcacggccgacggttgctgaggtcagacagactcag

SEQ ID NO: 838 - DNA, 205 bp, Zea mays
attgatccggcgtcgcgcctgattccaggcgataaaaaaccccgactggttcggggtttttttatgcctggcattccagcgctgtcttgttacaccgcagtacgaatgaagtacccggccccacctttatcccctcccgacgcaagcctaaattggccccactgcccgcccatcaccccgatggccggccactggagttatcgcc

SEQ ID NO: 839 - DNA, 934 bp, Zea mays
taaccttcctactactgactttttataaaagttattcaaggcatggttgcagtaactgaagtctagacaaaatcataatgtgtgagattatctcaccgctatttttgactttgttctttctgtcgttatcacatcacaaccttaccggtcacgagtcacgaaccgaagccccaaacgagatgcgctgccccccgaaggaaaaccaccaaccgtttgccctacccgtgcggcccggcgccgctgcgctctcccgaaagagaggtgccgaagcgcagtagattccccttcctctccatcgacccctctcctcaccatccttgcttcccacctgtccgtctccttcctcgctccgcgcctcgccgcctcctctccccgcctccgcggagagggagagagcacgtcctgcccacgagtgcccccgccccgtgaggaaaccctcgcccgccccttccgttcgcccgtcctgccactggtctccctgaacccccccgccgccgccgccgccgccgccgttcggtttccgtgtggcgtcacttctgagggattttctgggtctgacaaggatcagcgctggagtggcctcgccgctgccctccgttacatggaggagttcctgctcaccctgaacccgttccggttcaagccgctctggccgacgacgactgcccccaaatccttctgaggccctaggaaatcctactcccgcccggcttcatagaatccccgggccgcccccccttccccgactcccttttgtcctcagatagtcatccgggttttccgagaggcacccctcctcccctgcgaatcgagagcccctagggccgtaagcccgtaaccataagtcctcctccactttccgaggccccgccgcccgcgccccggacctgctgtgagcgtccttccttggtggcgttaagcgttgcggacgggg

SEQ ID NO: 840 - DNA, 1500 bp, Zea mays
cacgacatcgaagtctccacccacgtaccagaaaaaggacaggacgacacaccttacgcgtgcccgaacatgctggagggtgacacaagggagttgacggaagatgaagtcgtactgaacacgaactcaaccttaccggaagcacattatgcggaacccatctggtacgatggcaggagcatagagtaagctacagggtcttgcacagtagatatatgtgatagagcgtcatgcgaggaatatggaggcacacaacctattagaaggagtcatcccgtacacagacacgctccaaaattaactcggaggtcatagaaaccttccatagagaaccgttgagtagtgtgcatacggtatatatggttgtgagaggtttttatgaaaccggagagagccttaactctcacgaaccgagagccgaactttgtctcacgaaactgtgtcagttagttttattcaggaccagagctgccctaaaagagagaggaagcataaatctacttctatactcctatctactagtagtatgacacgacgtcactattcccctcaacaacttccagttccagtcggtgatgctcaaattagyacgccaagatccatccgtacgtttcagatcatatggtccacgtgccaccaagaaaaccccacgtgcacgctttgcaattgcagacctgcgccgtccgtcagtccgacccacaaaaaccgacggccccgatctactacatacgagtatacgacccgtgccgtttcccaccgttacgtcagtcacaacaaagaacaaaccagcgccacacgccgcagctgcccttatctcggcgcgycacgtctacacccttgggcaggtttggtggctgtttggtttggggcctaaagcgccacaatgtgtctaacttttctatctaatcttagttcttcaattcgaacatttaaggttagacagattgtggcgccttaagtagaaaaccaaacagacccacgagggatactagaacaaatacacttcatattcaaaattaaatagtaagtacttgttcggtgggtttaaatttcaaacaagtcaaatttattcttaattattttccaatcctatctcgtacttgttcggtgggtttaaatcccaaacaagttaaacttattcttaattattttccaatccaatccatggataacaagattaacggaataaaacgcctctccgtaaaytcgtgatctctagtcgcaaatcagcccttcactgccacctagaccccgccaccaccgttctacagtcccggtccgccggccggccccactacccgcactcgcacgtcgaaaagcaaacctatactcacctgtattgaggtcggcacgccccccataaatatcgacatcgtcttccacctctcggcttctttactctctaaattttcttttttttaaaaaaaaatattgttctttggcgtacgctggtgcgcctctcctccccgcctcggcatcgacgcgatttgcgtgcccgac

SEQ ID NO: 841 - DNA, 1500 bp, Zea mays
tggttgttttttcaaaaacttcaatcatttgtcttattaagaaaataatatgttctataaatcctacccactccatcacataatatagttttgaagttcaattgttaaatctaaacttcctcatttacagaacatttgtgtttatttgtatgtttaacactattcttaataatataaaaatattgctcatatatttgtatgcatttatgttgttcttatggactaaatagataaaaaaaaataaggctacgaaatgatatgggcaatctggtcgatttgtttgtgagatgagaaataaaagaatgaaacaatatagatggagggttgttttctgaattcatttgatgaaactgatgttgttctttcaattgcttgaaaccgagtgctatttgctgaacattgtcttaaagtagtgatgttttgtggacaagctaatgcatgcatgactctcataccaaaatcaattctcctgggctcttcatgagcatgtacaacgcacataaatgcctcgtatcttaaggggtatcaaggagttaagtgcaaaaaaacataagagacggtatcttggtgaaggaacgtctctagcacagttctctaagtctagatacgattctactcatacaacccacataaatgagtcgtatcttgagaggttctaatgaataagatacaagacttagatacattgggttgtatgaagtggtttcttagatgtatctagtgcttggaaaaccacaatatagtatctaggttatacatgtcttaaagattgagcctagcacaacactaatgtcgtaccaccacaacatcggtccaggcaaaattcccactccagcataaataatgcctcttcaacttcgccgtccacgctacatttgaaatacaagcaggttaggacaacaatacgatctttacaatatagctttggtcaatgttttgttagtggcatataaattaactcttaacacatttaaaatttttaataaaaaagtgcttttaagccaacgatgatacaagcatgtcatcaagtttagtgctgagaattggatcggatcgagcccgtccgttccgagtctattgtgcttctcagcttgttcgctgcggcttgctgcggctgcaatccggctgcggctgcggcttctacagtatttttctctctatggattgcagctgcagcagtccaaacagctgcaacagtgtcggcttgtagccagccgaacacgctctctatactctgtgcaaactgctggcgcgttgcccttgtgcaggtttatttttttgcggaatttcaatgcctgccgctgctgtccacgtgtagttcgcgtgccctgtgcgctgctgccgctttaaagcagaggggtctctctcgtgtctcgtcgtctcggtgcctttctctatcgtcccgatccgtcgttcatcagagtcgtaaccgtacgccctcgttcccctcgtcgctctcccaagtcccaaccccggttcctttggtctgcgcgagcgagc

SEQ ID NO: 842 - DNA, 1500 bp, Zea mays
ttcgaaatcaccacaaaaccctagcgaacagaaataacggagaagaggaagcatgggaggatgttgacggacacgcgcttactatgcagcgagggagacgatcgggaccaggagtgtcgctgatatcgtcggaagaagaaaccgccgggaaccacggtcgacggaggcggcttgggcttatgcgagggaggcggccaggtcaacgggctgtttttttacttactcatgaacattggcgcaagtgcagcaggtccgagctccaaaatgatttaaggggaaaacctatctcctctatatcctcgtcctcccagatcaatacagccataggagctctccggcacccgccccgctgtagatccaaatcaggtggaccttctctcgtcgtggttagggagaagagcgagggcgagggagacattgatgacgtgttggacgaacctgtaccaactgtggagacagacggagcacacgaggagagaggacacacggctgttggtccccgacgtcgccctcaccctcgctggggacgccaggccgtttgagaggcccttctgggagacaacggaggcgagctattcatacatttgttttactggaaggttccaaacgcaaacagacagagaagaaatcgcgtccgttcatcaaacatcgtgtgcacgttttttttccagcccacgtggacgcacgracgagagcgtttgcgtcccgctttgtatagtagtaatttggaaaagcagacacttttaggctattcctagtgaaagtttcattgcacgattacgattttcaaaagtaacatcaatttttgtctatgaaaccgtgtatcctgagtttcatctggatgaaactctcacttctcccataaaactccatctttcttatcataaatatcgtatcatatcattaaatatggtaatgtgttatctcatttaatgagaatgaaactatatttaatgagaatgaaactatatttaatgagaatgaaactatgataaaactcccgccgggaatgaccttacgccgtcttgctctagctcgaagccactctcctgccgccgcgtagcttattagctcgttgagtagtccaaggaacacaagccaatcttggctgctctgactttgaacctgacctcagaagtcaaaagcacatgtgaaaactgatgacaagtcacggctacgcatcaagaatctccatggaaaatggttcgcgtgccttattttagttctctgccaaccgccttttctacatattttaaatttcactttaaaattaatattttacacggttaccttctatcttatattttaaacttcacttaaaactaatattttacacggctatatatatatatatcattatatatatgcggtgcggtggccatagcatatggggaaaatatggtataacaaggagcctcagctctgcaaatcgcgaactcaagcccaagctgccagtctgtggcatcctgatcggtaggcgattctcaatccaccgccaac

SEQ ID NO: 843 - DNA, 807 bp, Zea mays
cagtgactgtccggtgcaccaccggactgtccggtggcccatgctgtcagagctccaacggttgaaccctaactgttgggtgacgtggctggcgcagcagacagtatccggtggcgcaccggactgtccggtgcgcccatcgacagcagcccaaccccaacggttggtttggtggttggggctataaatacccccaaccaccaccacttcaaggcatccaagttttcagtcattacattcaatacaagagctctaggcttcactccaagacacaaaacaaaagatcaaatcctctaccaagtcccaaactcattccaaagacttagtggcttgtgaaagagagacatttgtgttcaattgagttcttgtcgcttggatcacttttcttcttcctctattcttgttctcaagcaacttgtaatcaagcaagagacaccaagttgtggtccttgtaaggggtctaagtgacccgttgattaaggagaaaagctcactcggtctaggtgaccgtttgagagagggaaagggtagaaagagacccggtctttgtgaccacctcaacggggagtaggtttgctagaaccaaacctcggtaaaacaaatcactgtgtcatccgctttcatttgcttgtgatttgtttcgccctctctttcggacttgactttatttctaacgctaaccccggcttgtagattgtgcttaaagtttgttaatttcatatttgcctattcaccccccccccctctaggcaactttcaattggtatcagagcccggtacttcattagagtctaaccagtcgaagtg

SEQ ID NO: 844 - DNA, 1500 bp, Zea mays
cgtccaggctaatgctgcaccccaccggtagtctcacagatccttgcagttgcagcctgtagctyctttgcaaattacagcgtatttgcagtttgctgtgcagtttggttgatcacttctaaattttgcagttgcagcctgcagctcctttgcaaattacagcgtatttgcagtttgctgtgcagtttggttgatcacttctaaatctgatttttaaaatcttgtcggttcattgcctccttcaatggcacacgctggtgagtgcacttgtgaaaaatgtggaataaaaattgtgaaacccgacagggacccaaaacctacactaaacctggctggtgcgggtgtgggattttmcccgcgggtgtggtcgcggatgattttggacatgttccgcacgtgtggtcgtgtgcaggtaactctccaatgaactctaaaaccctaaaccctaaatcctaaacccgattcattgccatttctaactagggcacataactctggtaaatgaacccaccaaaactagatttaaaattaaattactctctaaatattaagaattgttggagaccaattttttcttctaatagctatttggcaacttactaaacaaaatgttagagcatctccaatagttatataaatttagcaccctaaattataaatttaagaagttgctaaaacattttaaggagtagaaaaatgcatgtgctccagcagttccttatttatcggttgctaatttttaaagtartccacgtcaacaaaaaaataagcgagcatgcttctatttttaattgagttgtcggcagaaatcaatatcacaactttccctgatgtcttgagaggtcgaagttatgaatgaaagaccagacggtcacgatgatgccgtgaagacatcacaggatgtgctctgacgatgtctcggcataagaggttgtctagcagtggcggcatcaagatatctgggcgctggagatgaatttatggttaacaggacaatgggacagtgcaaaacagtggcaaaagtatgttttttagatttagtgagtcccaacaaggttggtaaatgtagggataaaattgggtttcgtagaaagtttgtaaatttagggaactaatttacgtaactgttggagtagagtttttcttgaaaacttgttaaatttatatttagggacttgtttacataactattggagatggtctaactattggagatggtcttagatagctttattttagagaagagttgctcaaacggtggaaagcgaacttcagatgatgggaggacgtaacacactataggggtgttatgggccccaactttataggcgaatgggccaagcccattttcaaactttctatttcagtccacgggtcagatgggcacaacacaagaagactatgggcttctagcaattcacgtggttgaagacgtcttgtcccgttccagaacactcgcgctctcgcacgacggcacgagcgcgctactgccatagtgcc

SEQ ID NO: 845 - DNA, 1500 bp, Zea mays
atgggcatgagtagccagcaggcaggcaggttgcctgaagccgaggctggatggattatggtgctgagtccgatggaatgaaacatggtgcagctgcccactcgctgtgccctgtgcatatataaacaatggcatccccggacacagagagtgatgggtaatggcagaataatccacggtccrgagacacgccgggcaagactttgttgttcttttctgtagtgtatcccacccaattgtagccagcttctcaacagccagtactcctggctcagcaacagtggctcccccgtaataactaatccatctgtcgtaaatatgtatttaactacttatacttattctatttaattaaatttataaaaaaattgacaatgcttacagttccaaataaatttattataaaaacaaaaaaaaatagtctatctaatgataccaattatgtatgcactataaatatcagtatctttatgattaaagtggaaaaagtttagctcttcggaaaacaagaatgatagttattttgtaagcaagagagtatagaaaacaagaatggtagttattttgtaagaaagagagtctagaacaacgaaaggaagagtcattggactagtttaaaaagcatgtacgactctagtggcagagtcattaggaatagagtcatttaatggctcacgattcattagttcagaacatatatgatcaaatttctagtgctcttttttgaattctcctatgaaaatttttagtcccgggtggtaacacattagtcctaattagtgttaccaaacggtgccaaaggttgatctttagttctgattaatattactgattagaacaaaaggtcctctatattcttcgtaaattttggatttatgactaatgttcatatcaatcttgggtcccaacaatataaacgggactaaattaagggtgcgaatggaaagttagtctaataaaatttcacgagcctagatactcatatacgtgtatagttatgtcttctgtaggagagcgagagcctagatacatatatacgtgtatagttctgtcttctataggataacgtttcttgatatatatacatttgttggcattcatttcacttttttgtcacgtttgatcggctcatcctatttaatttttttaacaaaaaatgacaagtttaaagccacatttaaagtatattatatgttagacaatatcacaacaaaaattaacaataattataattttttaataagacgaatcagtcaaacttaggataaaaacgtcaaatgaattatagattgaaattgatgaagacatggagtataagttaaatataagcaactaataaacataactgactataatgactgttttatgcgtgcaatttttttccctccatcacttttaaaaggccaggctagcagcatggtggtttataaaaggcaatccccctaacccgtactctcacgaacccacacagaacctccctagctcgtctccccttagcac

SEQ ID NO: 846 - DNA, 1269 bp, Zea mays
ggcttacacctaattcctaaattattttggtggttgaattgcccaacacaaattgatgaactaactagtttgctctagattatacgttctacaggtgccaaaggttcatctacaactatactaattcgaatgtccggaataccgtagattattccggacaggagaagctttttgaaaaacaggccaagcgcggaccgtccgggcccctgcggcggaccgtccgtgacagaagaatgaccctcggacagaaccmatgcaaaaacacaagtttccactacagactgtccggaggaaaagcgaagaccgtccgagccctcgcgcggaccgtccggcctcaggcacggaccgtccggtcggtaagaaaccgaaaaacccgaaggtgacgggttcggagaaattaattatagggggcctcgcggaccgtccggggtgcacgaccggaccgtccgcgactggctctgtctgacatctgacgacgcattaaatgcaatatagccgttgatatagccgttactgctgaccgttgcattttcagccgttgatctacaggggcggaccgtccgcaccaggagggcggaccgtccgcgctcagcagaatggcccaacgactaggaagtggttggtggctataaatacaaccccaaccacctccattcacttcacccaagcattccaaccttcaacattcaatacaagagctagcaatccattccaagacacattcaaagcctccatctctccaagtttcacaattgagaaaagagatcattagtgattagtgacttgagagagaaagtgatccgtgtgttatttatcgctcttgtcgcttggcttttgcaatcgtgctttctttggatctttattgcgatcaactcaattgtaaccaaggcaagagacaccaattgtgtggtggtccttgcggggaagtttgttcctgtttcatkgagaagaagaagctcactcggtccgagggaccgtttgagagagggaaagggttgaaaaagacccgacctttgtggcctcctcaacggggagtaggtttgcgagaaccgaacctcggtaaaacaaatccttgtgtctcacttccatattcgcttgcgatttgttttgcaccccctctcacgggctttattatatttctaacgctaacccggcttgtagttgtgattaattttgtaaatttcagtttcgccctattcacccccctctaggcgactttcaattggtatcagagcccggtgcttcattagagcctaaccgctcgaagtg

SEQ ID NO: 847 - DNA, 350 bp, Zea mays
gaagctactcaaaagagaaaaagactgtggtattcaagttgatcataggatcacttgaaagggtttcagtgcaaccctgatccattgggacaccacaatgtggaagtaggcatgtgttacttggccgaaccatgggataaaaatcacgtgtcccttgtgttgcttttctgtgattgtttcgttcacaagaactcgcttcatagctacttagtcgcactaacacttgaataatcaagtttgtggctattcagtgtttgattttacaggatcacctattcaccccccctctaggtgctctcaattggtatcagagccgcactcttcatttaagggactaaccgcctgaagag

SEQ ID NO: 848 - DNA, 874 bp, Zea mays
atccccctgccatggagcaagcttatacaaaaccctcacaaagcctttttccatgcagaggtagtgcctctgaattccaagtacagtgttgcctgttagttgttcagatgaaaaaaaagagaaaatgttgcctttcagttcagtgctgttctggtgaataaaaacgttgcgaaggggtatctttacactttacagctctgttttcatccggcctgtgatggaaattgtgctgcaaagtgcgcagggccgttggcccgacgacaagtattttcgtcgagagaagcaacgaaagcccactcctccaagccacccttcgctcaagtcatatttagcaccacctcggcagtcgacactgcagcacaccaacttaaatattcatcccgatctccctcactcgccgagctcagttacgagagcttgtaaccctagtgggggcattaaaggtggtgcggatgctttctgacggcttctgggcctgggcccatatgtgccactaggctggactgtccatcccaagttgggagtgtctggcggggctcagggcaagccttggacctctctaggcctgaagcggtaggcacggcgtgaggctggtttaacagagcagcgatcactgcccgcttccaacggtgggaggataacaggccggctgcactgagagcccaactcgggcccagatccacattaaagcagaccaccatctttttttttacctttgtaaacctttggaggtcacatgttctccgccgctgcacccaacgtgttccgacttcagcagacaacgccatcttttttttctgcccatgggatccaacgtgttgggcccagcccagtatataggagtgcatgcagtggcgggcgatgatgtaaaaag

SEQ ID NO: 849 - DNA, 1500 bp, Zea mays
aatcctaacctttagttaggtgcaaagaaagatgaatcaaatgaggcgaggacttagattagattagatatgtttagtttggattagatctcactagatcaaatttgattagattgggtcgattaggtagattagattagtttaactatccatctaatttgtttatatatatgcatatatttttaaattttattgtgggtataactccacaacacatcgcactcaatcaaagaaattgttggggacaataattaggggcagccagattacgcccttaaaacacgcttaaagaactctacccaggtgcatcccccgagaacgagcaaccagagctccgcctcgctcgatgttcacgtcgagggccctccccaaagctccgttccaaccgagcccccccgggtgagggtcttccgaaatccccggctcacccaagctcggtctcaagtaggtcacatgctcgggggaatctcagtctcgcccgaggctccctcactctagggccaccatttccacctcgcccaaacccatctcaggcgataaagacaaggcatgctcgaaggccagcgggggacaaccgaattcaatgcgcatacctaacctgcccagctctagaggtgtacagtggcaacaagactacgatcttgtcaaagattcgcctaaacactattttttcgtccaagggtgctccccgtgtgagttgcggacccctgtagcctgcaggcgtagcgttcgcgccgaggttgggctcggggtgaagcgtagctgtgcggccggcgtgcggagcctcgggtgaattgtgatttggtcctgtatgaccttggaggtcgggagcgcgttttgccctgtgattctctggtactcgggtgttttggtatgtttaagtacataatctaggtatctctaattatggtatccgacaactactaaccaacaaatttgaaccaaaaacttagtttgtgtataaaaataaaaagacaagttttattaaggagtagattggaccaactcaaacacacatggaggggtaaattaaactaaaaatagtttaggagttatatgaacattgtgaatggataatgtgagtaatttagacttttctattaaaaaatcgttccaacactcagttttttaaaatattggttccatatctcgcatctgggcaaccgaacacgaccgccgtctctactcccagtcccagctgccaaggtcttcgtcgcctcgtcgggctcgggtcctttgccggcgacgagcgcgtgcacaccaggtatgcctgccccttaccttcgcttcccctcccttcgcttccttccgtgcaaaaatgagcacccgcgccacaattgaagctatttggctatctgtcttaggatcggatctgatctagccacgagtgtttgctgtcgtttttgagtaattcttccattgtttttcttgtgcccagaagaatacagtggaagtggtatgcggttgtaaaacgatttcgattattccaagcggccggcg

SEQ ID NO: 850 - DNA, 1018 bp, Zea mays
gtcttgcggagtcgaaactgcttgtcccttgtgtcgagctcagcaacgatgactatggatgggttgtatgtgggagctgacgttgcctggcctgtttgtgcactctgcataggtttcaggctcgatttttcttaaaattgagtcaattatattctttttttaattaaaaggtagagctcctgccattacgttcaaatgctagatcaagctaaaagcactagtttcacttatgtcactctctcagtctattcaatctagtatacgagaagtatggaaaactgttctaccaaatgcttttatataacaacttcaacctagctatttattaggctaaagaaataaattcacgttcgcttggctttaatccgtactggcttttattattgttttatctctatagattacagttgcagcagtaagaacacctgattttaatctaaagtattctaataataatacagaattatactaaacaagacctgattcctgattcttaagcctggttggtttacgttgatatagcaacagcactattccggccgctgcatcaaaatttaaatcaagacgcacggcactttcatcgaacaatgagaggcagctctggctggtgacgagagacacgatcacacgaacgcgacaagtcgacctcgctctcctcacttcctcactctatggcatcggcaagtctcaccttcgcgcttcgcggcaccttcctgacttcggtgctcccacctctcatttcccgcgagcacactgtgcaacgccggcccggcccagcccggcacacattgcgtctgtctctatataagaatggcggacgctagcgagcaactctgcccaaaccgcaccaacggccaacgcacaaaaaaccattctcagcctcctctcctactcgagcagctagcccagtcaatcattctgcttggattggatccaccttgtctctgaaaatagcttcgagaccttagcgcccaagaaacggtgaccgaccgtccctgcgctagtagcaacagcaaca

SEQ ID NO: 851 - DNA, 625 bp, Zea mays
cgaaggatgtaggagcaccgagaccgtccctgacacgaggcctccaaccttagtcaaatgtgagctaagccctctaggacgcgacctagcaacacgtgactggcatcgagcttcaataaattcttctaccataattcttgaaagatgtctccataaccttctatggatactaacacatctggtatatacaatgaacaccccaagctataaattattttaactttttatagaatttaaataaattaaacttgaccaaatttataataccaactaaatatcattagattttttattaatcatatttttataatatacatatttgatgttatagttttttttataattttgatcaaatgtccaccagcaacggacagggtatctagtttttcaaattcccaaatctttatggcatccaaatccaatgatccaaacgtcacgtgatgagcgagagagagaaaaaaaaaaccacgcaggccgcagctaccgttgcctcgcgtttccgtttcaaacgattcaaaccaaactatcgtggcctcttggggcccactgtctcctctacctcctccgtcctccggatcccaaaatctcaaaccgtcaaacgggacctgatacctgagatacgcgc

SEQ ID NO: 852 - DNA, 1271 bp, Zea mays
aaataggtgtagtgttttattacttcactgatccaatgctagataacttgaatcttatgagccctggtggaatatatcgtgtttctataatattaatgcagatgcttacatatacataccatttgatagctcgatttcgcccttcgacttttagggtccatttgttgtgattgaagtctcgctggtggcaatggtagttggtaggtgttgtcgtgttgacctgctgatgcaacaacgatcgtggtgcctcccccacctactcgctacgacgataaattttggtcgttcaggagttaattatttttaactttgaccataattatataaaaatattaatattcatattataatttagtttgattacatagatctttaaatctattttttagtaaaatacttgaagataaaatgttgctaatatattttatatatctagttaaatttaagaaagtttgactaaataccgtagcgacaaacttttgtgtacagatagcaagacaggccccagctgtcatatatccacccctactgtacttccagcccaatgcattttcaaactcctcaggctcggccccccagatgtctttgacttgaggtttcagcatctggcctcggcagtccgcacaaccgtccattcaccccacgcatcaagatccgcgcggcgtgtgccaactgccaccctcgagtcgtgtgaccgatccccccgcgcccgcatcgatcaggatttgaaatgctgtgcttctccaaaaagagccgttatctgcttccaaaccaccgccgggtgggccccagtcccgctcctgccccgcgcgtcagccttccccttccgcttggatcgtacggcagagcggggcccagcggcgcctccaaattcgaaagcactaattctagcgtccgtttaataacccctcccgttttaaaatgcccggcctctagaggcctccccgatctgatgccccctggccgcctccctgcctcctcgccgccgccaccgccaccgccaccgcttgtagcctccgctacgtagaccacgtcagtaagcacagtagcaccagacttcccctctctcgattcgcttcacgagtagacgaatgctttggttcgaggacgccgccatcgaccttaagattcatgggctgacagtctgttctgcgcaggtgtattttcttgtttgatctggagcatgctgtatcggtgattttctccttcttttgccgacgctgcggagcggcgaggagttttgattcagctgtagagagattctaggatct

SEQ ID NO: 853 - DNA, 1283 bp, Zea mays
ggctagaccactcatgctgacagcagctcttcatctattgcttaagctcatcagttttcttattgtctggcccacagatgataagatcgccaacatatactccaatcaacagaagtgagctcttggtgcctgtttgacagtacataaaaagagtcttcttcaatctcagtacctcgcctgcattcttggcatcagtcagaccaggtggattatgaacatatacttgctcctggatgtcttcatccaacaaggccgattttgacatttatatggtgtaccttccacccccatgagcagctagagctaaaatgagcctgacagtctctagtctggctgtaagtctggctgcagagcaaggacttcttcatgtccaccccctagatttaataagcatatccatttgctacaagttttgccttatgttttaccacattacctgtcgggtctcttttcaccttaaagacccacacccaatagcattatagccttagtatgtttttatgtctacctaaccatgatgttatggatggataccaaaatagtatgaattaactatcatgtggtatacatgctgctaataaaatttactatatacgccttaggatcaattagtagcattagctctctcacaattcttatccaacctatgtacaagttttaatccaaacacactagcatatatgtaggggtagctaagctatcaattcgagtttgtgaaacttcttcaaaatatttaaagcggttaaattgtttgggcgagtgagacaaataaaaaaaaccaagttagtaatttttatgtcgtcaagtactttggaattctaaacttgattcatatctttataagattatcatcaattactaaaaacgagtaaaattaaaagctatacatccggctgtttgttaattaaatggcaaccagtggagtaaccaaaacgatagcaaacaatccccggtaggccggagagcacgaattgaaccgccggcaaagccaggacccgcagttcagctgagttgaggccactcagtcagtcagagacagctccacacgtgcgactcaccccgccacgtgggcgcggcccttctcacttcggaccgcgtctattaatcccctgctgcgcgcggcgcgcctcctccgcaaattaaggcttcagctcgcgcgagacctcagctttcactcgagtgagtgcgagtccatcgccggagagagagagcgagagagcacgcaatcgagttaaacaagctctgtctcttggttctctgtccacggcgggagagtgtgagag

SEQ ID NO: 854 - DNA, 1500 bp, Zea mays
catgggtttggcctgccccttcgtcccttcgtatgggggatactccactactattagctggagatccagaatctccaccccaacaccgtcctccatatagcgtgttttattamgctatatgaggcttttatgggcatcgatccctattggaagttgtggcagtatctctttagcgcgtgggtgactttgggtcgtggcggtcaatcgtttggtggctcagcctccatccaactcctctctagctggaaggcagagtatttcaagatcttgcttccctccatcattcggtacgagggtgagtggttctacgccaagaatctgcccggcagtgctgtaccgtacatcggatgggagccgctttcgacgaataagtggcaccatggcacggatgcacgttccaagagctaagtggagcagcttctaaaggcgatcaccacgttgaagcagcacggtcttaccagcgtgtggcttatgcgtgttttaatgcaacgccgggttaagcctcagatggcctgctaaaacccgttgtacaagtactctagcgtcgacaaccccggccgccattcctccaagcctcttgcgctgaccgagatcgagactgcgggtctaggctatcaccgttctattgttgtgggcctttatggacgagaatttgcctcacccactttccaaagttgttctgatatgctttgtggtaggtatatctatttatcctcttttcatgttatcaaattacatatcaaatctcatcctccacaggctcaccagtcaccaacatcaatcgttctttgtgaaaccctgtgctggaatacacacgctcaatacattagttggtacatgagtctaatgaagtcagggaaagagtactaattttcgcgagtaaagggaaggctggatcctttttagttgcattgatcttggcttggtagtcctccccactcgcgacatctctctagccgcacgctggactacagagttagttccgcaagctataaaattcggctcgccattggcttgcaagattgagtagtgagccgtggacgcagctccccacttctcatcgccccctttttttaatttgtggccatctttggggtggtgggcggaggatttctaactggatggtgaagtttgtctggcgaaaaggacggctgcgacgaacccgtccatcgatccaacgctgtgcgcgcgttgggggagggacctgccaggccccacctgcagcgacagactatagatagatgccttcctctctcgatcacctgatggctgatgccttcgccgccgtcttcgcctgccgctgccgctgctactactagttgccttgctcgcttccccccctctcgccccagccgcttccgccctctcccttccggccttccgtttccttcccaactcccaattcccaaccctggatccaaatcccaagctatcccggaaccgatacggaggggcgcaagcaattattagctggctagcccggcctgtagctccgagatc

SEQ ID NO: 855 - DNA, 705 bp, Zea mays
ccaggctttttgctcacagcctcacatacatacgcggtgccgccccacggatgccgccaagcaggacggcgctaccacacgcccaccagattcgatacccaccagattcgataccccaccacagcccaccttccgctttcatcaagttctcttttccgcgacactgacgcatgggtccagtggcattattcccacccacgcatcggctgtattatagatcgccacgaatttaccaggaatgcccctgacacatgggtccacatcctgcacctgttcctgtcagcgacatggacggcaacggcagtgcggcgattcccgagcacagtgtcagtatacgttggctggtggtggggtcgtaaacgcgaggagcccgcgcatcagcggctccgacttccgagcgggttcgcgcctggaaacgaagctatacgtcgcgaggaggggagggcccaccgccccgcgtgggcgtcgcagcttccactcttcccccgtgaaacttttctcacgcgcacccattccacccaccacccaccttcctttcctctctctctgtctgactgtctccctccgtccctcgaagcttctctggtttcagacgcaaccccgcgggtcgcgggatcaaggagccagagagcgggacgcagcgagcgttccgccagagatcgagaccgtagctagggtttgaggcgccgggctgcggtggacgag

SEQ ID NO: 856 - DNA, 170 bp, Zea mays
ggtagataccaatttcctacaggttctggaatctggctgctaccatagtaggctttgtggttccatttgccctgttttttgcatctcgcaggggcactctacagccacaactaccattcattccatttggagtgctgcttggaccatatcttttactcctatctgtacag

SEQ ID NO: 857 - DNA, 511 bp, Zea mays
cccatatactctatcttatctgaatcctaccaaactctttaatttgactctttatgaatggaattcccatatgaattctataacacaacagtacgacgtctactggagcatactgccaagcacgctagccgacggctcggcgaccgtctgaggctgtccatgcatgcaaatgtgcacacatgtacgccccttttagcgctggcatgcacccacgaccacgacacggctcccgtggccgtgaatctgacatcccgggactcccgcctccggccgcgcgtgccgtgtcagcctccatcgagcggtgtactccatgcaagcctcgacccgggccacgtacccccctcccctccgctacgtgtcaccgctctcgtcacctatatatggcggtcttgtccagtctttccacttaactactccgtcactttgtttgcaaagctcctcctcgatccatcgatcactgcaccggccggcggcaccgcgctcgcaggggctagccaacgagacggcagca

SEQ ID NO: 858 - DNA, 277 bp, Zea mays
ggtttatatatatgattttggatgggttttctggaagctgacaagcaatttggtgccggattcattgtatgatgacgtatacatgttgatgagcacgtgtcttcttcgctggtgcctgaagaagtgaagatgccgcgccacaaaattgctgtgctgcggagagcaccaagatgatgcgccccacaactgattgcagcttacagtttgaggaaagtcgggcagcaattattgttaggttccaacaaacattggaatataatatatatatgaacgaaac

SEQ ID NO: 859 - DNA, 1484 bp, Zea mays
ctgtacaccttgtgaatccatgtgcgcctccgtgcaacgtttttactaggttagcaccaccattccctacatctcggtagcgtctaccatcaccgcctttcagaggtgtcaacaacgagaatttttttctcaaaaaactcgccacttggaatacaagacataagagagatgcttccttagcacacaagtgctatagaagttgctaatataaatataaattaataaatataaaattctaatataatgttagaaaaatattataaaatgctttatctaagaaaaatagaaattcggtcttatatattttctaaatcacgctctatgttttttttttgcttagaattagtttcctttttaaagattccttctatcttaattgaggcctagaccaactgcaaatcaagagacaattttgacccaagtagcccatccccatgcccactccttgctcagttgctcttgctcttgctcttgtattcttgcttatactgtgggccatgctcgggaactagggctgaagattgatgcagtgccattgtgccaataagcaagaaaggcccactaaagggcaattgacgctgggcggcgacggcggggggagactgagcggccgaggagccggtgtggcatcggtgcatcgcagcggcctgaggtcgcgagcagcacagcagggtgcgccaggcgccgacgcggtacggggcaccgcgcgacgcgtgagcgcgtggccggtctcagcaccaagacgcatcaaagccggcgctaggcagggcactatcgcgctgctgcgcagctgtgcctgcgctggtccctggaggattagtgacagcactcaccaatttgtgttttgcagaattgggagaaatcaagtaagtactaactaggtgtataaatgcaattccatttcactgattcaattagcccctattcaatttgtccgtggatagtgctgcattggtttaaggaagaacctcttcctgaatctaccatttcttagttttagcctttggggtaaggatttggtgtttctagacctaagttagtgactccagtaagggtttgtgggagcttatcaatcatttttttacttatccaaccgctacaaatagatggtgtagtgatttgtctgatcaagtttgcttttgtcctgttttgtataatcatatggtgattttggaggaaaaaaactgggatgttatttttcacatgttgcgggatggttgcagtaaaggtggttagattactttggaacaaatagttcaatgttgataagcattgggttttctcaagttatggtcctgaattaattctgattagttagtgttggagcacaggaatgggattcaggtgtacacagcttacttcaaaatggcgaacaaaagaacaagagattttaataaaaacaagttctgttctctttgtcaaagttctttctatgctatgtgcagataacttcacaacagatcaggaagctttagagcttggca

SEQ ID NO: 860 - DNA, 982 bp, Zea mays
gctagggttttgtattttttttctttttttcttttcgaatttctttttatggtaacaatatacatatatatacattgtagaaaaaactctcaaaataatattaacacaaataaatatctgttttgtagaagaatattgttttaggaagaattctatttttttaataaaagatctccaccacaagaaaataaaaatggagtttttgcaagcactatcatttgaaaagttattaacataataaaatacatattacaatagtagtagtttgaataattctttattattttatagaactagatttacttcatatgattaaatcaaaaattgtatttgcaaatcaattcaaccaaaatttatgctccagcatgattgcttcaaacacttgattaaaattttatctattccagaattgttcaaattatttatattaccccttttactattagaaatcataagtatttttcctttctattgaaaaataataatataaactaaattatcttcaattgatggatttagggtgttatacctaaccatagtttttaactaattggtagtatattattatttttacctctgtttagactttagagacggacgagtattggttatttgcatcaggagttgtagacaggcacaggctccgaggtcggagtcggatcagggacggaatccgggggatggggtgcggtggggtggaccggaatccatagcagttcacacagttccgactgcgccccgccttccgtgcacccgcagccacaagccaaagcccaccacaagtgccagtggccaccaccaccaaacggcaaacgggaacgggggcagttggtgagttgggacttgggagccgacgctgtcggggtgatccagtcgccgccgccgctgccgaacgcgcccgcgcccgcgcccgagcctccctctacgcggacgcgggaggacccttccactcccagagccgggcgtgtccgatcgtgagccc

SEQ ID NO: 861 - DNA, 630 bp, Zea mays
cgtccaggggtggcatcccaacgcccaatcccaggagtcgcatcgggggcatcccagtccgaggatgtctttgccttcttgccaccggcagcagcatcgccatcctgcgactgatcccacctgttacgccgcttcgtcgcagcagccggctgctcaggcgcggcagccttcctctccttctccttctcctcctcttccttcttcttcttggcaatctccctgagcaggtcctccttcttcttctgcagcgccgcgtcgcgcatgacgtcggcgtaggtccgcacagagggatccggggtggcctccccggcagcgaacgggtcatggcgctccggcgagatgatctggttgaggcggcggcggcggtagtcgtcctcgcggtcgatgatgcgctgggacctcttgggcagcccgtcgtcgtcgtcggctgaccgcgggaggtcggcggcggcgatggcgtggcccgtgtaggccgcgaggcggcgcggtgcggggttggccaactccgtgtcgtcctccgcggcgtcatcctcggaggccgggatggaggtgtcgtaacccgcgaagcggttggggtcggcgcccccgccaccgtagaggtcggtgtcgaaggtgacggaggacacggcc

SEQ ID NO: 862 - DNA, 458 bp, Zea mays
tggcggtggcgcgggcgggggcgagtagggtttggtttggtttggtttggtggacgaaatggaagatgcgaattgcgatgcgagattggagaagggaaggggactagctagcgggactgcggggagacgggagacgcccttcacccctgaccagtgacaacgtgtattgggttgaaatgtcggcacaatggctagatcttgtccgttgattgtcgtagacgcgatctgggccgttcatttgtggtaccgacttctccaaacaaaggcctcgcccccaaacggccaacccaatcgatcgtccccaatccgttcaggcagtccccgacatcgccatcgccgccgccgctctccatcataaacaatctactcctcgtcgcctcgcgtccgtatacttgaccgcccccttctcctacttgtaattcccctcctgcttgtgtggcaggggcctctcccgcgcg

SEQ ID NO: 863 - DNA, 137 bp, Zea mays
cttttttttttccttccccaacttctccctgcgtcggccgaggctgcggcgactgaccacagctttcgaccctttccagtggagggaacggggttagcgagcggcctccgctgcgacggcaacggcgtgggagggcc

SEQ ID NO: 864 - DNA, 959 bp, Zea mays
cagccggcaggtgtgaaggactacactacactactactctgctcctactctactactagcgccattcagctgtccattgaaatccttggacctctcctctctctgcgctcgctttcggcaggggtgggggagagaatctgcacaggacacgcccccgtggcccgcttcgtttggctggcactggcagcaaggatcgttccttccatgcaatgcgatgcgatgcgatgcaaagccgcctcgccctcgcttagcgtctccggtttcccctagcctcgcttcctccctcagacccaccacactgcttcagtgcttcagctcatcgtgtgccgagaatcgcaaagttgtttttcctttctcatggagcggcggccgggcgcttgctccgtcgaaggaccacagcaatccgtgcccactgcccccctcccctgatcgtgcaaggctcatgtcgttttcgcaatgccagctctcgtgtctgcggcaccaccagtccaccacctcagctttcgctccggccggcttctctctcactctctctctctcaacttcagcttttgagctcgctgctggctgctgccgaagcaatggccggcggggggggcctttatggcctcagcgcattcaatgacctgatccacggttgtacactgctgtacatcacctcctgcccggctgcccccccctctatctctctccctcgctttcttctctgaaccgacactctctctctcgtggtcgcggagtacgtacgtacagtacgtgctctactcgtattgattctgaacaaccacaggcacaaggaacccctgcccatgtgaacagtgaccatgttggtggcgctgctgtccgtccatcctctgtgatcgatataaaccgggcaccctacctactgttgccgacctcatttcagacagtggctagctagctaggcgacgttcagtgaagctccgagccgagctctc

SEQ ID NO: 865 - DNA, 75 bp, Zea mays
cctgagatcctgtcttcgaccacggactcacgctttgcgaggcagctgggcatccctgccctcgggttttctccg

SEQ ID NO: 866 - DNA, 802 bp, Zea mays
ttaaatattttcacgatcacgaggtttctttactgtacggccacacatgtcttagaccttgttcgtttacgtcggattgcagccggaatcgttccagctaatcaaagtttatataaattagagaagcaatccgggtaggaatcgttccgacccaccaatccggtagaaacgaacaatgcctaaatctagagaatttctaatttactagagcaataaatgtcaagatttatggcttatcacgattgtcgtacgtagaagattttagaaccttgcgttagccttgtttttagtagaatatggtctagaagcatgtcgtgttccttgccatgattattatagaatcattaggaacttaactctatttttttgcatatcaaatatttgagcgaggttctttttacatattttaacatagcaccatgcatgcatgcatgcatgcccaccggccggtgaccagagacctcttccacacgcacgcattcggtttagcaaaaggagactacagctagtcaggtataccatgcatatttttgcctcattttatgtagtacacttacctgtgtcgctacactatagtacatgcatgtgtagcttttgcatcgtttgtttctaacggttacaaggttggccggtgaggtcgtgactcgtgagtcgtgaggccggcggtcagcccctcccgacaaattctctcctcctaccaaaagccaccgaccctagctagccagcctatatgtcgatctgcatccccggatctcctcttcaattcgcctgcaatcttgggggtgatcgattacacagcatt

SEQ ID NO: 867 - DNA, 661 bp, Zea mays
tcacgaaggtcagtgcttgccgaaggtggccgaaaagagttcaccggaggtgggcgccaatgttggggacttgttctcaaatgctatgagttaagaacaaggcaatacaaaaaatgttaaacgttaaagtccttcgtccttcaaagcattatttcccttgggatataatgatttttggacgaaggttatgaaggacataccttcataagcgcaacatataataatgaagagagaatcatatgaaatataaaagataacatgaacaagtatgtattattatcaactcatttctattttattattatgtaaaaatagaaatgacatcaaattacaaatgtaccttcggcttgaaatagggtaaaagtacaagcgtgacgcaaaagcagaatgacaagtcagcgtgaacagtacgggggcactgttcatctatttataggcacgtgacgtagcccatgtaaaattacactcatgccctttacatttgctaatgactctatagtaatacatcgaggtctgaataaccttttcccttttaagtcggttcccttttctaatatcacgccgaaggtcccctgcgcatagcttcggctctgcgccaacctttgcattctttgtacttcttcatattgtggttctgatccgagtccagaggtaccagttc

SEQ ID NO: 868 - DNA, 50 bp, Zea mays
agaagaaattacacaagccctgagctacatctttattcttgttgacccag

SEQ ID NO: 869 - DNA, 1022 bp, Zea mays
gatcttcaattctagttcactactacttcacagcaccaaaatttcggtttaagattagctcgtttttttcttcttaaagcaacaactgggaatctgggacccctcacaatcttcttggtgactagattgttccctgtctgacagtgacaagaatgattgataatctcatctggtatccataaaaaactgtacgagtccctaccacaagtagagtacaggtcacgtatgccccaatggtttgtaggtgataatgcagagtgaaactaccaatgtttgtttaatacttcaatcagacaagaatattcttgagtatttttctgtgtacttcccgctctgtactgtatgtggattcatgcgaataaatgcatatatttgtggcactacaagtaccgtgtccgtgacagcagcacagtctcacaattttcttatattttaggagttctaatgatggcttactgtttgtgctaaatagcacccaaaatactcgttcctaaattgtttttatcagagtattgtaaatgtgttcatggcatgcaaaacaacgtacatacactactaaaatgaaagttaacaaaaaacacaaaaaccatgcctttccagtcctggaaacagcattctaaataaagtagcataaatcaccaaccaccaataataaaaaaagaggaaaaaaagagagagagagcaaccctgttcacaaaaataaatggaaccccagagagaagaactgccacagtgccacgggcccaagaagtgagtgctgccccgtcaatgccgctgggagccaagaaaagcaaggcaaagcaaactgcagacccattggtttctctctttcctcctcccctcccgacttctccaaatctccgccttttgttgatttatctattttgcttgcaattagtttttggaaagcaaggttcggaatccgttccagacagaaggtcatcacttccctccccccttttaatgcagcagtatattcatcttctggcttctgtttctgtttctttgatcaggtggttgca

SEQ ID NO: 870 - DNA, 1500 bp, Zea mays
gctggcgtgcataggccgagcaagtgtggccaatacctcgacgtcatgggtcatggcgccgagctctctcgtttaattcatacatgaatttgttagcagcacaaaaaaaacgtgagtatgtgatggtagctagcttaattaatcactcactcaatatatatagcatgtctattatcactagttagttgaatagattatttatgtatagtacgactcgcccatcttcttgatgtgactgaatcaacagaggacgtacgtgacctttattattacacggccttcattataacactgctaattaatcttactatgtgatttgtagcagtatgtttcacatcacatgatacgttttttccatgcatgcataaccgttctcgaaaagtttgaaggacttaatttacatgtgacagtccaaatataaagtatcagataaccatgacaaaatataaattattacacgaagcaatagttcaagaaaaccacagtatactttggctatctcttgctggttgctgcaaaaggtgagtagtcctcgtcaatcgatcagtcagacggtcagccgcgaagttgagtactatatcattacagcagagtttaaaaaagcgtaccttggcgccatgagttatgacgtcgagcagtgttaactcgacgctacaagctatgacgctaaacaaaggttatgaaaagggaatactttcttctgaggtctaaatatgattttttcgtaaaggagctcaaatgcaaaaaaaaacggacgagttgaatactgaagtaattttttagtggtggcatgattcccaaaaaatcgagaggactatgtcgccccgtctcactcactttgacctcaaatcaaatacatctctattgatgtgtttcaatacatggtttccaatgctatcacatcaaattaaactaagtgaatgtgtgtgtatatatagttttatctatcatcttacgtgaaactctcttcatatcttttctcttaactacactgtcatgccatcaatcgtatttaatgagtatggagttccgctacacgagtggtgggcccgatcccgtatccgtggtgttttctgcacccgtggcaggtgcgctgccgggaacagcctaggccggcgcgtgccgaatgccaaatctccctggtcgccgtcaggcgggccaggtccatttgccgcctcggcatcagagggtgctccggtaatttcgtggcgcaagcatatccccctcccgggctttggaaatgggctcgcggtttcctcgtaccttcctccggcggccgcggtccagacgtccagtccagcacgcgggcgtctttccccgtcaatatatataataaccaaaccaagttcacccagttcatccggatatcagaaatttcgccgtagtaataacagtataacacacaccgccgagacagaagagagagcagcagggcccggtcgagggccgargcgaccaaggacctccaccgtcgcggcgagcagcagcagaggacgaacg

SEQ ID NO: 871 - DNA, 663 bp, Zea mays
cgtccggatggaaaagacaacagacgttgcgtgcctgagctcgctcagtcaccaacacgaagcccaagcccgcgatggacggatcgatgcttagtggttaaggaatataagaatgcgtacarggaaatcaacagcaaactgcagcagatgatcgctctctggttgatkgatcgacgaagcagttcttttgtttcgtcagagagcgatgaacccggcgtgacatgcatcgacatccggtgaactgggtcggaacgaacgacagagagtgctggttgctctcagctctctgctggtcgtgggtgctagcttggtggacaaaacaaaagagcgaggaaataaatatcttttttctcatgtttaatattagagatagatatagataacataattatcttttacggatttcaaaacaaggcgctccttgaactcaacgcgcctaagcaacttttgggcgacggcggcgccagcaggtcaccactagccaccgcgacgcggtttccagctcggcggccgtggctataaaaggtcgtcgtccggcttcggactgtaccatccaccaccatcctctgccttgtcgatcatccatcgaccgcctcctgctcggcttcccaccccgcctgcctgcgttgcacaccagggaggagctcctccgaccgaccggcc

SEQ ID NO: 872 - DNA, 311 bp, Zea mays
ttcatttttcaatcaatagattcaaaacataataaatttagtgagcagtgcaaacagaaaagtattcataactacttcaggcttatatgtgttcctacttcctaatactagcaagcagccaagctcctagattatgatttctatctgtgtcgtttgctacattggattcagtggcttgacaacaaaattgttacattactgtcatacttcttgatgtcaagcaggtagttctacgtgctttgtcagcttcacctttcaaagactaccgtgtctggtggtctctttcagattcaaaatatgctgggacagct

SEQ ID NO: 873 - DNA, 873 bp, Zea mays
tgtcatattatcatgtttgattagatgacatatcatttaatgagaatgaaacttctattaagaatatcctaataactacacacttacacactgtataatgctcacagtacaatatagttggtagttgttaatagcatacaatgtatagtgttcataggtatatttgtgacgtgaggcatggctacaattacacgtgttgacagcaatgccatctttcacgacaaatatgatgaattaaagttatatttttcctaaaagggaggtgtacatttttcagaggaaaatgaaaatatatatacgtacgacaaactaaatagggttcacggtcttataggggtgctcaatcgaacgacaacatgtgcatcaagttgctttcgccaaccatgaattgcagagatatagatacaacgcatgtttagtataattttaacaagattagtttgatagagctttataagtcctagatttatcaaaaacagatttaaattcattttttttctaaacgctagctctataatttcaaaatttgtggacccgctcgatagagagaggaaggaccaacgggtagaggaagggagtaaaaagaagaaaagaaaaatataaagagctgacacgtattacgtatatttcagttagtagtgggatagagagagtttgaagttgtgtttaatatttcgataaaatttaaatccacggtgatccacttttttgcgctggcgaaagctgagcagcctccaccgattctctccaccccgggtccccggtgtccggggagatccatgatcccatcctttcccaccacatgctcggcgcttcccttgacacgtcactaccgtcccagaccagccgcgtacgcctgccttcgctaacgcc

SEQ ID NO: 874 - DNA, 695 bp, Zea mays
aaattgtttgcggagagtgttttggagaactatctaatttagttataatttgattgaaaatgcaattttaaaagtaatcgtatctctactatctatatgagcccaacgagggtgtccatgcgcgtcaatgtcatccaacgcgatcccctccccactcgctccgccaccagagccatcacctcaactcgagccacccgatccatcaccgcccttccccacaccctgctccaccatcccgccttcaacgctgcccttccccaggcgatccccttccccacgcgctgcgccaccatgccgccatcaacgccatgccgacaacccgagccatcgccacccgcccaccttccatcaacgccggcgacatgcacgagacgcaacccttgttccccaatttggaaacgctgacatcagcgcctagcgttgcatcaaggatttggatacgcccgcttgcatgcgtcgccccctgatttcctctctgttgtctccttagtctatgcgagccacagccagtcgtagccgcccctcaccgctcgcactcaacccccatccgcacgcagtggagcctggcgtcacagaggcgggcaagggacccagggcaagggaagcggaggtggtccctgttaggatctcgttcccgatgtcagtgtctttgtcctgactctccctcctatgctaccctaggatcagcgcaaggg

SEQ ID NO: 875 - DNA, 1500 bp, Zea mays
ccgcctgctgccggcgtgacctctcgtgtcgtgcacctcgtagattcgattcgatccctcctccgcgcgcgactcctcctcagtccaattattaacgccgcatgttccagccgcggcgcgcccatgttcgcgtgttcccgtccacgttcacgcacgtcacggggctccggttcccgaggcgatctggccgttcgtggtcgtcactcacttctccccggctcgccgctcgccgcaggccgcgcaggcctaccccgcgcgggcaaatgcaacatgcaaggaaacgtcctcgcgtgcgctcgccgagaaggccgtgatagtgacacggcgacgcgcggcgcgactgcatgccgcgcccgcccggcctgcgggggcggcgaggcgtggcgtggcgtggcccgcgtgccggcacggaacgaacccaagcgttttgcccgcagcggccagcggaagttgccgatcgttgacgcccctcgcagccggagctgctatcgaaacggaaccccgttcgcgttcggcattgtgagaggatgctgccgtgcgtgtgtgcatggcgacacgctaacggtcggcctcgatcgcgcgttggcttctatagctttgtgcgaccagactacccccatcttgagatgagactacgggaatacgtagtatatacagtatacaccacctactgccctacaccaagagagggataccataccatgccaccctgctactagtctacgtccatacaatacacattccaatttccacagaatctccggccggcatgttcacccatgttaacgatgccatccgatcaaatatccaacaaccagatcactcactccgtccaaaaaaaacaagactagtacaattctaggtttaatcaaacatatataagaaaactattaatatttacgatgtactttaaacattactaaactaattacgaaacatatttttaattacacgtttatctgaagaactagatgcgagcactagttttttttgtcaacaccgcctctgtcttaccggcagtagttgctaaccattcgcaactaaattaataagccacgcctcttgcgctgtgtacccgggggaattgaattcattatctgacagcccacgttaacgatgacagggcataaagaagctcttatccgatcatcaatcttcagaacccttcttagcccgatcatggttctcgtgcagaattcttttttggccggaggaggcatggcgctctgcttcctgcctccgtgcgccgtttccgtttgatcaggactctacaacagcagcaaccaaaaaaaaaaaatcacaaaaaaattacagctttgggtttcccatcaaccaaaccgacccaaactctccgcgccggacctataaatcgaacggcgcgccgaacccctggacaccccacaccaaaagaaaccaactaaaatcccaaaagagaggaaaggcacaaacagacggtacaaagaaagggacgctcgtctcgtctcgtcacgtgccgccgcc

SEQ ID NO: 876 - DNA, 531 bp, Zea mays
caaaatttatgtatggctaggatcacaaatgaattatgaaatatttttcttataacaatataagacacattttgtatataaattatcatgatattatgtgttcccgttgcaacgcacggatattgacctagttgattgaaaaattaggggctctaaaaaaatggagtcatgcgcgggcctggccctaatagtcactaggactagatagatgctgtcatgctgaggacgaaggcaagcatgttgggcacagcgccatagtatcaaactatcattttgagccgtttcgcgtaccctaaaatcagtggcaacagcgccatagcatcgtcaactccatcaagccgttaccatcaacaacgattgcttgctgccgactgccaagcggggccggtcaatccagaagttggcagcctccaatcgcagcatccctccgagatcgctgccccgtccccctcccccggcttatcccctatcccctcctcccccgctccttccacacaaacctccatgccccttcttcctctcctccccgtc

SEQ ID NO: 877 - DNA, 223 bp, Zea mays
ctggctctcttgtatcgttgttttcaataagcactaaattgtgttaaaatacctagcaagaatgcagcattttgcttccattgtttctattccaattgggtttacagggccattttaattatttaagatgataaatttgcaagaaccttatgactctgtttgttgaaggtatcttaggatttgttgactatgcccaattattgaggtgtctcactgttattat

SEQ ID NO: 878 - DNA, 65 bp, Zea mays
catgcctgcagtagtgcaacccttaggctccaagaggagcacgactgtctgccgtctccttagcc

SEQ ID NO: 879 - DNA, 961 bp, Zea mays
atggtagtagatcatacctaaaatatcccatgaggccatgactacgatgcccagtagtactggcattatcaggatcaggctgcgaaagtgcctgctaggctttggcaaccgaatccgactaaacgccatcgcgaggcaaggaatcgtggctccacgcggtgctccgcccaagaaagtggaagaatgggcgacgcaatatcgcaaggccaaaaagggcttgcaatgctcgtgcacgtacgtaaatgcacgagctcaggccgygcggctaagcgaggcgcctgcgatgcgcgcgcatgctcgayggcgccccatatgcgccatggacgcgttctcggtgcgctgtggtgtggagcgcggtggtaccggcgcttctttacctaggctccttgccttcccactacgagctgcacgatgaatccaatccctccacctcgcccccaagcacggcagaccaccggccgaccggtgctagtacagcgagaggcaagtacgtgcgcggccgggggctgcgccgcttgtaaaggaggacgtctctgaatcatggcgtgtgtggtgtgtggacgccgccggcggacatgcatgatggcctgatgggcggtccggtgcgtggtgcgctttccgcctcgttgtccggctcaaatcgtgcaggatgtagcaccgggggaaagtcgacgttgacaccgagagtgccacgtcgttcgtcagataggaacattttccctgatgatatacaaggacacatcggatatatgctttgcttgcactagttgtgcgatataattaggttcagagctgtccgtttaaattaatacaaagaggagcaagcgtcaacagtgcttattatgctgatgctaactggctccttatttgaaccgatcgaacgcctctgcacagccagactcattcggtgaagctcactccctcacccaacgctccatagtccacactcgccgtgctcccc

SEQ ID NO: 880 - DNA, 498 bp, Zea mays
cgctagcagctctcctccacacatcatcgacaagcaccttttttcggtgttttttttttggagaaggccggagtcgggtttggatggtcaactccggcatactgccgaaaacaaaccaatccgtcaccgtcaaggccccgcaccgctggccgcacgcaggaaaaataagttgcgaccgcgagcgggcgaatcagaaagggcgtccggccttggtcagacacgacagcgacgcggaaaggctgcgcccgcggtgccatctcccatctacaagggtccacgtccatccaaaaagagcggtgccctggacttctccctcgtgttcctacttcctacgcgaaggaagccaggcaggtgcgcagcttttccaaccttccaccccccccgtgcggcgctcccacgctgagtcgctgaccgctcgcgcctctcttcgcctcctcctcactcgccgcgtcctccgcagcacagcccactcgcatcggatcgcgcgcggggagcggc

SEQ ID NO: 881 - DNA, 634 bp, Zea mays
ggtatgcaaagtttttctcattgttttcatctacaatgttaaaaccgctttcttcagactcagcagctgcttgctatttggtggcaaaatatctctttatttatataaaatgttattctttcttatagagccgtgcatctcatgtgaatgaagaatcatctatatgaagatcagctcttcagttttagtgctgattaaaccataggaatactggcttcattgtttgttacatctatacttgaatatatgctatttactgttgtatatcatgttgggaccaaagtcctcttaaccaaaatgaaccataaagtttaagaagatgtttaacagtcattacatactcttttgtgtgctttcattttctgttgaatcctctgaagtgtttggcaaatggtgtgatacaatctaaaatataaaatatagagctacttctatcatagtagttgattgatatctggtgttacaaactgcttaattatcttttcctttcgggaagccagttgtttgaccagtggttgatctagaaaatgggttggccaatgactaatctttgatatttggtgatacaagctgcctattttttttgttttgttttggggaagccagttgtttgaagggcaagtcagaatgtcag

SEQ ID NO: 882 - DNA, 370 bp, Zea mays
actgaacatggtatttaaaaacagaatcagatggctgctagtagccgattacatgaacatctctgaaagcacgcttgctgcatatcattattatattaaattatactactgttttcagtaataagaagcatgtaaatgatgttgcataaataggccgcccataaaagcatgacctttatgcagatttcatgctgatttggtgtggaacagtccaatcaggaatgacagctcgcgtaatcagatttagaagcccatgcaatgtatgtaatcacgaaacgacagctcgcggctgaatcagcaaacaacaagaatagcatagctgtatagcatcaaaacaaggaacgcggtaattggtaaagatcaggtaccc

SEQ ID NO: 883 - DNA, 1500 bp, Zea mays
tggccaacaagcgcatgcggcccggccggccgggcatcatatacatacattggttggcgtacaggtacgcgcgtagaatattgttagctagatcatgaatggtggcgcgacgcgcgtggacatggacaaactcgagcgttcgtgcgctacgccgatcatgctcctagctagcttaattgatcatcgtattgtggcatctagctttgttgcagttttttcactgaattagatactaaaacagtaaagctaagacgattactggactggttatagtgataaaaaaaaggtctgatggccttagtctaacactgacgatactgcagtctgcagacatcagacaggcggatggggacagaattgcgtacgtacgtgcgtatgctaataggggcatcttttgggtctgctgcagcggtgtttcgagtcgactccgttctctttaatttagcagacaagtgtaaacttgactagcatrtttttttattaagaatcccgatgcgattagagtgtctgctgtgcacgtatgtgtgtgcaggacaaaacacgtgctccgtgtcttactgttgtgtgtgacactacgtgcatgcatgcatgtaacttactagtagcagcatgctggcagtagattcccttttgctaacgtggattagcacgtatatattccattacaagtctagggatagaattttatgatcgtctggaacttggagatacaacgaggttcctcctcctaccggggattttctcgtaatgcaagttggacctcaccacgaaaatctactatttggaaacattcagcccatacttactagattggtttccgaactgtagaccaagttggagttgggtaaccactctctccgaccgtagctggcaagcctggccttgcggagcaaggtgaggagagctgggctggccgcgtagcgtagaccagccaaatccgctctacttattctccttccgtttaccagccaaatcagcacgtggcagatcggggggacacggactgcctaccggtgggctatgcatgagagaggcgagctgccgcagtgattagacagagagagacacgcgggcccaactcgtcctctttggctctccctctctctctcgttgcagacttgtagtgcagtggaggcgtggagatcgaatcaactgctcgtctgctctacaacaccagaccacccttgcttcctgtccctccgctacacgcacttgcgctccgacccaatctggatccaaccacgagccagctcgctataaaggcaccctctccctttctgtctccctcacaactcagttattctacagctttaattttgcagagcgaccaccagtccaggtccagcgcgggacgcatcacatacacgcggtaccttcgttcgttctcaagcttatagcgcccgatcgaccctgcgcggagctagttcgttcgttccggcaggcggcggcagcgaagcagtgcgacgacgacgacgaggtacgtagagagcgagaggatag

SEQ ID NO: 884 - DNA, 1144 bp, Zea mays
tcctcattaaatagagttgttttactatagtacccctaacaaataggtttagatagctttcaaaacaaaagatgatatttgcttagttggattccaatgtaggctgcaagcattcaaatgctaactcgtgtgatcgaatctcatggttccctttttctacgttttttttcttgatcaatggtatacgtcgtgtgtgggaccatctagatcaatggtatactagctcaaaatgagctctaaatgcttagagctcatttaacataaccaaaatattcggttaaccgactagtcggtttcctcttttctaaatacaatttaggttttcattttctaaaaatgaacttttaaaaaaccgaaccataactattcgattaaccgattgctctggattaggagtcgtaggatggtaacggggactcgatctccgattctccacggggtatttctccactagaggatgaagatgtggaagtttttttactattgagatgtagacgaggaaaatttctttccggacgagtaaacagagatgggacacagaagcattctccatccccgtttcctatggggacccgttaaacctacacgtgatgatgtttttttgtaatacttaatgataaaaataaataattatattgacaagagatcacttattatacaaatgtgtttattttgatgtacacataatagttttttagatctgataacatgtataagtgataacattttacattaataatgaaagacatacgtcataaaactaattataatttaagtgagacgacgacgatttatcccgtgggaaggaatggaaagctatttatcgacgtaaaattcctcccattgcccgtgggcgtgtggcggcggcgacgacgaatcaaaygatcctgatctacctcacacatctcgaggaggccgtccagcgtccaccaactcccgcatctcaccccatcgcttcgtcgctagtacgcagttcggtccacctatctatcgcctccttgtcggccgtcgttatatttcgcggccgatccttgttcagttgttcctttttccccatttgcgccmcttcgtcgctgctatattccgcgaccgcctcgcctaataatagtcgccgcgggcagtggataccgcgaccgccaccgtc

SEQ ID NO: 885 - DNA, 55 bp, Zea mays
aatcgtatgacttagcaaaggaagggaaaaaaatgtgtacgattactctccagca

SEQ ID NO: 886 - DNA, 514 bp, Zea mays
ggtgctgccgaattttttattgacaataatattttctgtatataggtgttcttccgacttgaccttctccaccgttagctagactcgtacattattctcaggtatacattgttttcgtaatttatcatgtatacattattctcagttttaatcgttaaccgtagcgaaccgtatgcgtcacccgttcgggaacggcgaacgtcacattggcttgtgaggttcgccgttccggaattgtccacgtattttggacagcctgagagtgtaagccgatgcttgtgatttgtgacatgtgccttacgattgacgcggaattttggttgtgtaacccagttgttctccaacacaccatgttcaggcgtgtgcttggagagcagcggggttatgctgccgaaatttcgcggcaatcgtaggctacacgtcataaatcacaagcatcagcctacactcttgggtgggtttagggcctttacctaatagggagttcacctaattaagccacggacgatcgttg

SEQ ID NO: 887 - DNA, 1500 bp, Zea mays
agccacttaggccatctccagcagccccgtgtaaacgaccgtacaaaatatactattttgcactgtttatagagtgaagtttaaaatagaaaataagatagtragtctactgaagatagttgggcgtggtggggtggccaccctagctatcggtagttgccgtcgcctgagagttgagacccctcctttacgtcaagttgccgagtgttgagtttggcatgcaccttgtaccgacaccgctacttggcgaggaacaccgatgagcatggagtgacagaagaaggctgatgcctaggcgtcctttggttcacccaaccagaccacgcaacaatggcttattaatcgtcccacaaaacacgagtggccggtttcttcctcaatcgatccatttgtcatcctccacttctgtttccaatccttcgttctcgcatgaggtaagcagtagttttggcactatacctttactcctgtcttgttcgattgcgtctgaatcgagatagattgagagaaattaaatttccttctattcaattttaactaaaaaaaaatttaagtctataattctctttgacctaagctcttagtggatttataagaccaacttttctgagaatctagttataaagagaatatgactcttgagagaatctaaatatcgttacgattatgtgagcagaaatataaatgtgtctataatgttcataatctagaaacttttttttaacccgagcttctactttttaggtgttgtaggaagctctttcaacatctttgtaactaaactagccgttacagcagaccaacggccggaaacgcggccatcggccatcaacgtgtccagcccggcgtggggccgctgcataggcagcaacgaacacgcgtgggtgcgcgatatcgccatgttcgtgtgcttgccgacgggcgacggtcacaataatgggtcgctttccgggcgggtagccgaagcagcgaggcgatgagaatgatgggcccccatagctccacgggatcatcgatcatctcttctccgtgtggatgaggaccacacagatattttgctcctccaacgacgtagccctaaattttagaacaaagaaaataaaattttgagctatatttttctataaaagaatccttagttttggtcgaaacttttgtgtagcttttggatgaaatgctctcctggtctggaaccggaagtgcaagaaatcctgagaaactgcggagacaggcaacgtgctcatcccgcccgcgtggaccacgtccatcggagcacgagaaaaacaacgtgcctccccgggcaggtaacctcaccgcccccgcctgtcgctggcctcgtctcgtccccgtcaccctccacacgcatgactctcccacctcattcgcttgacctcccttccacttaaaccacgccaaaaaccagctcgcgattcctcccactggcctgaatctgacccgcatcgcccgccatccccaccgccgcgcctcttccgggcagcc

SEQ ID NO: 888 - DNA, 454 bp, Zea mays
tttgtcgtttcatatttatgttttatataaatttttactctcgacacaatgcattgtcacataccgattcaaattcaaatatatgtgcgattctgtgctcatattgtgcgattctgcgctcatatggcacctatgtttatgacagtgaaactcacaatgtttattctattgacattcattttcatgcaaattacataacgtatgctagaaccaaatgcaaattactgctaataaacatcctgcgtaagcgcaatggcgcaccatttaccaatagctgtaacggtgcaagtaagtaatagttggagcgttatgtttctctcctctcttcccaccgtacaggatcatatatatacacatgcctctagaacggcttcaatatatagttccaccacattacttccatatatttcccttggattggatcgtcggcgccaaaacgaataataatccggca

SEQ ID NO: 889 - DNA, 1500 bp, Zea mays
gatctcttggaatgacaatcagatcttgtccctaggagaggtaagatcttagggtcttcttagagtcggcaggccaaccaagacggatctagacgacgtagaatcgaatatgggtggaggtggatatgcggaaatctataagtacaactacgctacatctacttttagggcaaaaatgataaagaaagtaattggttcgattggaatatgttcggggttttcaatcagccatactcgttcagatatatacggggaggtctggacacatccttagacgatagctaacaaatcccacgtaattagatgcataatcacgcataagataaggataatcgtccgagttaatctgatcgtaaccgtccaggccctaaggctaaaccgtgggccacttttggtgttcaacacttgacttagctaattgatcgtgcatgcaactatagtcgatctggctcgacggttgaacaagaccgaagtgttcgttccgcgattgagggcttgaggcgaacccaagaaaagggaccctctccttcttgggacaatcgagcgtagcacttggatttgatgctaattgtcatcttaatttggaacaaggtacatcttaatttaacaaatctctttttttggaagccttaaccggtaaagatgattgtggggatggaaacagatacttattccaatattttttttgttttttaattatgaataaataagatataaattatactatataaatacatattcttatttttagtttgtaaagattaataaaaaataaaccttaaaatcatcatatatcttttcaaataataaatataaaattcgaaaaaatttagatataaatattttttctattttttttggttgtgggataaataatgtataaaacaatttatataaatttttctttttatttataataatgtgctttaatattagcataaaattttatacaaatttattttaaaatataaaatttgttataacaattcggatacccacatttatctctaaccctagctaataatgtataaaatcctatcttgtgatatatgttactggatcatatgatttttatactgatatgtcttgactccctcaccgatcaccaccgccacaggatttctgaaatggctaatgaaagcaacatatcggtcatttagtagaaattgtccggctccacacaagttcgtggccttgatcgaaagaaagcgaagggtctcaattcagaagctttagcacaactacagcacgatgcttgcagcaagcacaaaactagactgcagtctgcagtggccactggatgagaaaactaagatgagttccttgcagacccaacatgcagcgagtgaagacgcatccgtttgatcaaagcagagttcaattctctgctgtctttatattaagtcttgctgccatgatgctgagacttgttacttccgagagcagtctttgtgtttgatatccttcctgttgggtctgcaaaagtccagcctttgggtg

SEQ ID NO: 890 - DNA, 268 bp, Zea mays
atgatgaagactgtgacactatgtcgcatagaagtagaattgagtgtgtactgtaacgcgatattggaacattctgtgttgtaacctcgaacatgtggaagctgtaacttattttgcatgttgaccggtgcactttgggcgttgctgtgttatcctattctagtattgttgtaaggattgcgctcggttacacttgagccacagtattttggatcaacttgttgcttctataagcttgctgatgctataatgtttgatcgacctgttg

SEQ ID NO: 891 - DNA, 1445 bp, Zea mays
actttatatcgtgagaagaaaaatgactcaagattatatcgatccaaacaaggataaccattcattcattgcattgttcatacaggtcttctgggttacatcatattaggagatccaccctaaagcctagtcccaaagttggtaccaaaagctaagcttacgtggtcttccctttctcctaacatgtttaattctaacctgtctagcccttattggtagaggcaacactggccgcaggtgtagggggcactccggagtaggtcgtgtttggactggaagctagctctatttcctcgggatcctgctcctcctcattgtatgcctcattagcgttcatgatatagctcaagtgcccgatctttcggtgagtggagataattccgatttggcggaagatgaccctcgcgatccgactacgatgatcaagcctgaggcgccaatgcaatcgctgaaccaactccctgtggttaccgaccttgctgatgcgagatcggcccgatcacgaagatcgtttcctgtgcacaatcgaagaacgaacaagaaaaaatgcaaccaatctaatttattactcgagggtggagttctaaatacatgaagacagtgctgatttgtgcgtgttcgagagtagctaaagctaacataaaacaaaactcgaagaacaagggaggcgcagctcctggataaatagagagagggggcgcagcacctagtggcggccaaagggggaaaacgcaaccctaggggcggccaaccctaggtcgtccactatgggccgtagttgggctggtcatctattcttctgggccctcattcttcagtagcatgacgaagttaagatctctggcacgggcccgagtgattggcccagctaatgaaggaagtggcgcttgatgtggaggtgctgctggtgtagtcgtactcatagtgatgtcctcatcacatgtgatatggtttggttgcacttgagaaaggatcggtttcctactttgcgccgttctaaattaatgcctcgtgctgctggtccttttaaggtgctaacaaagattaatgataatgcttatatccttgacctgcctgcggaatttggtgtttccactagttttaatgttgcagatttgaaaccatatatggccgaggatgaggagttgtcgtcgaggacgacttcacttcaagaaggggagaatgatgaggacatcactatgagtacgactacagcagcagcacctccacatcaagcgccacttccttcattagctgggccaatcactcgggcccgtgccagagatcttaacttcgtcatgctactgaagaatgagggcccagaagaatagacgaccagcccaactgcggcccatagtggacgacctagggttggccgcccctaggggctgcgccccctctatttatccaggagctgcgcctcctttattttcgagttttgtttt

SEQ ID NO: 892 - DNA, 416 bp, Zea mays
ctccaccccctttctccccccttctcctcttccgcgcccgcgcgctctatctcatctcatctgtggaattgggttcgcggtctttcgcatctgtgcgcgtgcttgagtcgatggttaattctgataaatcagattcgcgctgttcgttccgtatcctgccgcgtcatgtgcgtcgatttgttacttgtaccgtagcccaccacccccgcctggcccgatagggacggacccgtccgatccgggcctggatggagactcctgtacgtttctgcggccgttcgatttgttggaattggactggtgggtgcccttctggcataccagcttctcgagttgccgtgcgggttgtgtcactgactccacacccatctcgctgctgcggccttattacttggtgaattgcaattttcagtgcg

SEQ ID NO: 893 - DNA, 372 bp, Zea mays
tctgagcaacaaacaacacacaccaacgcgtctgagcaacaaacaacatacaccaacgcttataagtcacgtttcgacgctttgggtggccgatatggcactaatcaaataacaccatagcagtccctatatccgagcggtgtatgcggcccaacgattagtgcggcccattctgtagcccatctttcagattgttgataacgaccaaatggctggcaagtcacagaaagaaacgaccaaattagcaagcaggcagttacagacgcggccgcgacggcacatcgccgccgtagtccttgaccttgctccacaaccccggcccgactcggcgtcctccgccaccctcctcctgggcagcgcgggcggggggat

SEQ ID NO: 894 - DNA, 1500 bp, Zea mays
aggcagctctactatcccatttttattttaaacatcactctctaaacaatattgtatacattttatacagccatatacatgatcttccgcacacagcctaagtaagtactataccataagggagagttgatctaaatgctagaaacataatccgtcattaatgaactctttgtgtactgctgaggcctcacactatacgacagttgatgtttagcgacccttattagggaccgacggttggtcgctaaaagttgtggaccgacggttggtcgctaaaagttgtggaccgacggttggtcgctaaatgagcatgtagcgacggtcattcagtcgttaaaagtatagaaatttaacaaccagtggtcggttgctataaaggtaagagagggactgatggtgggtcgctatagagatacgtgttgmaagaaaagcaaatgacacaaacgattgttatttaaatttatataaaataaaaataatttacaattgtgaaaaattaattaaaacaaataaaccattgttttaaactaataataggagcaaaaaattacaaaaataaaaaaactatgctttagccataattcgaactctaaacatatggtttactatgtaactcctttaccactacactatagtctatttcacatatatttatgcttttttccttatttacgaacaaaacccatctaaaggtctattaaccaaagaaacctaatatccatctggttcaaagaccaatgaatgtatctaattctctatacaccactacatcaatgcatgtatgtatgcctatagagagtacgccttatattatgggacaagaacaaaagatggttatgccttattgtcggcgtttcgagaccggggggtccctaagccgacgagtgaatgtcgctgcgtgccccagcccagatgggtctagcgcgtgggcgagcgcgaaggggggaagcgaaggtggccggagacgggcgtgagagaggtggaaatcccgcggccttcatgttcgtcccgcgcccaggtccggtgcgcttgcagtagggggttacaagcgtccacgcgggtgagggaagcgagcggccccaagagagcgtctgtcccgtcctcgtccccgcgcggccaaccctctctaagagggccctggtccttccttttataggtgtaaggagaggatccaggtgtacaatggggttgtagcggagtgctacgtgtctagcgggggagagctagtgccctaagtacatgccgatgtggcagccggagagatcttggcacccagctggtgtgatgtcgtggccgtcggaggagcaacggagcctggcggagggacatctgtcgtagcggttgagtccttgctgacgtcctcctgcttccgtaagagagttgagagccgccgtcgtcacagagcttgcggggcgccatcattgcctatctggcggagatagccagatgggacaccggtcttgttctctgcggcccgagtcggctcggggtagggtgatg

SEQ ID NO: 895 - DNA, 555 bp, Zea mays
gctcttaattgtggcctcctttggattaagggaaaattccttgtttccgtgtttttctataaaaataaactgatttctataaaattcttatacagttcatgtgaaatttctgggttccaaataatgtaagttctaaaaaaaccctgcacggcttgcggttggagctggcctcaaaccagccttaacctgacaggctgacagcgcagagcggaatggaggaaatgcccctacctgttcacagtgactggcctcccgactcgactctcctccccctatctctatctgcttcctgctgagctcaaaccccttccgcctccccatccaccattccatccgccgccgccgccgccgcctgtgcaaggtgagcccctcccctcttctcctccccacgtaccctgcgctggctgcctcgcgaggtccgcggtttcttttgcttcgtttactaggtaggctaggctagggttggcccgctgctgatgcggccgaggttccgacggttacttggtattggtgtggtttcgccgtcgtcatgtgttgatttttgtcatcacccag

SEQ ID NO: 896 - DNA, 540 bp, Zea mays
tctaattacagtgcaaagacaattatattattttacgtttggttttcatatgctacaaatccgtgcttgttacctattccattaagatcacggtggtatccattcatgtagtcctaaccaaacaacaccttataaattgacgcagggtccgaaatgaaaaaggcgcaaccaaacaacgttaagaagggaagataagaggatttcaaattcaaaaaagagagcgtctgcgcctccgcacgcacggacaccgggacacgggcggttcattgcttcaaatcgttgcctgacccaggcaaaaatctcagacgttggatttcggttgcctgatcacttggcatccaaacaggccctactagccgagcgagcggccgtctcaaaaatcccgcccactctctctctctctcaccaggcacccccattccctccccgtcttcctcccccatttctaccacggcctcggcatcccaagtctcaaacgtcaaacccttacctcatcagcgacgagaggggagccccgcctccgcctcctgcttctctact

SEQ ID NO: 897 - DNA, 819 bp, Zea mays
ctcgcgctcgcgcgggagctgcctgccacactggcctcggcgggcggaacggaagccaggccacacaatggcgccatcgcacgcctgccgtggatgatggataaaacgaagcgggagccccaccaatctggggggattgttcctttggcgcgtagctggaaaacaccttgcctccaattatctgccgtcgttttccgtggacttctcttgcgtgggggtactgaaccgtgcgtcacttcgcttcgtacgctgggtatgcctgcacgctcagtatacatgccagatacagatacgtgcagctcaggtttggacttttctttttgagaaagcttgggcttggacaacttttccctacaaggatgatctcggttcacggcccattcagtacaggcctaaggcccagcgaagcagatcggccaagatcttgcgggacttgccggttgccgtccccggtccccttgaagctccaacagccggccatgactggactggtcgacgtcgacgaaactcccaaacaaatacgcgtgcgaccactgaaatttccaatccagcgcgggcacccgtcgccgtcaccgtacgctggtcatgggctcttggcatccgtcgtccgtcccacgccacgccacgccacagtgcctcctcgcagcttcatccactcgtctcccctccccacaccaaaaaaacaagcaagggtcagcagatagccgcattaaaaggagggaggtcacgtaaacttaatccaatccaccaaaccccaaatctctgtctcgcgctggcgcagcgcagggcaccgccacgcgcgcctcatccggtaccggc

SEQ ID NO: 898 - DNA, 64 bp, Zea mays
gttagcgtggcagatgttgtggatgaactagaggactttgataaaggcagagttcatatcatat

SEQ ID NO: 899 - DNA, 740 bp, Zea mays
attcatattcaaactacattatataaacggtacaacatacaatataaaacgatgtaaaataatatttttagtgattatatagtatattgtataatagttcatctatatagtcactaaaaatatcttttatactattttgcacggtaaattatattgtttataaagtatagtgtaaataagggacctttgcactctctcctctcctggccagcgtcgtctatagtctatacacgctctgacgcgcgcccgcggcctcgccctagctcgcttcgcggcctcgcgccctcccctccgagtcgcagggtcgcacgagcagacaatcaccaacaccctttctgtctttcgctttcactgctcaccatttcgcgtccttgcctcgccctctcgccgtagcgagcagctctttttcgtctccctccctcatctgctacgcacctttgcagaaagaaaggcgcccggaggtaggggtagaggtagagcccgagagcccaacacctccaccagcagcaaagcaccaccaccagagccgagcgcacaaaagcgcgcggccgagacgcgggacaaagcaacgggcagcctgtactgcccgcttctagctgcagctaccctccagtcccagttccagccccggccaggcgctcgcaaagtgcggagccgccctctcttcgagtcttcgctcgtggtctctctctccaggtcgtgcagtacgatccatatcccggagctcttgcgcgagcgac

SEQ ID NO: 900 - DNA, 640 bp, Zea mays
aattctttaaaccaaacatccttttaaaaattaattatgttactctgttttttttttagaattactatagatcccaacacagccgaatctgtccctgtcagtagagctacccagaagcttcctttgtctctgtcgatgctgactccttcaccccaacagctcccaatcttcccaacgctgcttcctttcccagcgagcagtcagcagcaccatcggtctcctccacgacaaaaaacagatattctatcgtcaggaatcaatcagcaatcctgcgttgcctgcccgacggagctgcttccctcgttgctgcattgcactgcggcggcctcgcgcttgttgtcgattccagctccatgcgcccatgatttactttacttgtgtaagatcaccaatctcgactgctatttcccctttgcgttgctgccttgctggaaaataattggtttgtccatttagattcactaattttatgcgtctttccaattctaggttttctcgagtctgtagcggtttttatcagctgcttgccttctgcagaagaaaaaaaaaacagccttgttactacttcccatcgttcacccattcatatttttttttcttggttcacaaagtaagaggaagcacaaactactccaacttc

SEQ ID NO: 901 - DNA, 129 bp, Zea mays
ggtgggccgtcggcgaagcgccgtggtcgtcgtcggggggcagggaccgggcggtgtacgcgctggcgcagtgcacgctggacatgccgccggaccactgccgggcctccggcctgcctcgatggcgcc

SEQ ID NO: 902 - DNA, 1141 bp, Zea mays
ttgccatataaatattcatgcctataagaacatgttgcacaagaattcttcttcctgctctggtcaatagatcggccttcccaatttggaagcagatcagcaattctttcaacaaattggctggaaccgttgcctgttcaaattttgtaaggataatggaagactcaaataacggcaagggaaggctgcaacctcacatggcagcaagttctggacttccaaaagggtgtcctctaggcacctgatggggtaaatgttggactttcgtgcattattatagaggccagaagcatccccaaataactgaaggatttctattgtaacagagatatcaaaagatgttggatgaaggaataatgctacatcatctgcatacatagaattcctatgcaatctttttcttcttgatagctgctgaagtaatccttcctcttctgccttattgaacaaaattcccaagatattcatcgcaacaatgaaaagcattggggagagtggatccccttgacgaagacctcttttgtgatggatatgggttcctgggaaaccatttaaaagaacttgagtcgaggaagaggccagcaatccaagattatatccctccaaatctgtccaaaacccatctgctccatgacctcaatttgaaggaccacgacaccgagtcaaaagtctttgtaatgtctaatttgaatagcaaaccagccattttatgttggtgcaagaacctggatgtttgctggaccaacataaaattatcttgtatgaatcttccttttatgaaagcactctgattggggaaaaccatatcatgcaactttttggccagccggttggcaagaatttttgtgatcaatttagcaaagcggtgtacaagactaattggccgaaaatcctttacctgatccgccccttcatgctttgggatcatggtgatgtacgcagtgtttagcttgctgaaattacagaattttctactccagaccgctgaaaccgcagccatcacatcatttttaataataccccagcaagatttgtaaaactgccctgtgaaaccatcgggctctgggaccttgtctgaaggcatatctctaatggtttcccatacttcttgctcagagaaaggaaagtccaatcagtcagg

SEQ ID NO: 903 - DNA, 1007 bp, Zea mays
ctagcttgcgtgcactcgcccatgacggccgccaatgcgctcacccacgcccgtgccacacctttcctccttgttcccttcttattagagttaatccattagccctatgatatgtgtcactgatgactatgtgcatgttgttcatttaattttaattgtggggatattttaatttttttaatcaggacatacggtgcaacaaatgtttgttgagacacttagctataatggaaatggcagtgtcaatacttttcccataactttcgagtgaaattgtagagtcctttacayaaatcagatacctccactggacattcttgtgttttttattcatctgatatgtgcatgctatgatatgagttagaagtattatttggatcgaagggattaaattttagtcctagcatatactcacataagatgtttggatgccaattagaagtattaaatgtagtttaattataaaaataattacacagataaggattaaatagcaagacaaacctatgaagcttaattagtatatgattcgcccatgtgatgttatagtaaacatttattaatcataaactaattaggcttaataaatttgtcaagacgtttaattttgtgtatctaattagtttcctagttaaactatatttaatagtcgtaattgatattcaaatgtctgatatgtcatggattaaactttagttacggaaacaaacgcccttagttttttttactgttgtagatagatgaactttggcaaaaacaaaatgataaatgaaatttttctggaagaataaagaaagatcacatatcgggccaagtttgggttcaatttaagcaccaagatagatcaagtcatctttgttgggttggtctaatgaaaagcccagtgaagcaatgccatccatctcctacagaagaagccgaacgttttcggttccgctcagagtcataagccaggtcagactaggttagggtttacctgtgaggcctgctcccctgccgccgccgcc

SEQ ID NO: 904 - DNA, 196 bp, Zea mays
agtaaggacgtggcctggcctggccatcgaaacaacgccgctccatatgcaagcattttgcaagattcagacactgaattagacaacttttatcttggttcagtttgtcgccggcacgcagaccattaattccctggccttcgtgtttgatggcatcaactttggagcgtcagactacatatactctgcttactcc

SEQ ID NO: 905 - DNA, 682 bp, Zea mays
tgctgcgctagcagatgtaatcaatgcggtaagtcatgcgttcgacattcaccattgcacaattcaaatggagagtacggacttccataaggacactccaattccttcacactagctaacctagaaaacttaagccgtagggttaatattgaaggcgtcagcaccaaaaatttagattaattttggtttattacttagcatcgagagacaggccaagtaaagattattttattgtcacgttacgttagtaacaataccaccagctaaatattacaaaactaaaatattggcacgttaaccaggaatataatttttactccgatcgattgatgccaaatcacaatggagctgaccgaaaaaatattcagcggctctcgagcagaatagtctggtgcatccgccagtcgtggcggtgctcaactacctcgttcatcaaagctatgctacaccaataatttaaatcgccaaaactttcagtggccttgcgatcaaattaaaaatttgtaatttttcgccaaggcccactatttcgcgttaatattcgagcatcctgagttgatcacggcgtattgatataggtagaaatcaccacatgccaagcacgcagagaaactttaaactggccttaaatcacgatcagggagagctcggcctactccttactcacaccttgagataagtt

SEQ ID NO: 906 - DNA, 636 bp, Zea mays
agagtcatctcattcccaatctcctggatcgtatcgtatgcgtgaagagaaaaccgcaataaatgaagtttgacaaggcatttgtaatctgtagccgtctatctacatgtgggtggcctcgatgggcatacgctgtcactgactcactgccactcccactgtgctgccgcaacggcactggatttttgtgagtccgcggctccgcgctcgcttctctctctctctctcccccctttctgccgctcactctcgctcgctcgctcgctcgctcttctactgcgggctggcggcggcggcggcggcgactgggcgagccgcgagcgcgccgcccttcgccaggtcttcgccggccacttcgcgggcgagggcgaccaccgacgagcatccaccaggtacgccagcccattccctctgttttcgttcctgccgtgggggaaaaaaggagcactcgcgcacatccaaacctagacgggagctacgcgtattcggatctgacccaatcgcagctaaaacctgctaccttccattttttctccgcaaatttatcgggtgtacatccatgcgctaatgctggcatgctgacatcgcattaccgatgctgctgctgtctctgcaggccgctgaggaataacaaag

SEQ ID NO: 907 - DNA, 177 bp, Zea mays
ggtggtggtggtagtgtagagagccctgcccttccgatccggtccggtccggctggattcctcactttagtttttttttcgcttcttctctgatcagatgcaatctcgccgttgccgtccgtagcaaccgcacgcttcctcgctcgccgcgaaccctagagagcaggtgtcggtgtc

SEQ ID NO: 908 - DNA, 184 bp, Zea mays
agaacagactggatgctacctctgcgaacgccgcctacagtactctctggtttcttcagagtcgaaagtttgcatgcagttggatgtgggcaattaagagtgaagcggtttgtgtgtttttatgtcaagacctcacgcatatcgcgcggagtagctaagctcgaccgtatattggttgcgacgt

SEQ ID NO: 909 - DNA, 700 bp, Zea mays
ggttagtaataaaaatttatttccttgtgctatgttacattctgctttgcagtgatgtagattttgccccccttattgaacggtaatatcagcccctgtaggattgtcaagtgccaactttgttctgcatagattatctgtaccaagctgctatatattgcaacattattagaatgtctataaggagcatttgctgatatgatgtatcagtggagctcttgcttttgttgattcatggggattgaacagaatttatggtatggttacttatggtttctatatattctctgtagcactttgacagagagtcaatgttgtaactagaactggtcttattggtttgagatcatgctctggaccatattgttaggtccatgctcagctatactttcagtccatctcgttgcatgcagtcttaagttattgtcaatacaaccaacatatgtgtccattcctggcccctggaggaccacacaacatgcatcaacaaaaaccaattataatttcaatcgattcaagctgcatacagaaatgtgatatttgaatctgaatgtaggcagtttccaagccatccagcacataatatgtatctgtacttttgcttgcaggcatttttgttgcacttgccttgcgctttgatgtctcaagaggtatcaagaagcgttacttcaacagcgcattttcgggatacgccgtgggt

SEQ ID NO: 910 - DNA, 541 bp, Zea mays
gctgcagaaaaacaaaagaacttcagcaaatttcagctaactgcatccaggagagacgtttggtgagcatagcttctgctagttaacctcccatcgcgacatccacaaattcttctggctttgtggtttgattcttcagcaaaagtcgcccatgccaccaatcaatctcctcccaaacgttagtacagtgaaacacgcacccgccgaccgccgtgcyctccttgccgagccacgatagcccccaactaatcccaccgcaaaaaggcgccgtttccgtgctcaaaagctccggttcggcgttatgatgacgccttctcaatcaacccaaccattccaccgattccctcgtcgacagccgtagtgtgctcggtgcccgatgccatgctttccgtccgtagtctgtaccactaccgtagtaccgtgcgcgtcttaagcatccgtgcacctggcccagtgactgcctgcctttgccttccactggttcgcttctccctctcctgtgcttggctgctgcttgcccgttgagcacagcagggaggcg

SEQ ID NO: 911 - DNA, 145 bp, Zea mays
ttaagtatacataaagcaattttttttactttaatttaaactatacttttgaccttagaatgctaacaggtctgattttcgattttgtacttaaatttaaattgtattttaataagtaaaagaagtcagttaattcattaagrct

SEQ ID NO: 912 - DNA, 204 bp, Zea mays
ctaaacaaggaagttagattcggcgatgcccctttcggggggcattccgatttcgctagtaccatcttttttgccgcgcaaatccagattgagattgaggaaagggagtaaattaagttttcgaatcactgactcaggcccattgtcgaatcctactcagcaattgtcgaatcctactcagccaaaaaaagggggtacttatgt

SEQ ID NO: 913 - DNA, 1417 bp, Zea mays
tacataagtaccccctttttttggctgagtaggattcgacaattgctgagtaggattcgacaatgggcctgagtcagtgattcgaaaacttaatttactccctttcctcaatctcaatctggatttgcgcggcaaaaaagatggtactagcgaaatcggaatgccccccgaaaggggcatcgccgaatctaacttccttgtttagatagtgtatgaataggcccgactaaatccttgtatggcttcctctatttctctataaaaagaaatatgaccaagagtggttcgaatgtatatagaacggatttctttttttctatttcccactactagatagtgggcataaatctcatgataagtcccaaaagattcatattgaacttcaatcggaacttctcttgacccaacgatgcgttgatctagtttccatcggagccacaagggactgtttaaaccgattcgtttttgtctataagctcccagtgcatcataggaactagaaaaatggggttctttatctttcgtatacttataataattgttattattgtagtttacttttttatttggagagtttccgcaactattatatctatttgcacaaatacctagacggtttccaatcgttaatacataaagtccgataagcatgtcttgggttggcacgcaaataggatctccaatagcgggagacaggagattcatatgagaaaacataagtaaacgggcttccgcctgagcttccaaggataaaggtaggtgaacagccatttgatccccatcaaagtccgcattgaaacccttacacactaatggatgtaaacaaatagtacgtccctctactaaagtgggttggaaggcctgtatgcctaatctatgcagggtaggtgctctgttcaacagtacaggatgtccccgcataacttcttgaagtatttcccatacaatgggttccttttcccaaattttccttttagcaatcctgacattagaagtagcacgtttcgtgattaaatcgcgaattacaaatagctgaaaaagctttattgctatctctagaggtaatccacattgatgtaatgaaagcgaaggacccacaacaatgacagaacgccccgagtaatcgacccgtttcccaagcagagtctcgcgaaacctcccctctttaccctcaattacatctgaaagtgatttgtatactttattgtgaccatccctcgtcggttgcccgcgggacccactatcaagaagtgtatccacggcttcttgtaccaatttttcctggcacattactaaatctgctggtgctaattcacttctttttaatagataggcaaggttgttgttccgacggataactctcttataaagttcattaatatctgaagtcactactttatccccagatctataaaca

SEQ ID NO: 914 - DNA, 812 bp, Zea mays
cctcgaaatgcagcagagctgtgggctgtcgctgacactgctgtgagctctgtgcttgaaatggccatggtctgtaatagcgaactgggcttgagcgaaaataaatccaccagcgcgctagcgtgtgtcagcgatcatcattgctcaatctaatggccggttggctggggtaacggcagtccggctacaccagtgacgagccggcaccttgttcccggcggtgagggccctttggcggcttggcgcatggcggcatgggcgatgtgtatgcatgcagtatgtgtcgttgcgtaccacaattaccgttgttcctgggccgtgaatgtacttgggctcagagtgagcggagcgacggcgagcccaaccacttcttcgtgcggcctgaatgcctgatcgcggtaacagccgccagcccggccgccggtgaggcggtgaccggtgagcggtgaagtgatgacccgcattctgcatgacgccggctagtgtgtactttgtagcgcccgccagctaggacaaaggtcccacacagaactggccacgtacagccttacagcgaacaccacgagcacagataagagtaggcaaaaaaacccagcattttctggtttgtttactgataccttctgtttcctctcaccttccactccctggatctccagctccaggcaaggcccgaactggggaattccgatctcaagagcccccaccaagcgctcccgccgatcccaaggactcctgcctccgatgcggcaactcatcccatccggcttctaaagccgcggcccctgtggtcaattccggtggccggcggc

SEQ ID NO: 915 - DNA, 60 bp, Zea mays
cctcgaaatgcagcagagctgtgggctgtcgctgacactgctgtgagctctgtgcttgaa

SEQ ID NO: 916 - DNA, 503 bp, Zea mays
tggctgccgatcttagattggggggcgggaggcaagggcagactggcgtggtaccagtaccaccggcggggcaacttgatcggagtggttgctgtgtcagggccggagccggagccggtggcagctctccgccgccggcgacgggtgctggagggcggagcggggctggggagctagtggctgtagtcgtgtttctgtcgggagtcgggactcgggaggctcaagagagcgaccgctgcactggaggccgaagggaaggaacgaggccgttgaatcgcaggatcagggaaaaatctccagcctctctacatattcttgtcgtctcatggatctggcctgccatttggtgtctggtgatgggattctaggatcaattctactttgtagggtttcatcgattcttgtgttacatctgtggtctaggaaaattgctgttttatgtttctcagtgaagaaaaataccgatactaataatgtaggtcttgtgcgggatccacagaagg

SEQ ID NO: 917 - DNA, 558 bp, Zea mays
ggcccgggaccgtcagccttaacagcttccccctccggcttctttctctctcctaccaccaccaccaccctatgctaacagctaacgctatgctctgatcttcccctatctctcctcgctgcgcacagagcagcggctgccccccgaaagcaaccacagtcacgtcgctatcgccagcgccaccagaaaaacgcatcccacgcagaacccctcgcactcctactccctctctgcctccctttcctctacattgtgcccgtcgcattgaaatggagcagcagcagcagaagcacttgcgccggtgctagctgcgacgtgagcccgcagcagccactgccaaggacttcctggcccgcccggcttcgctgttgccggaaaggcggtggctttgggggaagcaaaagcaagcgacggttgcggaaggttcttgcggattcgcgcgcgggaggaatggcagcgcggtcgtcggcggcagcggtggcggtgctgcttcttgcggctgcgggggctgcggcggcagcaggaggagcggagggcgatggggacggccaggcgctg

SEQ ID NO: 918 - DNA, 1500 bp, Zea mays
atcggcgtccataggccgcgccggtgcggtccgtggtggagacggtgagacaaaactctctgaatttgtaaccgtctgatgatgatccgatcatctcaagttctgaaccagaacgacctcagcttgttctcataaaagagaacacttttttagactccctttgctttcccctgactcaatttgtaacatgttttaacgctagttagaagtattaattataatctaattgcaaaaaccaattacactaggactaaacgataatacggatgtattaaatctaattagcacataattttttttgcgatgctaccgtaaacatttgttgatcgtatatgtataaattatacatttatatttaatacatttctcttgttattattcttcagctatataattattttttttataattagattatatttaatactcgtaatagacatttaagtgtaggatgttttagtccccgcaagcaaacacgtcttagttgtccaataatgggaagaggcaggatctggacgtaactgcgcaaatcgtgtgcatgcatgtatcatcaccgtcgtacgtggacatgttcaagtccactgcatctgcacgtgcctgtggcacacgacgccagctgccgccacgtcattgcaatagtggcgccagcgtacgtggtcgagcaagcagacaaaagaagctcaagcggaccgtggctggctgatcagaaacagacgattctccggtttcctcatcctccagctccaggataggccgccggtgtggctggttttggtcaggaagggaaggttcatgaggccggtaggcggtaggtacttcccgaatgggtgcgggtgcggccgaaaccgacggcgcacaagacagcggcacaagcacatcgccaattcgccatggtgcccggaatccccgaaagacagagagcaggctgcagctgctggtgagagaacgcccgacgtgcgctgagccagcttaggcggcgccgcaatctttgtgatcaatctgtactccatcgcactacaaatcactaaaaatatgcgtaaattaatattcaataataattaatactaatgttccactttaatgttacgatgtatttatactttagtaccatatcgaaagtttaagagacaaatcaatcaacttaaatagatagatcattaatgcatcttctgagaagttcataaaaaaaaaataaagaactgacacacgcgcgcgccgtcgactggggctagagatggcaatgtgtaaaaacccgctgggtattacttgcccaaatccatacccgcgaaaaaaaacacacccgctaaaaaacccatacccataacgggtataaaattttgcccaaacccatacccatgcgggtttcgggtacccaatgggttttccatacccactaacatcaacataaaaaataattcgtcatgtaaatgacaatcaatacattaataagctagcataaaaggaacaagtgataactaattttagcctaaaatttgttac

SEQ ID NO: 919 - DNA, 1500 bp, Zea mays
tttgtcatctccattttaaattctactctatttttatatkgcaactctttctatattttactctccaaattatcatttaaagagtcattgcataaaaaatattttctatatcttttcaatctccaacaacatttctaaatcgttttgtaccctagagagcaattcacgttttctatatttggctagcgagaaattcgtaatagaagatgactatatttagatagccatttagataaatattctctttaaaaaatatttatttatatcaattagaaagaatatagagagactcttgaagttgctctaagacgttttagtttttttagatttagctatgcatctaaatgtattttaatatatctagaaaagacctcaaatatcttataatttaaagcatataaagtattatatatatatatatatatatatatatatatatatatatatatatatatatatatatatatctagaatataagatatatgtgcatataaaattatgtactacctctgatcttttttacttgtcgtttgttagtgtaaaattcatctatccagtgacaagtaaaaagaaacatagagagtatctaaaaagttatcataactttcatttagaatcgacagagtacctttttcttatagagttgaatgctttggagttaactgtcgtcaaggctgaaaatggtacctaaaaagcagaagtttaaggtttgcgtaaatagaatcaacatttattcgtactaccttttgctaacttggatatttctgaaatgttaaaaacaattattaccactatccttctgctgatcaaaagaggctaaacacacatcagtcaacagcacgttgaaactgcagcagagcacacagcagtggcccgagcacgaggtgaagtgaaaaagcaaggtgctgtggtggacgccaggacacatgagggggcaatttggtcacagcaaaaaatccaacggccagttccctacagcagacaggggaggaaggaaggaagagctacacttgaaaggcggttaaaacccagcccagcaacgataaaaggcaaacaaaggaaaagggcttagcctcacgagacaaaagacgcccgccccggccggcgaccagtacctcgccattgctagtgctagccgccgtcgctggtgtcccctcctcccacttgcgccgcctgtccccgcgccctcgaaacctttttctcccaaaacagatttcgtcccggcgctctcctgcaaagggcggctagctgtcgccggtggatacgtttcacctctgtctcactgcttgggggggttctgcttcttcctgcttttccaagagagggccagcagcagacgaagcgagcaaagcgcgcaggaaccgctcggtctggtgattttaaggggcgaggtcgtgttcttgggaggcggagagacacgagctctctcttcctgtcctctttcccgcggcttctctcttgtcttgctccaagagggcaaaactcgtcggggtagggaa

SEQ ID NO: 920 - DNA, 1147 bp, Zea mays
cgaatcacagcgacgacgatcgacggcgacggtcaccggcgatgggcagggggggtgaacctgtgatcttcttcagtactgtaccatggcgatcccattcagacagtctgtcagctgaacttggagcatcattatctcttaatttctaatgtcaacacatatcgagctctgcagcaaaagtgtagagcaatataccatctacaattcgactataggacttgaacatatttgagcactggattatgctcaaaacctagcttgaagtcgaggtcagttcactgctagtctgaaaattcagacataacagcctgacaacccaactttaggcttggttttctctaaattcttcttaacaactaagctcacaaccttaagcaaagttgttctcctataatgggtcttcaactttgatgtggtgacctagggtaaaaaccctatactttgtaagttacaaagccccaaagttgagcccattcactgattttcagacttagagcaaaacctcaaatgaggtccattttgcatttaggtccaaaaccttaggttttgctttcaagtacacatttttgtgaaccaagggacttaagaaacctatttggcttggtttttgcactttagcccaaaagtggactaattttgcatataagcccctagggtttggtttagggttttccagggttccaattagggtttctggtatctcaggggtacaaaagtgattcaagtttatttttagggtcattttatgacttttaccctaaagtatttaggttttcttaacttgggtaaagttttacccctataatccccatttagggttaagttccttaactagggttctagttgcaaaacacttaaaacaatacaacttgtttgaaatttttgcctagtgaatgcactctaggtgtgtcaaacatatgcaatgccaatgctcatgatgccatgctcaagttttagttatagtaacaccaggggtgttacaattttcgacaaaaatggggggttgtgtggccattgatcatcgaccataggctcatacacctcaccccacatatctttccttgccatagatcacattcttggatttctggtggagaccatttcttggtcaaaaatccgtaggtgttagccttcggtattattgtaa

SEQ ID NO: 921 - DNA, 1003 bp, Zea mays
taatatttacagaaaaaaatcctggtggaattagtgactttgaaaagcctggttttgttggagtacctacttcttcatttttggctcgaagtccgtgggccgcagggtctagcagatggcgaggagagtgaggctcctaattagagtaagacgggtaggccacaggccgcgccgcttcggcccagtgacgatatctaggttgcgactttgggctggcttcgcgcgtacgtgaactcgtgaagtcatggtagtccgtggaaagaacagagcaaaaaggcattcttttttcagtaattaagatttttggtcaactatttagcccttctgtgcttcctatcaaaaaatatatttgttttgaatatacatacggtaagctgtagttgtttcgaaggaatccgaagataatacttggtctctgtgatagggtgagcatctgtgcctttgtatttgccctttagcgaagtttgggcaattgttcttccgttatccgtaaaaacttcaagcaaggaacctaagagtggaattagtaaatctgacggacattataatactgcctttacatacacactacagatgtattcgaatatttatcgtccactagtttatttttaaactaaactgcgacaaataaaaaacggagagagttgaaccaacacactatttttgaactaaaccgtgataaataaaaaacggagagagttgaaccaacacacgagagggaagaggagcgaaactaaataaaaggaaaaaaaggactccaaaggtatcttcatttcctctcaaaagatcaagaattccagagagaattcggaagcatctcgcctttgttgtgctcaaggcacgaacattactgtcttgccttgcatgcgtgcacaacgaaccgggcctgcagctgagctgtatataagacgtggatcgcatgcgacaccatcatgcatggtgccggcgcaagatagacacgaacactaaggcagcggcgaagcaacgctagcagaggagaaga

SEQ ID NO: 922 - DNA, 69 bp, Zea mays
tggactgttacctcctatatattatcgatcagaagctagcgctcttcagtacttcaggcttagccggcc

SEQ ID NO: 923 - DNA, 412 bp, Zea mays
tagaaccatttctcttctcaaggatcaatgtaatatgttggagagattttttttacccgagaagctgcgccgcgcgccaatctgatcatctccatgcgctgaagatcgttggtgcccgccatgcttcccgatgattgctgccacatcgtcgctgtaattttgcttctctgacccaacacggttttttgctcgcctcttcctactttctgggatgatgatgtttttatgaaacccaaccgagcgatttcattcgtttccttctcgacatccttttgctgccgcgtttcttgcatcgtgcctatatatgcatcaacgcatgccgatgcccatgtggagttgtaattaaaatggcaacaagtccgatccgttacgtttcctaggacaacaggtgcttgcctgcacaagtaattca

SEQ ID NO: 924 - DNA, 71 bp, Zea mays
attttctttcctttgttggtctgacatgtaaaactttatgctgcagcattctcactgggcttctgtccttc

SEQ ID NO: 925 - DNA, 989 bp, Zea mays
tggcagccaggcaggcgtcacccattgttcacctgctctgtctctgcctgcagtctcctctgcagctacgcgtttgttctgtcattcatttgttcattccctcaggctcagcaacacaatttgacacatgcgccattcttgtacagaccaaaaataataataatactggtacggtacagtgcatagatcgacagatactcctactgtgcaggaacactaacaacaacaacaattgttgaattagttcacttcggtgccatcgacttgtgaattgtgatgaaagaagatgtataacaaatttcttgagcattgctgatttatcaaatcccgacttcccgagaggatcatgttttcttgacgcggggaaattagcttgggcttcacgtagttggcgtggggccggccttttatggacaacatatcgaatgccatgggccgatccataaagcccaatattgacaacccagcaactcgagcgagtggactcctgaatcctgaacggtcaaccaaccaaccaaccaatcggaaacactcacacagacacgacacgagcggacgacgggacgagccgtcgtgttccggcgcgggtgtgtggcggcaggaattcgcgggaggaatggctggccggcgggagcccagatcaccctcaatcatgcttcgaccaggccaaagaagacggaattatctccgtcgccatccaccactcacaaccggaccgggggctgatgagatgaacgggaacgggtgcccctcgcctccgccgacgtggactcgctgcctgccccgcaaggccgcgacgaacgaggacgacgacgagacccgtcgccgtcggtgttcgcgcccgaccgcacggtgcaccgaacgtggcgctccacttgtcgcgctctccggactccgtcgccgggcgggcgccgcctacttaaccgccccggccgcgagcggggtcgggagaagacggttcgagtccgttctagaatctagacacggca

SEQ ID NO: 926 - DNA, 1500 bp, Zea mays
taattaagattaaagttgaatagattatttctttagattatatttataaaatcaactcaagacctagttttaattacttcatcacatagatcttccataagtcataactctttaaccataactcggaatttagcggttctcgaacccacgatctcgtagtgacacatagattatttttatgcagtttgtgcttatgtttagtgtgatgttaattttgtctataccatgttttttgtattgctacgattagcagtgaggtcacaaggatctgaagaatcatcctagtacctggaatctcaagtctcaggcaagttgtgcccttgataacttctttttacccaatcatgttcttattaatcataatgatctgcataggttaattttgatgggacccaataggttaccctagtttgactatctttataccttgtttaccactgaatttttgggtagtacctgctattgctttatgtggttttgggtatagagatacacattattcatgaccacacttttattatcagtttgttatttactgatcatgataagatcattatgttaattggaacatagagaaccacccaggaaaacagtgctaccacaagggtggtatgggacgcccttagctgactaaataggaaagctagtggaggactaccttacccgaaagcggcaagggcagtaggggagtggtcagtgtagggaggcccttgggttaattttgctgcgatggcggtcagacgaggggtccctgcattggaggttcctaaaaactgtagcgggtttcctgaagctagtagagctttgtaaaggcctcgtagtgttaccctgcctcgcctcctcggtagaggtgtatgggagtggccttcccttggcagatgggtaacatgacttgtgggtaaagatgtgcaacctctgcaaagtataaaactggtatatcagccgtgctcacggtcatgagcagctaggaccctcgcatgattaatttatggaactaaattcaatttgtcatatgcattgcatcgtaggtgttgttatcacttttgttctactacttaattgggttggtctttacttatacttagtaattgctaataaaattttgaccaactttaaaagcaatgctcagcttcaaccwtcctcttttgtaagccttacacttcacgtgagctcccacccttggcgagttcattcacattattccccacaacttgttgagcgatgaacgtatgtgagctcactcttgctgtctcacacccccccacaggtcaagaacaggtaccgcaggatgaggcgcatggaggatgctgtgacgagttcgtgagaggtctaggtcgtcgtctcccagtcaactttgggttgctggatcgtttcctcatatgatgtaattatttaattatttttgtacagaactcctgttatatagtaaagatgtgacattcgatcctgtgccactatgcatcatatgtgtgagacttggtcccagcacacctggtgatt

SEQ ID NO: 927 - DNA, 70 bp, Zea mays
tgaggaggacgtttataattccttattctttataagcagatgcctcaggtgctaacggctggcacaatta

SEQ ID NO: 928 - DNA, 120 bp, Zea mays
gcaaaagagcacacttgactcttgctcgcctctctcactcactctctcactcaagctccagtcacacactctctctagctctctgccactccgtccattgggctggactggactggaggc

SEQ ID NO: 929 - DNA, 301 bp, Zea mays
ttttaaataaacacccgtcatacaacctatagttcaattctttaatcaccttgttaagaagaaacatgtctacacggctagtcgggtcaccggccggtcccaggctctgaggctcccatcaagcagaaagcagtgagaaagggtggcctcaataaaaaaaaaagtgcagcttaaaaagaagctgctcactctcacaatcccactcacactcgctctctcactgaagtgaggaagaacagagagaaggggagggagatcgtagcagcggcgctgttcgagagctcgccgatctgctgcggga

SEQ ID NO: 930 - DNA, 1500 bp, Zea mays
tttatggtttgttttgaggatgttttctagccatgcttaggagtattgggggtacccctaattacggtacccgacatctagtgaaactataaattggtttaattccaagtaacctatgcacttaccttatgcaaactagttctattttgcacttatatatttgctttggtttcttttggcatcaatcaccaaaaaggggagattgaaagggaaatagggttaaccttttcccagtattaattttggtggttgaatgcccaacacaaatattggactaactagtttgctctagattatatgttctacaggtgcataacggatgaacacaaaccaatcaaagattgaagttagggatcaaattcaaaggagcaaagaaaccgagtgtgctatggtctggcgcaccggatagtccggtgtgccactggacagtgtccggtgcaccaggactgtactgattccaactagccagtctcgggtttcttcaggcgcactccgctataattcaccggactgtccggtgtgccaccggactgtccggtgtgacagcggagcaacggctacttcgcgcaaccgtcgactgcaaaagcgtggtgatcagatgaacagtgagcaaaagtgcgcgcagagtcagagccgcgggtcagaggcgcaccggacacggaacagtgtctgtctggtgcggcaccggactgtccggtgtggcacaggactgtccggtgccactagaggacaaagcctccaacggtcaaaagctccaaaatgctaacatttggctgacgtggatggcgcatcagacagtgtttggtggcgcaccggactgttcggtgcgcccatcgacagcagcctaccccaacggttgtttggtggttgagggctataaataccccccaaccaccaccaccacaaggaattcaagatttctgagtatcacattcattacaagagctctatcattcagtcctaggcacaattgaaaagatcaaagcctctccaagtccccaattcatctcaaacacttagtgacttgtgtcagaggagattttgtgttcttttgagctcttgcctcttggattgccttcttcctttctcatttcttttctcaagtgatttgtaatcgaagcaagagacacctaagtgtgtggtggtccttgcggggtctaagtgacccgggagattaaggaaaaggctcactcggtctaagtgaccatttgagagagggaaagggttgaaagagacccggtctttgtgaccacctcaacggggactaggttctttagaaccgaacctcggtaaaacaaatcatcgtgttcatccgctttatttcttggttgatttgttttcccctctctttcgaactcagatttaattctaacgctaaccccggcttatagtgtgtgcttaagtttataattttcagattccgcctattcacctccctctaggcgactttcaattggtatcagagcccggtgcttcattagaatctaacaactcgaagtg

SEQ ID NO: 931 - DNA, 105 bp, Zea mays
cgtaagcgtcttatgtccactcctacatccctaattccagatcatgtgctcttgctctccaagcacttaactgatttatgaatattaacatacaggctactgggc

SEQ ID NO: 932 - DNA, 539 bp, Zea mays
gaagaaagggaaatggaggagatggcgtgcgtgaaaccgtaagggtataaacggcacaacgcttcgcgggcccacctgccaggtccgccaaaagtatccctgacctattttgacaggcttaagcgaccctttttacgactggagtttgaaacggtctatttagtagggcggtaagatagagtgacccgttttgacaaatttctctttggctcaagtgttgtgcccacatgaacgcacactctacccctcgagtttctccacaatccgcaacgagcatccactcacccattgacacaacacactccggtgacggggcacggttggagatcacgacaacataagggtccgaaacgaaaatcccgcacgcccgtggaaatatccacccgcggtccgggtcaccccgcaaggccgcaacgcctccgctttcattcttcttctcttttctcgttccccccgttggggttttgagctccgacgaaccctaataatcgccggggaccggcgaccgatcgcccgccggcatgcaccattagcagcgg

SEQ ID NO: 933 - DNA, 1442 bp, Zea mays
aggagaacacatgcatgtgtgtgctgataacacgccgaccggcccggccggcgatggatccgtcgtcccagcagcgcaaattttggttcaatttgaaatttttaattcaagagtatatatatggatccaaacaacaacaagagtatattattcatagctgctgttgaaggggagaggttgagagtggccagcaggtggggaagatgagcaaataaccatgtatgccaaatgtgttctccagtgacagtgccatataatgctgctgctgctgctgcgttggctgcacacacgcacacacacacaccaagaataagtggtgggggcggcagccagcaacaggccggccggtttcttgcgagcctgggtctcctctcctcgaccggtcacttgctctcttcttctactaggaccgagctccactccgtcctctcctcgcctcctatcgagttcgtgctgcgcaagcatcggtcgcgtcggcggcataggagaagcagatggggaaaaaaagaggagcaaaagccgcggcgaatgcgacacgcgcgcacacacacgcacgcacgcgtcctcgccctcccccctccccatctccggccccgcccctgcctgcgtccggcgcgcggcgacagggacgtgatcaacagtgcggcgtacgtctggtagatagatagatagatggatgcatggaaccatgtagctcccttcctcgatctcggcggattattcgtcgtcctcctcgtccccgctgctacccccccttcttcatcgtacaacacacgctcgcaccaccggccgacggcatacggcggcgatctagcctggtagagctataggtgtacgtcatgccaagctactgatagcttcgttcacgcccggcctcctctccgccctccatcgatctctgcctctctaccctgtactcctagctactagactagtaccggtaccagcaccaccccttaaatttgctgttgcttgcttccctacacttgttgtttatttaatttctttctctctgtcgtattgtatctaatcactactatttactgcaatataatgatttaaattttagtcccggcaccaagctatatatatactctccatcctttccttcataccagccagaggccacacaaactcatccggctacagcaagcaagcaaacaaccatagctctcagatcagtcgtcgtagatgtgtgcagtgcagccaattccttgctactcctagtcctagctcgtctgtcccctccccctctctctcctcttcagatcgacgtgcatatataggtccctttgtctcatatatacatatagttcttccatatccagctccttagtccttacataaagattcctgtgaacagatagaaatatagatagataggaaataataaggtggcagctagctagcagtagtagctggagcaggagcaggagctagcc

SEQ ID NO: 934 - DNA, 893 bp, Zea mays
cggaacgaccgttgaaactgattctttaatatagtagagaaagataaagatagaaatgaagaagaaagcagaaataaaactttgtgcttggattaacaattcgaattccatatccacatgaaagcaggatggtcaataagccgatgatatgcctttgttaagtccaattgcctccaagagtaggactaaatgtttggactggttatgactggatgcacttgaagattattgtcgaggcattagaattgctggaaggcctgttgagaaagaggcagggacttttttttctaaattttatccgaatttttttttaggaaacaaaaaaaatcgagaaatcggagaataggtgaggtccggtttttttaccggtaaggtaaaccctggaaagaggcagctgaaatagatctcaaagattcgaaagagatttaccttgcttgattgtgatatcataatatccttgcatgaaaaaaatatactgtatatctttgtatattccgtcccggctttcagttccgttggtaggacttgtttggcttaatcaattccttgctttatgtaaatctggtccatatgttagaactgtttgtttgagcgagagggagagagacccacccaacatcgatgatgatcggtcatcatcaaccgcgccatcagagatttgtgctaaaaccaatgatgagcttactaataacacgcgggatctcagagatgggagtgaaagcaaattcggggccgtcaggagcaatcatatatgcatcactcacgcctacatgatgcggtgcctctgtgtttataaattccatcgcatccctctgcaggtgcagagcagctccattccattgcccctagctcaccacacactcgagtgacgagcacacccaccgacgatcgcc

SEQ ID NO: 935 - DNA, 1500 bp, Zea mays
cgcggctgcgcgcgggtagcggtgtatgcggtgaagtccgctgtccgccgaaaagacgtcctgcttgtcttcgtctctgcccgacgcagcgcataggcgcagccgagtgcggcttgtttaggcatagtttgcttctccggtcaaaacgggtcaacgtctcaattattaagggtgttagtttgagattataaatctggctaaattacatcgacgcagcgcataggcgcagcctggtgctatagccatagttttcttctcctgtcaaaacgggtcaacgtctcaattattaaggggtgtttgtttggaaattgcataattcaacaaattttgaacaaattttttgtttattttctttctagattatgtaagctggactaaccaggtagctgtgctttgctgcaggtgttatatactacctccgctcttaaactttgaaactttgatatctcatcctattcagaaaaaagtgaactgtcatttattttgttatgatttgttttatcacttaaagttgtttgagcacaacttgaaattttacatttcgaataaatatttttgaataaaaagagtggttaaagttttcaaaaaaaaataacaatgttatatatttattaagaacggaggtatcgtataaataggcatgagatatttattcaaatatatttattgtttgtttctaaaccctaatatatgtgtgttatggtggttagcctcaaaattttggagcaagaggcatatgttcgagtgctcgctctgcactattttttgcgggcgagagaccgagacagggcacttgggacgggtccaaagtgtgaggatgaagtcgtgatggattatggtgaaagagtagaagtgtaaaatatcactttagaatcataaataagctactcatttatcattctaccatttcaccataatccaatttatataaaatagaagacgattctaagtgttatttcaaaatttgttagattatataatatgagcatattataatcccaaacaaacacagcctaataatctctctatggttcacataaatagaagacgctgaactgtagatgataaatgtttgtaaagtaaagttgaaatagaaaatgagatagtagattggaaaaggatctgcttaagatagtcaaagaacatattaacaataccttaatcaacaataccttaatcatagccatatattaaaatatactttaccaaaatatacaatcaagccgatttcatctctaactcacagtcacgcggacctatagtattatatagagtgtgccgcaacaaatattgtatatataattctatctaatgtatatataattttatagatttttataaacgattcgacaaatatatgtaacaagacaatcgtccacttcaaaaaaaatatctcgctcaatatataggtaacaagacaatcgtccgctacaaaaaatatagtagatcaaatcatagtgcaaacgttgaaattggggattaaaaatcacaagtgctggt

SEQ ID NO: 936 - DNA, 1500 bp, Zea mays
ttcacacccatatttaactccactctacgaacggtgtagtctacagtgcaaaacaatgttttggacgaccatatgagagaactgatgaacacgatgtaacattgcaatacatcaccaacacgaaactcaaagcatctagcatacattgaattatgtgatgatctgtcagaaaaatgttagaaagaaaaagaaaaaagaaaaagagaaaaccagtacaaacttttattatagcatctctaagagactagtaaaatagcttatcaaactaatttttggctaattaatagtaaaataggtctccaacaaataagttgtctaactctcaaattatcctgctctctaaattgactccatcgctagccaaatttggctagccactccgtccagccaaaataactttggtgttaaagattttgttggaataagatgttatatatagaatttaatttttccggagagataaataaagagttccttagagataatgttagttgatagcccatctaaaagccctttaattcagcacaaacacgttcctccagacaaccagagccacacgtttgtttacccaaatacccctaaccttttcagttttcactgctccagttttcttatctcccccatcttcgtcgtccwcacagcgccggcgctccatcttccgctttctcccttactcgcgctcggcacgcaggcgacggcggcggcggcggcgctcaggctcgggctcgggctctcagcgacggcgtcagcggcttcccctcccgcctctcgctggtcgcctcgcgccctcgcctccggtcctccgcacaccggccggtgaccctgcgtgcgtgcctctctctctctctcccccttcccgcctccggtggatcgtcaatggctcccggccgcggcggcagcaccgcgcgccgcgcgcggcctgagggcagcgggagccagcagccgctgctccaccaaggcggtcgcgccgctttgggagcgcttatgccccaaagcgaagcgttacccgtccgcttagtgcttcagcgcgctggggcgtgctcctagtgctgccttttggaaccctggttcttgagctccttgtaatttgaggcgtaaaaaaagattgtgcaacatacatgttcacacaaataaaatgccatatacatacaataactgcattgctgaagctaaggccttgctttgcatgtacattccacttgtcatgcttgttcgtcgtgttaagcaaaagtatactgtttgttaggaaactacgaggtacgacttattggcttactttaaaagttctagcggttaaacaagtggtgatctccatgcttttgtgggattcaataacagtaatcattggaaaatgtttgcatatgttaagacatttaaatttgttttctcccaagtttcatacttagcctcgtgtttcttatcttaaacatgttctatgtgtttcagttgaatagagggctattaattgtttggaatctacttttgtagttgattccaagc

SEQ ID NO: 937 - DNA, 1500 bp, Zea mays
atattttgaaattagcgacaggaaactttctctctctcttttgagccgcgcatgaatgggcgggattattcaaacgcagagtgcaaaccaatttcaagttcgtttaaacgaccgtccaaagtccgactgatggtgagttttcagactgatctgagcacacctgtcgggttgtccatggcgcccaccacatcaggatcatatcacgtccacaagatatcctaccagacacgtggggcctctgaattgatagcaggcgccaacgcatggcgttgttagctgaaaaaaactagcatatacatgtgtagcatctctcttcgttggaggtttcatgttcatccgtgggcatgcatgcttgatgagtacactaaaaatactccacgcgctgtcgatgtgtgcatagcgctgcgcgctgctgtgatacgcttgcttctataccgtatgcgcatatgctgtgaggtattcacgtgacaccacagtaagtgcttgctcgggtgaattaaggaggattagaaatgattaaatctattttttaaaaagtttaaataggaagatattgaatcctccaatcttgtccacacttgcaaccgaacatggcctaaggtagcctagaacctttatgaggtaagcatttttggccacctctgttcgctcaagctctaatatattgttgctcaagcccaactaataatttgacttggcccgtaacaggctcgggacatgctggctggttacgacccattggccagatatatctagagtcggagttgtttctgagttgtttctgacaagtgttgacaaagaaatactccctccggtgcagtaaaagaagtcatcatgcgcgtgaccgagcgtgcacaaaaagaagtcatagcgcgtgtgagtctaggatttggacgttgttgccctctagtaattgcacaaaaaaaatgcacttaagaggaatctaacttgaaacctccagtctaaaatgccttggagctactgtagcaaccaatcaagcttgattgttttggtgacattaatgcacctatatccctatttaataggggcaaataggaaaaactctatgataattaatcactccttggtatgcacaataatgttctaaacgactacatttactgcactggagggagtatatatttagtaggtgaaaagacgtacagatattgagaaggtaataaaaaaaggccagccgaccaatagaagagtgacgtacgtggacctccacttgaacgtttatacctgcgggataataaacgccggccgaccaatagaaatctaaccgctcctattaaaaagggtgacgtggcgcttttaccgtagaaaatactctcacgtggccgggggggacggactcggactctcggagaatataatccaaccggctcctcccttgcttctcatctcacctgcaatttcgtcctagccaggcttcccttgccctagtttgcgccgccgccgccgatccatccggcctctccccgcccgccggccgcg

SEQ ID NO: 938 - DNA, 91 bp, Zea mays
ggtagatagcttttcttcccccgtctcaatgaagttaagctagcgttgtagagcctgaaactgatgttgttgctgctttgtgaagcggttc

SEQ ID NO: 939 - DNA, 564 bp, Zea mays
tgacgggtggtgccaacagggcccagcttcgtgacctcgcgcgtacactcgcgcgacggagtttcccgagcgcgctatccttgccgcctgaccaaatgcccacaatatcctaggaggtttccaacaaactacgagcctactcttccgcaaccatcctccatcgtgaaaccacggtggcagtctcgtgataaggacgcaacccatgggttatcttcagcaccgcatgatataaatagtaggcttgcccccgtcctcacgccctcctttctttttgaatcagatttctctcctgcttcctccatcctctcccgtctctcgtactcccttcgtttcctctcctccttctgccctgtgaacttacgatcctgcccctgcgtgggtcccaccatctcagttcgtactttgtgttcggtctctctttttcttttcttttttttccttcaactgctccgcagcgagaccaaaggagggagcaaaaaaaaaaaactctgtgcctctccgtatttcctttcggacggctcagctccgcgctgacgtgtctggaggcgaagcgcagccgtcgat

SEQ ID NO: 940 - DNA, 261 bp, Zea mays
cttgcatgcctgcagctggtgttgcagctgagggtttgtctcctgaagaagcaaaaattcaagcagagaatgctgctcatctctcagtagcactagcagagaatgcaatagttattctgatgcttgtggaagatcatctgagatcacaagctcaacatttttgcacatcccttacaggtgatagcatcacatcgtccacatcaatgacttcattggctgccagtcggtcaaattctttgagcacaggctggtaaagaaccc

SEQ ID NO: 941 - DNA, 766 bp, Zea mays
gatttaacgttagcagttatctattacagcttcaaatcatcttttggggtttacagtaggatatccggaacctttgcttctctctccctatcgtccagggtgtttaaggaattcagttatcctagtcccgcctcgcaagcctccttgggccttggctcgtcgccttaagtttgcttctctgatcttccttgcttgccctgctcctgctcccttgccttctccgcggcctttgcatcgcatccttccgtttctttcttcccctcccctccctatgttcgtggagaaagccagcaggatctttgcggcggcagagccaggcgtgatgcgtgctataacgcgtctcgtgccgtgaaaacctcgcgccttttctttctgcctcggctagtcggctggcttccgttctctttggcccaggacgacccaggtagcccttttcacagcctccatgcatgcctctgccttccccccctttctaccccgagcgagtccagcgaaaaaaaaagatggtcgaaaggagactccttttcagcggtctcggtgccatgtccgtgctcccgtgttcgtagatagcacaacattttcgtatcggagatggtcgctgtcacctggttttaaaattcagatgagtttggcggcgtttgttcttaactctgagaagaaacttcgtttcagcgttccagcgatcgccgccgcatgccgaccacgggtttgtgctgatgattccacctctccagagacagcgtgcgtctaggaagcagcgccgagg

SEQ ID NO: 942 - DNA, 586 bp, Zea mays
ccactccgttgtctaaagttgactgggagtcgaaaaggaaaaaaatatctcgagcactctgtgaacacaagcaaaacaattcttatctcagcggatatccaggattggttcttccagaaccctcaaccagaaatttccgacactactatataaaacggagtagtaaagaagccgaagaaaatagaggaaatggattgaaatcccagaaaaccacacggcactgagctgccccgggtcacaggctcgcagcgagtgcgtgaggcggccgttgcccccacttcggccttgtattttcccgaaaactatatatacctccgcgctccctcccctttccctttcctccgtcacacccacccacctccgccgctcacaagccctagatgtcccccctctcctgcccccgccgcgccgccgccgcccgcgccacgggccgatcccaccagatctcgcgcgaatcggaggccccgctcctccccgtggcccgattctccgcccgcgcgaccaggaacggcgctgatttgagccggttttggaggtgaggtgggggtgcgatttcggtggtcctgggccttgcggggccgggtgg

SEQ ID NO: 943 - DNA, 64 bp, Zea mays
ggaagcagtgctcgtcgactttctccgcgcgaacgccgacgtcttcacgtggagaccctcggac

SEQ ID NO: 944 - DNA, 1199 bp, Zea mays
gagggtgtcgacccccacccccttcctgtgcgctatagtgcacattggagtttggtagttaggaaaaattgatattggatgataaatagatgtagaaaatgatactttatgatttggtgggggtatagggagaatttaaagataacctctggcttctgctgcggagaagagaaaaatagaggatataatcgaattgactgcataatgcggtacatggagaaaaatttactgaaacggccacggatagactaatacccagagtcccagactttaaatgggtacttccatgctgagctggaacaatattccccttcccgctcgtggctgtggctgtggctgtggatgtggtagtgtggtccgattacaccgaggcgcgagccatcatttctctagtctgccccctgctcttcgcggctctgccgcactcgtcttctctcttcctcttctctctgtctctcctaccctccgtcaccacctcgtccctatggcaagcgagcttctcccagcctcttcctaccagactatcctcctgccgcaacggacctgacggtttccctccatctggcctccctgtcgcgcgagctgatcgacccacgcaagcgcaatgccgtccagaggctagttcgagctgctgagcgctgatcacggtgaggccacccagatccacccgactgccacccggatttcgcaccttgccttttcttctctcgttcacccagctggctcggtcgctcctccctctctagtgggcaactgccaactgggcgactcgccgacgcccctacgccaggtgctcaggtcttcgtcgggtcttttgccggcgacgaacacacaccagggtttgcgcaccctttctcttccattcctggtgagagaaaactaccacacgaccctaatttaagctatttttgttcggatctgatctaattactagcgtacgcatgcctgccagcatcgattctttgagcaaaagttagtgggtgtacaattgtacacgcatgccctttactggctccgcccctggccttagccaatcttcctgtttttccgtttattggttgttcggcttcagttttgaagcattcacatgtcgccttaataataaaaaaattccgttttttttccagggtattgtgtagagctatcatctccctcggtttcttggaagaacaattatttgacataattatcaccataag

SEQ ID NO: 945 - DNA, 705 bp, Zea mays
tcggcttccgaaggtcctcaaaaacgtgatttaacaatgcttctggagtataatacatgagcaggcaccttcggacatggactcttcagacacggactcttaggacaaggggaacgaaggatgaaacagagccgaagcctgagcgcaaggaagcttcggcatgataacaggaaaaaggaaaccgacttaaagaggaaaaggctatctagaccccgatgaattgctatagagttattagtaaatacaaagggcttggatgtaattttacatgggcagcgacccgtgcctataaataggtgaacagtactcccgtactattcatgctgacttgacatttgcttttgcgtcacgcttgtattcttgccttctttcaagccgaaggtacatttgtaatttgttatcatttctatttttccacaataataaaatagaaatgagttgataataatatttaagtgtttatactttataagaatctttcttcattatctgttatgctgatgaaggtatgtccttcataaccttcgtccgaaactcattatatcccaagggaaataatgcttcgaaggacgaaggactttaacgtttaacaatttctatgttgccttgttcttaattcatagcatttaaggacaagtccccaacattggcgcccacctccggtgaaccctttttgaccaccttcggcaagcatcgaccttcgtc

SEQ ID NO: 946 - DNA, 211 bp, Zea mays
ggtcactgctcaagctttgttccagtgcactcaggatcatgaagaataccttcaggcgtatgtccgaaggttcttacgattaagggcgcaggcgccaacagtgcctaatgaaattgttatcgaggccatgattaaggggcttcggccaggacctacagcccaataattcgctaggaaaccccctcagaccctagagaaactgcttcagaag

SEQ ID NO: 947 - DNA, 1500 bp, Zea mays
acaatttgagttcttatttgaattgattttgtatttgttctacttgctttatgttgtgttggcataaatcaccaaaaagggggagattgaaagggaaatgtgcccttgggccatttctaagtattttggtgatttagtgtccaacacaagtgcctaagtgtaaaaaggtggacaaagtacaaatcaaggataaaggtatgtttctcagacttagtacattgttttatggactaatgtattgtgtctaagtgctggaaacaggaaaaatccaattgaaaatgtcttggctcgagcagccaagactttgctcagtctgggagcaccggactgtccggtggtgcaccggacagtgtccggtgcgccaggctagctctggcgaaaaggctgctctcgggacttcgacggcggtgtacggctataattcaccggactgtctggtggtgcaccggactgttcggtgggccgttcacaggcgaactcgtcgctctcgggaatttatcggcgacgtacgactataattcaccggactgtccggtgtgcaccggactgtccggtgtgcaccggactgtccggtgagccaacggtcggcaggaccaacggtcggccgcgcgatctgcgcgggacacgtggccgagccaacggctagaaggaggcaccggactgtccggtgtgcaccggacatgtccggtgcgccaacggctctcaggctgccaacggtcgactgcaccatatttggaaaaaaaatcgggcaccggacagtgtccggtgtgcaccggactatccggtgcgccagtcgacagaaggcaagatcagccttcctagattgctctcaacggctcctagctgtcttgggctataaaagggacccctaggcgcatggacgaggacaccaagcattcctacaacattcctaagcaccaagacatcaattccgcgcctttgattctttgcgatagcaattagagctctagttgagtagtgaactcattgagttgtgttgtgagctctcattgcgacttgtgtgcgtggtgttgctgtgatttcttgtcttgagtgtgttgctaatccctcccttgctccgtgtttctttgtgaatttcaagtgtaagggcgagaggctccaagttgtggagattcctcgcaaacgggattgagaaaagcaagcaaaataccgtggtattcaagtgggtctttggaccgcttgagaggggttgattgcaaccctcgtccgttgggacgccacaacgtggagtaggcaagcgttggtcttggccgaaccacgggataaccactgtgccatctctgtgattgatctcttgttggttattgtgttttgttagagattccactctagccacttggcggttattgcactaacacttaaccaagttttgtggcctaagttttaagtgttacaggatcacctattcaccccccctctaggtgctctcaattggtatcagagccattctcttcacaaagggactaaccgcccgaagag

SEQ ID NO: 948 - DNA, 1500 bp, Zea mays
gtttgacttagagatagagatttgagtttgatttgcaaaaacaaaccaagtggtggcaaaggatgatccatatatgccaaaattgaatcaaaataaatttgagttttatttgaagtgatattgcacttgttctagttgctttatgttgtgttggcataaatcaccaaaaagggggagattgaaagggaaatgtgcccttgggccatttctaagtattttggtgattgagtgccaacacaagtgcttaaatgtgaatttatgctcatggatggacaaagtgcaaatcaagagtaaaggtatgtttctaagccttagtacattggttttgtgtactaatatacttgtctaagtgttagaaacagaaagaagaagaaaagaaaagaggtgaaaaaggcttggctgtgtacagccaagactcagctcagtctggcacaccggactgtccggtggtgcaccggacagtgtccggtgcgccaggctgactcggcgcgaagtggccgctctcgggaattcgccgacggcgtacggctaaaattcaccggactgtccggtgtgcaccggactgtccggtgagccaacggtcggtcgggccaacggtcgaccgcggaatctgcgcgcgacacgtggccgagccaacggctagaagggagcaccggactgtccggtgtgcaccggacatgtccggtgcgccaacggctctctggtggccaacggtcggcttcgctagttaaggaagggaatcgggcaccggacagtgtccggtgtgcaccggactgtccggtacacccgacgacagaaggcaagattggccttccagatttgctctcaacggctcctagctgccttggggctataaaagggacccctaggcgcatggaggagtacaccaagcattcctacaacattcctaagcaccaagtcatcgattccgcgcctttgattcattgtgttagcatatagagctctagtggagttgtgaactcattgagttgtgttgcgagctcttgttgcgacttgtgtgcgtggtgttgctgtgatttcttgtcttgagtgtgttgctgatccctcccttactctgtatttctttgtgaatctcaagtgtaagggcgagaggctccaagttgtggagattcctcgcaaacgggatattgaaaggcaaagcaaaacaccgtggtattcaagttggtctttggaccgcttgagaggggttgattgcaaccctcgtccgttgggacgccacaacgtggagtaggcaagcgttggtcttggccgaaccacgggataaaccactgcgtcatctctgtgtttgatctcttgtggtattgtgttttgttgagactcctctctagccacttggcgtttattgtgctaacacttaacaagtttttgtggctataagttaaagtttcacaggatcacctattcaccccccccccctctaggtgctctcaattggtatcagagccgttctcttcacaaagggactaaccgcccgaagag

SEQ ID NO: 949 - DNA, 136 bp, Zea mays
gggaagcttgagctgcatccaatgaaaccaagtgcatagactaagccgctagctgcatgttaaaactgagcagcttcctctttcgcgaagtccaataggatgtagacccagttctgaaatcctgagtaaatataag

SEQ ID NO: 950 - DNA, 185 bp, Zea mays
tgcctcctaaaaaaaccgccttctctctctctctccctctcttcccccaccgccccacctcgctacgcacctccatctcccctatccccaccaacgccacgacgcagcaatcccatcaggccaccaccaccatgcccccgcctctcccgccagatccgatcgagccgtgcgcgccggcgccggcg

SEQ ID NO: 951 - DNA, 737 bp, Zea mays
tgcagtaatttccacaggcccaatcatttctccagccaacagcttgacatgtgagttctctccactccacgcagcggagaccagagcttctctacggcgagggagcgccgaggggcaaatccgtcagcgcgggcacatcgcgtcgcctttccggcccccacacctctctctctctctctctctctttctctctctcttcccggtcgacgagcggagagctagcggcggggcgcgcgctgctatttatcgagcacacgggagccacgccgcccgtccctgtctccatctcgtccccgtgccgtcgctcccacgccgccgttccctccgcctgcctcgaccgcggaccgcctcgtgccgtgcgcgctaaggagggagggagggaaagggaagcaggagggtggaccactgcgcgcgtgcggcgccttcctcctcgaatcaccgccgacagcttctgcagctagcgttatcacccccaccaccccggggctcggattaggtacgctgttcatgccgtctccacggccaaggaccggggaggagcttctttctctagctgggggatgagcaacaccaccaagtgatgttccatcatgtttgcttaaaaagacacgcactgcctctgcctgtgcctgcctgttcatggtcctcatcctcacagagctggttaccgaaaaattggtatactttttcttggcgcaggatctgagctgaagctgccaggccaggcgatcgagccg

SEQ ID NO: 952 - DNA, 182 bp, Zea mays
tgcatgcctgcaggacaccctcttcttcccatggtcagcggtcgcccggacggtaccgggctgggcctggccattacccagaacatcatcagccagcaccagggcctgatcgagtgtgaaagccatgcaggccacaccgcattctcgatctacctgcccctggaacaaggagccaccgcctc

SEQ ID NO: 953 - DNA, 1073 bp, Zea mays
gtaaccgtgcttccactcaacgacgccgcatccggtcgcagcctcacgcggtcagttctgctccgttctaaagcggaattcaatgttggttgttggtgttggcaaagatttcaccgcgcgcgtgacacatgcacacaagactggtccttccgtgttccgtccttattgtaacaatggccacaatttatataacacacctaagctgagataagtgtggctcgtagagtcacactttaccatgtctaagagagctttatgggttttttttactctgacatgtgatatctaaaaccctaagggccagtttgagaaccctatttttccaagagcttcgtatttttctaagaaaaaataaactaattttgttgagaaaataaaaattcttgaaaaaataggcttccagattagccctggccaaaagagtttttactatggtttagttaccaacaaaaaaaatgccaacttggccaaacttgactaaattgaagtgtaaacaggcaacacctatgacctatcgttgttgatcgggtttcgtgatcctcacttctccgggcaagatcacgctttgaaatacagtgcaactccacgcgctgctgcgtgaatatcttagcacatgtacacgcctatcacccttctcttctccgcgctccgctcctccagttcggtcaccgcatcgtcatcgtgccgagtcacctccccctcgatcccaaggagaattcagcgcggttgttgacgacgatttcgttgttcctgacacacgcggacaagaatagtccgcgcgcgcgccactcgtgtttcgtcacctgccatggtgccaagcgtccgtcgtctgacgccaactgccctagctagcgcgtcaagctccgaccttctctgaagctagtccgagggaaggtctgcaatttctgtcgccttccgtactaccatcacttgccggcccagtctcaaagcaggagtatttcatttgtaccttgctggatcggagtgtgccaacagccaagacaaaagcacatggctgcacctgcactgcacctctttgttttttgtaccttactggacgaatgacctgaacc

SEQ ID NO: 954 - DNA, 894 bp, Zea mays
aatcccacttaatccacatggattgggagctaaccgaacaagccctaagtaaaaatctcttccaatccgtatcaatcctctccaatccatatggattgaaaataaccgaacaagccctaaactggttatcggtgctgatcggtttttggccgccgtagaaccctgcttcagactcgattacagagtgtatttccgcaggtgcgcgcgtaaacggatagatctactacagtattagtagctgatggtcgaacagacaaccccctgagaagtggatcttgctggccaggtggtgcaagggccgacagcgaccactaaccaggcagtgttcctgcgagatgcatgcatggccatccatcacctctcccggtctccgtcgatcgcctgtcaaaatgaccacggggacgcctgctgctaccgaggaccgatgagcgtctgactagtggggcaggagccgaataaaacacagggtccagcactggcaggccggtccggacgcatcaacaagtgggaggaggccccagctgtcagttagctgctcccatgaataaatatttctggtggcactggatggacacagcctaaaatttcaccgaacgatagcagtgcccgctcccagctcccttggacccgggcctagctttgactggccgcgtgctctctcgccattgtctgcatgagcacatcgaattccttccatctctgatctctcccactcccacgtcccacccataaatacttggccaccatctttcctggccttccatttcccaaaaaaaacgcaagcatagatcagtggataccactccatcatcctgcttggccccggccggctggtagatcgtcgttccggagtcgtcgactggaataacgaactggcgcagcaggaggccaata

SEQ ID NO: 955 - DNA, 1053 bp, Zea mays
accctaacctaaggctatttggctatttgatgcctcctaacttcgaacttcttggttcttgcaaaacttatcggctgttcatcgatgtcccttggctgggtccagccctggtgcacacgatgcctggcttcctgttctgatagttagtataaagaagattttagaaatatcagacacaatattccacatgggcacatatgcctgtgtgatgggatttggtttgacagttttactatgtatcagtatcaccgctgatggttgatacatatgtttttgcatgtttcatgtaaaattcgtgtttctgcaatcacgccgaagttcttttaagtttctctgttattttgagttgttagtctctacttctttacaagtcgcaggacatttgagtagaggtccaatttaggcgcagtcacatggtgagaatgtgttggaattactgtaccttaaatttgttctgtttgaaatgccatttttccagtagcaaccataaatatccaagttgtccattgctatggggtttctaggaatataaaaaatggaccttcccaatctctgtggtgaaaataattatgcgtctctggtatatgcatgccaaatacatctgatttcctctgaagcagttcccgaaccaaaacaagaggttcgaagttggcagtaacagtgcccactgagtttctgatcaaaaccaggcatttctgtaacttgtaagtgtttgaactgtttggtaatttgatggaaaaatatatattgccgtgaatgaggtagtatcaatgttcagcttgtgttttccatacttatagaataatgatcaggataacaaagtaaattgagtttgttttactaaatttattattaagctatatttttttattcttgactatgtgataggtcagagtaattaaaaatatatataacttaccctgtgctagcaaacatactgttgtattatgatccagggtccttcagtttatagttgtaatatggacaaagtgaatttcttttaatagacttcatggcatctaacttgctattagatcttacagtcctttcagg

SEQ ID NO: 956 - DNA, 164 bp, Zea mays
taacaaacaagcaatatacaacagcgcggtcccaagaacgagaggccgtaaaaccatgcatgctcggagcaatccgtgatgccaactgcatgttaggcatgtagcttaattttattcgatctgttctcttccagatcgagctgaggtaaggtaccgacgcagcc

SEQ ID NO: 957 - DNA, 1500 bp, Zea mays
aagatcctctccaaagtttccctctcaacaccccttccactcttcagggtgtactccccctcacgagggcgagctacgctcatcacgatgtataaggggaactctaatctccttcctttagttaataagtgcttttagctacaaaataaatactttttaaaattaattacttaataacaatgtgtattataataatataaatattgtagtatttttttaaaattctaaaaaactaatgtataaaagttaaatagctcatgtataatatataggggagctgaatctcatggaggaggtatttaaatataaatagaaagtatgaatagagaatggttttggagggagaatggttggatttagcctaaggctctctccaacaataaaccctaaaagggttatgtaccctatatttagtggagatatttgccatgtatccctctatcatcgtctttcaaatggtactcggacgttggtggattatctatatatagagtttctctyttctctcctccatccattataatactttaaacaacagatttagcaaaacaaaatttgtacaatacatttgagagtatgacaaatacatacgtacaaaaaagaaaagtaaaatatgtctctgctggagaggaagaagatatagaggagtaaatcttttggaggggaccgtaaaagacagatattgaggatgaactagtcagttgtccgtgtattactacagtttttatatatcatatgagtaggttttgttttaataagacacaaaaatatatgtgttttattggttacatggttgtgagtagactttgttttaataatataaaaatatatgtgttctattggttagaaggttgtgaatgtggagtcaacgatcaatgttctgacctcatttatgcataattttactttatttttgctcaagagagaaaggtaacctaagagggagccaacctgctcgctaatcgctagtgtatgagacttggtccgtggaaattggattaaggatgagagcaacatagttgaggttgaatctaaaggatctactgcgggataaatattcttgtaagttaaacctcaaatgtgtaaatgttgtggcagaagccggatcaaatcgtcaacaggtacataaactaaggctagagactgaacccatcctttgctatcagtgggattgatcctgtaaatgttgtggcagaagaaattgatctgtaaaaaaaaatgatgtagcagttggatagttccaatcgcgtcgttgggggccacggcggtcggcgtccaccacgtcatgcacgcgggcggtgaagtccagcaccgttggaccccgccttatcaattcccaagtcagacgctgatactggctgccgcatgtctagattggtttggtgatgctgatgccggtgccgcatgtctatattgggtaggtgacgctgaggcctcgttccccaatcagacttgttcggcctcttcgacggcgtgcccgtctccccgagctcattcgcc

SEQ ID NO: 958 - DNA, 743 bp, Zea mays
aaactaccaaggggtgcatctataactgttcgttattttgtttgtatcttaggttatacaatacagtagtgtaaaaaacgaattggtgctcgttaactagtacatgatgcatctagtcagcttaattcctgttttggatgttgtgtggttgatttgatcataactccttgtttggaatgtggacctcatcattacttccctgacatcttgtctagaattgagatgccttcatttaagctttggaccacttaattgaaagttatctggactgtaggaataaataggtgctgggaggaataatgaggtagattacaatggtcccgtaacaatgataaaaggccattgagacctgaatatagagatgatcacatggtggggcttgtgactgaattctttgacacagtacaacatttcataagtcttgggaaaagctatatcatatagtctagatttcttagctcagtacaaattgctcctagattcttatggaagaatggcatcagttgtgttgtgtcctctactctctattgtgtcatgggtgtgcacccctctgactctgactaaataataatattgttgtatggtgtgcacccctctgacttcaggagaaacttatcctatattttatagatgtttgggtctgtgatatggtttcctttgtctacactgaatgttctaattatctatattgttcctttgtacagctcttggtgtagcttgccactctcaccaatcaagttttc

SEQ ID NO: 959 - DNA, 702 bp, Zea mays
ggttactttaaatataaaaaggaagaaaatgtactctgttcctgatccaagaggcccaagatgccgtctagacaagagccgggagagctcatcatcggaaatcgcaaggcccaaaccctgctccccacagaggtccaggtccaggtccagtttgccgtcctttcggtgcacctctggtcgctcgctctatcggtgatggtctgcacaccaaccacacgccttgaggcatgaatcaatcggatcggaatgccactcgtcatgctggtgctggagaggagctatgtctcccggtcaaacacggggtggccgctaaactatgctactgttcatacgggccaaagccagggttggtggcgtgcacctggtaatggtaaaagagaagaaggacacacggttcttgatgcatacaaatcaaaataaagaatatcagctattgacgatcacccatgactgcatctctgctgcatgtgtgagctcaagaaccgggccaggagcgacgcgagggagggagggagcaccgtgatcctcactcagcctccccttctgaccagcggccagtagtgcatctcatcaggtactataagcttttttctgaactttttccccctccattcagaagggagggatggtttcagtttgtgatcatggtggttctgtgtcctccaaccaaaccaagatcagggaaccagaagataatataag

SEQ ID NO: 960 - DNA, 236 bp, Zea mays
cgtgtgcaagtctttcttgcccaaatcagcctcgctgtcgggagtacccgcactttcgcccatttcatttcaaaccaaaaccctctctccccttgccttccaccacaccccggatcaaatcgccacagaaaattcccagaaaaataacaagcacttgttcatcatcaaagtaaacgccgcagaaccctagcgaggcgttcctccaacgactcacctcccacccactcacccacccc

SEQ ID NO: 961 - DNA, 294 bp, Zea mays
gcttcacccacacaaggccacaagatcctccctacgccacacgctcctcctacatagtaattgctaaccgcgctgcgttgattcactcgtcggtggctcagagacctgcaccaaaacagccgaggcaaagcttgccccgagtcctcgtgttttttccccctttctcccccttagtcttagcactaggcgttttgatcccgcctctggggtcgctgtcaatggcgcgatcacggagtaccgcctagagcctcagacaagggcggctcgactctcgactacaacaagttcggcgca

SEQ ID NO: 962 - DNA, 808 bp, Zea mays
cgttgctaccacttactttcatcctgaactcatgatacatgttgcatagacaaatagcagcaattttgtctatagcaggtagcagcaatttgtgtttttttgtcttgtgttctgtcaaggtgctctatccatgagatttatcagttcctgtactggacatcaaaattagtccagccaactgcaaggaagtagatattttaaagatcaaagtagtctcaagcctgttttcacctgatcagatcttgcactactccgtttgtggcaggatcctctgctgtaacgtccgtgaacgttgtggccgacgactggctgacatgtgggaccagccccatactgcagtagctggacgatacggcagaggagccgttcctctttgtttacatgcacattttctttcggttggtttgtatatagatgtcatgccagtgtgctgcaattggactaagggggtgtttggtttctagggactaatgtttagtccctacattttattccattttagttccaaaattgccaaatatagaaactaaaactttattttattttctatatttagcaatttatatactaaaaaggaataaaatgaagggactaaacattagtccctagaaaccaaacaccccctcaattcacacatgcatgcatgcatggtggattggtggcctagttagcactagcagcctccatgcatctctgaaaaccattgtccattttgcaccaccgatcgatcgagctctaggctctagctagcgcgctgcatatgtgaggcaacttttcatttatctgacacacgtacttacggcccacg

SEQ ID NO: 963 - DNA, 757 bp, Zea mays
taagattccaattccttaaaataaaaagaaacaaacgagacctaatagtgaaaactgtatctatataatcttctgatcccaaatggacaacatatatcatatatagttattattttctacttccttgactatagttcccaaggtcttgcttatagttgatagttgatggaactagcttgtttagaatggtcatcaccagctttcctttcgtggttgcgacgattttctgggctatcattagyacagaggcatcatttaattagggttaattagcaccagccaataaacaaagccctcattgaggggtgattagcagcagccaataaagaaagcacagagatgaggtagggtaagcaggaaatgggtgtacatgtcgtgcgcgtccggcctagcttctcttccctttccttgctaaataaagcaagtagcagataggggaaagtctgctcgcaagttgcatccaccctgcgccaagaaaagccatcgttcttcccacaagaagcatcgtccatatttccccctcctcctctcccccccccccttgggagaccagcttttgagctaattcttcttcgacagctcccgccagatctcctcctgccgtcgtcctcaattagctttaatttctcctgtcctgtcctggatcgagtcgttggagttagagggccacaatcatatctccataggtttcgtgccagcgaacgtgcgagagcagcagcaggttgactgaagagagatcgaggccggggacgcggag

SEQ ID NO: 964 - DNA, 177 bp, Zea mays
ggtaaagttaaactaacattttcagttctaagacaagaaattgaattattgcatgttccttatgtgcgtggaggaagcctttgcaattagttgtgatgctatctatcaattttgtaggttgatgggtactttcacaatgaggaagaaacacaatataaaaagattatctgggaggaa

SEQ ID NO: 965 - DNA, 164 bp, Zea mays
ggtacgcaattacttgtgttgaattaggtttcaggttgcttcaaatatatttgttatcatggttagtaaacaatgctaactgctcatgttcatattctagaatggcaagcaaatggtgcacggcggagcattgacagctctagcgtcagtagcagattcatcac

SEQ ID NO: 966 - DNA, 1500 bp, Zea mays
tataaatcgtatggtgatcctttatatgctcgtccttattgtgctcctcccacatatggtggtcatactccttttcgtccttccttaggcatggtagtgccaccaagaaacaacaatgatgcatcgtccaattagtttgcgtactttgatgtattgcaattctaacgctgaagggattagactaagagaaaggatgaaagacttgtaagtatacataaatatttacgagtttcacactttttaagtcaagaatagtttgtgagttcaccaatttatgggtagagctcatcgtatgtggcctagcacaacttcaccattgaaccttctcgccatcataccagcaaacaacttaaggatcagtggtccatgagcagccgaaatttcaccctcttcaatggcatctacaaccgcttatccacgacccggtcaagcgaataagatgatgctatgctgcttaaagtagcaaaggagagcttctgcatcaagctagttgaaacagacttctagatggagcacacgtggtgtgctctttgtcatcggccaattggtgtgtacgacatggtgactccaactccaggaacgcgagcaaacgaccccaccttaacatagagggcgattatagctccacatcactgaatagtgtctaaccatcacacccattggtcgtgatagggcaagagcgcaacacaagggtaagaggctagcaataagtagtagcgatgtcaaatcgaagaacatagtaaagaagttctataagggcagtgagaagataaaatcaatcaaaatagtttgatcacttcaccaaattgctggattagtatatcaccgaaatggaccatgatatgagaagggcacacgagttggccataaaaatattgatcaaataattaagattaagggctagtttggcaataccattttcccaagagattctcattttcctaagggaaaatgaactaatttcctttaggaaaataaaaatctcttgaaaaaatggggttgccaaactagccctaaatctttttattgccctctgcaacagttatttcaactactggaatagcacaacgaaggtaggtaggtaggtagacagcttgttttactggtctgcgcccatatataccgggagcctaaatttagtttcctaggcctgtgctgaaccatacattcctctcgagagacgggcgcgaaccgccaaaacaaacaaaaagcccccactgccatctccgaaaaatgctcttgtgcgcctgtgtcttcaacggcagctagcccctgggtcaagtatcccttggctggcgccttattccccccaaacaaggatcctcttggaggaggagattacagaggcatgcacacctctgttcttctccctcctctcgtcttcctcctaaactcgactcattcgctcgacaccgcatggcctaaccagttaaacccccttcctcctgcaccggtgaattgaacgaaccaaaccgtcctgactggtccagcgaggcgaac

SEQ ID NO: 967 - DNA, 659 bp, Zea mays
acacttcgaacatcttcgtgcaatgacgcccaacttttctaacatgccattttaaaataaaacaaactaaccttcttaaaatggcatgaaaacacttgcatcattacgaaagataaattaaagtaaccttaagttacacctaaatgatcctactataccactgtgaagatcacctgaaatagaccttgatatgggtacctaaattatacatctgcatagaaattacccacacctgtgaatgcgatacgacattacgacacatatatgtcgaggaatgcttaattgtacagcatacttacgtttgactttaaagtatatttgtaaagatcctttaaaatttataagagaactgacgcacacgtgtacacgtgtttgtacgacgtatgcgagcgttttgtggaaaaaaaaacaaatttggggggaaatcaaccggtctctgatttgaaaagaaaaacaaaatccctggatggaaaagatgaaaatatacagaactctggtggggtaattaatcttggccgacggataggattcaattagatgacaccgaaaaaacagggccacataccagggaggagagattttgcaacagaagaaacacgcggagaccgacacaacccagccaggcacgacgacgccagaatcacgccccctgcatcatc

SEQ ID NO: 968 - DNA, 1500 bp, Zea mays
atatgtgtgtgtgtaaaatagataaatttcaaattttgtagaggcaattattgccaataagttgactcaaaaggcaaacttggagatcaaggaaaatgacacattgattccaaaggcacacactgttgtattccttgctcctttcgtgaggacatcgatcagcaagcgaaacgagaaacttgtgagctagagttccagataatcactgtcaagtcattcttgattggcatctgactcatcacttgtatgatttgtatattgtgtgactttattcgtttcaatgtagctttttcatcatgaagtttacatccaacaacatcttaccaaactgacagtacgcgctagaaacattggttgcgtccagagatgtgttttccgccatggtgctatatgcctgctaatcctggttgctcagacgtctcttcgctgcttaaatagtcgtatacgttattagaaatgcatattaagagttggtgcagctttatttcaagcactaggggccaagaggacacgagtgcatcacgtcagcatatagaaattgttcattgtctggtttggctcaatggtaggggagaaaaaaatgaatatttaatgtagaatagggttagaaaccacttttagggctagtttgacactcatttttttcaagagatttttatttttctaagagaaaaataaactaatttttcttagaaaaataaaaatttcttagaaaaatagggtttccaggactaatttggaaactctattttgggatttctatttttctaactgggtgtttggattccttcattttagaggaattgaattcactcaataaaataacttatttagtttagaatttgatattccaccactttctaaagttcagatataagcttatctcaaattcatgaagagaagggtgggaaatgattttatgcattaatagaatttgtttctattttgtaacttacatgacactcttcgtctcactcctctatagtaaaaatataacacataaatatctccgacatcttgctaataatattatataaatatattttacataaaacctaattagcttaattgatatatgtctaaattactattattataatagaattcaattctaatgatccaaacgggaccttagactaattacgcattcattaagtaacatataaatgtagtttgcatattgaatgatgtgcacataaaaaagtgagctagaactatattttgggatgagtataatataggaggatataaaattaatctatttttaaaaaacgaaattatgtttatttctaggaacaccgtacaaaaaaaaacaatgcatccgacggctgtggtgtgtccacaaaacctacccgaacccatggacgcctactacgtcgtcttcgtctctccaacccggggacattttccaccctccaaatcgaaaccagattgaaatcctaggggctagggttaccctccatcccatcgtccgatccgatccgatcccgccgctcatcc

SEQ ID NO: 969 - DNA, 1145 bp, Zea mays
gccttcagtttgtagatgtggggcgggcggacgcgggaatcacgactggcatcgcgcggcgcgacggggaggggggagaacgtcggcaatcctgggggaagcaggccaaatcggtgggtgcgagaacgccgacaatctcgggcttgcgagttgcggggagagggggcgtcgggcggagccatggtgtcgtccgtggccgcaccaattaataacagacgaccttccatgcgccattgaaggaaggcctcgggcgggatgcggcattgattggtggccgcgggcattgattggtgggtgattggtgcgccattgaaggaaggccgcaggcggggtgattggtgtgccattgaaggaaggtcgtgggtgggtgattggtgcgccattgaaggaaggtcgcggggggtgcaccattgaaggaaggccgcgtggggtgcaccattgaaggaaggccgcgggcgggtgcgccatcgttgcggcagaacatgcaccactgtggacgcctacagtagacccttaagtagtagtagagatttgtcatcttagatgaagttttaaccagccggtaattactgaacgatcttcgatagttaccatgaaatcgtatactgatacatcagcttagtacccagattaaattcaaatacggacttatgtattgatacaaagacaaatatgaaaaccagacatgtgacgtagtgtgggcctgatttatatatgcaggtgtttgtttccaaattttagggatctgagtctgatgctcgtgtggctctatgagtgacgtaaccatgttcttggttttctagaataaggtggacctgtatttcaacaatttgaagagctagataatatgaatcctctagtgagtttagaggcagttgttgtgtaaggacgtcgtgtgagacgctgttcttacagactacagcgccggacgagggcgggtctagtcaaccaacggatcggacggagcgcgagcggtgccatgttcccatcaggcatcggcggagttgatgggggcttaataatccgaagtcgatgcaccaaaccgaaaataatatgtactccaatccactctaaacttggagtactattattacattatcagtggccgatcatcgcattagcttgtcgtatgaaagtgtccaagc

SEQ ID NO: 970 - DNA, 556 bp, Zea mays
tgtgggcgcgcagcaagcggctagcagctttcccacagctcgctttacccctcccaacaagcgccaccaatcgctggagactggagagagagaagaaccagccacacaactctaattaccacgcactctctctctctctccgtcctatcgatcccggcctccctcccccagccccagcggatcggagcccccggctggcttcctaccctgccccctcttcctccgacgcgcgggcggaggagttcgatccgagcgcgagagggaaggagagagaaactaaagaaagagaggggcagagagcagacagataggagtggtagatatagataggctggggctggcctcatcgcggatagatccccctcctcctcctcctcactctccccagcgagcaagcaaccaagcagccagctagtcagtctccgccaagcagggaccgcgtcgcatcaaagccgctgcccgcaacagggacaaggcaggccagcgcgcgctcgaaaggggaggcgtcgttctacacgaagacgaggaggaggagccctgcagggcgtagctagct

SEQ ID NO: 971 - DNA, 552 bp, Zea mays
gatatacaattatacaaaaagggatgggagggagccgtcacagtttttatagtgtttgattgagagtcacgtagggacgatataaacatcaaagtaatttttggtagcgacgtgatctaaaaaattcaagacggtgtcgtcctcgtctcatactattttgaccttaaactaaatacatcctaaatcaccgggaaccaaaagaggcctaaattgcttctacatggatacggaggaggcgaggagctactacatttgcacagtagacctcagattcattaataaagctgctccataataaactatagatctagttctagtttttaacggataaactgttccaaacctaccctaattttggctggagatttttttttgaggacaataaaggcgctttccacactcaccgaatccgccttcatcgcaactcgcgacgacccagccatacattcatccatcacttgcggactcgcctcgtgcgcttccatttccactccgacccggccggcgacccgccccccggtccccggagcgaccgaggcctcgctcaccgac

SEQ ID NO: 972 - DNA, 72 bp, Zea mays
tctggctgagcgagccagatgggacgccggtcttgtttcctacggcccgagtcagctcggggtagggtgatg

SEQ ID NO: 973 - DNA, 1500 bp, Zea mays
tcggagcaacttggctcggctcggagtggctcgcgagtcccgagcaagtcgagcttgttttttgggctcggagtggctcgcgagtcccgagcaagccgagccgactcaatctagctcgcgagctgcgccaactatgctgaattaatcaatctgaagaatcataatggattatccattcatttcttagtctttaatgatggatatatgacaattcaaattttagattgctcctaatattggataatggttctatatttcatgtttaaatactattaatttaataaatcatccaatctatagaatcataatgggtttatttcttagtctttgatgacgaataggtgaatattgcacctggtctgccactaccttgttaatatagtgtacctagggttaaccgttggaaggtccgatgcttgtgcagttagggtccaacgctctgtttttcttttttctctcaaatatgtcaactccaaaagtgttccaaacacttgtgcatgtgaattttatattcacaaacattgtaaatgtttttttacattctcactatgtacaatacatatgcatagagtaaatccacccaatggcaaaagttttcctctttatagtatgattatctattctaaactgaatctacactctattgttttttactggcaaataaaaaatgcccctagctagattctaaaccgaatctacactcagataacatatgtttgtgaatttgcaaacccatacatgttgaccgtttgtcaacctttttttttctatgttataccccgaagagaagaaaagacaagaatgtttccttccatcgttcttacaacaaatgaaaggcacttttctggtccatctgtttgtttggagccagcaaagagtttcatcatttgccaactttctcttatttgcgccctccgaaaagaatcctcagcctttatcagttcaccagtcaattgacttatgcagagacaaggttcaggcacggacagtaagttcaggcctccagggcagagcgccaccaaacccgcaccaaatcgaaaagggagcgagatctagaccaatttaatactcctgtatgtgatcggtggattaaagcgatgacgatccgtgcatgaagtcatcgatccagttcgtacagctagctaagctggcaaattagctgctgcatgatgcagagcgcagctatagaatgatagatagctcacgccaagcgtgagggaccgacataaattcgccgaaaaggtgcaaactttttcttcatctgtcgcctgcctgcccttttctctcttcaacgcatcttctttctattctacaaccaccgtacctgcttggggctagcttcttgattttgcttgagatgcagtatatacgtgcaagacagatatcagcagattatatatatagcagcgtagaagtcctgtggttgcccgattatctgattctgtgatcgagatcgaggccgatcggccaggtttcttgtgcgtgcgctctgctactgcc

SEQ ID NO: 974 - DNA, 326 bp, Zea mays
gtttaaccattcgtggggtttttaacggttttgtctttgtattccatcttttctctaacgtggatcgaattgcagatggagacagttaaaagcccaccaccaccatcagatccaggcccagcccaacagccctttacacctcacagcaaaaccctaggaaagcctcatcaatggctctcgctctcccatccgtcatccaacggcggacgcatgagacacctgccttataagatcacgccattcccatctcctagggttttctccacctccatcacccgcctccactcccccctcccaggtgctgcccaggtaagtcggcggcggcg

SEQ ID NO: 975 - DNA, 1203 bp, Zea mays
gatcttttttttcctaaaatgagccagcatgtatgcccatataatttggatgtggttaatagaggtcatcgcgttggttgtttacgtatatccagaactgttcgtataaaaaaacacttcattttttctcatgatattctcgtacacatagcacatccaacagtaacgcgcgcccacaggataatccgttgtcctaggcctttttattctagtagaaaagagagtaccgctgctttattgaaagcaaaagcaaataagcattcacattgaaagcaaaataatcgttcgcagacaaaacaaaaagggtgaggacacgggctcctaaacaccgtagttttcacataaaggtgacgcaggtgcaacagagattccgccgattccaccaatgcctaaaaccacgaaagccaggcgagtgtacgctcgtgtccacccatgcctcatctttcaacttgagcagtggccaccatctctgcacaaaagataacccccccaggaacaacgaacaataattgagagattcgacgaccgaatgagtatcctgtgacggcctcggcaactcgctagctccatctcgccatctatctgttcatgaaacaaagcactatcttcttctagagctggtcacccaatctccctcgcttccacagtcacagaggccaggactcctttttttttctggtggaatgtaggggcaacgcggaaaacacgctgcaaaccttgcgtgcaaagtaggcttttaccaccaaaacctagcaacaatccatgttcttgcgagaatggcaggcaccagcactccagcagagtccactacatgtattgcatcagtcagttccggcgcaaaaagtgcaacggcgatcaaaagcgagtgtatacgtacggtcactgaattcatttcagaatcaggtttttgctatcacccgaaaatgacacatcacctccttgagcagttcagtcggactggactgtagggatacacatcctgtgcatcgatcgagatttctgcggagggcggacgtccaagtcgcttgctttgcttcacccggtggagaaaccagagcacagcgcatgacttttataaatatatatatcgttcgatctatctatctatctatatatactcctgttgcgtagaatcggcacaagggtgcacgttcaggaggagctctcgtggcgtcctagtctgtggaaggtccaaagaagaag

SEQ ID NO: 976 - DNA, 738 bp, Zea mays
ctaatatgcaataaggctaatattgcagtccaactttttctcatcattccgtttatattctgtgaaaaaaaaaacatatgacacttcgtaaacatcttactgtgacactgtgaggaggctgacatacatatgatatatactatatatgagcccgtacagtcaaactatctcaacgatatgataaaccttagtccatctgtcccaacaaaaaataaacacaagtgtatcatcgaatctatttccatatcaaatttattcggagatataaactattattcctactttttacaaatccaatcaaacctgcttagaaagcccgagcaatatatttcccaaagccacgcttaaataaggacagagaaagtatgtgtttgtaattataatcttcgttgttttctatacaattttagtaaattcaatagtttggtctaaaaaactaaaatttgtactgttattttttaaataaactaagctctactacgatggtagtgtaaaaactaaaacggcaagaggtgtgggcactatccctcacaaagagaaagaagagaggcggcttgtctgtccaccgcgtttcttcctcccgggtctataataaaatccccatccatcgccagcgacactcgaccaactccacaaacaatcagccagccctcgcatcctgacctgctgacggccgacgcccacaaagcattgaagagaagaagagaagggacgccgccgcgcgagttcacgtggacg

SEQ ID NO: 977 - DNA, 243 bp, Zea mays
agggcaggttccacatttcctttttttttaagaagttgaagttacagaattttagtgtccagatttcagaaccatgcatactgacagtaagttgtagaattctagttcaggaaatttacatctcaattcacttctattgtgtttgcaggaaaaatattggcattagcacgactccaaccaggttgtctgccatagttttgctggagggacaaaaacagaagcgttcctgactctacctcaagg

SEQ ID NO: 978 - DNA, 146 bp, Zea mays
tgtttgtttagtctaaaactaattatattttaggagggaggaagtatataataagatataaatgatgttttttagaaaaagatagaatcttttagataattttaaagttacggggggagggatgcaacctcagggatgcgaactga

SEQ ID NO: 979 - DNA, 1500 bp, Zea mays
agtggatacgaaaatcagaaaacttctgattttatgtaaagatttggagccccgcgctgtccgaaaagagtaatgcgccagcacattaattgagtcggcatgtgatccttgacgttaaagcgaatgatcggcagctggtgagaatcgtaaaattatacgggatcaaatacagtcttgaataccgaagccgaaactcgacaactaaagtttttagtgcaaaatccgtgtctaaacaacgcacagcctctcaaacacgtaaacgatgcgtgtcatcgcttctggaatggatcgcaatctcgatgtcgcatcaatatcacacatttatttcacgatatatcgagtcgtgtgcctgtttaaaatttatagattaagaaaatacgaattcggaagctcgacccactctgatgatttttatcctgaacaaaaattaattggaattcacaaaaatagttttcagtccaaatcaaatcagaccgtgtcacaagtaccgtcgacccttttgttatcgctaaaaatctcgatccaaaaatatctatgattttccttaaaaagagaagaaatgaaaaaggaaagcaaatatggaaaaatatcctatgcaatcacttatcctggtgcaagcatgcaatcaaacgatctggtgcatccgatctagatctaatgatgactgttattttatatttaacctcttccacctaaaatatagtacctattttacttttaactccttccatatgaaatcgttggatctggattggatgctctggatagtttgattgcacgcttgcaccaaaatgagtgattgcacagagtacagccaaatagaagatgatatagggaattgaatagagtagatggtatagaccgccccaaggtacccttttcttgcactgttccattctggaccccgtccccaccacaaaagcagccgaaagcccaaaacgaaccaaactgggacccagttggtgattcggcgtggaacgttactgggaccaatcccagccgttcgttggagatccgacagcaaccaagaagcttctctcttcctcgccagtgcccaccccgccagccggcacgaagcgcggcgttaatatctcccctcccttccctcttctggtctccgccccgctccttgcctccgatcctcaattcctccttcggatctcgcattcagcgcagcgcaggtgagcccgcctccgatccactcctctccctggatccagatctgagtcccctcgcgctctcagatccctctcccccgatctcctctccggccgccgtgcgcggtagatctccgttcggcagcgtgtgatctgcccgatccgtgcggttgggtctggatcgggtcggttcagatccgcggcgccgtcgcctggacgcgccggggagattcgcgatccgttgtatacttgtatgctaggcttgggggagatctgagcgcggaatgaatgaatgaccggttgacgattctgcaggtgtgaaggaagggggacgcggaggaag

SEQ ID NO: 980 - DNA, 1500 bp, Zea mays
caatacaattgattagtggctgtcatgagttatgtaactagtggcgtggtaagtaattttcatgcaactttacgagatgatataaaaacagttgttgtgaaacaatctttgaggagcttcaaaaaatctttaagctagagatataagtatttagaaaacatttagataaattattttatttattatttagattaaacatatttttaaaattaattaaattaatattataaactacagtaaagctaaatctggtttgaatgaaagaataaagctctcccaaacaaatccgagaggagcaaactgaactgaaaaatatataaaatacaggcacggccgcctcgcatcgcggcccttaacggaacaatacttatctttttccctgcccccgcggccgccgccccgaacgcgcacgcctcctccgccgaagccaagcaaaccaccgacctcgacggagtcttctagccgtcaccctcgttgtcgccctgctcctcctctcagccggtccggccggcggcgtggcgtgaagatcaatccggacccggaacgagttccctcttttgctggtaataaggaaaccctagcttgcttttgcatgggttgttgtaggatctagtcccgttttacgtgctcttctatcgaaccgtgaggagcctcctggtggatttcactcgcccggtttgctccttattttgttttccgtatcgattcgattggtaggcgatggtagcggtttattcctagagattttgcgcgcgttgaatccgctacgacctcgggccgtttctgatggaattggtttgctacggacttgttttttgttgtgctagatagaatcgtaagaggtgtttaattgggttagggctatgcgaatggcaaacatctgcagcagcatccctaccatagtaaacggtgaagaattcgtctggtttacttgggtcagggttacatatatgcataaccattatattggtggaagatcttagtacttcatgaattcttgtaggctactcatgctcaaatgggttacgcaggttactatataggccttgtataattgataattcaatcatttggatatgtaccatgaggtaaatatgagttaggatctaatgaaaataatgctatatttttaactgtgagttgaattttgatgtgaatgtaaatatggtgtcgttaattattcttcactagtatgagcacagtggaaagcgatgcaagtttaaattggcatgttgggggcaatgtggtggtttcagccataggccaaggaaagggaccatttttcactagatagattgcttgtatagaaacaaatgatctgtcatctgtatatggctatatgctcaccctattgtttagcagaaattcattcgttcactccttggttttgctgtacctttcttattccctgactttactgtgtgcaggttacataaactttggaataggaggatatcccatattgatctttgtgattgagattgattttttttctggaaa

SEQ ID NO: 981 - DNA, 229 bp, Zea mays
acagcagaagctttgtttttgtgtttgtcaaacgtgattgctctttctgtagtaaaagtgtcctagaatgcaactgtatccacttcaaaatccatcaagtttgcagttagacattagggattggtgcatttgtggatcatttgtcagatgattgtttccgaaataataattccgaaaacatggtttactatctttgccatcagtatgcaatctagacttgccaaagtcg

SEQ ID NO: 982 - DNA, 449 bp, Zea mays
gacaggtggccagccgaaaccgggaggcaggagcgcaaggcagaggggcagcgtcatcacccgggcgcgcgccaacgacaacgaggccgaggccggaaataacacgccgggcgggcgggtcactgctgctgcctttgccgctgcgcgtccgcggaaggggacgcgtccccgtccgtcttcccacttttccccgataaaaccacgggcgcctctcgtccattcctcgctcgccccccccctccccggctccccgcggatcacagacagcctgtgcccgccttccagtccacaatctccctgcctctcctctcccaccctccctccgaaaagcaagctccggcccggaccgccccaccgcgcgcgcgcatacacacacacacacacacagagagagagagagagaccgcacggtcgttcggggttcctttggccaggcgcacgacacgagc

SEQ ID NO: 983 - DNA, 1500 bp, Zea mays
tcatgaaacaagtggtcgctgaactagcttggtgggaggattagcggcccgaatttataagagagaaggtaactgaggagggaaagtgtgaggtcctgaagaaaggaaaggctctagaacaggtgtttgacgagtctcttttcatctatttcttggctgactccactgccattgctgctctggtgcactacaggtggttcttgacggggctgcatttttatggatatagtatttgtggatggtaactaggatgaggtcgtggatcggattgctgagtgttatagagaagctatgcttcatgacattgcaaatttcattccctacacggaatagatgttaggttccctatggcctactaaagttattcaagaaattcttgaaatttttctataatcctcacccgtagtatgatctttgctcgctttacatggccgcctgcaacagatcgagcaacttcttggaatagtttttcaagtccactaggcaggcaaactattgcacgatgtgcctttgttaatgtatgtttgatttattacacttaattaattcctcaccaacacatagacatttaatttactgtatgccaacaatcacaagggaaggatgtgcacacacatgcaggtgcatcaagtccttgacagcaagtttgattttagaagtttgatgtatgtatcttatatcttttcgtatcaatattttgtgataggcttttattttcataacaaagcatagacacatacctatatatttaaggtatctaaatctttttaacctttaaacgacgctaataagagcatagtatgacaattagtgcgtgtgtatctcaataccctgtgtgttaccatctctgcggaatagtaaaaataagctaaaattatgcataaatgtcacgagcaccctaccaccacgaacctaacaagccgcttagtgagtaaccattgaacaactatcctatttaaaggtatatagaaaccgtagcaaaacacgggcaaataactatgaacaaagaaaaaacgtagcaacgcacgagcaccatactagtcaactaccttaattagcgatgtctgaccatcccacaagaatattcttattctgtaatgttattgcaaccaaacacacacattctaaattccatgcttcctctcttggattaagacaagtgaggttagatatttttttagaggttttaagagagagataaacaaccatgaagcctgatcaagactgtagtgatggagtccattagtccaacaaccaaggccatgctatattgatcttgctgttaatggaattgttttaaggaccttcatgcaaaaccccaaccatttccccttctgcactccacggagcagtgaaaccgacctttctcccctcccccgcgttccacttcgcggagatctagcccttgggtttcgccagcggcgaggcctaagtcatcggcggcgagccaaactccacgagcggaggaagaggaggggaagctgagacgaggaggcagct

SEQ ID NO: 984 - DNA, 1136 bp, Zea mays
cacttatcaatagaagacaagagccgagaggaagggccacaatagcaagacgaaaattaagaggggcacacgacacacacaggcagccctacaagtggagcttttggagggagggaggcctggcctcgtagtttcggtgccagtggtgaaaagtggcagctctgcccacattcctacaccaccgcccaccgcggggccaccgtctccatggcaccacttctccatctccaatccaactgcccttgcgatgctctgcctgctgcacattttcctcccactactacactttattaatcacacagaccgaatcccacgccttctctttccttccccttcgttctctccctgctgctctgctcctgccgcctggctgccgtgccgccgctgatccctctccctctcttccccctcaaagccccaattgccgggtgctcctcttccacccccattgccgactgcttcccgccagagagtggggaagggaggggggtgagaagggagatggcttcttggatagggagtgggtaagaatcacacgatgcagttacctccacctttctctcttctccttttgcgggcatattcttcacctccgcctgcctagatccttctttctttggcccggcttagcttccagtctcaccaacagttctgacctcggagcatctatcaatcggcccactccactctctggtaaggcaaccagccacgccacggcaccctttttgttcgagaatctgcttgcccgcgtcgccgtcgtggctttgttcctcctcgcgactgattcgtcggcctgagtcgtcactttttgtctaattggtttcagcgccggttccatcgggttttgatgcaagagtagaggagttgttgctaggttgttgtgactggttgttggagagcaggagccagattgaggagaatttcagccaattttagcggaaccgtaaaacccatcccgagaatttttcctgcgcctcctacggttaggagctgtggctggacagtgcctgcctacgctctggagttttagtgcagttttacaagttttcagtcaattttgatcaagctcaggggaagtaccaatttgggagtgctagctgctgctgcagcagcagctgcgggttccttggtggcag

SEQ ID NO: 985 - DNA, 355 bp, Zea mays
cgtgagtagctagctagcgccatcccttgttttcccagcgcagtgcaagtgcaaccgaccgacgggcgatggtggttatctgtttcgattcaaggtgtccaaggcggacagcctgagcggcaggacggcgctgcacgtggcggcggcgggcggccacgtcaggtgcgcgcgcctgctgctcgcgggcgccggcagcggcaggagcaagctcgtgaaccgggcggccagcggcggcggcggcggcgtgacggcgctgcacctggcggcgctgcacgggcacgccgactgcgtgcacctgctggtggacgagcgcgccgacgtcgccgcgcgcacgctgccctgcgccgcgccgccc

SEQ ID NO: 986 - DNA, 926 bp, Zea mays
ctgcagctgccggcgcctatgccctatgcctataggactggtagcggtagtagtctactagtagtatgctgaaaagctgggagacggcatggtgctgggactggcaggttgaaaaggcggcgaagagacggcgggcgggccgtacggatgtcccgtcgtctgtcctaacagcgtcactgcctacctacactgtggtgtcgtggaggggcgaccgggcacatcaattatcacgctcgctcatggcatgtgtagatggactcgaccgtggctttctttctagctttgatgcaaaatggcgaacaaaagatgtccctctcccttccgagcgcgcacgcaggccggaaacgactgggctttgcgtctccttttattaatctcttttgtttttcccggccctgtgctccacctccactccacgcgagatccatcggtcaaagccgtagggcacggagactgggcagcgggaggaaggaaatccatcaaagggagaaggatgctacgtgccgcggcacgatctctgtccttctgcctcactgcctgtccttcaactgcacacactcctctctctctctctcaactctcatagccaagacgacgacagacggttcaacaactgccactgtcctctatatctcattctctctctctctctgcgcgcgcgcgcgtgtctctctcctgagcagcagagcagactgccctgctttcccagcttctatctctgcccagcgccgcctgccctgcctccactaaaaagggctccccagctccaacactccggcgctccgcgagccacccgccaggaagcagcagcagcagcaggtggctagcaaccaaccagttagcacgtaacagcccaatttggcagcagccatatactccaactccaccggtcgggcctccagttctccgctcccattcgccgatcg

SEQ ID NO: 987 - DNA, 541 bp, Zea mays
ctgcagggagatcgtggacgaggcggtgcggcggggcgccagcgacaacttgacggcggtgatggtctcgttccactcggacgcccctcccccgagccgtgccaacaagaggaccggcagggtcacgcggagcatatcggctgaggggcttcacagcctcagagtgctcctggaaggccagtgacgtcgcccggcggcgccattgctgcccgttcgtccctgatgctgtgctacgttgctgatgaggtgttaactgtaagtagcggtttccggtatcttggtgcttgctcttcttcttccgctgagggcgggcgactattcttgtccttcctccgacaataaaccaacgggcctgagatctcactgtgagacgctgtaaataaggaaatatggaagttggagctcgtcattaaggacgagttagcggtgtgcatccagggggcttttgtggctcagtatgtgatgccttttcgcccctcctgattttctgtaaataaaacgatgctgggagccatcggtgtgattgaactagtgttctgtt

SEQ ID NO: 988 - DNA, 975 bp, Zea mays
ctgcgcgccacgctggccatgccagcaaggccacgtggtcggcggtctcccgctggacgggcccttccaccccacccctacggccctacccggacagtccacacgaccgttgcctctggctctatacctgacaggagccgcgcagcttggagcaccgctcctcgacccgtcgcctgtcaccggcgcgtgggtccaaaaccggtgggggccctgctgccggtgccgtatagatctacgccagcgcgcctgggccgctcgcgcgtatctcgcgtcaatcctgggacaccgtggcgtgggcccaacgtggtcacgccgactggcgactggcagcgcggcgccagcggtgcctgcccctgggccacgtgcctgcccctgctgtttgctcctattcacgcccctgccactcggtcgtcctcttgcctctccggccctgtttggccgtctctctggatggagtctagtggagagagagaggctggctcgtgctcgtgcatgcagaggcagaagaaggggagagaatctcttgttttcgcttttataacttgataaagatcattatggatggcattgctggctaggttacttatactaaaccagaagctatgcggtagtctgttatttgacggccatgatgcatggacaatttggtaatcttagagctaggtatgcacagtttttcgttatcaatcaggctaacctctctgctgtgctgtgctggcgccgtcgttcggcatccgcccagccccaattattagcgcagcgcaggcagcggtggcattcccgcaaatccctcgcgacgccggaggtcttgtgggtgcgcagcgagccctataaacttggggcggcgtaacctgcccgtcatttacactgccatgccacagccacagcatcacgtccactcattagcaaggtagcccgtgctgcacctgcctgccagccgcagctgtcctgcctttgccttcccatagcatagcc

SEQ ID NO: 989 - DNA, 133 bp, Zea mays
gctgacccgtcactcatcgaggtgtcgcgcagcttcgagcaggttatgggccttgccaaggcggagctgcgtgagcccagcacgctacaggtggaggcatcggctgcgggcaggataggcccccttgtggcca

SEQ ID NO: 990 - DNA, 386 bp, Zea mays
tttgacgttagtacggtagtttatgggggacaagtgacatgtcgccgcatcatgattagtaagcgttgccaggtcaaagtagcattaaaatgatgcgttcattaggaagctgttccaacttccaactagatctgtgttgaaacgagtggcatatatacaaaatcttgagaattttttttcaagacatctcattcatctgcctcgttaactagaagcatgcgatcacaatgaaatgttgtcgtcggcactcagctggcttggacgacgtgacgtgcatgcatacttaagtaagtgctataaaaaggcccaaagccgaagcgaactagcgaagaaaccacaaccgaaacccacaacaaaagcatcgccaaggtacgtagaacgtagcc

SEQ ID NO: 991 - DNA, 394 bp, Zea mays
caggtttgcgcactacctaacgtgctagtgcaatcataattcggctgattggatgcttgtgttcggacctgcaggctcgggtgaccctggcagacccgatacggcagttttttgcgtatgagtggatgcaaccaaatgattataaaatgacttgttttacattcatttatgtagtctgtgtctcccttggtagccaaccaaacaagagcttagagagagttaatgtatatggtggtccaaaacgatacggtgaaacatatggaatttgtatatcctggactcctgggcagctgggctcctggccacagcccacacaccacaggcataagtaagttatcatccagtaccagaacagaaccatcgatcgagcttggttgctcggcagcagctagca

SEQ ID NO: 992 - DNA, 121 bp, Zea mays
gccactatttttggtgaccccattttatattcgacggctgaagcttggttgggacgtttttctgggaaaggaaattggagagccgcggggactgaagtggttggctgttagttcgtggaat

SEQ ID NO: 993 - DNA, 1500 bp, Zea mays
gcacctctggctccatctctgctctgatatcggagcacctcctcggtgtttatggcaagaagaagataagagaagacgataagtgaagcccatatatcactttgtactatggtatctttggttagcttgttttaagctagtgttgttggagaagacaatgaaagaaatggatagtattaaaatactccatttgtcccattattcgttttagacttttatttttttgtccatatttaaataaataacaacgaatctagatacatatataatgtacatacatcaaatattgtatgaatccattaacatcctataaactggatactattttgggatgggggagcagatgactcatcaaacaaaaagccaagtagaaacctacgtcttgggtagctgtaktcctgtagagcatttcagcatttgcatctcttccttccttgtagcgcctgtatttcaatttgatcccgtcaccaagcaggtgaacggtgaaccatggaacacgtattatgacaagttccacgttcctacatgtcctagactcctagtgtgccaggcctaataatcgtgctcgcgaattcatcatctaaaccggattcaggtggacgtgaacacatgatggaaagaacaatgcccttaggcaggggtagggaatgaacaggctaagacgtcagtgtcacggtcacctctctggctctctcaagggaatttggcgagggggcctggaggctggaggaggaggcaatgtcgtcggcatgcccgagaaaggtgaccagtcaagagagaggggggtggcgctcattctccggcgccccccacaatctgccaaagcggacgggaaaaagcaatcaaggagacccaaagcgatcgacgtccgccaccgccactgtacctgggctggggcgcttccttccttgtccgagtgcctgctggctcttgtcgccgcgggtgctctgatccaacgcaacgttcaaaagcaaaagcaacagccacacaggccactcacagccacaggggagtaggggacagagggagagaagccagggcccagggccagccgcggctgctgcagacgtgccgagaccgagacgctattccaggctcgctttgaactgctccaaagggatcccaaagcaccggcctttctcgcggtccgatgcgttcaaagatctctgcgaaaacaaaggaagaatgtgagagagagtgggaaaggagagatgggagcggcatcatcatgccatatgccactatgccagcagctgagctgagtgaggagtcggctcgagcacttggcttgtgagaatgagaagaagaaaaagatgcaaaggaaggagttgctcggttcaaatcggcgccttcggctcccaccataaaaggaccacaccacacactcccctcagtgcccaagagtgagactcaaacggccgaaccgttgcttggattggagtgagaggagtgaccgtttagttagctcgagagagccgagagaacccaagaagcaagggc

SEQ ID NO: 994 - DNA, 1078 bp, Zea mays
cgcctttcttgatagttatttggctagtatcttagacccgtttgtttcctcttgctaaagtttagcactgcactttttagtttagctactaaagaaacaaacatggtgactaaaagtgttgtgctaaagtttagcacccattagcgctttagctccaccaaatatgttaaactacgctaaaactggtccctcaacccctttctcttacctcctccacccacaccacaccacctacttgtatccaaacaacccttaaatgctaaagtttagcgggtggaaaccccttatgctccgtttggatgttgatattggacaacaaggaattgaattgagctcaatattaaaccaaccatgatattgaaatgaaatgtaattttaattctattgtttgaatgtcactgaatttgaacttagaattgtgtggtctaattcacataataccatgggtgatgctctgtattgaaaagttgagtttcgagttgtagtctaatttccaaagaattgggtctctgattccaaatctcaattctatgcgcaaccaaacaacaaaaattttgagaaaatgatttcaactaccaattctgtgctctaatatctgcatccaaatcgggtattaaaatcatgtgagagcgagttttttaaagatgtcaaagatgctctcaattctaaccacctggcagcccgtgtagcacatgcccccaccgtcagcccacaacaacgagggtagccgccgacgaggccagtaggcagtggccacccacccctgtcctcctccgggtcgcacacctgtcccggcggcctcccttgcgcacccgatcacacgcacgcaccgccagtcaaagcccccacctcccggccagcccccaccgccccgcgaagactgggtccctgccgtccgccccacatccaagggccccgtatccctcctccggcgagccaccgctcccccgcccataaatacctcttcgctcccgccgctgccgctgccacccccgcgagacctgtccgaatcgcgcccaggtccctcgctgggagtttcgccgagggccctcccgcctcccctagattcacgacggag

SEQ ID NO: 995 - DNA, 322 bp, Zea mays
ggtgcgcatggatctgggttagttatgtactttgcttacttctgacataaagggcgcatttcaattttcaacaacacaaaagttgacgtccaagtggcctttgccttttccgctttctaagcaacttcgcttactgttcacttcacgaaatttccttatgctttacttgttttgcaactgaatgtggagtagcaatgtaacaaagtgaaaaagggtgtctggctgattcatttagtttctgctcgttttgctttcttgagatggttcgtgttagccttaacctttgtgatagcacaagaccaatgtggttgggactctgaac

SEQ ID NO: 996 - DNA, 727 bp, Zea mays
gggcagatcgatggtggagtcggaggagggtagttggatacctgagctggaggagagagtgaggaaaacgaagtggaggcgccggcgctagggtttcgaggaggtgtggttgtctgcacgggtgggagctcttatatgcttcgttaaaaccctagccccggagagtgggctgaccaggctaggtgggattccagaacgtgatacgggccgagtatttgagaagcctattttgtggcccgacttgataggtgtgttagacttgtgcatctaaggcccaactgtatcacggaaaggcctttcgtgcttcatggcggaggtttctggaagacaagagcaagagacgagacgtgagccgtgtgtgagtacgtgaccatcgtcagctgccggtttttccatacgcgcaacagtgtgccgactgccgacgacgaccaaccaaaccatgcgaagaggaaagagccgtcgctttcgctacgctcggcagtggaggacacatcttcctcgccgcttctggctttgatccggtcgcatccaacgcacgacctgttgaaccagggcgcgccctcccagggttcctttcttctccgtctccgcgtaggcgtagcgaagaagctaacctagaatcaaagagatcgcacgcaagagggagcaccggagcagcgagccagcgacagcagcagagagatcgccggggccgctcgcctgtctggagagagaaaggaaacaagag

SEQ ID NO: 997 - DNA, 1078 bp, Zea mays; identical to SEQ ID NO: 994

SEQ ID NO: 998 - DNA, 746 bp, Zea mays
caacataaaaacgcttgatcaaatgttcaggtttcttgtgggatatggtgaccattcaccaagtaaggtacagattagctcttccaaagcagtccaatttcacactaaaaagaaacgcatccactagaaaagaaaagcaaagcactttcacactacgtatgcactagaaatgaaatgaaaaaaaaaacatccattccactgtaaaggaaacgcatgcactagcaattaaactgaactgatctgaacaagaatataaacgtatgctatctgacagagttccttttcagcatacaccaaataaactgaactgaatacaccagctcagtgatgctagaactgaaccaaacagaaattattggcataaaaactgaactgaatacaccagttcagtgaagctagaacttaactgaacagaaactattggcataaaaattgaactgaatacaccagtgatgctagaactgaacagaacagaaagtattggcatagaaactgtcaaactgaactgaatataccagcagaatgtgcataaactgaactgaatacaccagcagaaagtattgcgaaacgggcggcgttccccggtggccaaaccaccatggatgaatggcgggcggcgttccccggcggccgaaccaccatggatgaatggcgggcgggcgcctggcagcgggatctccttaggcgacggagcacccgagcttgtgttgtagcagccacggtcgtatgagggagatgacctcacc

SEQ ID NO: 999 - DNA, 1338 bp, Zea mays
ttagctttgctattttacgagtgtcaagatgcttaactatttcatacttgctttgtaggaatgttcgatgccgacaacatcttgctctaccagaaggtaccagctccaaatcaagaaccaaaatttaggaaaaatacgaactgcaaccttatccgtcatctttagtaattcatgtgtttatcttatttgcaccaagaactatgctggaggctataaaactatgaatgttatttgtgacatgtaaataatactagcttgtacatgcatctaaatgcatataagaaacacaatgcaccttttgtttgcattccatgtaaattataaattaaatccaaacattgaaaaattacaaaacacacacacacaacactatgcgcgcatgggcgcgcgcaagacactagtacataataataacgatattgttcgcttcggattaaattaaaccaagcgagtatgcgtgcatgtgtacgtcggatgctttgtttgttcatttgtggcccgtgaagtaatatttgggcccaatagcccattcatccatgtcytaaccctagggcgcgttcyttataaaacctatctccattctgttctcactctcagacaccagacgcagtcggctgccgcagactggtagtagccggcgcgccgtcaccgtatcctcagatcagaggcgagcagaaaccacaccactctactgacgcccgacgaggtacacttccgcgcgcgcgcttctcttccttcttttttcgctcgacgaggtactctgcttcacgcgcgggcgcgcttctcttccttctcttttcgctctgccttgagcctgttcgtttgatgcccagatctactaggtttgtcgatcgtcgttatgtgtgatgagctgagccgattcatgcactgtatttttaattaagtgtttttttcctccgccgctacctttattgtctatgtatgaacttgcagcttacaactggttattgagccataaattgtaactgagtttccgagatctataatattacgtggctgaggcgcttcatctctgttttgtttgtatgacagtaggagtactagtccaagatttgcttccgtctcctcatctacctttagtatgtactctgtatataaacttaattgcagtttgcaactgattctcggccatatattacttccgttgcgttgttcattagatccatttccgatccctgatattacgtgggtggggggtacttcgacttgggttttcctgccctttgtttgattactggtttattgacatatatttatctattgactttttatctgctatgtttgatgtaagcagcagtgtaacattttccttcagcc

SEQ ID NO: 1000 - DNA, 207 bp, Zea mays
ggtacaatgcaataacttctaaagtgccatttagttattgaagaggataaacttctgaattttattttggatttgctgtatcttarctttatcatattacaccttgctatatcatttttatctgtaacacaacctagttcttgctgctactttttttgtttcagaatctaattcatcattagttccatgcatgtagctgaacaaaaa

SEQ ID NO: 1001 - DNA, 133 bp, Zea mays
gccccaagcgaagcgttacccatccgcttagcgcgtgcgtctagtgccgcattttggaacccggagcgatagtacatgcagtatttcaatcttggtttcttggtcactgaccgtaacactttgctttgtatgc

SEQ ID NO: 1002 - DNA, 574 bp, Zea mays
gccccaagcgaagcgttacccatccgcttagcgcgtgcgtctagtgccgcattttggaacccggagcgatagtacatgcagtatttcaatcttggtttcttggtcactgaccgtaacactttgctttgtatgcatggcccttaagatcgcctcccttttgctatgtgggagcgtgtcgagtcatagccatgcaaaattaacgacgaggtcccagagagtttttctctggaacttcctcccttcctgttgcagttctaggtgtcttcatccggggcatcgagttccctgtagtgtatgaccattatgtggcagctgttttctgcagcgcttctgtgagctcatcactcgtgcgactctttgccaaatcaaatggagatgtctaagctttggaagggaacatgttttaaaaaaaaagaatttgtgaattgtttcctcggatagttctaccataatttcgaatttccattagttcagtcaaactgcagtacacagttttaccattagtcttaattctactgattgtcaattttcttttcaactttgacctttaagatgtcttgcttccagtggatca

SEQ ID NO: 1003 - DNA, 1500 bp, Zea mays
ctgcctctgggccaggcactaaccgctgctctcacggtctcaccgatgccggcggctttaagttttttttactactagtatacttgacyggcaggagtaacaatggaggaaggatgcccgtgattaagatttaactcgcttcgaggcagccagcgctggtgtcgcccaccggtcactgtccagggcccattaatgtcctcctgcaggagcagggctgctgactgcgtagatgagagatcaatctctggcgcactggggcgctctcgctcctcccctccgctgatgggtccattcttgcctgccccggctgcttgcttggtgccgaggaagaacggggaggagaaggttgggggggttcttggatgcattcacggcgttcaggctatgaactaagctgagcagcttcttgcgttttaattgagctctcttgttcttgctcccgcgtcccctgcatttcaggtcagaagcgcaaaatttcttgctgcatttgaattatgaacttcgtttctcccctgcgctattttggttccacatgactgtgtgccttctctgctctgtactacggtgtgattctgtttgcagacactctttttttttctttctaatttcccttctttttccgccttgtttttaagttcatatgctctgagagtcttctcgctgcaaatctgagttgcttccgttttcgggcactcatagtttcctatatctccaaaggtgctttaaatcagtgtcctaaataggacgcaattcataaaaaaacagctctaatagtaccttattttacaaaattttataaaaaataatacggtataccatgaaataactcaaatatattacacctagattagtgtcatatccatgttttctaggtcattctcaaacttttctttctaataatgtaatttatttcctaaactctattttttccccgtttagctgcatttctttcgttttgaagcctgctgcgtttcatggcaggtttcactgcaatccttgcttgcaagctcagatttgtttttatttgttgccaatttcttttgccaagtccctcgcatgggtttttgcaaaccacaggtttcaaacttgaaatttgcagtacaatctgccctgccacacctgctgtttccttgtttcatcctacgttcgatctgaagcactggttctgccgtccagcatccaatgtgttttttttctaataataagacaaggacacgagtcagttcactgacatattttattgtacttctattgttattatacgttttgctacatccaaattgggctgaaaattgtaatctttagcaggaaactgatatcggggagcaagcaaggcaaggtttctctcggaagaagcattacagtgccccacttcggcctttctgatttatttgctttgctagtcctcgttaaagttctgaccattttggtggcttggaagtgataaagtttaccaattcactaagccaattgagaaaggatagtgctaactgagctcca

SEQ ID NO: 1004 - DNA, 218 bp, Zea mays
ggtcagcattatttagtccagctgctgcaaagatacctgctcctcggataaatgtttctactgctgctccttagacaaacaatgtagctatccccctgaatgccactcgagcactagggtctggtcaacagaatcctgctgtaagaggaccacaagtgcttcctggggcatcatcaaatccacaagtgaggccgccacaaccttcaaatgcaaacact

SEQ ID NO: 1005 - DNA, 536 bp, Zea mays
agaattttctaggagattataaatagacctttttgatagtccttggttggtattactcaaccattaacacttgcatacatttctggaggctagatctatttaaacgtcacggcaggttgtattataagttgtttggcctgatctatacctagtatcagattgagttagatcaggttagtccgtgtttttcaattggacgtgtcgggttgtgtttttagcgttggattaagtttttttaagttggattgtgctttggataaaaaaaatatggctcttaattcatccgatttctatgttcttttcttacaagtgaacagccgttgcccgtcggccgccgcccctccctccgcgccctcccgaccaccgctccttccccgccttccacctgcgctgtccgccagtcctcctccacctcgctccggcacgcagggcccacaagaagcgccccttccagaagttaatccgccccggtttgactagggtttgtcccgtctcctaatcgatcagattggcaggtaactgccgttgccgccgcg

SEQ ID NO: 1006 - DNA, 1500 bp, Zea mays
atgaagtacttgcaaagcaccaccagtttatcagtaatattatrgttctcctttgtacagtaagacatattgttcccagaaaatatattcaatatgatcttgaatgacaaatgttgatatttgccacttgacctgatacattgacttccttatttgcaaatgcaaaaaaaagcttgagatacttgaaacaaatcaaatcctcaaccgccaccggaacaaatagaaatagaatttggaagaaaatgtaaatgttgtatccaggtccattggtgttttatcttataattcagtagtagttaaacggtgggctcttgtgaaaaaagaagataaatggtgggctgtcaggcaacaagaaaaggttttttcccacttgctcccagtgttagtgttgaaatataatataagtgaattgcacacctcttcccatcagcttaagcttttgggttgaattgattggtgcatgcaacttaatatggtattagagctagaggtcatgagttcgaatcctggctagcgtaattaaataaaataattgttgttcgctcctattccacgtctgagacccgagagaggctcgacgtgagggggagtgttagaatataatataagtgaattgcacacctcttcctatcaatttaagcttttgggttgaattggttgttgcatgcaacttaatagttagtatcaaaactaaatacttctccaagatggttcaaactgctttgccaactttattgcctttcatgttactgaaaactgaatacgaggttgacactgattcaatgagcgcatgcacataacaaagtgaacacggcctagatgcaaaaacgtagacactgctttaaatcagaattttttactgtacaacccaaacagattttgatctactcttataagaagatgaagtcattttactacattaatgtttttcatctcatgtatggattgtttcctttatgcttgtttctggcctccataaggaggtcctgtattcgggtccttttccgaccctatttcttcttacttaataaaatgaggcgcagttctcctgcgtttttcgagaaaaaaagtcagcacagctcaaatcaaatatgaaacaaaaaaaattaacctcatttacaacataaaattaccaattagctacagagcaatattagagtgaagtagaaaaatgcacagagtttgagctatcacaagctagcgcctcactgaaattaaattgtctaagaagttgaactgttacataagggttcaaaattttcagattgcaagcaacttcaaagagggaaacaactcaccagacttcttgcgtttcggtttcttcttgggcccatgcttcttgtctccagtacctgaaaccttctttttgtctgggctgctaatatcatgactacccgcaatccctccacctgcttctgtgtgcctctcagtagcgacctcgtccttcttctcagcaccctcatggctgccaccaccaagcttcctcccaccatcagatga

SEQ ID NO: 1007 - DNA, 76 bp, Zea mays
tggttgctgatcgatcctgctctgcttatcgaatctcctccttggccgcagggtccggcggcgaagggaaggtaag

SEQ ID NO: 1008 - DNA, 1243 bp, Zea mays
gccatccttacgtcccgcggcttcccgactcttctagcaggaaccgagcgacctcggactcagcggctccgcctgtcggcgagcgcacgccgcgtgcctgcccgcggtctctcgtcgtctccagaagatgcgccccgatactcgtctttccacccttcttctacctccttccacccccttctccccacgccccatcggatcgcacgcgcaccgcaattgttgttcatcacctctccgaagaagcgtcacagagcaccgcccggaggttccccttcccgtcgccgtcgcttggccaggtaagtaatgactaatcgcctgagtctcctgcgcctcattacttcgaactgtggtttcgttagtcggacgtcggagcaatgctatgaaccttgccattccatgttacttggtgctgcgtgtccacattcgacgccacatttttttcttgctagccaaccattgcgcgtctgtgttacagttccaccggcgatatacattatgcgatcatttgatgtggatattggtgtttttttggttagcggatcaccttagttttgcactgaacatggaacaaatgtggatgttggtgtttttttgttagtggatcaccttagttttgcactgaagatggaacgaggaaatggggaaggggaactgaacgaagcacatagtttcagagactatgtgcactgcagagactatgcgaatggtcaagggaatttctcgccttggtttcctaatcctcgcttccttcttgtttcgaattcggtgtatatatgtggtttattcggcacgtttaggaatttagttggggaatggggcgcagtatgtcagggttgtgtccaaggccactatctgaatatataatgcaagatctattactagtttaaattgacttattatgcaagtcgattaacctggctgggctcagtggtgtaccatggaagctttgtgattgtagccgggcagtagaacgctaaacctgaggtttggtactgtagcactcggctagtcagctgtatgccaagatgttacttactcgatactttctgccatgtctcatctgtgttaaccagggtgtgtgccacatagggcttctttccatgctgtttgttaacctgttcacacttcttccatatatatattcataatagctcgatctacaattttcctgtcttgagcttctttgttcctaaaaacgaattgtataccagcaatgtatatctgatgcaatattgtttgtagg

SEQ ID NO: 1009 - DNA, 707 bp, Zea mays
attttgaaaatgaccatagaacttttcttttttgtagatttaccacaactcttttggacacactaaagaatcgagttgttaataaatctgcaatattttgttataaaacacactaatattttctatcaggttgcgaaccatggagtatatgtaatgttttgggtcaacacacacatcatgtgtggtaccattctaaacatgcatctactaccccaattgtgatgttaaaactcttttgtaatatatgtacctacctactttatgttcaagaagccatcaatgtataaaggtatatcctagaagtgtttttaaccatcaaactcacttagatgttatgttaacattattataccttttacatataatgaaaatctatgatactatcactttcaaaaacatataggtttatgattttgaaaccattcaaaaattacaaaaacaatggtaacctcaaatagaaagacactaagagaaaaatgcaatataaatgaaacagtgtgcacagcaacgccgctaaaaaattctggttatccatagagcgggaggaagcaaagcttgccaatttttcatccgggaaagagagcaattttgatgtgggccaaattaactgggcctcccaggcctctacgggattcgctttgctcaggcaactcgcctaccattgaaaccgcggaagagcaacagcccactaccagcgaaaccccaga

SEQ ID NO: 1010 - DNA, 1500 bp, Zea mays
cccattggcgcgacgcgacgacgccgctgttacagaaagctaataagcagtcatgcatgcatcaccacccctagctagctagctggcaaagcacgtcaaggtcatgcggtctcttccgaccccggttcctgcaattgcacttgcacccattatcggccgaaacaaaaactgccaacgtttctaagatatatacccccagtgatatacacatacacactagcgcatcaggacgtgcatgtgcggtggtggatgagtggatcagatcgtccgcctttggacgatgacgctatacgacgtcgacagtacaggagtacgtatatgcctagaacaaacgtactagaggcccagcagcgggtggaagaagacacgctgcagccagcgtagctttgttcagatcttcgtaaagtccatgggataagtagctgatcacgctttcaagctccgctgctgtcgtctttaatttctttctcctcatggtctgggcccccacaaaagctagctgtggctgtctctatcctcccgtgcccagcccccggcccgggtccgtgcagccacgagacggtctagaagcaatgcaccacatgacttccacgccatttcttcctgcgacggcaaacctcagggccaccgcattgatgaatacagatcccacagctcttgtcgcggctccggctgtcgattccgcccgcccgcccgctcttctagctgtcagggatgatttccaacggaacaaaatgcctccctcgtctaaaaaaacacacgagggaaatgcaggtcaggatcgaagaatttttttcagtgataataatcatcgccgccagaggccatggaaaaacgtagagtattccttctgccttcttcgccgtcacgggatcgccgtgtgaactgaccagatcgagaagccgaggcggaccagggcaggtctggtcaggcgatggaccatctagaaaagcaccgagcggtggcagggcacgggccaacagcgccgcggcacgcacgcacgaggcacgatcccgagtgccaccacgccacgacgggacgggacgagatgagcccacccgcgctccacctcccgctgacgccgacctcatcgctgacgccaccacactctgctaatcccattcccatccatccaccttaaccaacggtcaggggcggaaagcgagcggccctcccccgcaaactactcgactaagatcacaatcagggctatgcattagcgtcgcctaactgggccgcgacccctgcttattttaatgaacaagcccattccgtcacgtggctggctccaggttgggaaagttcaacgaacccgcctccgcctatataaaagccgcgccccggcccagccctcgcctcgccgttcaactcgatcacttctttcccttccacacaggcacacaggcacacagcacacagctcactcaactcccctcccgcttcgtcagctcatcatcataaaccaaacagagagctctctctcggtcgttccattccagg

SEQ ID NO: 1011 - DNA, 1500 bp, Zea mays
atgtccacaggacatcccgcccgttgaattgtctgcaaggagtatgcattatgacacagtagctagctagtgactttattatattatatgttgatgtgatgcctaactgtctcacatttatagctgaatggacgagcggatttggcatgacttatgtatttacgcggcagtggttagtagtgtatagctttacctctgttcccccatcctgttttggaaacttttatccgtgcctgttctgaaacgatcagccgggctttcctggtgagctagctgttgccgacttgttttcttgtggacgatttacagcgcaagtcagaatagtaactgataactcacgagattaactctaaatctctaaatatgtagcctatactaactaccacatattctattatttattttcacctctttcctctccacacccaatgggcagccaataggaagaggaaagagattattcagtccaccacagaaggtgcactagctgtgaagttcctgagagctgtaaaaatttacggcgcggctgcggatagcctaaaggcacgtactgatcgtatgcatgtaacagcttttgttgtcttgaggagttgaggtcgtcgacgctcgacagcattggaaaagctttggctgctaaagtagaaagtacactttgcactttccaggtgtgcattctagtagccctctcttgctctcttggccatcgaagcatcctccagagtgtgtagatccgatcagatccgcgagaacatgctgagagtctccgggcaaagggatgataagagctggaacatgaattggcagaagcagaagcgaaagcaggctgtttatttgtcatgaatggataccatgattcggcctctaggactaggagaggataagagggtcggggtggacacgtagaggaggatggtggtaggcaggagagctgtcagctgaagcagcaagcaagcccatgcatggggcggtggggtcatcgaccgacgcggcgcgggccggggccattctggagaccgtgaaatcgacatttaccgttgatggatagcgtccctacatgaccgaccgcactagaggcaaaaaaaaaaaaaagtggacccatctgccgaccacagaggcgaggagcgaaccaatgagctcctcgtcaccgcgtccagcaggcagcaggccgggtggggtgatggactgtgatgaatgcccgcgcatcccggccaagttccgcggggcgtcagatggggatgcatgcacacagctcagcgcacccgatgccctctgcccacgcatcttggcatgttggcacccccggacccccgcccgctccccgcctttataagcgccagcagccacggcaggtggagctcatcgcatccatccaccacgcaccccaccaacccatacccataccagaggctctctgattttacttctccgcggtagatcggctgagcgagcgagcgaggcacacggagctagctaaacagagcacacgggtagaaaagcaag

SEQ ID NO: 1012 - DNA, 620 bp, Zea mays
cttcagttttgaaaacagagattttagtcagcttgccaaacacctttctgttcactcccaaataccccctaagggtttgtggtttggttggttgctttaattcgaaccgatttggactggctcgccaagccaaggtgtacatacgtatgcgctcattgcaaacacccctggtcactgacaggctcgtgctgggtgggttacgcgaagagggcaattagttctcgtagatttatttgaaattcttggaggctagtccacgtcgagtttggttaaaacatgacaaagcgcgccgcgccgcggtgagtatcttggagcctgccctatggcacgagccaagtggctaatccccgcgagcacatgcgtgtcctaccagcgtccaatcttgtccaccaaaacaaatccccgcacaccatacccagccaaaaccaccaatttgacgctttgcccccaagtccaacccagcccagcacaggacgcgcgcggccgcgcccgcggctacatataaccctggacggagcgctggcagctgcacatttgatttcattcgctgcaagcgcaagcgcggcagtcgagctcgccgagctcgcgatcaccggcagctcgctcgctcgccaatcgcc

SEQ ID NO: 1013 - DNA, 366 bp, Zea mays
cttcctccccatcatatatatatatacacggatgtttattggcacctctagtactactacctacgcactcctccatagatagaaacgagcagaaatacattacacattgaaggcaaaatagagagagagagagactaccctgatcttttccccttccgtcagtccgtcctcgtttccccttctcattcgacgagcgcggcgaagcagctccccgtgcgcgccagcgagctccgggacgcccccgcggcgagggcggagacgccggggtcggcggcgtcgcgcgtcgggctgctcggcgtggaccgcgccttcctcgacgccggcggggacccgagcctgcggcgcagcagcaggcgcagcgcagcg

SEQ ID NO: 1014 - DNA, 1500 bp, Zea mays
aagattagactggaacagcaagtcgatgaatggtagcgcagcatctgcaagcacttcaagtagtatgtgttgggctgtcggttggatcagtgattaactgatctcgtgtctcgtccaagcctgaaggcacaagtcaaaggcgattacttgaatatactagtggattaagcacttatgcattactagtgggggtttgcaacttcgatttcgaaaattcaatggaaatgctcggcaggcttgtctattggagtgctgtcaaaatggaaatatgcaaaattggagtgggaagtacaaataatagaattcaagggaatttcaatgttcctggcaggctgatattgttttagaattttaatatactgtttgtttacccaaaaaagtactaaaacgtgtaatattcctattagtattgtttttttctagaaaaaaatggcttacgcatgtatctgtattcgctcaatactagatatagtaccctgtatccgttaccaagttggtgtaccccaaaaccaaggtaccattctctttgaaattgactggtcttcagtcgactattgcaattcgagggcaaaagtaaccctgcatcgcagcacaagaacctgcaaattaacccacatgaacaccgataactgaagcagaaaataaatgtgctccatggttccaggccttggatgcacacaattaccatctcctggtctgtttctttcaaagaatatttttcttggttatgtgctctcaaaagattttccactcccctttctctctctttctccttttggtgacatattgttgggtttcaactctaacctaccccaacttgcttgggactaaaagactatgttgttatatatggtgtcattatacacagggaagaaaaagatcttcatgttacagggaactttgatctatgagatttgttggatgtggttcggttcttgtaagtaaattcttcagattagtttgaaggacctgtgttgtagtatttcgatatggtattaaatatgcaagcatatgtatcaattctgccagcactgattgtgaccacacattctgatattggattattctgtgcaaggttgttactatgtactagtaagaaagtggcttttccacttgtttatgatgatacatgtataatcactaacataccttttgcatttctgcatcagaagtgtatattaatacacttgacgtggtctggttcctgaatatcaacttgtctcacttcaacttttaatagatcagttttacctttttattggcattcagaaaaatataggtgataatttagagagaacattcatacatatgcagtttccctctcttgatttacagcattatttcagtgcagttttgttaaccccttttttcctttagcatgtcttcatttagtttcttattatgctcatccttttatttttgactatgaagcaggctttctggaatcacatttcttgagaactatctgttggagaactaaactaggctcttgttcatatt

SEQ ID NO: 1015 - DNA, 1500 bp, Zea mays
aagaatgtggatatccaaggtgaagaaaatccgtcagttagctcacggaggaaacatgaaacacaagaaggacatgaccatctcagtccacgccaaaagatattctcattttcctcaccattttttctcccaaaaataaaacatactaattactcaccattttcaccctcattctcgttttctattcacgttcctctcttcagcgcaaccggaaatatctaacggaacatgcggtccacgctcgtgccgtacgatcccaccgtccaaccgattaaccaaatacaatcaacggctaatagaccatactgtgcggctccccgtgtccgatgcggctccacctggactcgcggccacgcgcagccatcatctgtttcttctttctttgacgcctcagttcaactcgacgtccccgaaatgcccctgccggccgcgccccaccggtgtcggcctcaccgccaccaagtcggacgccgactgggccagggcccaggggcgtttacgtaaccccgcgccccgccccgtcgcttccgccgtcccgtcaccgcatcgcgcggcgcctcggacagctggaccctgccccgtcacggccccgcgtggatggtcggttctgcccctggccccctcgcggcgcacgcacccgtctggtggccggcctatctggtgcggtgcggtgcggctcgatccggcccgacgattccgatccactcccgtcccgtccatcccgtctcgtctcgcctcgccctccacgccggcgaccggagaaggggccgtgcagcgcaggcgacgcccacaacgaatccgtccccccgcgccggcttcgcccagccccgcggcgacgcaccaggtaaggctccgttcgcggtagctctgtatctcccgcgggaatggattgcgcaacgcgtgttcaatggcgtgaccgacgccgtgcgctcgcttggctgccagcacagtctcctactcccgctgggtggagaatgccgtgcgcttataccctgccgctcgcgaagaatcgcacctgggtatagcttgttcgaggagctctcgatccacgcggcccggcacaacccccccgcacgatgagcaagcgagcgcctgcactgcctgctctgtctggttgaccgtagttgcttgctgcacgcagctacatgaagtcttctcctctaagtttcctaggcggacatttgggttttcttctgatatatacgttccacctaggaagcatttcgtgctgttggttcgagcttaactgtggggtggtttcctcgcgtggacacgtgatggtgaaatgtttttttttccggatttatgaatgataaaaggaacacgtgttttcctgcgcttatgccattcctatgatttttctttgattgacagcagacagcactggcaatcaatcaattataactgtcaaataatttagcttcagcacttctgtacaacaggattgaaagggggcatgagaaggtggacatcgttgctctagtgatttgatcaccagag

SEQ ID NO: 1016 - DNA, 94 bp, Zea mays
ggtgtgtgtcttgatttggaaattgtcgtaggtcggctagctaaatcaacagccaaaatttagtttattcagtagctatattggggacctcctc

SEQ ID NO: 1017 - DNA, 1321 bp, Zea mays
cacaaatttttggactaactagtttgcccaagtgtatagattatacaggtgtaaaaggttcacactcagccaataaaaagacccaagttttggattcaacaaaggagcaaaggggcaaccgaaggcacccctggtctggcgcaccggactgtccggtgcgccaccggacatgtccggtgcaccagggggactcaaactcaaactccccacattcgggaattcccagaggagactcggctataattcaccggactgtccggtgtacaccggacagtgtccggtgcgccaagggaggtcggcctcaggaactcgccagcttcgggaaaagccaacgacccgtccactataattcaccggactgtccggtgtgcaccggactgtccggtgtgcaccggactgtccggtgcgactccggtgcaacggctatctccgcgccaacggctctctgccgcgcaataaatgcgcgctctgcgcgcacagatggcaggcgtgcccatactggcacaccggacaaggaacagtacatgtccggtgtgcaccggacacccaggcgggcccacaagtcagaagctccaacggtcagaatccaacggcagtgatgacgtggcagggggcaccggactgtccggtgtgcaccggactgtccggtgtgccatcgagcaggcagccccccaacggccacttttggtggttggagctataaataccccaaccaccccaccattcattgcatccaagttttcccacttctcaaccacttacaagagctaggcattcaattctagacacattcaaagagatcaaatcctctccaattccacacaaagccctagtgactagtgagagtgatttgccgtgttcatttgagctcttgcgcttggattgcttcttttctttctcacttgttcttgtgatcaaaactccattgtaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaacggggagtaggtttgagagaaccgaacctcggtaaaacaaatccgtgtgtcacacttcattatttgctcgcgatttgttttgcgccctctctcgcggactcgtttatatttctaacgctaactcggcttgtagttgtgtttatatttgtaaatttcactttcgccctattcaccccccctctaggcgactatcaattggtatcaaagcccggtggcttcattagagcctaaccgctcgaagtg

SEQ ID NO: 1018 - DNA, 128 bp, Zea mays
ggtttgccagtgccagtgagtagagatgtctcctagtagtttgcgagttccatccggcgtcgtctccacaacagcgacggcgcacgggtcttgaagggtattttgaattgcttccatggcaggcgcag

SEQ ID NO: 1019 - DNA, 563 bp, Zea mays
ggttggataatttggatatccatttctattttccatcgctagctataagcctataataagtttaattcaatttgtcctatttcctgcttcttcacctcaagtcctcaaactacatgttgtaaagatgaggaagtcgaacactccacgcggtgcccacctcttttcatgcactcaccaactgatcatttgttcatggttttcatcaccacgcgtgcatcaaaaaaaacctagctgataagctcaagccgcatctcacagaaggttcaagaaattatactgaaatcactgccagcgcccaaacaagtgtcagccgttcttgccatttgcatgccacgcgtgctgcaggcttacgtggcagaaacgttgcacggacatgctggcacagttgtcactcgccccatgaattgcttgccttgtgttgcatgcatggtcgctcacacacatgaatgatttcatgttattcgtcttgtatgctatataactgcagtttgtgttgacctccattttgattatctctatcctgtacgtgccgagagtccttcaaagccgacgacgagacgacg

SEQ ID NO: 1020 - DNA, 619 bp, Zea mays
ctataaatacccccaaccaccacacttcaaggcatccaagttttcagccattgcattcaatacaagagctctagacttcaagacacaaacaagagatcaaatcctctcccaagtccagaatcactccaaacaattagtgactagtgagagaaggagatatttgtgttcttttgagttcttgtcgcttggatcgcttttcttcttcctccattcttgttctcaagcaacttgtaatcaacgcaagagacaccaagttgtggtggtccttgtaaggggtctaagtgacccattgattaaggagaaaagctcactcggtctaggtgaccgtttgagagagggaaagggttgaaagagacccggtctttgtgaccacctcaacggggagtaggttagcaagaaccgaacctcggtaaaacaaatcgccgtgtcagccgctctatttctttgattgatttgttttcgccctctcttttggactcgactttatttctaacgctaacccggcttgtagttgtgcttaaagtctataaatttcagatttgcctattcacccccctctaggcgactttcaattggtatcagagccaggttcttcattagagcctaactgctcgaagtg

SEQ ID NO: 1021 - DNA, 201 bp, Zea mays
ggtgggatgagtgcatgtgatatcctggaccctaggatggtgatgtccttggccaaggcttaatagaattaatagagtatccatagcagcaagtgcatcttctttttcggaagcctatctcgaaagaacctccaagttaagcgtgctcgacttggagcaatttaggatgggtgaccgaccgggaagttttctcgggtgcgc

SEQ ID NO: 1022 - DNA, 160 bp, Zea mays
gtgccgtgccgttttgtcatccattgatatcatatatgcagttgtgttgcgtgtgcatgcaccgtgaacaacatttgactgtacgtaccccaatgtcgtcgtcgtcgtcgtctcgtagctagtgttcgtcgcaattgtggatgtggactccgttcgtgga

SEQ ID NO: 1023 - DNA, 357 bp, Zea mays
ggtacatgtataatttgatattgttcttatttctctatgatgatataataaagttaaatgaataatgttatataattgttcatactatcttttatgtttcatatgcttcgtctttcattaatatatactgtgatgatgaaggttcgtccttcatgaccttcgtccgaagatcgttatatcctaagggaaataatgcttcaaaggacgaaggactttatcgtttaacattctctgtgttgccttgttcttaactcatagcatttgagaacaagtccccaacattggcgcccacctccggtgaactcacttccatttccctgagcttttcgacaccttcgggcaagcatcagcttcgtc

SEQ ID NO: 1024 - DNA, 1225 bp, Zea mays
accggcccggcgcgccgcgcggcgggacggacagaaacacagccatgcgtgcgtgcgtgaatgcagatcgatcgccacgccatgcctgtcaaaatgtcactgtacatgctttgggtcgtttagggaggcagctttggtttggaattgtttgattctttgctctctctctctctctctatctctctctcagaatctttgcagtaaggtatagctggattaatgcaaagggaagtgactctcaagttcatgtcaacaatgcgcttgtctgtctgtctgtcgccgattattaaatgtctcattagccgtagactggctgaccagatcatgaggaccctctagagcttcgcatttgtttttgaagcacgtttgcagccacgcacagacagcttcttcttcttcttcttcatcttccaggatttcttcttctttcttcttcttcttcttcttttgtgttgagatacacaactgtcagggactactagttgacatggctatgtgactatgtctatgttctgagtaccgccatcgattgagccgtgcgcatgcatgagaggccagcggccagccagcagccaggccctacgaagcggtgtttgcacgccatggcagacgtgccgtcgacaaacaaacatgattgatatgccgtgatggcgtgatgcattgcatcatgtcttcaacacttggctcaagtggtggtggtctgaagagttggtcacaaaatcatcagaaaaaaatgcttaattatactgtgatgctgcagctgcacttctgttttccctgcaaaatgggggaagcataacctcagcaccaaggccaagaaccctatgccatgccatgccaccatacagcctgcagtgcagggacgacggcacagaatgacagaagaaccttgcatgcatggacatccacgaaccacaagccacaagggatgcgtattccagcggcatgcaattggcggctacgcctcggccaagacgggaaggcgagcgaggtgccaatgtgccatatgctttggaagcacagcgcaacatggccatggaaagcaaggaaccctacaccttgtaaagccccccacaggtcccagcccattgtgacacacctacaaatacgcagcaatcgcaagccccgtgcttcttgaacctcctccactccagcacgtacaagagctctcgccaaagcctaaatttagctacgacccgcgtagcttctcacgtactcaccaccc

SEQ ID NO: 1025 - DNA, 1500 bp, Zea mays
gggttattttcttttaaatatgctgtgtactagtgattgattttcttaggttttgataataattattatgggctcaagacaagtttgccctgtcgaggtattgcaatctactcagtaggaagcaagcaaagagggattgttctattctgttgacagtatttatttcctcatcccaatgtactctatccattctttggtgtaaatatgtattgcacattgtagaataagaaagttatcaatagtagagtttgattattgatttcactcagatcatgttgtcattaaaaatcaacacaattttagaagcatttttaatatgatatctaatgatgtaacttctgtacattgaaggtgcatataatttaactagtcggtagtcaaaatttatgaagtttgacctttttaaacaaaacacgtcaaacacaccgttcgtcatagggagtaatatcctaaccaatttctaaataccctaacgccccttaaagtgatatggtgtgcttattagatgcatagcatcttgtctggccattctcagatgtggggaatgatatgtggtagaagcccaaaaatccaggccaaaatcagccagaccaaggttatctgttactccctccgttttttttatttgacgccagtagtacaaacggaaagcatttaaaatatttgacgcggttagttcaaagtgaaacaataatccattgacttttcctttttttttgccccccttatcaagctctggactggaaaatttttcgggggggtctgatttgtactagggacaatttactctattcaagcttaccttactttttgctaacctatctgaaacgtcaagtatgtatttatggacggagggagtatttagaacctatgcctttccgctgtgcagtctgtacttcgtatcagcacccagagactgaagccttggttctcttttacatgagatggtggatttctgagccatttatttgtggatatacaagggtgtgttcggctggctacaagccgacactgttgcagctgtttggattgctgcagctgcaatccatagagagaaaaatactgtagaagccgcagccgcagccggattgcagccgcagcaagccgcagcgaacaagctgccaggttttcggcatgaccgtgccgccgtactgctcgatcgccgtgtccgcagcccgttggccgcgtggacggtaacgtctgccccggtttaatttctcccgtcccgatccggcaacccgaggcccgggcgggtgctgctcgtctgtgcccggtccggccgcctaatagctctcgctctcactagtcagtaggagtactcagtagtagtagtagtcactccactccccccacccggctgctctgctcgctgcctctgcctcggctatatatatacgccgcgggcgcaccggtccagcaagcaacaataaagggcggggtcgaagaggaagcttggagcttggaccgacccgagccccaccgagcgagagagaggaaata

SEQ ID NO: 1026 - DNA, 318 bp, Zea mays
cctgtttcttctaatgcttttcgctccatgtagcaaaaggatatttcctatttatgaagcacagagctgttgcttttgtatgaaatgacaacattttggttacactgatataatgtctaccatgtcatttttctatggagaaaaaaaacactttgcagatatcaaggttcaatacttagaaacaatgttatgccttgtttgtgttcttttacagtgtattgttgcattcatgtgtattaagctctaaactgtttcttctcctgtgcatatccatcgacttaacagtaatttgtctaggttcatccaaatgtcccatgc

SEQ ID NO: 1027 - DNA, 1500 bp, Zea mays
gacgcctcgtgcctcgtctcagagacagctacaaaccaaagaacagacaatttgtctccaaaaatttaaagtgaactatatatacgcactctcaaaacttaaaactctccaaaaataagtcaaggcaatttgcctgaaacccactacagatcgagggaaaaatgaagcttcagagcctcactaggatgatatatgcgcgggcgacatctaaaactattttcagatttaaagctctgtagagctttgtgcaggtatctaattaaagttgcatctccggagcctggcgagaacatgtacgggcaaccaatgctgacataaagctagtattttggtctgagactctgatggccttggccacaaccagcaagaaatatatccaggtgcctttaactagtggcggatcaataaggacttcagaaacccaaaatactatggttaaataaaaatatttatctaggaaaaaaaatgtaatgttcctttttgaaaaagatcatttgcgcttcaccgtgtctaaggggtgtctggtttatagtgactaattttcagttcctctatttaaattctaaattattaagttttagtttccatatttattaatttagagattaaaataaaataaaattgagtgactaaaaattagtgcctataaaccaaacaaccgcggtcatctaagggcgtcgtgaggtggatccaccactgtctgtcggtgtacatcagaaaaacggagcaattagggcgtctctaatggtaaagtcattatctataagaaacatgcactttacctgaagatggcatcaatagacagactcaatcttaacatgggttcggctgccgcagagctttattaattactccctccgtttctttttagttatcgctggatagttcaaatttgcactatccaacgacaactaaaacgaaacggagggagtacttccttacttctagaatataagtaatctttagttctcccaagtcagatcattataactttgaccaagtttgtaaacacaagcaataatatttgtgaaatcaaatgtgcttcattagatacactgtaaggtatattttcatggttactcattttaaatatgataaaattttaataatattctatcgaaattcgaccaagtttgggatattattacattctttggatttgaaacgtctgacaaaatcctaagaagatgaagaaaggagcgctttattgaccagttaaaactagtcgacagtttccttgaatcagtatttttttaagataataatcgacagagagaaactcaccccaaaaaaatatattgaagtgggaccacctacccaagaaaaaaggccgctggggcagtggggcccatcgctcccctgcctttaaaaccccctcgatgcgcgccgcagagctccatcgaccgcaccatcaaaactaactcgttgagagcggcctcctcaaagcccgcagaaaaaaattcccaagatcgtcgtcgtcccgagctcaaacaagcgcag

SEQ ID NO: 1028 - DNA, 1500 bp, Zea mays
tgcgtctgagagactgtccgcgtaagcggaacagcgtccacctccctcgtatttatacacgcgcagagggagggagaatcgtaaccgacaataatggttgcgacattagagccagaaactaatgagtcattggagccagaaactgacgtccgttactagccataagactggaaacagacgaccatcacttcaggcaaaatgcacaaccattagacatggaaactttctgctgatttcgtagactaacagggtctagtgggtccaatgcactcgagcaaatagaagattttggggaccctaccaaatggctattgggtggttgggggatataaatacccacaatcgaccccttttcggcacaagagctgtgaaccaactcctacaatctagagcaacaggccatagagatcaaaagcctcataagtaccaaatagagaaaatcaatcaagtgaaatccattctattgcaatttgtgatagcaccttgcgtgagtgaattagaggagggtgtgttgccgctatcttgtgctctcgcgcttggagttgtgaactcctattgattataaaggctaccaagaggctacgagtctatggagtgccttgcggagattccagtctcctggattgagttgagcaaaaagaaatgcctcaaatttgatctttagaatcacttgagagggttggaagagacatgtccctttaggacgctatcacaaaccattttcgtattcgtattagaaacaatacaaaaacaatttgactagttttccgaccatttttgtattttccgtttttgagtcatgatggcaccgttttttaccgtttctatataatatgagatacatttagcgtataatttttgcaagttacaaacttttgttgtgttcaagtgaatgaagaagagaaaaacaaatgttttaattactctgaataatatgaataatgaagaagagttatttgtctattttaatatcttgaaaaatagataatatactattttattatgtatttgtgaaaagtataaaatatttgtcttttcgaaaatagtttatcgttttcgatcatttttgaataaccaataactccgtatttcgatcgttgattttcgtttgcaccttgacaatatgaaaacaaaaccaatttagatgcttttttgatcgtgtgacgagcctcaccccatgatgaaaccaaacgcactttaaaccgtctgaaaattcggaaattgcgcccatttagtttctttcctccaaaatctccgccgggtccgtcctctcccgcttccgcttcccctcagccgtcacctccccgctcccaccgccaccaatcgcactcgcagtggctgttggcgtgcgctcgcgtccaaaccaagcaaaccccacaaatcctaccttccgccggcgtcgccaccggccgtgctccctccctccggccccggttgaccctagcctcgcatcaccctaaccctacccccctcccgccgctgccagagcaggggaaaaag

SEQ ID NO: 1029 - DNA, 203 bp, Zea mays
cgtcagttcacatgcatctcacttctagctatatatacctgcttaattaatgaattaattaattaattataataccatggaggaggaatgacaactgatcgagtgaccggacggataataatatctagttatatacactagctaacaagcaaaacacatcgtatcgccagttctggaagatcgcggcgatctacagtttcgac

SEQ ID NO: 1030 - DNA, 1250 bp, Zea mays
cgtcccaaagawttccaaggagacctcgtcctcgatgtgaaggtcatgtttagctacgtttcgttttcgcactttgatctatgttaatgactatgtagatgtctctgacatcatgatgtaatcaactattacctcttttatgttattatttgagtattgtgtgatgatgtccggttatataaattgttgtgtacgtgaattgttgatcctggtccgtacatggttcgcattcggtttgtcttctaaaaccgggtgtgagacgatgtcgatgctagcagacttcgcaccaagagatctccatgtaacagcgtccgccctctgcggtcccaattgtaagcgactcaggagggtgttaagttcggataattcagatttgaattgcaagtcactcaaaaaatagaaaacaataaatgcaattcatgttatttagcacatgttacgacatattttaggaacaggccggaattttcaagcaacatgctcacgaaacatgaacttgaacttgtgatatagttgtttcaaaattgtataaaacaaaaacaaagttaaaaaatcatgaaacttatcgacatgtcatgatatcatatgtcaaatttttatcaaagtctctacatatgaaatcatgacatgtcgacaagtttcataattttctaactttgtttgttttttatacaattttaaaacaaatagattgcaagttcgcgggcttgttttgtgagcattgtgctcgaaaattttagtttattcctaaaataaaccgtaacttgtgctaaataacataaatattatttttgcagtgacatgcgcaccatgtgtgtgtatatttatgcattcgagaagctcctagctagctagctaagagacgagctgaacagtcaacgcgcaattgttgagaattttccccatccaataatcacccgccatgatttggtgttaggatatgatcaaatttatggcttgctaaataagtatgtagtccctacaaacataaatgcgtttcgttctggctaatatgtacagtatgtagatttgtagcttaataaaatatcggatcgatcgacagcgaacctgtacgctgctaccactacctgcagcgaaaatgcatcatccaacaggctgcatgtgcgcgcgtctttgcaccatctccgcatatatataagtgcaccctgggtggtgaggctgagagcagcacagctagagacctctcttcgtctcatcagtagagagaaaggttaattgtggggaaacta

SEQ ID NO: 1031 - DNA, 1500 bp, Zea mays
ggaaagttggtaacaaattacagttagtaaatttcggtatttcaaaaacaaaaaaatctggaaaaaatatctcaaaatcgatttggaaatgttaacttaaatcagaaagcacacaataaataagtcagaaccacataactgttcacatccatatgcaaatattaaccatacaaatacacaatatatagtctcgatgacacataattgatcatatatgtccgctcataacttttaaccatacaatacataaattttaaacacacgatacatgggctatagaccctcggtcatgaggtctaaatcacctgatatatcttatatgatatctaaaaaagataaatatcacatataaattctcctagttcacataaagagatggaacaaacgtggacgctgaaatgaaattatattatcggattttctcggtaaatccgaaaacgaatagtagagatgtcgacacaatttgttgttccgttttcgaaacatctcatcacaatttcataccatttttcgtatatcttgataaatccagaaataataaattttggtaaagggatccgtgaaaataccagttttttccaaccgttctcacctctataagattcagggcatagctaatgggtggtctagataggccgtgacatacaccagtccacccgatcactagtccaccgatatctagaaaaaaccctaacaccatcagtgtattttgtgtttggtgtttagacaattttatattatatttggccttaaaagttaaatctatagtttcatatactatagttatctttatattctgaattatataccatataatttgtggattatattaaattatttataaaagttttattatagcaaacttaatggaaaaattctagctaagtcactgacgagccttacacgatcccttccagttgacaagtgactattattttaatggaaacgaaaagaaattggcaggcaccctggcgagccacctgtccgcacatgcgcggcgcgttggcgaggagcggtgggattttcgctcgtggttaaagttggaacgtgcaatttggaaagaagaaaattgcgacgcctgaacgagcacgaatatttcgtttctgaaatgccgtctggattatgcactaagcaagcgaaaagacaccaaagtgcgaaatgcacaattctccgtatattttgccagagactgacagcgagagcacatgtcggtcgagtagcgtcgccggagaaaaaaaagcactagtaaaccaaatgtccaaaacacgaggagcgtccatcttctccaactcaactgacagttgttggtcactcgcaccagccgcccagccggaaccggaagcggaaactgaagcgagggacccgggcaccggcgccggcacgattcactagatcgtaggcgcaggcgcgggtccgtctgtgacggacacggcggtggtggcgaggaggaggaggacttgaggagcgttggggtgagcgagcaaaccagatgcgctcgga

SEQ ID NO: 1032 - DNA, 639 bp, Zea mays
tgagtcttgtctagacggatagttattagaagaaccgaagatacttgatctacggaatccatcttggacaggaaatgaaaccgaaattgaccactaaactagacttgagctacgggtttatcttcacatataacatataacatcttcacatatagcatataatagtaaacaaaaccaatattgtctaaattgacgtaaatactcaattttggcattaaatttggttttccggcaaaaaatggcggcttactggtcccagaaaacggtttaccagtggttttcggtttttatgaattttttcaaaatttttaatttcaaacaaattttgaaaaaaaatccggtggtttaccgaaaccgcacctagttttttgggtaaaccgaccggtttactgccggtttttagcggttttgtaaaccatgatgaccatgctcaacattcaacaattcaacatagtgccatagtggacacgatattcacccatttcagccggcagctaggtatttcttttttcaacaagccagaccgccaggcgccagtagccattgagtccttgacccgaagtcccacagccgccgccaaaagggttcctcaccatcttgaacgctcgccggaccaatcccaagcagtcctcgcagcag

SEQ ID NO: 1033 - DNA, 1500 bp, Zea mays
gcacacaagtgacgacttgagctcaaatgacaaatcagagagtgcactactcgagtggagcccaaatcacttagcacaacgaagcgaatgcgcgggagcggagtctggatgctttagaatactcagagaatgcttggtgtacttctccatgtgcctaggggtcccttttatagccccaaggcagctaggagccgttgagagcaaatctggaaggctgatcttgccttctgtcgactggtgcaccggacagtccggtgcacaccggacactgtctggtgcccgatttctttccgccgccagagagccgttggcgcactagccgttggctcggccacgtgtcccgcgcagatcgcgcagccgaccgttggcctggcggaccgttggctcaccggacagtccggtgcacaccggacagtccggtgaattatagccgtacgtcgccggtgaaattcccgagagcggccacttcgctcgaaccagcctggcgcaccggacactgtccggtgcaccaccggacagtccggtgctcccagactgaacagactttggctgaacaaagccatctcatttccaatttgatttttcctgtttccagcacttagacacaatacattagtctctaaaacaatgtactaagtctgagaaacatacctttatccttgatttgtactttgtccaccattttacacttaggcacttgtgttggacactaaatcaccaaaatacttagaaatggcccaagggcacatttccctttcaatctccccctttttggtgatttatgccaacacaacataaagcatgtagaacaagtgcaaaatcaattcaaataagaatccaaaattgttttgattcaattttgacatatatggatcatcctttgccaccacttggtttgtttttgcaaatcaacctcaaatttctatctctaagtcaaacacactagttaaaacataaggagagtcattccaagagaaattgagtcaagattcaaaaactccccctttttcccataatcaacatttctccccacaagaggccaacttttgacaaaagagacaatacaagagttttgacaaaccaaaagctctattctactattttcaaaatttctcaagtggtagctgatccatctattgctttggcctttattttctccccctttggcatcaagcaccaaaacgggatcaatcttggccctttaaccccattgccttaccaaaatcttcaaataagagtaccaaggcaataagattatagagatgaacttggaataagttaccctctcatcggagtgcagtggaagtcttgcatggtccaagttcaccttttccctttcaattctccttcgagactaaatcaggcaaactcaagcacatggttagtctcaaagggtcaagttgtaacacatctccccctaaatatgtgcatcacttgcaaaaggacttgtgaggtccggggagtgcttgtacaacttgagcaccatcaataagcaacaaa

SEQ ID NO: 1034 - DNA, 236 bp, Zea mays
aatgcggtaagactggtcactttattgcaaactgtcccgataatgatagtgaccagggacaagaaaagagcgggaagaaggagaaaaataagaactaaaggaaggcaaagggcgaggcgcaccttggaaaggaatgggactcggactgctcctctttcgactctgacgatgaaggacttgctgcctcggctttcaacaaatcctcactcttccccaacgaacgccatacatgtctt

SEQ ID NO: 1035 - DNA, 747 bp, Zea mays
cccccagaactagaatcagattttctgattatttaacctgacgatctttggttgcacgctgaatggtgctaaatcgatggaaaatttgatggttctggttgacctggttcatggcttacaagtggcttttatgtaactgttatatcatccctgtgtatgtcaacatgctttgaatttgcaatgctcctcaaaatgaaactgtatttgcctgcatttattctgttcctgttagagctatacattttccggcttttatacatgcattgcatattatgatgtgcagcttgtgcatttgtctgaccattgcttatctaattcttatgtgatgtgaaacttgtgtctcatgccactggtaatatgtcatgatctgtgatagcatacaaggttagttctgcgaaactaggagctggatttatgcacagtttagaatttgaatttcacttactatcccagtcataacttgtctgttaacgccagtaaagtaaaatcagagttcaaagttttgtgcttagttgatctttgtaagcataagaaagcaaaaaatgattgtttttctgttttgtctgccaaagtacatgctgctgtatgctgatgtaggtattcatagttagatttccaatatgtgatayctgctaatctgatgtgatagccaactgcatgttgtgttgtgttctcactgttgtagtgatgcaagtattgtatctgaagtatgaacccttctactgtcatgcagagtgttaggacaag

SEQ ID NO: 1036 - DNA, 471 bp, Zea mays
aatggtgccattacaagttaaggtttggttgagccttttttctcagggccactaaaagtttatggctgcttgagtctatggattcatggtcatgaaaatatatttttagtgctttcttgcttcctgataacacttaatttatatagaattgttggtacctttgttggcatgtttatgttgattatgttaggtgatggtgattagaagctacaacagcggtttatgttattagttattcaaagacagggctctgaatcaaagtgagcttgtagtcgaatgccagcatactgcattagtgatactttttaaatacttcacctgattaagtctagataaacctgatcattttattgtgttatttatttgttttttcgcagataaagttcttccacaatataaacagtcttcctggacctgtagactgattctgagaagctaatttggaatgttctggaagctgaacgacctgac

SEQ ID NO: 1037 - DNA, 172 bp, Zea mays
agtaggatctcagtaacaagataaaacatttgcttttagatattgggtgaaaattgacataaggcagaggaaaaacaaagattatgaagactcagtctatgtttctcctaccgggactggctattggtcaatcactaaggcttatgcagttttccaagaacagtttcaaaat

SEQ ID NO: 1038 - DNA, 1257 bp, Zea mays
tgctaggatgaatagaagtggtgagaatgtttatgatgaccacgtgtttaagtttgtcaaacgctttttcaaagtccaaattttaggatgatcatttcttttttggactgtttgcataaatgtatgtatccaaaagagcaagccactcaatccataacgatttatgtgaatgagctcaccctctacagttggccaacagtttggttagaagtttcacgagcgaattcaagagtgagattataatcactacctcaataacaataaaggtgtcttatttcataggacaatgtgggacccatttatgctttgcaaatcatactgtttccaataattatagttggtcactatacacggtttttagcagacatggactcttgcgtattttccaatttacaaaaggaaaaatattaaaaaatagtaataaaaaagggaaaaaaaacaatggagacatcgtcgtcgtctccttcctccctccttcctggtcgcccatggattattccatagatacgacctagctgcgctgctacagcccccgcatttcccttcccccaatcctctcctccacgaacacgccctcccttttgcccgttcccagcctcgaacggcaaatcaaaaggcagatatatgagctcttggtcatcgtctccacgccccattggtagccgcctctgaaattcctataaaaaaagatatatgggtggagccatcacccacgccgccaagatcctgtcttcttgcgcggccagctcgtagctccacgccggatagatagaagaggccaacctttcctccccgcttgctccccttttctttcggcaggattgcacatcttcccccacgtgacacctgagaaagtgagagcatagatttcttctttcccttgccgttgccgcttccgtttctcgcttccattcctctctgctcgtgggtttgtcgaagataaacctcgcataaagcttcgttcgtcggcttttggtatcaatcggcagggctcccccgtttcctctctccaagatcttccccccttttcttctgtctccaacccgcggaaatccttggaggagttgcggaaatttgtagcaagaggtgggcttcttttcccttttgaccggttcttgatcaccgtctcctcaaatttctcacatttttctccgtttttccggtttcttgaccaaggacaggttttcctttccagctttcctgctgcggcggcctccgcacggtttttgatccggggagcgcacctggggcgcgcca

SEQ ID NO: 1039 - DNA, 578 bp, Zea mays
tcccctcgcctcgcgatcgccaccacagaccacaccaacaatcccctcccttctccccggggccgggcttgtcttcttcctcccgattcgttttctttttcttttcttccgctgctgcaaaatctcgcgctggcgcggcccgaggccagaggagagaggactcctcggatccttatccctcacgcatctcccgcctcgcctccgccacacgttccgcgcctctacagctctcgacctcgtctggatttttttccccgacccgattttcgcatcagctccttctgcccaccgggctcgtctcctcccctggtttctttttcgtcacttgtcaccgctagttcctttagagaaggtgtacccccattattccattagcggcctcactgacgagagagagagagagagattttggcgtgactatccagagtctccaatcttttacacccaaaactcttctcagctaccggtgcggcatatcgcccctgtcggcggcgaacatttgagttctcgcgacgtgtctcgaggattctgtggtggaagatcggatcttttgctgcggattccagttgccaaccaag

SEQ ID NO: 1040 - DNA, 1435 bp, Zea mays
agtagtagttgtggttgtaggtacgtcacgttttgtgagccctagctcggggaccttcatcacgaagacgatgatatataatcggtttcagtagtaccaaattctgaactggcgatgacgaacataacatcaccaacagattgaacattgatcctataatgatgaaatttaccataattggttttaaattaatggtgataattgaggcaatcaccagcgacgatgatatatagcagtgaaggtggcttaaaagacagactcgttcgactggcaaaaagccgtttgggcgcctaccactgtttgggctgctagcgtgagacagatctacattttttttttcatttgctaaagtgctcgcaaaaagccagcggaacgagttcaacgatgataactttttgtaatagtgatactatgtctttaggttactgcatcaccacttaaaaggagaagctttgacagatacaagtaggtgatgtgcgaagacacaactcaaaagaggcactttccaaatatctaaagagatgatatgaactttcacaaaagagaagattgaactatgtattttatttttatttttttgcttgcccacttaggatcttgatgattcattagccgatactaggtgccctttcataggcgctaggatattgatttacaaatttttacacttagatctgcaattagttgttaaaataatattatttgaaaaaggtatttagggctagtttgataatctcattttttcaagagatttctatttttgtaagggatattagttcatttttctttagaaaatgagaatcccgtgtaaaaatagagttgccaaaatcctttgggaaaatagagttacgaggattagtttgggaaccctattttaccgagtgattcctattttcttaaggaaaaatgaattaattttctttgaaaaatgaaaatcctttaagggctaatttgagaaccatatttttccaaagtattcctatttcccaagagaaaataaactaatttattttgaaaaaaaataaaaatatattggaaaaatgggtttctaaactagccctaaggttaccaaactagtactaggtggcaaaaattcggtccaaattaaatctgggaagcattctgtgtgttatttgacagctgctaccgaccaacccaagggcatgccgagagtggtcacgaacagtacttgacacgtgtcagctctccattggcagtgacgcaatcctgaacggaggccgcaagtggttcacgcggccacatggcgctcacacactggccatcaacttatccagtcagataaggtggcgcctccaactgcgagcgacgtatatgtttgccacgctgccactcgggcaagagactgctcgaccggaccgacgagcgacgaagcgcgcagaaagagaagaacctcggagctgagatggcacaagcc

SEQ ID NO: 1041 - DNA, 524 bp, Zea mays
ggtaatttgtgaataacatttgatgcagttagttaccttggggatatttgtgtttcaatcaatggacaatcgtacggtcgcaggatttatgctttgctctccccgtaggcgatggctgcgtttgttgtggtaggggtaggatcaatttatcctagtggggttgattgcacttaggactggcagtgtgtcgttgtaactttgtaataagaagctcgattgcgtggaactgtaaatcttrtctctggccagtggccactggccatgccatgtgggcttgtttactgtcgtgggtaaaaataaaatctgacaaacagtgtgatgttttgattgtgcctgcaggatggagacgaagaaagtggagtctgtccctggtcataatcacgcggggagtggatgataagatcataaaaatcagacaatcatcggtcacaactcatactgttgtgtctttttaacccctgagccaccgaggccaggagtgattgattggtttaagctcagcgcacccagagtctgtgacattc

SEQ ID NO: 1042 - DNA, 161 bp, Zea mays
tgtttggaactaactatcattattaattctggaatcatagttgcctagtttgattccgtaatcgcatataaaggtttaactgacagaaaaagttccctattgcaagttcagacagccagaatttggtgctcaatatctctctctcatcaccgttttttatc

SEQ ID NO: 1043 - DNA, 560 bp, Zea mays
gatccgtcgcccgcagggccacagcagccgcggcgaggtcgtccgtcggattcggaggctcaggtgagtgcctctttctcacgcaccttctgttggctcctcctccgtcctcccccaagcgccccctctcggccggtcgaatttccggggagggggattggggggatttgatatatatcgagagagtagtgtttgtcccccgattcctcatgcgtggcgcccaaaacctagagatccttttttgcgcccgaaaccttcctgagctggtccgattcggtgccgttagaggggatctgtgtacctcgccgccggccggcgctgtcgatctggttgtcttccacggttggtttccagacggggactccgccggcgcggcgcggcgcggcgctcacccgcatccgccgccgcttttctaccgcccgcggggctgggtccggctctgacggttgagtctggtggcgcaggcggaactgcaccccatggaaatggaatcgagagaacttacacgctgcttcgcaaccgtattatgcagttattactgaaaagataatacagtacct

SEQ ID NO: 1044 - DNA, 1353 bp, Zea mays
gcgacgaggccgcagctgcccatcaccacccaaccggccacacccaccagcaccaccgtgttctcaggtttgtgcctttctctaatttgtttcttttttatcgtttgtgcctttgtggtgtcgatgtgcccattgcgtgtgccggctcttagcatgattgctttgttttgatggctacctgtctttatgtaactaatgtagaaatcatgccaaaacacaattccccacaacataaaagataagaggaccctatttgtgagctaaaataattttgatagtcacaactcaccatctccttttgatagccttaggatcccctttttataattttgaccttacaatacaaaattgttctacggaggtcatggtatatcatcatattatgtattcaacttagggtttacctatttcgattaatagttacattgaaccaaattttggtcgttcaaaatggcagatttcgacatttgttatgactgttgagttgattcttgatagcatcactaaacactgacctatgtgtataaaagtgtcccccgttgcaacgcacgggtatatagctagtagtacttattaaggctacaagagtagtcccgttctgccactattcacattccttgtttgtgtttctcattctcatgttctgccatcccattccctcgtacatcccacgtctagctaaaattaaaaaaacacacatgtcctcaaggggatttgaacccgtgacctcacaagcaaagagccaagagtagctaccgctacaccacatggtgtgtttatgtctacatctatgacaggaaacacatctactacatctctcaccaagctcacttcactacaagaaatttgtccttttatgacaaaatacctaatgacaaggttagttatcgtcatataatgtcacataatatgatggaattttttgaatcgtcataatttcatgaggccatgaagattttatgacgatagtgttttcgttgtcacataagggtacgaagattcgtcatatattgtcaggcgccaggagccggtagacagttttacttttatgacgcttagatgtgactttatgtgatgatttggcggcgtcactttatgttttttccaaaaaggaccgtacccctttcatttccctccgaaacagagatccgcatttgatttttcatttccctccgaaacagagatccgcatttgatttttctctcgccctctcctgacctagtgacttctcgagatttcccattccggtgccgcgcgcgcagctcgagcaagaacaatccccaatctccaatcccaaatcctaacgattccacacccgtctcccctctgcatcccgctgtttcactgcccgct

SEQ ID NO: 1045 - DNA, 362 bp, Zea mays
ggtaagacactcatgagatcttcttttaagagcattatattattactaagctcgacgtgtgggcgccaaagctgaagaactctccggccggtctgtgcaggaacgacccggcgcagaagcaggccgggcaacctggcgcgctgaagatcgagacgctgtaccacgcggacaaggagaaggccgacgcatgcgtactggacctggtggtgtggctccacatcctgatcagctacagcaggccggcaaacaggtcgccgagccgatcccccgtccgttccccgacccacgcggccccgcgggtggtggtagcagcagcagccacttccgggcgccccgctgggctcacccgagaagagcgcgag

SEQ ID NO: 1046 - DNA, 394 bp, Zea mays
aagaactgagctttggtgaccggtgttgtgctaggtgctggctgaaggttctgatgcgcggttcagggaatatatctgcctgctcttagttcatrgcgaatgatggttcggtgggactcgacgccagcgaatctgccgtgtaaatagtttagaatttgaagcgtagtgtagtgctgtggaccaatgctgtctctgaacatacatatgatcagagtaatgtgtgtttgcgctgttagtttcagactccggaatacaaatagttttggaccaaattcctaaagcctgtttgtactgtggaacacatgaaagggctagtttgtattcacttcgatatatgtgttgttattattgagttccctggacagtgtttcaaatttaaacatcgtatttttag

SEQ ID NO: 1047 - DNA, 402 bp, Zea mays
tccctccgcggctccgcacctgaacgctttgctcacttctgccgtgtcgcctcaaccgccgaaatggtctcgccacagccgccaaaattaactaaccacgtcttttccacgcgggctcggcccacgtaaacaaatacgtaaacctaggcccacgtaaacgcttacgtaaagcctggagcacagtctgacccacgcagtagtagatgtgctttaaagtgcggcccaataagagaccactttgagctagaggcgagggcgaggtattcggtcaacgatcggtcgggactccggactcgggagtcggcactcgggtctcgacgtctcgtctcgtctcgtctcgcctgcccgcagccccttggcttcgttccatccggcttctcggcggcggcggagaggaggggg

SEQ ID NO: 1048 - DNA, 1500 bp, Zea mays
tggctagggacgatcgatggatgataagaagacgtgcacggacaggcacacgtagcaggttgttaccgtgttgttttgtgtccatggagtggggctccgcgtcggcgcctcgctttatcttcttccactgccgctagctaatccactagcttggccggctcaactcaagaggttgtttatattattaattaatttgattatttgaagtggtggccactcccatgtgccttgtggtagtacaaccatctctagctagctaggagcatccggccaatgcaagcactaatatggattatattggtaggctttttaacatatgtatatatatgtctaacatccttacccagccacttattggctagacaaatattgggttggggggggagggggggtggaagagagtaagtgtgtcgataaggtcattgtgtattttcatatataatcacatgatctgaaatcaagagacatcagagggttacaagcagctcgtagctacctaaatacagatcgagtgcaccaaaaggtctaaagcacaaccaaaaaacatagaccgaaagtttggaacaacctacaggacaggagagctagtgcacatgtattgctcccgagaggcaatcagaagtctgagactcaattctcctcagctcatcctcttcatttatcttcatcatcgctaaaacaactatcctatttagtggcgttaaacaacgctagcatatatgctgttaatttgggggtttttttcctttattaaaaaaaatttgtttgctattttactgagctggtcttcccacgtagacaatctacgtgttgtgagttgcttgttgcctcactttatttactgtttaattttgtgcaatctgctagtattaaatacttgggtgtgattgcactattgtgggtggatttgtttgctcaatgataatagcggtgtagtgagacaacgtgacagtctgagttttagtgtgttattaatttcagcatcaagtatatatttcgtgcctaattatatctctatttgttgaggttgtttacctgtgttaaattctgttattttatttagtacacaactccttactatttgtatttatgcttgattattaggcttattacatttgatctaaaaccctgatttgataagataggactgtcacgttagttgaggatctctaatgaccatttagcgttggagggctatttattacagcaacccactattttgagagcaatatcaaaagataaacaataatgtttatgtgcgtaatctgccttcttcatctgcaagccatgtttaatattgaaatggacctcagtagctattttttatatgttttcatgtcctagaattactacttcattgctgctataattacatatggcatttatctgagttatatgtttgttttattcgaaattaaaatatttaatatatttaaatatgttgaaagcatgtcacttatttctctaaaattacaaaaatctagaaaaccaatacgtata

SEQ ID NO: 1049 - DNA, 152 bp, Zea mays
ggtgtggcttttggtggaaaacatgaaagaacttcacccactgctacaatctaattgttttatatttttatcatgcatatctatactgttggtctgttggattaatttgagttgtgactatttctgttgatactttgcagcccagtacacct

SEQ ID NO: 1050 - DNA, 578 bp, Zea mays
acttactataaattagccttccacacacccttccattcactcgggtcatctttctgcacacagcctcacctgctcagcccatgctcccatcgagcgttaagtaatatggtttattttgaagctttaggtatcaagtaggaaaaatacactcatataatatattgtataaagagatatagatagaggtagagaagcaaagaagagatagagataagtagtagagatagatatagatagaggtagagaagcaaagaagagatagagatagctagagagatacatagagatagatatatagatagaaaagatgagatcgaggtagaaatagagagatagagtgcacaacataaaatttatttgatatagttcagaaagtacaaagctgctgatacatttgatatagctgacagagtatccaataaggatttgcatatccacgcattttctcagaatgctttagaaacgttagttgctgatggatgcactctggactatatataggtagacaagacaccagtgctctttgcttcctcctcacacaacgttaacaaagcagctcacttgagttcaattcagcc

SEQ ID NO: 1051 - DNA, 1117 bp, Zea mays
ctgctcaagcgcaggcagagacttggaagcgatcagatcatgatctcgctgtccaacttaatgctgacagtgatgtttggattgtcacctccacactccagagattagattcattagacgctccattgcttccacggtttttgatcgggcgacgggtctttttcagatttttacacccaagtagtaattgtctgccgtgcagggctgtttcagtggccgccacttcatcagaaagtcaggaaccccaagctgatgcagagattccaatccacccgcgggttccttggttagctgagttcctcaaaagaagaactggtagggttggttgagttcctgaagaatagagttcagttggtcaacggagtttccaaccggcctcgacaaactttgaaggaaggaagcatatagtagatgatgacttcactctttgcacaaagggcgtggtggatctcgaggcgttgggtacgcagtagaccaccaccagcagcaccgcaccagtatacatagtatgatgtaggagtatactaaagaaaactcctcgcccttccgcgtaccgcgcgcgcaaagcggtcgacaagcgcaaattacagtaaataaactccacaggaagtgacaccggtgtccgtagagaggtctagagaggaaaaaaatcctgcggccgcgcccgtgacgagcaaaagggtcggaagctgcaggggaaatgcaccatgcagcgcggctcggccccagcccccagatccaggcacgcaaccgagccgcggcccccctgcgcccttgtcgtcgccgcaccgtccgtccccgcccgcgtcaatccgtcgtcgtcgtcgtctcctcgtcaccccgcgagcttttttcaccgctgccctgccctgcccccgcgcccgttgacgtttccggcccccaattcgaaagcctcgcgctccccgttgctcccttccttgcctaggcggcaacgccctcgtgctttataacccagcggcccctcccgcgtgaggcaaccgagacgggaggagaccagaccagcagcagcccatccgaccccccgcctcctcctcctcctcctcccgggttcgcgtgaggctgtgtgctgctgggaggcggcgccggcgccggcgcc

SEQ ID NO: 1052 - DNA, 1151 bp, Zea mays
cgtgtggaggtcttgaagcttaaaatgtttatgtgtatgtcttatggaaaggcttcaccttttccaattgttgtagtaagttatgccctcgagtattattaggatttgtaataatttcaatcactttcatgttgtaaaacttgagttctggaatataaggcatattttgtaaaagtcttccgctctatctccaatgtgtgtgaataaaatgcgattagtgtaatatgcctgtaatgtgggagatccttgggatgatgagttcgagttgataaaatcgatagccttgttaggtcacctggtacacatgcgtagccatctgaggccgttaatggcaaaggattggtgcatgtgagcctgataacttggaagggctatcataaaagcgaaggggacgggtgagcggtggggtggggacccctgctgggtagcgggcggtgactggtgcgaagctggggtgtgtaggagacgatgacctaggtttggaattaaatgggccggtggcccggtgtaagtgcgagttgtagctagatagttccgtgctttcctaaccaagcagttcaattaggttcgggttagtggtcttgtttgggtggacagggcttctattaactacagagagcctatggcttgtaatatacatactatatatatatatactacattaattcaattgctagttaattctagacgaatttaacattagaaaagcgtaataatactcatgattttatatactacattaattcaacactaaactagtatagtttatcagttattaattcatctgacagcagtaattactttgttttgatgatgaatgctaggattttaccccaaaagtgtgccggattgtttgcccttttctagaagggaagcacgtagtagaaaccaaaaccagagccctccaggcccaataaaagcccagttcagactggataaaatgggtcgaaacagtcccggcggtccccacgacacgtcattgccgtggyccagcgctagtttccagaagcagccgcgagcttccaccgccttcttcccgtgcattttctcgagcgacggagcgatccgttcgggccgtccaccacagcgagagagagcggcagaggcgcagagcgcaaccgagcgagagagagaggacggcgacggcggag

SEQ ID NO: 1053 - DNA, 1500 bp, Zea mays
tatgggaaaaagggggagtttttgaagatttgagtttgatttgcaaaaacaaacaaagtggtggcaaaggatgatccatatatgccaaaattgaatcaaaatgaatttgaattttatttgaagtgattttgcacttgttctagttgctttatgttgtgttggcataaatcaccaaaaagggggagattgaaagggaaatgtgcctttgggccttttctaagtattttggtgattggatgcaaacacaagtgcttaaatgtgaatctatgcccatggatgaacaaagtgcaaatcacaagtaaaggtatgtttctaagccttagtacattggttttgtgtactaatatacttgtctaagtgatagaaacagagaaaagaagaaagaagaagagttggctgtgtacagccaaaagactgcttcggtctggggcaccggactgtccggtggtgcaccggacagtgtccggtgcgccaggctgcctcgggcgaagaggccgctctcgggaaattgccgacagcgtacggctaaaaatcaccggactgtccggtgtgcaccggactgtccggtgtgcaccggactgtccggtgaaccaacggtcggcccgagccaacggtcggccgtggaatctgcgcgcgacacgtggtctggccaacggttggaaagtggcaccggactgtccggtgtgcaccggactgtccggtgcgccagatctgcaacggtcggcaacggtcgactgcgctgtttaaggaaataaatcgggcaccggacagtgtccggtgtgcaccggactgtccggtgcgcccgacgacagaaggcaaggatggccttccagatttgttctcaacggctcctagctgccttggggctataaaagggacccctaggcgcatggaggagcataccaagcattccttgagcactcttgatcactcacacatcaatcttgcgcacttgttcgacattctagtgatttgagctccgttctagtgtgctagtctcttgagctcaagtctgggtcttgtgtgtgcgtattcgctgtgatctttgtgtcgtgtgtgagttgctaatccctcccttgctccgtgattctttgtgaacatcttttgtaagggcgagaggctccaagctgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccaccgtgtcatctctgtgattgttttcttgtggttattgtgttttggctcctctctagccacttggccataattgtgctaacacttaataagtttttgtggcttaagttttgaagttttacaggatcacctattcaccccccctctaggtgctctcaattggtatcagagccgttctcttcaagaaagggactagccgcccgaagag

SEQ ID NO: 1054 - DNA, 89 bp, Zea mays
cgcgcctccattcctctcgatyccctccctccttcctkgttcgaggacctccgcgaccgtggccgagggattgaggacggaaagcgaaa

SEQ ID NO: 1055 - DNA, 136 bp, Zea mays
agagggcgtttgtataaatttgttgcccacatctgggctgtgattgggatgtttttggcatatggattcaggttttctcattcacacctgtatttatcactagcgcagttatctttgattcttttgccagtcttgg

SEQ ID NO: 1056 - DNA, 50 bp, Zea mays
cgtctcaagtaccgtgaagctgggggtaccattacctgatcacccacggc

SEQ ID NO: 1057 - DNA, 489 bp, Zea mays
tttttaagaactttttctcgaaataagaagagagctgtttttttaaggagcctagttagaaaagaatgagccctagcaaacggacgtaaacagaggataagctgtagagagcgtcggcttctgttcgctcaccaactcgcagaatcgcgcgggtcgcaactcgctacatcccgcgggtgccgacgccgccgctcgcgttaggccactccgccgttcgcgacctgtcacttcctgtccgtccccctgccgcacgccaccggagctcactcaccgattagtccccacctcagaccctctccgcgcgcgcccagtccggcggccgccctgcccaacgctagggtttaggtggcggctgcagggtcacgccggcgccctccgccctccaccggccgccgacagaaggggtgacgtaggtcacctcgcttttccttggcgagccgtctgtctgttggtgtcggcccgacaaacgccgaggagggagacagcgag

SEQ ID NO: 1058 - DNA, 751 bp, Zea mays
ggaaaacagggaaaccaaaccgaagaactcggaactatttcctccatctatacaaggagagatgtacatagaaaggaagccaggagaggattgattgtatttttagtggtagacagcgactttgtatgctgtaattaacaggcagaaggtttcgacagacaggcctggcatccttagcaaatgcctcctatgcttctcatatggtatggcattttgccatttcctggttcgctgggggcactgtatcatgagcatatccaagagcttctcagaagtctcccctaaattatgttttttttttgaaaaatggcggttccttttaccaatcattctcactaattttttaaatgtcccttagaactgattttcaggagttattttgtacaacaggaggatgtttctctatcccaagtcaaaaaaatggcggggttcagctttgtccctacggactcgagggtaatgtagataattgaggagtttaaaatcccttatcattcaaaattgaatagtaaaggattttgtttccctcaattactcttcctctcaaacaagtaattgatggttctcgccaagtaaaacatgacgtctggcggagttcactctgcgcgccgccggcggacaactccgtgtgcgcggtgcaggtgctcacacggcgttccaccaggtgttcaacctgatatgatcgatccacgtgcggttccaaacacattacaaactgtggtgtcaaagatgcatactatgacggactgct

SEQ ID NO: 1059 - DNA, 1500 bp, Zea mays
gccatgccaagaccaagacatgcggcgtattgtcccaaatctgctacgccttagaattaccgagtctctacagaacacgtattccagaatccagatagaaaattatagaaagattatctgtaaacggttgggattccatagctatatcgtatttgtatctgttgcggagtctagttctgttggctggcctggccatatatatattgacatgtagggtggacagtttccataaactttcgtcctatacacgaggtaacgagtattcttgtgcaaaacttttagttaagttcttgacaagatattgcatgggctgtaaatagttcatcgcgaagctcaaactcataatctttttttgtcacggttcaacacgtacggacttgaattatcttgttttctctttagttcgcgaccttgtgttgaaataaacggacgagaaaaagagagtaaagaaggggttaaaaccaaaaaccctttgccgagccgaggatccgaggctaggatccatcggttcgtgagagcgttgctccgtgtagctacaattaaggaaccgtcgccgccgcgcgcccctgccctcgccgccgcccggtctcgcctcgacgcctcccatagcgatctgcttactcttttaagccggtggccggagctccggcggccctctccctcaccggattcggcgccctcttcagaggattcggcgccctcttcagagccctcgctaacctgctcgaccgctccccaccgcccgcggtcatctcccacctcgcgcgaccgccgtcctctcttcacctgttggtcgcccctgtcctcgcgacgaagacgccgccgccaagctatcctctctatctctctatctatctatctatctcatcaggtactacgtcacccttttcctttccttcctgctgtgtggaaccaaccaacccaaactatattccatccggaactgacccagtaaccagtattggttgtagacaaagaaagtacagaccctggtgtacagaggctgcgtcgaactcagcacctttggctttagtgagaaggtttctcaccactgcgcctttttgagaggttttcagttaagaggagaaagtcgttttatgtacaatagctgatgaggccaaagaagtaatatatacatggttcataaccattaacttcgattttggcaaagtttatcgcacccatgtcctgtattgagcctatccctatatctgagtgccaccaagaatcctagggcacaagtttctaataggaagggaagagtgcagctagtaaattggagaacatttaaaaacctttgttttggtcttttggaagaagacaactgtaagggaaatagggaacattgttccaaaagtctctttttttattgagtttgcatatattttgtaaacaagtatgatggatgttctatataggcttggaactgaacagaaaatccatcaaaatttcgcagattgatatcagctgatcatccctggctgtgtagttccatctgca

SEQ ID NO: 1060 - DNA, 1486 bp, Zea mays
aatgcttcttggcagccgtggtaccgagccagtgagctggtttgacctgagctgaaggattcccactgacatgaactccaaatcacggggcagctcaccagtaatcttattgtaagagaggtccaagcttgatgcgttagcaaacacagcccaaaaccattctggaatcgtaccggtaaggttcgagtacgaaatgtcaaggacgttaacttggttctgccagcgtagccaggcaggraatcgggaacccagctgacaggatgaaaactctgctacattcagttgaaacggtggcacccagtccggatccactctgatctgtagattgttgtcggacagatcgagagatgtcaaacttgttagcttgctgaagtgctcttctgacatgacgccattcaggttgttgccagacacatctagggaactcaaggctgcaagctcgcctatctccacaggcacagggccagtaaggtgattgccagaaacatcaagtagggtcaggctggtttggttcggcagccagttcaacatggtccctgtcaagttggcttggctcaggtctaactccctcagcttcctctctgggcagcttggtagcctgtccagcagacgcgctatgtccaggccaatgttggtgtaggcaagggtcagtgtgttgagactgcacatgtttctgaacgtctctggcaacatcccattcagatcgttgttgccaagatcaagcacttcaagtgaggtcatgtatcccagctcgcgaggaaacgatccaaacagtccgcacgcatcgagctggagactcctgaggcggctgcccaggtcccagaaccaccagcgggacgagaatgggccgctgaacaggaaattgttcgagaggtcaagctcctcgacggctgtaaggttggtcaggcgcgagagcaaggaatagatactgatgctgcattcatctaggtgcagcactctcaggttagcaagggcgttgatagcctgggtcggatcagccactgtgctcaggttcactatgttcaggttgaggtgctccagcaaagagagccgtgatagccacgacagatctggtgagtactggttaccgaggagcggattgttgaggtcaaggcgcaccagcctggagaggttgccgagctgaggcggcaccatgccgtcgaagtccatggcggagaggttgaggtacaccaagctgctgagggagccgaggaagccgggtatggtgacgcctggacctcctaggaggtttccgctgaggtccaggcgcctcaggcgccgcagggcggttatggaggggcttatctgcccacgcagccagtggttgccactgtcgtggtcgctgaagaagctgtcatgctgccagtagtcgttgcggaggtcgagcccgacgacggcgtggctcctgttgccgcaactcacgccacgccactggcagcagtcgtggccgcgccacgagcgcagccggcccgccgggtcgctggtt

SEQ ID NO: 1061 - DNA, 1500 bp, Zea mays
agtatggagagaaggttggcacgggtttcaagtgcaagtattatagagaaacaaagagcggagggggtgatacccgtttgaaggagcatctcacacatagaagcgcaagtattccagatgcatgcacatataactacaagcagaccagtgtgttattttttctttatcgataaatatttatttgtcgtttttgtttttctcataccgtttgtataggattatgtatacggaatgagcccatatctcaatccttctacacatgcttgagtactatcactatgactcgagcttaatacgtgagtattgtgaaaaatattgacctatgtcgtgggagaactctaaaagaacttgtatttgagtattgcaaagttcgatgattgtttgctacatgagaattgaaaattgtggttgcatatgcatgttatatgtcattttcgtgaatatatgttgtgtggatcaattaatgtttaccgtgcaacatgaattaagtaaaatacaaatgaaccttgtcgtttttttcgttttttctgtagtaagcttaaaatacagttattttgggcaaaaaactgacggttttaactgatttaacaacagttttccatcagtaaacctgtacagaaaaggtttaatttggattgcgcaaaccggtcagttttaccattaccagcgaggggcggttttcgcatgtgaaacggtttggtgaaccctgatagtggtaggattgtggttgatrggattgggatataagcaagttttaaccataacaataaaataacatttyactactactctatatgaagctattgtaggcgtccactcaaaagtgcaccacggttctgccccacgttcttcctcccccacgcgcccttgctcatggcccaaacccgccccgccatcagcgccaccaaatcctcggtcgacaccgcgccatcaacaccaccaaatcctcgcagggcggargagagttcacaggggcacgagcaggccgtcgctggagggaagaagcacgagcgcagacggagctcggaaggggctggaggaaagcctagagtccagagaggtcgtcgcctagaggtctcgaccgttgccgcttggagcttctctcaccgtaaggctttcttaccccgcgtccctactccatcccacgcaccctaccctctccacaaccaaccctgcaagatctgctcccatctctctccgtctcccccatcacacgaggtccgcgccctcctgctcgccgtcggcccatctcgactccctctgctgccatacgaaacccccggtctccatcgtccgaccctgcctcgatggctcagatccacttgctgccgctgccctcgtgcccctcactccctcgcctcctccggggccgcgactccacggcgaagacagctgcgagcggggtggccatttctaggcagaagcgtgggtggctgggctagcggattggttggttcaagtggttgggtcggctctaggaaacgccccgccgccgcggcg

SEQ ID NO: 1062 - DNA, 60 bp, Zea mays
agcaagatctgagtcatgagaagaatctagattcagatcttcgtctgcaacttcaaaaag

SEQ ID NO: 1063 - DNA, 165 bp, Zea mays
ttcgactggcgggcggcgggcgaatcacgcactctctgctgcacgcactacagtttttaataggaaaaaatgtgcggaagtgatgtaatgttttatattacaaaaacaattatgcagaagtgatgtaaaattttgtaatgcgcgaatatatcaagatcgtcttat

SEQ ID NO: 1064 - DNA, 176 bp, Zea mays
tgatttaacgttatcggtcacccatttgcgttacaaatatatgaaccaaacggcacattacttcaaggccgacgggctatctcactgatagtgataggaacagaacccgtgcatatttcagtcgtcgctcgcggagccgtggcgcatcgcgactcaggcactcaccgaccgcggat

SEQ ID NO: 1065 - DNA, 536 bp, Zea mays
gcatcatatgatcgaatcatgaactaattatgtttgatagatttatcttatcatttagtcatcatatgtgatatgtactaaatttaatctttttttgtttaatcttctcaatttttttttcaaccccacgcaaccgaacataaagagaaaacccagccagcgaaaagaaatcggctctcgagtcgtcggtcgtcgccgtgtcggtgtcgctcgccatatccccttttccccctcccttcgtctcccgactcctgcgatccgccccacctgaaccctactccacgtcgcctcgcctcgccggtaatcgacttccttctcttggcccttatgcaatcggttcgtactccatgctcggattctccatctgatccctatataccaactgcgccgattgtattgtcttaggttgggttgtggctgagccgatctgacccgatcgggtgggtccttgcgccgccgctgcgtgggctcatctcggtcccccgcctgctcggctcgatcggccggggacggcggcggcggcggctagatctgcg

SEQ ID NO: 1066 - DNA, 217 bp, Zea mays
cgtatgtgcacagatttcactccaaaaatgattccgatcctatgttaccatacgcgcgttgatctccaattggtcaccctgcactggttctggtttcatatattgcatattcactggtttaatcagtcaccttcttctattttctcttaataaacaggcccctgctccagctccaggtgacgacaagcagctcgaggagctgctgaggagagcgtcc

SEQ ID NO: 1067 - DNA, 1500 bp, Zea mays
gcagccgctgtcgttttgagtagtcagtcagagaggctcggagcatggaagcgtagagcgggggtaacagaggaatcatgctgctactacagtccagactccagagcataggtccactctccggtttcgagctccgacgaacgaacatgaaagctgccgctcggaagaagaagaaaaaaaaagagaggcgcaaatgccattattgtgcaaaagctggaattcatttttcttctgcgagtagtatactattactatccacgttgctgagcttcaaaccttcaacggcaacttcgcccacccgtgttccgtatcgcattcaaaggccccgcacgaacgcaagaagcgagaggagcttcctattcgccgttttaaagaagcaagagcagcttccttaaaactttggcagaaacctttaaccaaccattcaatttcacacaaatgcacgcaacaaaacgtttaatagatcattagccaagttgctaatcattattggacaaaataaagactgaaccaaattagccgagttgtacccgcggccgcgggtaaatatctttacccatgcccacactcgtcggattaggtatccatcggttttcgagttaaattgtcatctatacttaccatattttatataatttttctgtctaataatagttcttcaatctaaaaatctaactttatctacttagataaagtgtgacacagttatcacgaatcaacacagacataaaatacaactaacttgtttgaaatttcatggtactacggcctaggtaacagatacacttcaactaaatctcagtctatactagtctgcatccttctacccaaagctatttatcaatcacgcctcagatctgcctccagcatacggagtacgtagcttatgaaaaaaaaaggcaaagatgtaagcaacaaacagctgttctaaatcctactgcaacggtcacaattagaggcgttgattagcaaatgctagaaaaactgcaaatggccactttcaaattagcaacaaattaaaactagctagtaggtgccaattaaagattaacaattacacacacggctcatttcttatcatctcaagtttggaactaaaaggtgaaggaaaacatctaacagttatcaggtcgtggcctctcggatctggagcgtcagacgtccggcggcgagcagacggggcatcggacgaggccattctcgttgcagccggcgcaggcgcggaagccgccgccgcccttggcgctgtaccgcttgtggctgccgtcgcagctgccgcagagcacgtactgctcgccgccgcaccggccgcaggcggcgagggaggcggcgccggcgccggccacgacgcggcggagctcgccggcctcgtggaggcgccggacctcgtcggcgccgccgaggtggcggcccccgacgaatacctggggcagcgtggcgcgccgcggggacgcgaggcgcgggaggagcgccgcgagctcggggaggtagcgcgggtcc

SEQ ID NO: 1068 - DNA, 663 bp, Zea mays
caaatagagggattacaagtagagttgtaggaataatctgaaaatgcaaagtttctttgaatattaaattcttcctatggcaggttttcaacaacaagattcacatgctggaaaggaagtggcaagcccatccggcagcgcaaggggcgagcaaggcgtgggccgcgtggccccattcggcagcgcatgctcctccgatccgacggcacaggtccacggcagtcggtgtatgtcgttatcacgtacagttggatgattttyaattccgtctccgttagtccgtgcgtgctcttcttttgatatcgatctcttaccggtctcgattgctctactaatctgccaacgcgcgtctctaataacaataatatacgtacgtactaggtccctcgatcggtgggcctgccagttcggcgaatgagaggccatacatggattttcaagatagggaggcagccaatcacagcatgcatgtgagcacccacgtctgcagtcaccactcaacagggccacaagacatcaggaggcctactacgtgtacgtgcacacaatatccattccaccttggtccatcagcagcgagcgaacaggcaaaaaggaaaggccgagaagcgctttatccggccgtacgtagcgataagagtggtgcacccgtagcggcacggc

SEQ ID NO: 1069 - DNA, 630 bp, Zea mays
caatatttgaaacaaagttttagtgtctattttggaaacacaatattttcttagtcctaagacaataccatggtatttgagcataccatggtattttacaccaaaaggtgtttgaaacacatctaaaaactatgtattttaaaccatggttttaccaataccacaatatttttggggttaaaaaaactttggtcttgcacatagctatagccgtctcttccccactacaaatattgtgtcttcaaatatgtgtcggattgaacggtaaaatataccatagttatgttatggcatataataaactatagtattataaactttggttttatgaaacagagttcccaaacatacccttactctagcaccaaccaaacacctttaaaccataaatactaaaatactatggtatttacaaataacatagtttttatatcgaaacaccaaaaatactgatatgactgggccctcactacctcagctggtgatgggcttcgaaaaggatggaccgccccatctgtttggcccaattcgaagacacagcactgatataaccgggcgatgcctagggtttctcagtctttccctgccacagtcatcagccgccgtagggagcaggagtgagggagcgcg

SEQ ID NO: 1070 - DNA, 1500 bp, Zea mays
acatacgattctatccatatacgaaactggtgtattataataatcgagatataaaccacttgaatctctaacaaattcttataactgggggtggtggtggtaacaaagccttaacgaaacaggacccccgccacttgaatgagtacgaaacagcctgacggatgctcaatcggtttggtttggttgcgtgacaagtcgtcgatccggttagggagcttcacaccaaaggaaacttaccgacgcggcaaagcagcagcagcaacgacgacggaacacgagtcacataggaataggacgggacgacgggaaggttaggatgctgctggcctgcccgtgtaaagcgaggcagcaaccaccgcaagcgtatgacgcaggagcaagttgctagattcttcttcttgtccagacccagtccagctcggttccggctgcgagcacgttttccttggaccattggatggactggactggactgtaccgtggctgccgcgcgacacatgcatgtacgtgtacgtgagatggggacgtctcgtttgtccgggccggcgtttttggtgggcggagacgcgtgatcaggtcagggaggggctagtttggccccctagattcgcgcgtctgtgcctgcctccgacgcgcggtcgtcatcacgccgatgctcggctttcctctcctagacataccactcccagccactagcaacacagtagttgtagccaaaggaccatcgaccagggctgcctcttttctctggatggaataataaaaataaggctttttgtttaaaacagtggacaccaatgcggtagagccaactgtcaggtcggccccgctcgccagcgccagaggacccagccccccagctgcagtgcactgccacccaaatgactcacccaccggcgacacgcccgttccactgaccggaccaaccagcctgacccaaggccaagcgcgcacggcacgaacacggatccttccactgccactgccactgccactgccacgcgggacccaaccagccagcgaacgcctcctaggccacgtccgcgcggccgaacaaccactccggcacgcatccaccggcacgcggggccacattgacgggcacgcacgcgcaggccaggcaggcagaggccacaggcggtggccttgtggcgcggcgcaggagcaggccttgccgcgccggcgctgccttgctcgcgaagacgccagttcccaactatttgcggagccgagagccggaggcggaggcgttaagcgtaaggcagcgagcataaagcgccctggcgcccgcccgcccgccgcagccgcaccaaagcctagccaccctcctctgccctcgagtccacgtctcgtctcctcgctccactcgccagtcgccacccaagccggagcgaacccgctgcccgaatagagtaatccgaggagccagccaaatggtggtggccgcgtgagtgtagggtccgggggatatagagagagagagactaggggccggccgcg

SEQ ID NO: 1071 - DNA, 723 bp, Zea mays
gtgacacttctatttctcgggagaccagcggccctcggcagccttgtaacttgtccacgtcacccttatgggatatggattgcgtggtattgaatccgtttaaatttatagtaagtcaatattcatctcaatcaatttcaatacacactaatctatatgaaaaggaataaccgaacaaggtctagtagatttttttatatttagcatctatattgtttgattcaatccttgattgttgtatctacagctttttttccccaaacacgcttatctccaccttcatcatgcttgacatcaacggggaaaccttataatgttccataagtcattttcactgttgacattaaaatcattgacatttctttatgttgctttagtttagtgtgtgtctgtgagtgggttttgggtgtgtgttttgtgcgtgagcgtgtgtctggtctgtgttttgtcttgtgttagactctcgcgtgtttgagaaaaaaaaatcattgacattgttttttcagactcctatgtttgtttcatcttctctgacccaaatccaagacgcttatatgttgcttctgcacagaggaagggcactgtctattcagcatttcacaacactgctcgctctaaccacatatccttgtttctgtttcttacgaaatagatgctcctgtaggaagtgagcggtgcctaccagcggctgagcagcacaacggggagatctagagtccaacc

SEQ ID NO: 1072 - DNA, 47 bp, Zea mays
cgtgagtgctcgcgagctacgagcactgctgagttcaatccgcgacg

SEQ ID NO: 1073 - DNA, 1500 bp, Zea mays
ctagattatgggtcagattatataatctaaaccccaaattatgataatctcataatcttctcaagactagcttatttgagattattttggtaaaagacccactgtccatagttatgtaaatagaaattacaatatatgccatccttttttcccacctcaaataaataataagggtattgttgtctttgtgaataatctacattggtataatctaaactaccaaacaactacatatagattataatatatctagattataatctggattatataatttagattataatccagattatataatttataagttgaaacaaacaggccctaagccctgttgtttcagattataatctctccagawtatataatctagcgcaaataatccattaggtaaacaaacaactagattatgagttcagattatataatctaaaggccagattatgataatctcataatctcctcaagggtagcttatttgagattattttggcaaaagaaccactacccatggttatgtaaatagaaattacaatatatgccatctttttttctcaccttaaataaacaaacaagggtattattgtctttgtgaataatctacatttgtataatctaaactaccaaacaactacatatagattataatatatctagattataatctggattatataatttagattatattccagattgtataatctataagctgaaacaaacaggccctaactgactacgagaaatgagatgataatagattaactcattattcaaatcaaataccccgtaattcaaaccaaacatcccatgactcttcgtgccgcaagtccgcaactcgccaaaggttcgtcacgcctctacgcatgtgtcgccgttcattcccaggcgctggctcactaacagcccgttcgtttacataggaataaacctgaattcattttagcttatcaaaatttatataaattagagaaataattcggctagaaattattccggatctccaatccgtaaaaaccaaacagagccttaaaagtcaagtgaacgttttgtttgccgcactcgcggcatggttgtcttccaaacatggtttaaaccttcgtgctcacaattttgctcatgcggggcggcagaggtgattgagaaggggtttatttataataaatgttttgttatggctccataatacagtggtgtggctttaccgcttgggtcacctaggtaattaaacaagcaaaaaatggttaattagaatcttaatgccagatttatccacgtaacgacgcatcgagacccatgcaagggtaatgatgaagagtgcccacgaagcttgtgtgtccgcggtccgccttgtcccccacctcctataaaacgggagcgaagacggccctccccttggagacttgcaatcccatctgctccggacagagccctcgctccacaccgccggcgacctttttcctcctccgctcgaggagtgggccaacggagggagaccat

SEQ ID NO: 1074 - DNA, 640 bp, Zea mays
gatcctatatatactctttgcatcgacagagttaactctatagaatgagatcctacattctctttgtattaaaaagaatgcaattctccttttccgagtagttgaacaattacaattttaattaaatttatataaaaatagtactatatccatttgtaatatttgtcgtcgtccgcaagagagagtaacatttatgatgagagataaatattattagataagttatagaatatatatatatatatatatatatttaaaaattagtgatataaatattattattatttattataaatttaattaaatttaagctagtttgaacatacgtcatatattgctttatggaccgactgagtcttatattcacattcgagtcacgtgggagtgtacaaatcttggacacttggcgtgcatgctcattcggtatgatagcttccgctggaccgctagtgggtagtaggggtgcatgtcgaccacgaccagcatctactggggatcccattcccatcccatctactgtgtatctccatgcctataaagtacattcccaggcaagactagcatgtccctgccaccagcagtgcgtgcactaaacacaaactaggcagtagtgcactctacctatagctctctccgatcc

SEQ ID NO: 1075 - DNA, 370 bp, Zea mays
cgtgaggggtccagatctgcagagcgagccatcattcaatgcgtgctgcacctgcatgcatgcatgcgctgtttctagtttctacaaggcggtgatcgatccagctggcgattcaattgtggttgggggtggcctgtgtattctaccggtactaaattgtaattgttgttttttttacgattcggttcatttcctcgtcctctttcttcttctctttcggattctttcggattcgtagcacagattgtacaaggaggggggcagcagttagtaataatctatagcatacccttttcatgtcacagaatgaacaagtctgttcgcctagctctcccgctttctttctcacctctctctctctctgttctac

SEQ ID NO: 1076 - DNA, 1500 bp, Zea mays
aaataccatagtattggtgaaaccatggtttaaaatacagagtttttagttgtgctcccaaacaccttttggcttaaaatatcatagtatggtcaaataataccacgttattatcttgagactaaaaaaatactatatatatatatagagagagagagagaggatggatgtgttgatctatatttatttattttgtttacatggtatgacagtcccaaaaacagcgtcaaaactctctgtcaaaaagaaacacctatgatcgagaacatattccttttattgcgttgattgtatttgaaatatgtgctgatattgtaaacattaacatatttgttacaaaaaaaatattcatagttaaaaaaatgtttggtttacaaaaaaaattaaaaacaaagttacaaccatgtatatgtatactccatttgaatttataaggcgttttagattttctagatacatagtttttcaacttgcttaggtatacacatatgctatatttagatacataataaaggcaacatatttagaaaaaaacatattatggtttagagtataacaaaggaaggattacagttgtttgaaagcgttgttttgatctgaacctcagttcctttgaactatatatatggtgagtatccgaggtgtgtgtgtgtgtgtttgtgtcaatcatatctatatataccaccaggccacctcaagttgtccatatatatagtggccagaggagaatgatgtcgcttctttatatatatatatatatatatgcaatgcggagcgtacggagtacgtcttggcgtgcatgcaggggtagctaggttcctttaacccaggcaatgcaaactcgaattttatccacggctgtcatcatctactagctagatacacacgagcacgaatgaccttagcttagctagctcttgtcgccggccgagaacagtctaagaacaaactctagtttctagtctaagaacacacatctacttcaacatacactctctcgtgagcagcctttcatgccttaaaggtgaaaatataagccaacaatagttaatcattttaatagtaagttacatgcatgcacaccggccagctaataaaagcaagccgtcctcggatatatgaagagatttgacatggatagatgtcttgtgtttgtaatattttcgttacatattctcggccaattattttttgttatcactattgtgtgattctagaatattatgtatatacacccgcacggcacgacgaagcgccgcagggtagcgacaaaaaggtcacgtgagtgcccgcggtaccgggagaccacgactatatagatatgggggggatcgagtccttggttcctggtcctccattcaagctccactactccacacctagacttcccaatcctccattgggcaacctgtcacacagtacgccgtcgcctgtggtttggtttgtggagtgagagagaaagagagagagagacatagactcggactcggagagaaggag

SEQ ID NO: 1077 - DNA, 1500 bp, Zea mays
catcagtctctaaattaacaaacgatgtgactaaaattgaagttaaactgttttagtttttagtacctcaaaggatgattaaaatagactaaatcatattaatttcacttttttgacttttctttattacaattacattaatgacgaaataatgctaatagatattttggtgctcttataagtcatttaatgtattagagactaaattttagtccaytaactaaactttagtccactaaacaaacaaaatgggcccttagtggaaacttccttcgccaattgcgtgacctcaatgatagatcggtagagtccgccttgtttgaccgggtgttattcaaagttcggacacacatggaaaaggctggtgcctgccgtcacatgcagacacaccaaacagaaaaaaactaacgcagccacgctcgaaatcaaacgcccacaagaaacacacaaatcttccatttaatcgttcctcaacgagattcggtggtcgcgcgttttcttggatgaaacatggtgtgtagggatttcacttccctaacaatttacgatcagatcataggagtatgaccagttcgtttcatacgaaataaaatcgcaagagagaagctgatttgtctttaaaaaaaaatcaacctcctttaattattggtcaatcaccgctaatgcatcatcacgtaagtgctattacagagttgagaaaatccttaacatgccactgcaattttacgcaatatcttatttaacacaaatgttttaatctttttatgttactcagatgcaatttttatctaccatcgtaggtgttatataagggtaaaaaattgcatgtcctaatattttctataccaatgacgatgatataaaaacataaaattttatatctgagtgatataaaagagactaaaacaattacgatcaaataaattaccaggcaaaattatagtaacataatttagaaattaaaatcagttttcctaatttttattgtttggttacacgtggattgaaatttagaattagaggtctccaattctctggaattagactataattagaaattatctcccccaatataaagactcatccctcggtattgtgtcgatttacaccgtacaatttaaactctaattcaataacatttaaacaatagaattgaaattacatttcatttcaataactttcaatatcatacatgatttgatattcaacctatttaaattccatcgtctccaatatggatgtccaaacgcagcattagggattacacgccccacgtgcataccaccgttgattgcctatccagcggtgctacgcgctcaacagcaggagagaggatacgagttcgtcttcctcgcctcgaatccctctttcttcgcctgctggctctctcgtcgtccgttcctcgtcctctccggcattcgaggatagtttttcgccgggggcggcctagaaatcagccgtcaggtgaaccgggaggggtggttgcctgaggaggaagag

SEQ ID NO: 1078 - DNA, 971 bp, Zea mays
gaatatttttcgtccgatagtttatttttaactaaaatgtgtaagtaaaaagaacagaggataaatcgtatgactttaacgtcacgtgtcacgccacttaccttaagatcttaaagccgtaataataccaaatatatatggtgtaggcatgaaaataaaaaaaaactgcaatattatttaaaaagtgtcggtctaattttacattcttaaagtaccgtaaatacttactaataacaacgaagggtctcatggcacaatggcgaaggccacttgttgatagtgctcccgcagggacggcagggttcagtacacacgaatgtttagtggtattgcatgttcacaggcattagagttctagacctcttaatttattcttagcttgtaaaggatgcgtatgtggtgtgatgtgcagcagtgtgagctagtatcgttcttccttgtaccctctaaaaaattcttactaataatagatttgttagttttaataatttggtatcgtcgtttattagctttataagcagtttatttaatattcgtaattgaatttgacgtgacatgagtattgatagtactagccgaggagaggagtacgtagacagagggcagcagtgagtggcgtaggctgacccatccccatcacacagcgggcgacatctgccatcaatgcggccctccacagcctaccccgctcgcattcattgcacatcttgtcctcatacctctcctttccaacacctaattaatggcgcgcccatacgtgcctgatgctggctccaaaccccgacccttttcatccctccctccctccctcgtcgtctcctgactttgctcgccggccgccccgcccacaccctcctcctgcgctaccactgtcagcaagtgcacacccttcgaggacagctgctgtcgccgccaaggccgcaaccggccgtcgctccatgctgcggtagaatttagaaacgagaagggag

SEQ ID NO: 1079 - DNA, 400 bp, Zea mays
ttgaatgaagtaccaaagagagcatcggtgggggggggcctcctccgagctgaacttcgggtgcaaagagcgatcccctcagatcagacgaacaaagcgatctgaaacattcagagctggaatacagctctgccttcgcaccctggtattcggagctggacgtcccgtatactttggacacgaaggatggtggcaggcagtgtctgtttaggttacagcagagacgccagacgatgtggctaactgtttaacaaaattgtagctgtaaaaatcgcccatgtcagtttttttttggtgatgcataggttttactactacattttgatggaaggttgttagtgcacccaacacttggtacggtgccatcagttgatgtaacatctcactgatcgagcggttt

SEQ ID NO: 1080 - DNA, 771 bp, Zea mays
tccggaggatcagttttagttttcggtcgatctgcatatatcaaatgtctgtctttcttcatgtgattagtttgtacatttgtcctaggactcatttacctgtaaagcaacggcacacaaaaacagagagggaaacgcgtgcgcgcacacacaaaaaaaattgaaaaagagaaataaagccctggtgccagcttgccaggtcagccacgaggcgccggcgtccggcgacgtgacgagccagaacagaaaccgaacgccagcgccacgcacgcagcagccactgaaatctcaaatacaaaaaatcaactcacggcccccgaaaactcccgcgctctccgcaggcgggtggacgccgcggcgcgtttgcggcctcgcgccaacactcccaatttttttaaaaagaaaaattttttccccaatctttccctcgctccctccccctccacggagtgtcgctgccaaaactcgaacgaatttccaaatcgaggccgccgcgatcgaaaccgggaacccaaagcacccgaggctcttccctccaaccggagctctcccaaatccttcgaatccaaaaataatggcggcctcctctccctcccattccccccgcccccgtccgctacttaaccgcgcgcccgccaccgcagccccaatcccctcctccgccctccgcctcctcagtgctccggcgcctagcgacctgctcctgcccccgccgccgccgtgcacgcacagccggagcaggagcagcgctgcccgcctttaccgttgccc

SEQ ID NO: 1081 - DNA, 906 bp, Zea mays
atccgaattcagaagggctgcatcctccatgaccacctgcctgcaccccgtccaatggttgtgaatattccagtcccgatcagatcaaataagtcatcaactattagcagcacatgaagactatcattgtgatagctattattttgcgatgattatgcaactatatggttccaacttgctagctccaggcataccaggcctgtgcaccttttacgggtgtagaaagttatacaaattccgattgtcacgaggtgtggtgtgccctaatcaaagctaaaggtgaaattatcaaaacaatacaaaatcgattgtaaagaggtcttgaagtttaagacccattaaattttctatcaataaatgtagtctaatgtatctatcattcacacaaatcttcttttgcgacccatgtcgagactctatgcttttatgttgtgtgtctatctaatataattataaagctcactatctaaaaatctaatacaataaagtattcccaaattagaattcgttgtagtcttttagtggatttatacaataattcatgtattttatacaataattgatttatacaataattgatgtattttgtatatgcttttatgttcgctaatttggtttagcgcctatttttggatcccagttgctaaaatcagcactatgtytagatgccaattagaaggtgacatttaagccacatacagcccacgggccacggggaccgagcaatgggcgcatgaatgggctagcacaccatccggcccatgtagccacgtcgttctgtgggcagctcatataaaatgcaaccccagtatccggtagggttttcctctcgcgccgccgcggaacacaacaccgcaccacactacccagcggaatccgcccacccgcacccggagcagaggagat

SEQ ID NO: 1082 - DNA, 706 bp, Zea mays
gtttgctacagacgaattagcaagctcttatacgaaaatccatgatctgggttattgggggtctgcttcgtagcccaaggtcctgtaagaagaaacaccttcggaagatcagcacgcaaataacgccgaagctaccttacagggaacttcggcataacaacatgcctaagatgaagagttgcatagacttaaagatgaaaagacatattgacccatgatagtttgtgtcatgattgtaattgattgtaaagggtataaatgtaatctcacacaggctacaccctgtgcctataaatagatgaacagtaccctcgtattgttcacgctgatttgtactcgctcgtgcatcacgcttgtactatctccttctgtcaagccgaaggtacaaatgtaattttgcattatttttgtttattcataataataatataatagaagatgagttaataatgttacataatcattcatgttgttttttatgtttcacatgcttcttctttcattaatgtatattgcgatgatgaaggtatgtccttcatgaccttcgtctgaagatcattatatcctaagggaaataatgcttcgaaggatgaagggccttgacctttaacattttgtgttgccttgttcttaattaatagcatttgagatcaagtccccaacattggcgccaacctccggtgaactcacttccacccttgagctg

SEQ ID NO: 1083 - DNA, 1479 bp, Zea mays
gtacctggcagaggtacatctttttcgatgtgacccccatcaaggcccctgatggatccaccatccaagttttattttgaaaaacttcccatcccaatctgtagcatcacttttgtttggaaaacaaaacattttgtttttctaaagcaaggctaagcatcataaaaatcctttttataaaagggaatcaaggaagggtaatcaatttttaaggaaggaaatgcatcaacggtttagcacacaactcctatcacctaatgcatcatataaggtgataaagattttaaaacaacaaggaggtggcaaatgcaccggggcttgcctggataacactacgttagtgttgttaggtggcgaccacttggcgatcatctcatatcttggtacccgttcaatttatccatcttcaggttcgtccatcagcatcatcttgtggagaagctcacgcgcagcgacatcttgtggtcgactcagctttggtccttcgcatcacgtgattaattaacgtacctgaatgaaatgcatataaacaggaatatcacaaacctaaatagtgctacgcgatagcgaattaaaagcctagcagcgaggcgtcataccatttcatacgaaaacactagttatcaacgtatgactaagcgcaatagtcgtgcctttctaacttacccaaatctcattcaaacatcatagagttctacaaaacgaccttcaaaacaaccaaagatctaaaccgcttatgtgaactctccactgacattcctcgggttttcacaagaatagacttattgatgttcttcgcttcctaaatattttgtgtaacaacaattatctatttatgacacttaaccaatcaacaaacatagagtttttcacaagatcataatttagatcctaaagagttaaatcattaaggtgtaaagtctactatgtaggtttcagaattcacctaaagcgaacctgatagtgatacttgctccaaactaattaaaataatgatgaatatttattcatgacaatttacttaagtgaccaaattcaaatatgacatttaacttgatcattaaaaatggaattcgataactactaaggtaatgcatcattcaaccacttaattaaaattagcataatcaatttttaaaagaatctatcgactagtcgttagaaacactagacctattcctcattttattacttcgaccactcatcggatacgaaacaccgatttaatccttctcgcataacctatgtcgttaaacctaaacttagctatgcagcacgacgacttcgcaatcggggacacaattaacatgctgcaggtagccccgtattcctacaagcgtcaaataaatacgtgcctgagctacaagcggaataatcgtcgcgacatacatacctatcaattcatttatcaaactagtcaataaaaatagcaaagcagctcaccgttccaatatctgactcgaatccgcgagatcggta

SEQ ID NO: 1084 - DNA, 1500 bp, Zea mays
gttccattccatgtgtgcatctgcacatagtggcggctgaatgttcattagccaatcctgtcagtgtgagatcatcatgtattgtcacccttaaccacattgaacttatttctgttgagcaatctgagagagttctgcttttattgtgaccatgggtactcttacttagtctgctacatatgtyaattaacactttgcttgctgaaaagctaaaaccgctcaggggtgtttggattcagccactaaaatttagttgaggccgaggccctctttgagctctacaagatmagttgttctatcatcgacgacgacctatcaaccaggtgcattcaataaaattcctcttcgattcctgtatctgtcgtgcatattcttgtcattcatgacgtgatttggggttgatttgaacatctatttttttgaatgaaacattccttgcacttggaagatgtgtttttttgttgctttaggcctcggacaatttctttggatttaaatatggaggaaatggttacaaaagacctgggatagtgacactctgtcatcctaggctaatgagattgagcacctggtaattccagcaacagattacctctttgaaccttcactctaggatatttctcaagccatagatttcatccatagtaagttcttgccttttcttgtttatttttaatgcaaaaattacatgatagcaaatcgataccttttctgaaacataacaccagtgctgatcagttttctattattttgttttccttgcatccgtggtaccttttttatatggatttttcccaaacaacaaccgttgaatcataggtaggagagtttgttgtggctgactcaaaaacttagggaagcaaagcaagtagtagttaacttagaaaagggaaatatgttattattttgatcactggtcaactaatgtttatgttattaggtatgcattgccaatttgattacgatgtggtaggtatggttacaaagaagttgcaacactatcttttaatgcatagtccattcccaacctccagattaaggttctgttagattagtgtagattttctattgaaaaatatgaaatgagactagccattacacaatgtctgtcagacattcaaacaaactagaaccataaccaatcaaaacacgtctataatctaaaattcttgctttgtgtcaaacaacaacccatgacagggtagacttagctgaatgcatagatacgtttgccaaaaagttatgcatatataatatatattatgtacatatatttaaaaagatgacacaaaatgataggctattcaagtaatcaacccaaaatcatacatacaattagtattgtgtgattttaatcaaatatacattacagaaagtatgatttatgcgatcaacgatttttttaccctttgaaattttgaatactcggtctcaaattggtagattcagcatatagttgccttttcagggaatgcatcacaaggtggtaccacattaccc

SEQ ID NO: 1085 - DNA, 266 bp, Zea mays
ggtatactccctcgaggagatcgtcgccatggtgctccactacgccgcggggctcgccgatgcgcacgttggggcgcccgtgcgggacgcggtgatcgccgtgccgccctactttgggcaggccgagcgccgggcgttgacgcatagctgcgcagctggctggaatcaacgtgctttctctcatcaacgagcacgctggggccgcgcttcagtacgggattgacaaggacttctccaatgcgtcgcggcatgtcatcttttacgac

SEQ ID NO: 1086 - DNA, 470 bp, Zea mays
tcgccgccgtcctcttgttacccttcttcttgcgcagtaagccaaaaggaagaaaaaaaaactcgaagcttccactcgcctcaacaccaaccgatcagccggaggttttagggttttatggacagacgccggcgcagcggaaaaattacgagcctgcccctttgagatcgttcgccgcgccaacgcaacgtgcgccggcctctcgggtgccctctagaacgttcctcgttaactgatctgggccgagcctcatgtatccaggtggcccactgtcaagcgttttggagcccgctaagcatgagcttctgcttattgatgtgtcgttgaaagcccacggaccatttatccagcggcccaatccagcaggtgggttaagcttgggagttgggagtgacaccgcggcacctccactgcagtagtcttgttgccggcggcggcggcggcggcggcgcggagaaattcggcgaacg

SEQ ID NO: 1087 - DNA, 470 bp, Zea mays
tcgttcgccgaatttctccgcgccgccgccgccgccgccgccggcaacaagactactgcagtggaggtgccgcggtgtcactcccaactcccaagcttaacccacctgctggattgggccgctggataaatggtccgtgggctttcaacgacacatcaataagcagaagctcatgcttagcgggctccaaaacgcttgacagtgggccacctggatacatgaggctcggcccagatcagttaacgaggaacgttctagagggcacccgagaggccggcgcacgttgcgttggcgcggcgaacgatctcaaaggggcaggctcgtaatttttccgctgcgccggcgtctgtccataaaaccctaaaacctccggctgatcggttggtgttgaggcgagtggaagcttcgagtttttttttcttccttttggcttactgcgcaagaagaagggtaacaagaggacggcggcg

SEQ ID NO: 1088 - DNA, 710 bp, Zea mays
gtcttaattatggcctcttaggatttgctcataaacaggcccctattgcttgcattgcctttttttgttttggccaatatgctcctacatacaactatagacaacgacacttctggaatttgttagaaacaaacattaccatatttatgttggatgttgatgttagcttgcttttacgcaggatcgatgttgacggtaaaagtgaggaccgccgtacgtcaacagagatgcgcagccctgcagtagaatacaagacatgtgatcatcgtattactcccagcagcagcaggccggatcggacgggacacaataagctagaggaagtagccaagtctgacaagtcttgagagagcatcgcgtccatgattggtcaagcatgcatgtcacggacaatagatgaccccgtttgtatccacatcattgtctagctagctgtctgctgtcctctttcatctttgcatccatccattcatccatccccccacagtaagcaaagcaggcatgcatcttcatcaagattaaccaacaattaatcatagctactcatggagctagctactgtgtgtgtgtgctcgccccttttcgctagctacacgcctataaattagaggcgcgtgtgtgtagtctttgcctcaccgagttcgtcggtcgtcacctgatattttttccgacggacacacaagcatatatacatacacgccgacataggg

SEQ ID NO: 1089 - DNA, 1197 bp, Zea mays
ctgagctaatggcgccatttcccctccagctcccctcttgcacctgcagcaagagatcaattcaatcagatcgcggacaggagtcttcctcctcctggcagctggcacagacgctcacctgccggcccgtccggggactggaacggcgacggcggcggcgaccggtgactttgttgacccggttgatgtcgccgcgtttggcgggtctgggatttgtccgcgccggaccgccgaacaaccggcgactttcgacgctggttgcctggttgagcgcgtggtttggtgcggcttgattgctagttacagcgacgggcacgtgttggacacatttctttctcctagctgctgtattgttacgcgtctcatgctatcttacttcttattttaaattttacgttataaacagtgtgatctaatgttgttcacttttagattaaagtcagtttttccagactgcttcagctataattcatagagataacactatagaaacagtaaatacaaattaaatctaaacaaatagcctgaaaaatgtaacataaatatagttaggatttattatggaagacaacatcatccatgcatccatccaatctctcgagagtcgagagtgagtgagaatcactcgtcatcaaaccttgcttagcagctgtgcaagcaagtgagaaacacccactctatgacgatcattttgcttcgacatcgtcacggaattcatggaacgggatgggacgaggggaacagcacagcagagcaaagtggagagagataggcaggcaaggtaacaacagcccagagagagagactactagcctgccaatggtctgtgggctgtggcctcctctcctctcctctcctctcgtcttcgtcccgatcgggcgtccgggccagcgcgcgcgcgagagagaagagacacagacagcgagagaaagggtggaagggaaaaaataacagccgagccgacccagaataggaggaccacttcccttccctccccctccggccactacgcccctcttccccaccgctcgcccgcaccacgccggcgccggcgccgtcaccggagcgagcggccgcgacccggaggagcctccgcacccccgccgcgccagatctggccccgcccgcagcccccatgctccagatccgcctggcctagccacgaccggccgtccgctccccgcgcccccgcgtgcc

SEQ ID NO: 1090 - DNA, 631 bp, Zea mays
tgcggcgccaggtactactccgccttctcgacctcggcctccgcggtgcccgcctggcctgcttcggtcgccgtcgccatgctcgaagcggatccagcaccccattccaacatcttcctaaaatcctcggatccgccccttcctccgcagcttgtgagatcgcatcttctatcttctatctattcaccagcaaggtacctggcgtagaacttagccggatcctagaacccagccggatcctagaaaattcccattggcatctggtgaccgtatccggtggttgggcgtcagacgcagctgggtggtaccggtgcctggagctagaccacccgtgcgaggcacagtggtgcgacgggccgctcggcgcgctggagagcaacgggtgggtgtactcggcgcactgctccttcaagctctttgtggtcgatgtgtcatggtggtgaactatcttggcttgcattccctccggaacagaggtttccggtagctcatccggtcctacttcaggtccggtgatcgtgttctggacgtcgtggtcctgaactctggcctgcacgatggctgctactggaccagtgtccgcatctacgcgcaggctacggatttcgcagcatagttctggtccggagtc

SEQ ID NO: 1091 - DNA, 80 bp, Zea mays
acttggaaatggaatatctgcattacctctttctttttcatctcgtggtgtgcgcaattcattagcattcaaaccctgat

SEQ ID NO: 1092 - DNA, 57 bp, Zea mays
ctgcaggtcctgtacaatggtgccctatagaatgcatgcagtgagcttggagcccgt

SEQ ID NO: 1093 - DNA, 1380 bp, Zea mays
gttcgagaaccagccaacagaacagacgaaattaaggaactagccacggtaatgcctggtcgtatgtgaccggaagcctacagaaaatggactggactgttagttgcttcgctggagacatcgttttgtccatagaagtacgctggagacatcgttttgtccatagaagtaaacgtccccgcggcgcttacgaaggacgtgacgcaatgactccgtcaactggtgcggtgatgcaatagaccgtggaaaacagaaaatttgcactgtttaatattcacccagtagagtttgaaatacgggatgtacttcctccgtcatataatataaggtatcatcactatttcttcttatctccataatataagacatactctctttagacacatatacatcgatgcagcagtataaagagaactaaatatattttttggtctttgaaccagatatagtagacgatattggaaccacgagagtaatagaagagctgccagatagtctaacttctttgaaaaaggctggtaggttcacccggggccgtactctcgcatatatctggaccggacacacactccacctagtaaaaaactcacgctaagggcttgtttggataatcttagattggagtggattgaggtggtatgtggtgtgttgaagtgtaatatgaactaattttttttcaatccccttcaatacaccttaatccacttcaatccctctatacccaaacaaagcctaaggggtatttgaatacaatagacataataattaggtaactaaaaattgcttataaaattagctagctaacaaataactagctaactattagctaattagcaaaaatagctaatagttaaactattagatagactgtttgaatggcttcaactatttttagcagctaaatattagttttagtgcatttaaacacccctaaatgagctaatatggggaatattagctatcttgattattttgtcagcatatgctgatgcagcagtatataattgagctgccattgccacagtaattacccggactactgcatatcatatcaacaaggctggccgaggccagccagctagcttgtttgctcgccttaattatagcatctttttcatctcgcatggcatgcatgcaccaagatatccgccctcttccaaagatctcaaattaatgacgattctgattactaattaacgtctatatatatatctcaccttgttttcgctgtttcttcatcacgccaggtggtgctatatattgatgcatctatataaaatactagtagccctgaatcgcctcccagctgcaatccaacactcacacactgccacacagtcgtccaaaacccataccaacaacaggcagatcgacggtaaa

SEQ ID NO: 1094 - DNA, 1110 bp, Zea mays
cttcaccattctctacgtacgctatgctacagttttctactgcaaactttatctcggctgatgctacgtacgaggtagctagatcgtaagatcggccgggctgacacgtgtcattggcgtcactctgatatggtacgtacagttttcttgctgtattaattgatttaattccatgactgatatgtggtggtggtggggggtctcatgagttaaacagcttcgttcgacttaattcgtacaacattcaaaatagtcggctaattaaagagaacaacccaaaagtaaagtgactaagatccaaacaggaaataaaaataactagtccttgagttttgacacgccatggactaaatggaaacgaaagttgaacaagctgacctttttcaaaagccccagacccacacttggcacggccacaaattgctacgcagacctggttagctcaccaacaacttgatctcttaattaatcaacactcaggtgtacaacaaacataacatcgcgaaaccaaagacctcggatctctcttcacatataaaactaaaattcgtttatatatatatttgtacatatttatataaatgaaaaatgacatgagatcaaattcttcgtcgtccaaaatttttagtagcctctctctttgagcaagaaaacgtttgagatgagcgagaaaacgtcgttggcaaggtcgcttagaaatctcgtgcactcttcataaaccagcaacccaacagaaccggacctgccacgtaggcgggctccaacgcattcccgctgctgccaaccagtcacgtcccgccgcgttgcgcgcgcgcgtgtggaatttagtcctaaatggctaaatcccaccattaccgcgtccacgctatgacgtcgccctcgtaatcaatctccgcctccctgcctgcttaccccgaccccgtcggcatctcggagaatcgcggcggtcaaagcccagcctaccccacctcgcgccgcgtcgccgcggtttccgcgggccagtgctctcgggagtcgggagctcagatcaggagggacgggctaggtagggttcgcgagcgagcgagggtgctgccgtccggcgccggtgtccgagtagcaagaggagag

SEQ ID NO: 1095 - DNA, 123 bp, Zea mays
ggtgatggcggatccgcctagcggtgggggatctagggcttgtgtctgcagggagagacaggtcgaggaggcagaggcgggtctggggctcgggagaagagaacaggggaggaaggagggagg

SEQ ID NO: 1096 - DNA, 1500 bp, Zea mays
tcagagtgcagttccctctttggctcttcttcccatccccatcgtgtcgtgtcgtgccgtgcgcttccgagacagctcactccaccagcagggccgtcaccaccacgtcggcgtcgccatccatcgtcctcgtcggagcccaggccagctgagagctgactcctctccccgaaaggctggaaccgtccaaaaaggaagggtgcggatagcgtgtccaaatcgaaatcgagcagagttcctgggcgactgggcgcctctctattttaagctgacctccctccagataaactccgccagcgcagaggcctcgtccgtctccatttccgtctccctccccgcgccacctcactcgttcgccgcctccgccggcgcccgtgcgccatctccactccagcgcgctctacgccgatcgagctgccaggtacggcaccgcgccacctcctgcttcctctccgaccggcgtcccgaatatggccggcatcgccagttaatctacctagcttgctttggagtatcgcgtcgcacgggcacggggccgacgggtgtacgcggcctccctgcgcgggggatcgattcgtggcgggttttcccgggggttcgggttaattaatttgcgggtccaacggcgaagtccgtcgatcagtgcggttaatttggggacgccgggggccgggggccgggcgcggtccgtcggtggggcgttgggctggaagcggtgggcgttaggggccgtcggcgacgccaccgttgaccgtacacgtgcatttgctccagaggatagggagggacgtgacaaagcctgtgcggctgtgctgatgcctgatgatacaggctcttgtccggacgaacttatgcgtggccgagatagcggcaggcagaccgtgacgaggtggagactagggacggaacggacagtgtgagcgtgatgcatccgtgacttagcttgcctacgtggttcagcttctggctactactgagagtgatcgttgcgccgttcaagccgtgcgaagaccagttcatagtacaggagaaaaggaagcggacatgttcttcaatcatcttacactagtagtgaagtcacatgctacactactatcgtctctttatcgggtagtaatcttgatttggaaccttccgttgctttggagtttggactggttcattcagtggctgacactgggatggtgtactctgtccgacagctacctttccgacagctacctggttggactactagctttctcttttgtttctttgcccgccagcgcctggcgactatattcagattcagtaaaatgggcgaatttcaactagtaatttgttatcgtagctcgtagcaccagattgccatgccgtctttgaactgtattccgtcccctgacaacatctcactgtattaattttgacactttctaacggcctgactgtgtaaactcacttcattttcaggaggttgtggatttcatgtccgtgatctaggcgccttacttggactcaggt

SEQ ID NO: 1097 - DNA, 897 bp, Zea mays
actcaactaagtaaaggccaaaagagtcataggaaaatagacaaagaaaggaagaaaaaggtgctgactgcgcagcaccggacggtccggcgccacagaaaaggaaatcagccaattaggggattcactgtcgtgtactgtgtgcatactgttcactgtccggtgcgccaccggacagtccggtgcattgatgaacagaaggcaagaattgcctaccaaatggagttccaacggctccttgctgccttggggctataaaaaggaaccctaggcgcatggagcacacacccaagcctccattgaacattctaagacgcctaaactccgcaaccacgcaatcggatcatcgtgtttgagatttgagcacttcttgagttgtaaactcactgcgccgtgttttgtgtgctcacgtcttgacttgtgtgcgtgtgattgctgtgattcttgcgcgtgtttctttccctcccttactcttgtgctcttgttgtgatcaactttgtaagggtgagaggctccaacttgtggagattcctcacaaacaggaaaacaagtataaggaagaaaatcgtggtattcaagtggatcattgaatcacttgaaaggggttgagtaccaccctcgtccattgggacgccacaacatggaaataggcaagtgttttacttggccgaaccacgagataaaatcaccgtgtctcttgtgtcgcttttctttgtgattggtttcttctcaagagttctcactatagcaacttggctttaatcttactaacatttcataaccaagttgtgctattaagtgttgaattttacatgatcacctattcaccccccctctaggtgctctcaattggtatcagagccattctcttcattaagggactaaccgcccgaagag

SEQ ID NO: 1098 - DNA, 224 bp, Zea mays
tgcaggacttgaagtgtgcactgacagcgtccaaggctccctggaagatcgtcgtgggtcaccaccccatcagcagcgcctgcgggcatgggaacaacactgagctggaggagttgcttctcccggtcctcagggtatatatatacgctgttcgatctaacatgaagttattaattgtcttctcaagtcattaacatgatcgatcgatctatatatgaaactga

SEQ ID NO: 1099 - DNA, 1031 bp, Zea mays
gaacaaaatggtgtttcagtgacaactacatcagcctatttttaattgtatctaggtacgacctatatctctgaatgttgtgtaggcatgtagtgctggagtttatcttgaaacttcttgcaattatttacatatgtctatgtttgtctgcttacgtaagtctctagcaaaatcaataaggcacttttgtcctgagcgtgctttgttgctcctttgtcctgactgctttagtagtccctcagtcaagtaattaagtatgatattttatgttccctattgaacggttgccatgtaataaggattagttgagatactatttgaggcagctttcattgcttacaatttacatgtccctatgactatctgcaagaaattcaaagaggataatgcagtggcttggccactttgctgttactggggaatccacacatagaaagggagctaaggcactttttgagtttgcatttgtaaatcatgactgctgctggaaagaattcgagtgaaaaggcaagcatggacaatatcctgttgtagttgcttccaagcctcactgttttcgtgatcttgatgttctcgagacagtcgataatttcttagagtatgtcccagatttctggtcttctgatgagcttgctaattctatcaaagatggtgaaatactgcaaatcgatgaagaatattttgtagatcaatttttatacttaatgtatgaggagaattccaaagatgcatggcatgtggttgaagattttttgatggacgagcagttctcttctctttgccagcatcttcttatccatctggatgaggaaaggcttcttggtttcttaaattctttaggcaagctcatcaatcctactaggcagtgcaaggaattgacattcccgtgttgttggcttgaagttcttttatcaggacattatgatcacatatctcttgatgatcttgtctttttgaactgtgtcattgccaagggtagacaactttggcggctcatgaatgacgaagaataacatgaagaatgggggcaa

SEQ ID NO: 1100 - DNA, 987 bp, Zea mays
gatgatccattgaagaataaccgatggatgggattgagtaagagatagtagacaaatgaaatgatctggagcgttggttttttatagatgaatttgtttgggttaaaatgcttggtggatttagcaggggcatgagtgcgtgggttgtttcgctgggtgtacttagcttagtttaaactagtggatttaaggggtagagatggtgatacgagacacaaacatggttctgattaagagagtatctctacaactattaagactctaatgtagaccactaccgtgcctccgctcgcgcttcgcatgcaacaacctccctgcatgcaagcgacgcaagttgatcaacctccactgcatgcaagccgcatgcaaaccacatgcaagccacatgcaagccgcaagctgctgcagaacctgcatgcaagccgagaagctgctgcatgcaagcatcgtgtctccctccactcatgaaacgtcgtggaaattgaagggggctggcctggtggctggctgttgtccgtctgtccctctgctgcaagcctgtagtgctgctcagctgttgtcggctcgatcggttcccctacccgggcagcgctagccggctagccctatggactcgaggcctgattcgcaatcttactcttacccgctggccgcagccgctggtagcatcgtacaatctacaatttccagttcgagaataaaatcagctagataaaaaccacaaatccaacaaaatctaatatgtactcgcacaaaaacaattaccatatatactttttaatttaggtcatcaaccactatgcactaaggaacactatgcaagcactgacggggctgggcgggaggaacctagcgaggcgccacccatcgtgtttcctctgaggctctgcgatcgtcgttgtcttgttgcatgcactgaggctgaacgcgctgctgctcctctgcctctgcgcgttccccgccccggcgcggtcgcagaacacgacc

SEQ ID NO: 1101 - DNA, 702 bp, Zea mays
agtgagcccaatcatttcgcatctggctctcgcaggcggcaggtcgcagagcagcccagccccagacccacctcgtccgcttcgtcctctcgtctcctcgcactcgctagctgacgctgcgtgcgccaaaagcagcactgcagcagcaggtccagccgtcgcccccacttcccaccactgccacgcgcgcgccggatcgagggagggcacgcagacgcggaggagggaggatgagtctcttcgggcttggacggtgagcgctcgcgggatctcgatygtattgtagtattgtacacgtacttcgctctgcaccctttgctttattattccttgtccccggctcgtcgcccgtgggttcgggaccgcgggatccaggcccgctgatggaactgagatctcgcgcggggtttcgttcatgggatcggggaattcccctgcttgatccgctgctygagctgagtgagtggttgtggctctcttctgacggccctaattagtaattctgcgtagcaaccagtgccactggggagttctgctccgctctgctcagaccttgtttcttcaccttgattttggatttgtctcggcgtttttttttttacccaacgtcagatcatgctgagccgagtttggcgggctcagcctgcttggcttattcgttactgagggactacgctgattttagcttctgatgcaacaacc

SEQ ID NO: 1102 - DNA, 1500 bp, Zea mays
gattagggttttgacaggcacgtctggaactggaagaatgcggtcgtgttagaaaggccgggccggtagtgttactggactaggctgaattaccactcgctccgccaaacaatcaccgtcgcccacgtaacgtgactcgccggctcgccgccggcgtccaagctaacagtaaagacagcgcactgaaatgttagcgatcaatagtataatcagtaatatgacgaacgataaaaaccaaaaaaaaaaaaaacaacgcgcaccggcattccaatgtcattactgaaccgtagcataagtatctaggcgtcgaatcaacatcaggggttctcactttgatatttcacagatgaagcagagtgcagttacatgctgtaggtgattactctaccagatacataaaccaacatcaaattctgaaagggaccggattcagaaaaaaactctccgtttccgtatctatgtttttttggcggaaatgggaccggattcgatgccattcagcgtgccgctcctcgacacctctccgcctccgcgcgacgggcgacagcgccagtcgtgaatcagcgccggcgagcccccatcctggccggcagactccctaggcggctgggccagctctccgcctccgcatccccagtctccgcgctgactgccccgccccatctccagccacgccggcgccgcatccccattcccctcaccgccgtctccggtcacgccggcgcgtccccagcccccgcgtcgtccgcttaccaggcagggaaccgagaatcttcttcccttccattatcttcgttgcaaggtctctaatgccagctttctctgatctaatttgatattttgatgtagccatctaagtagttgaattgtagaaataaccatgatgtattggttctttaattatacgtatttaatttatggctctacactatttagtatttgtatatcgaattgtggggtcttttaatgctactttaccaaattgctatatatatatatatatatatatatatatatatatatatatatatatatatatatatatatatatatatatatatatatattaccgatttggccatgaaatttgtttggtcggatatgtcccatgcaaacatcttagatctgtcactgactttagaccgtgttcggttgcatgggattagagaggattggggtagattaaatctctttctattcgattttaattaccaagtgatttaattcctctaatccccttcaatcccttcataaccgaacaagcatttactgggtatgctcctgcgtcctgcccgaactctaacccaacttaagttgattggctattcgtatccggttctgatctaatcaatattgaactgtatacatgtgtttttcgtactaactttgatattttttttcctgaacaccattggctatacatttgtacacccatgtactaactttactcggaccgcgtatgaacccgcaatgcttccttgtcaaggtcgctacatcaac

SEQ ID NO: 1103 - DNA, 763 bp, Zea mays
tatacttttgttaagttaaattataatatatgccgtcccaatacacatgtgcattatattattgactttataaacggtggacttagttggagtgactggcgaaatattctcctaggtagtttcgactcatagataaacatctcttttgtaattttctgtacgtcggcctctcgaatatctggaattttgatcagaaatttccggggtttgcgrtgggccgtttctgccctggcacgctggcatttacgggagccaagcggcatttcgaaaatttcgttgcaggcaggtgtaaccgcgcgcacaagtcccgccgctgtcttcgccacgagctcgcgacctgagcttttcgacttttatatataccaccccagttctttctaaaaccgcacacccaactacaatctctgacagaacagtccaaacccccgaactgctacgtctcgctgaaaatatctgcgtacctagaggtgtcggataggattctccgcctataataagtcggctgccaagcgggaaaaaaatctctgtttgtggcgtgcggaaggagtcggagggaaccgaaaactcaggtgagggcttcttccgccgcacccgccgtcttatccgaactcctcgacccgattggcgcgattcgccgtttgttttcccgaatcggcgacgggatccgcccgattcggccgtcgatctgcgctgattcggcccgcgcgccgtcggggttcgctttcttctgcgcagggtctcgaatttcctaggagcggaggcg

SEQ ID NO: 1104 - DNA, 435 bp, Zea mays
cttgcatgcctgcagatgctggcaaaggaacatcaaaggcggttgtagcccagcagcaaaggcaggaaactgaggttgacaattctgatattggtggtaataagcatgatttaacagatgatacagaggaactattttggggttcacctatcagagtgcaaaatgagattttaccctccaaaagttttccagaggaacatgacgctgacaaagctgaatcgcagtttagttctctatcatctgatcctcatagcatggcaagccagcgtgcatggaaacaacctactcaaggtctcaggcctaagtcactgctagaaatccaagctgaggaacaactgcgtgcacagaaaggattaactactgaaactgctaagccagcagcttcagttccttcaatttcttggagtggcatgtcaatatcttccgagcaacatt

SEQ ID NO: 1105 - DNA, 85 bp, Zea mays
ggtgtgcccataacattaaatgcagattcctcatgaggccttcggatttgatacttcatggcccataacagatgagggattcacg

SEQ ID NO: 1106 - DNA, 1500 bp, Zea mays
tgataaaaacaccatgctttagatattctagtcaagtaatcgaaatctcatactattgagatattgtgctttactttgtaaatttgtcattctagaaatattgtagtcttcattttgttcattttacatgttgatggcgttctatgcttcttcgtctagcctacctcctatgttaacaaaactttgctccgtatctttcttatttaaaatgtgcgggcgcagactcaagaggaatatcacgtcgatgcttttctatacttgagaggtggtagcacttacaattcgaacaatcctctttgcaattggtggtcgattaacttagaggactttagttgctttgttatgtatgaaagacatcgttattactttagttgcttcgtgatgtttgtgctacgtcactagataagtttatcggcatatggagaccgtcgaacttatatcgcttaatgtcatcgagttatcttaacggactaataatttcgatagaaaaccatcagaattagtttaattttgatggtttgctcctaatttcgccatcaaatttttatcaattttgatttgtctatttagatccgtgcccgcagatgcaaaactataaaataggacatcaactacactgcgaggaaagtgtataaatcattatttctatatatatagacacgtaaggcaacacacattccacttggaagagtatagtctctttccttttccccgaattgcatagtatagatgtacgcattagcctcaagctgtgatgtggtgcacggtttttggcccgaaagttttttttgcaaatgtcataataatgatttgaattaaagtagatctctatcagcgcacgagtccgccccatgattattatgcttttcccaacaaaaaattataggttagtatgagcaaagataaggaagagcacgcatgttttgccttggcgcaaattaattgcacctaccggcaaaaccgataagctaaggtgagtagtcacccgtcaatagccaaccagctgctgcccccgtcagtgtcactgtaaagccaaccatgtgcatgcatttctttccccccactcgtacaacacacgcacactcctgtccgatcgaccccgggcgtctctctctctctcctctcccccgcgcttttatataagccatgggtggcgcactcggtgtgccgggcatcagctacaagctagaacaaggccatccattccaccacccttgtagtagtgcgcgctgttcgcttgcactagctagccagcagcgtgcgcaccacctctcgccgcggcagcgacgacgacgggaggcttgttgagagctagctagctagctcagcgagttcgagagcctgtgtgctagagagacagacagagagagagaaaacatactcctcctctgcacacaggggagctagaagctagcgttaattatagcacagctagccgcaaccgtcgcaggatatatatatagacgacagcaccgatcgagagtagtacgtgaggccggc

SEQ ID NO: 1107 - DNA, 677 bp, Zea mays
ggtttgttttaaatttggtatactttcataaatgcaattctcacttttcgagaagtaggacaatttaaagtctgactaaaattattttaaaaaggtattaatattgaggatacagaataaatatcattatattgattataaaatatattttggtagtaaacttagttgaagacataaatgttaatgttcctctatagttttagttaaattgaatctagtttgatttgcacacatcccgtagtttggacggaagagtaagctcttgtttttccctgaattgctctgaacaacctgttcctgctttcctgaatcctggtaccatgagaaaaaacatctcatgttgtatatggtttctgctgctgcacaagattccccatgaccccatgtgatgttgcagtttgagtcaacatatgtgattcgtcagtggataatgcaaagttctttttgaacgggatcatatgactagtttgacttggctatgactctgaccgcttttgttttgtggctataaattccatccaacatcagaccctgcaatccgcacttgacagctgataggcaggcgataccgagatagcccgaagctgagaattgagaaagaatggccggggctctacgagaagccgtcggagacgtacgccaagaagcgtccgcagtaccccaaggagtggttctcc

SEQ ID NO: 1108 - DNA, 1166 bp, Zea mays
ggcacaagagaaaagacctacgccctttccaattgtaaaaatttttttggtttgcttcaggtgcatcaataaagacgcaagctataaactaaaatttgatatcatcttttttagatcctacacggcactcaatattcagtaatccctgctacctatcaacgaattgatataaaacacataaaatcgcacttgcataaagactatgcccaatcagatatacatatatccctggtacaaacatgtctgaggagcaagcaagaaacaggaattggtacaaaaactaagcgcgagcatcagagcaacagaggcaccgagacgatacgggggtcggggtgctcacgtcgctggtagggacttgaggtgggaggcgagcgcggaggcgtggtggtggacgcaagcggccgcgccgagggcaacggcgccggtccacgtggagacaagccgctgcgggtcggagtgcgggaccgcagagtcgcccctgtacgcgcgcgcccaatagtcgtcgaactcgcccatattcttcctcccctttcccgttccctgggcgcgcagggtgcgggaacaagagcgctccgcgaagcagaaaggggacagtacggggatgggggcgtacctcgtcgccggcgacggccccgacgaagacgtgggcacgcggggagagggggagcggagctgtttttggataagatctcgtacagatttacgtgggccggcccagctctcctgctgaagcaccaactgcagcagcatgggccagtccctgacactttttctagccccgtttgctccggagaatcagattctgttcgaagcaagtacagatagacggaggcgagtcggcgctgcagcggacagcggaagaaaattcgtttcttcacgtcgccgcctcatccaacagctagctttattcccgcgcaaccatcatgcacgcctggctgtgccagccaaagccccgtcgtgctcgtccatgcgcgtcccatccgcctccggatctccgatctgtccccattatcttctgctcgatcctttattttcttcctcctcccggagcctcaattccctctccggtcggcctcatgagtgccgcgccgtgcgccgacgacagagctacagctactagccgccgcgagtcgagcggcgggccggctcctcctgcggcgacgacg

SEQ ID NO: 1109 - DNA, 972 bp, Zea mays
tcgtcgtcgccgcaggaggagccggcccgccgctcgactcgcggcggctagtagctgtagctctgtcgtcggcgcacggcgcggcactcatgaggccgaccggagagggaattgaggctccgggaggaggaagaaaataaaggatcgagcagaagataatggggacagatcggagatccggaggcggatgggacgcgcatggacgagcacgacggggctttggctggcacagccaggcgtgcatgatggttgcgcgggaataaagctagctgttggatgaggcggcgacgtgaagaaacgaattttcttccgctgtccgctgcagcgccgactcgcctccgtctatctgtacttgcttcgaacagaatctgattctccggagcaaacggggctagaaaaagtgtcagggactggcccatgctgctgcagttggtgcttcagcaggagagctgggccggcccacgtaaatctgtacgagatcttatccaaaaacagctccgctccccctctccccgcgtgcccacgtcttcgtcggggccgtcgccggcgacgaggtacgcccccatccccgtactgtcccctttctgcttcgcggagcgctcttgttcccgcaccctgcgcgcccagggaacgggaaaggggaggaagaatatgggcgagttcgacgactattgggcgcgcgcgtacaggggcgactctgcggtcccgcactccgacccgcagcggcttgtctccacgtggaccggcgccgttgccctcggcgcggccgcttgcgtccaccaccacgcctccgcgctcgcctcccacctcaagtccctaccagcgacgtgagcaccccgacccccgtatcgtctcggtgcctctgttgctctgatgctcgcgcttagtttttgtaccaattcctgtttcttgcttgctcctcagacatgtttgtaccagggatatatgtatatctgattgggcatagtcttt

SEQ ID NO: 1110 - DNA, 691 bp, Zea mays
aaaccagcgagtatatatatactgtatatgtaaaaactaaaaggaaaaaaaaatagtgcattagacagtatggcgtcatgataggaggcccattaggcgattaagatgcggcacgagcggcaatatagtgcattggatgtttcatttttctgactcgtagtgcccggtagactgcagtccaccgccgtttcagtttcctagtggcatggacgtttcatttttctaatctaatcttgatcggagagaacggagccctggccatagtgttgggtcgcagtctgccgccaccctgctctaaatcgaaggttcgcttctcatgtctcatctatggtatatatattagattgtcagatataatcacggtctctcgaaggttcgtcgtctggatctatcgtcatactatatattgttttaccgaattatatataattttttgcatcgcatactctatggtcaaattctaggtccgccactgcgtgcgggtcatgctaggggcgctagaaaacccgacctaggcctgcctttagactataccagtctaactcatattatttcgttccggactatgttatagcctcctgtttttagtccatgctcgtgcttaaaaaaaagcccccatgcatgcataaatctaacggcgcgcctcctataggctatagcactgccgcatgagaagatagcgcccgctgca

SEQ ID NO: 1111 - DNA, 1082 bp, Zea mays
tttaattatgaatatgtaggaaatttaacactttcttcttccgaagttttcttctctgacgaagcaggtttcaaactggagcttcgtttgattccgacagacaagcttcggcggtggttaaaaattttggcagcaaaacagtgaaaatagcaatgaatgctgtggtaacttcacacctactcgtctgtttatatagtgttgcaggtaagaaggcgaagcgccaggatttttacaccaggcggtcacccgcttgtactcgctgtgcggtgggccgcagagaccaaacagtaactctgcaaggtgggaccgctacgcgctgggaaattgaatcgtttctcggcaacgagctcagggaaggtgttttttggaccttcggctccccgaagcctaagagacttttttcacggaccaagctcgttacgaaaaatgatctagcaccgcgaaaggggctactgttgggcctatgcttcgtcgccgaaggtcttacaggaagaagcggtcttcggcggaagctgtttgtataaaatggccgaaggttcctcttcgtgaagcttcggtattgcaaaccgacttaaagatagaatgaccctttagtccataaaggtctgagtcaatgttgtaaacttttatgagggacgtaactgtaattcctcacaggctgtgtcctgtgcctataaatagtgaacaatattcctttactgttcacgcattctggtaattgcaatcgcatctttcgggaaccaatctctgtcaaggcagaggtataattgtattcaataattcaatatattagataaatacaatataattcgtttatgatttatttacctttttgtaccctttattttatgttatcttatacaatctattaaaatttaattacgaagacctaaccttcgtaattatattctcatcaaccttcgtccaaggctcattatcctcaagggaataatgtttcatgggcgaaggacgttaacatttaacatttttatgttgccttgttcttaattcatagcatttgagaacaagtccccaacattggcgcccacctccggtgaactcacttccacttttctgagctg

SEQ ID NO: 1112 - DNA, 459 bp, Zea mays
gaaggtatacgaagttgcatgctgcaaaataaaaaagaaagcaagtttttaacaggcatataaatgagatgcacggcgatatatgaccagtaatacataatcaagaggcatgtcaggataatcacgcaaggctacaaaagtggaatctgttagaattattcctattgtttaggctaattcctattatttagtgaagatagctcctgttatttagattaagttagttattaggcttcggaatcgactatataaatatgttgtaagctacagtaacgccgacagaagaaaaaaggagcctacaattatcatttttttcaatctgttatctattttctttcccttgctgggaggccttagtctcccttctctttctctcccagccgccagccgccgccgcactctcccagccgccagccgccgccgcggccgccgcaaaaaaccctaacccccaatccacca

SEQ ID NO: 1113 - DNA, 146 bp, Zea mays
tcataacccaagtttgtgtgttttagtctgatttttacagggatcatctattcaccccctctcctaggtgctctcaattggtatcggagccgtactcttcattcagggactaaccgcctgaagagatagatcctaaaggtaagggg

SEQ ID NO: 1114 - DNA, 900 bp, Zea mays
tggttgattcttcttcagctgtgtttaataatggagtgaatgtatttttttttgaggaaaatgtatttttttgttgaggcggtgctttcagcctgaaacgatgacataacaagcagtatacatgcaattagccaattatattggaagtttcttccttgtttctgtgccaccagtattaatttttcgccttgggtcacgtgcaatgtgttgagcccgaacaattgactagttcttctttgggggtcacatgagcgaatttaaaaactatttagttgccttggaagattcacagccctgaggggacaacacgatgtatctaggaaattgccagtcttttttccacatgttgccaagtttttattaaaaaacaaataggatgatgctgattgcctctacaaacttaaataaacaaagattacacacgaaagcgcaaaaggatgaatctaggaaattcctgccatttcatatggtgaaatttcttaagctcacaggtggtgttgatctgtcttgcagaccgtcgggaacaagtgctttgaaaagtgcgtgaccaagccaggatcaagcttgagtggaagcgagagcagctgcatatcacgttgtgttgaccgctacattgaggccactggtattgtcagccgcgcattgttcacttcccagcgctaagatcacatgaataaggagatggtttcgaagatcgctcgtgagagtaatgtcgccatgagttttttgacttgtcggaatacaatgacatttgatgcttggttattcaaaaaaaaagtctgcctatagactcaggtttcttgtacacctatctgctttagtaatagagaaacgtgctctatttaagtggctctgatgttaatttatgctcatcatgtggtttgtttcgcttaatgttgt

SEQ ID NO: 1115 - DNA, 310 bp, Zea mays
tattttttttttgtcgtgttatgtatatgagatggtaatactcggttacccattatcatctctaatcgaagataacttttttttaagcggaaaaaaggagaaacgcttctttgtggtgttgcagatctccggctgacaggcgggccgcaccatagaggggtaaggtgcatggcccgaccccagaccccctctcgcttcgcccctcctcatcctctctcctctctcccccgccccgttcgtctccggcgagctagggtttgcccccccgccttgccaccccacggttcccgccatccttggatctccagcc

SEQ ID NO: 1116 - DNA, 140 bp, Zea mays
tcccctaccatatcgatcgaccttgcaagtttaatccaacagaattccaccgggaaatttggtgaagtgctaatcgcttgcggcttgcctgcccggtctcgtggctttgtgctgctcccgctgtggtgaggaaccctagg

SEQ ID NO: 1117 - DNA, 1500 bp, Zea mays
cttgggcaagtcctaggcggaggagggcgcacacgggtcgcgctcgcgctccatggcggaatccgcggagcagggcagggcgaacggaaggcaaaagagaacaaaccggcctcgtcaggaacccggtggcattgacgccttgctgccgctattttgtactaaatgctgctttcggcgggtggcggcactggagatcctgctgctgtgatgggcaaaaaaaaaaaaaaaaaaaaaaactctccgctccgcaggcctcaagtctgaattcgactcggctgccggctgtctgatctgaatcccgtctggtcggtgctctacctgtgtgtgttggcttcaatacggaagctcgattcacatactgctctatttggtagcaatttcataacgcctcgtttagatcattagaattgaatttcattctaataatagtaattttggcatatatcaattaagctaattcagttttatacaaaatatatttgtatacgattattagcaagatgtcgaacatatttatgtgctacatttttactatagaggagtgggacgaagagtgtcatgtaagttacagagtagaaacaaattctactaatgcataaaatcatttcttatcttctaccccatgaatttgagatagactaatatctgaactttggaaagtggtgtaatgtcaaattccaaactaaataagttactttattgagtgaattccaattcctctaaaataaagggatccaaacgctccgtaagagaaattagattattacttcacaatttttcatttttcatactatatatttatataagaaaaataaagccgtctattaatacttgagttacgagccaggtgtcagacacatcttttcatatataaattgcttcacaattattttacaaatatttgtttagacaacttaaaagtcttacatgtctatagatagatagatagatagcgccgttcgagaaaaaaaaaacctatgatatgatgagcacggctcctttcccgaaaaagaagcgagcccaccaccacggtcactgacgttcacaaaaaaaatcgcacacaaaattcctagaccacgttttttttagtcgcacaaatcctacaaaccaaacagcaagagcggaagaagaaacgaaaaaggttcactggaatcgaccaagaaatccgccttgccatctccgtttcgtatatgccctgagaatttccaaacgaaatttccgagcttttccctcgccgcgcgaccttcgatctcgcttgaaagagatggcccagatcacgggaccggtgtgaggactgagacgccgacctccgacctcaccgaggcattcgattcgtcgcaatcctcgccctcactcgcgtgttcaggcaagcgattccgtcggttattgtgatctgcgcttttgtttcttctcgattgcggggtgtgacgaatctgatttgccgaatgcgaggcgtccaggtttgtcgggctgccccgggataggaatgcttctgtcgac

SEQ ID NO: 1118 - DNA, 556 bp, Zea mays
caaaattactttttaaggtaaagtctatatatatgattgttatatttcaaaactaaattaaaaatttgttattagtagtcaaagttttatatgtttgactcaaacttgtcaaagacgacttgttttttagaccgaagggagtactacgtgctccttcaacttcactatgaactcctcccctttccaaaactttgctttattgttcctactgtccatgagccttcttcctctctctccccccttactctctgcgtgtgtttcagctaggtgatcctcaccgctctctctacatctctcccacacactttctctcttcctctctctattgaacttccctttcatccactacaacttcatttgcacctttagggctgcaagcacacgcttctctatctccatctcaccataggaagctactagcagctgcaacccctgccatctcactctctctataatagttcccatcccgtccacacctcttcctcttcttccctatcctcagcaactctccagcccaacccaacccaacccaacccagaggtgcctccactccacc

SEQ ID NO: 1119 - DNA, 1500 bp, Zea mays
atgagatacgacttcagcactactacatatgggaaatgggatgttagtttggaaggtcaagtagtgccagtaaggatgtctttcggtatttaggatcagttctatagagagatgagagatggagatatcgatgaaggtgttagccatagaatcaaagtaaggtggaggaagtagtgccaagcatttggagttctatgtgacaagatggtactatagaagctaagagtcaagttttataggccaatgattagacctgctatgttgtatagtgcagaatgttagtctataaaaatatgccatgttcaacaaataagtgttacgaaaatatgtatattcgtcgtattcgtggccatacaagaatcaagatgatatatgtgataagctagggtagcactaattgaagaaaagcttgttcaataccgattgaggtggttttgtacatgtccgattgaggtggtttgaacatgtccaacggagacctccagaggcaccagtgtgtagtaggattctaagtcgtgatagcaatgagaagagaggaagaggaacaatgacttgaaaggatgggatatatccaaagatttagttttgataggagtgcatagaaactagctatccatgtgcctgaaccatgacttgtggtttctattggtttttttaactctagcctacctcatattgctcgggataaaatgctttgttgttattgttgtttagtagatgataagtctatgacagccttgtgcggttctgatattattgttcgtctgatttgacgtatgcttgtttgttagtggatagtttcagctctcgctattgcagatgctaggatgttgatatcattaccttggttctttgttgggtgatagggaaatccgtccgactaatctgctttgcagcattttgtggctttgtttgactatatgatggctatgtttttgggagtgagtgccaggttaggtgaagggtacctggtgtacatttgttttttttggtcgaagaagcaatgattgagagctatgacctggaagtatttcaggtgtcattttctgtttctgccctaatctttaagaaatgtttcgtggtgaatacgggaatttaggatgcaaatgtaagaatagagggagttgactcttttgagtttgatgatgattttctgggagaggttgctgttgagcaatgaacccctctactatttctgaatatcctgtttgctctctgcatatctgtgggcgattctttatagtacgtcattgctgcacaacttggggtccaattttgctatgtaaatatcaccttagcctccccttgtaggtgtgactaatcgtagaatttgaatgggccgaaatgtgacgctgtctgcatttattaagagtacctttctaccttattgaagaaatgctgtctgcctgttgcacagctgcacccacgcatcagctcacataagctccattgctttcgtttcaggcgcttggcgtctgacctcaacaagcaagaaagcaa

SEQ ID NO: 1120 - DNA, 1500 bp, Zea mays
tcccaagtaaatttagttcattttctcttaggataaatagaaatctattggaaaaatagaattgtcaaactagctttaatagagtaattccctataagttattgggtatcagatctctatttacacctctagtgagagataaagtagttaaactacgtaaaatttagatttaaaacttggttagaactcagaaagagaagaattaacaagtatcatgatattaattgaagaaagatgatttaggagtggtatattttttacccctattcttagtaattgtattgtttagatccagattaaattctccgtaagttagtggcagatcttgattaattaaaagtaccatggctacggtgactccggattctaaaaataaatatttcacccagtcctttcgctttagagcaaaattcatggatagcgtaatcaaaccagttgtcctctctggacgaagaaaacatgttaaagtattggccaaattgatagcagacagcaggcccagcacccaccgactccctgaatgagcgaggacgcctcgtagctgccaatggcctttacgtgccacgtcggatcctggtcagactcgtcggccggagcagccacaccctgcgcgtgccacctactccccctcctcccgaagcagtggccggcgactcggattcagattttgacccaggaaatttcctcccaaaaaggattccaaaaactaaaattgatgctgtagtactactacctaccactctccttttggttgtcaatgaatttgcagttgtattttaggaaactacaaaatatatgaaggactttcagatcgcatctttaattttaaagcagattcgataatatccactcgatcaacaacagcacatgcattgactggagtactctgctgcatatctgttagtccgatctgtgaatgttcctgccggtgaagaaacatgctctgtgaatgttctcgctcatggaaagagagattttccgtcagtcaaatttgttaacctttagaattatgaatgagatagatgaaaaaaaagattaacgcatcttattttaagcaagaggtattgcttcatcgttccgtagtttcggatgggtctttttaaggccctggcccgaaggtcacaatttcttgcccaaaattttcgtaggctgtccaccgcaccaccaccctgcgcgccgagcgcaccccgatccagatccacccatcctccctccggtctccggcgggcgccctcctccacgtcctcacgcgcctccggacgccagtgcgcgcgcagtgagcatcaacatcaacccgcctcttctctcgtcggtaaggacgacggacggacagacggacagacctgctgctcttcattttcattctatttcggtttcggaggcggaacggcatgaatctgctgtattgttcgttggccactaccacgaaccgtccctgaactccagaaatccctcctccgtaggaccggcgcgcgccaggtggcggcggaggcggcaggc

SEQ ID NO: 1121 - DNA, 160 bp, Zea mays
gatatacttgccttgttatgatatattccgcaactggattgaggatttcacaagaatttttgctcctggcttgacaccatatgccccgctagtagcatgatctgttgcacgctcgttagcatgtattgcttgttctccaattgagctcgcaaggacgcgt

SEQ ID NO: 1122 - DNA, 1500 bp, Zea mays
tcaaatttatacgatagactacagtgaccaataggaaaccactgtaatttttacagaatttttggaaaatttaaatcactgttgtagttcaaacccaccctaaaatcataaatagaaaatgaaaaagggaattaatagtggagactaatgttaccctaaccaaaccagcaaaaccccttgagtacctactaaaacatttaaggggaaatcctagtcttaatccattatgcttatctctaggcaaaacctcaaacctaaattgataagcataaaccactaagagcctcttataacaaggaaaccctaagttattaactaacttagttttgcttcactaggcataaatgttactaagttctacatatcatagcatacatatatcttattcattgcattcgataaattgtaaccttgcggacggagaatacatcctcgtgccggagcaaggagttgctcaagaggtagccccggatctagcaccagagcctgccacacctttggaaggaaagccccggttttatgcataaccagttctatatattattttactacacttaatgattgtaggcttgtattgtgcacttaagtgtaggagttgcctgaaaccctagttgcattacctcaagatttcctttgagatggatactggtatgctaggtcgagtagctgctttactaattagggatctcggtagaagtcgagtgattttctagcactcgcgcgaggtcaggacattgattgtacccactttcatatcgtactgatgttggtttgtgggcaacaatccatgaggattggttgttcacgggataaaaatttgaataaggattaaggtgtggtaccgtgagtcaagcgtttgaatgtactaaacacataccgagaaatatggtaaatcggtaaacctagtacctgattgaacctggcagtagactttgcccctcacgcgacctgagacgtggtctcccattccagttatggtaggtacaagtgcggtcactgcacgacggcagtcggggttagtgaggcattgtacgccaaggcggtgagccctgatctgctaatggggaatcgatggggacggttgatgtgtgtggggacggagtgcccctgcatgttgtgtgtttaggtttaccttgcaaggataaaaactcgattcgaatcgtctgcttctcgcagctaatgagactgcttgatccatgctgctacattgagtaacaagtggaattgtgaagagatgatacaatatgttgattgctaaaaatgtttgctacgatgtatgagtagatagtacatctttagccttaagagagtcacacttaatttgacaaagttaaaaacttgattagaaactcagctagtgcttttggcaaccaaactccacagccaaacagctgcatgtctagaggtagaggagtagactcctcacaccgggtaagtctagctgagtattagtatactcagccttgcttgtggcacaattttacaggttctctggaggac

SEQ ID NO: 1123 - DNA, 1500 bp, Zea mays
agctgacacagcgcggcgcacgagggtggcaaggcggggccttttggcgggtgccgctaccacgcgcacaaaaaaaaaaggacgcgggaaatcacctcgccgtttcgcgcctccgccccctgccaagtcacgcattcgcacacgtaccccgggccgtatcccagcgatccgggcgtacggcacgacacttccgtcctgctgcctactgtactgctgctaccttgggacctttgaccgcagtccacaagtcctaaacagttatacacttctactgtaggtgcagtacactgtactgtactctagctctactgtacaaaaaactacacaccacgccacgctctgtatccgtattttctccactcgcgaaattacaacttctccggaggaccacgtcgcaaaaaatgggaaaccaaaaagccaacggagggcgacagagaaaagacacgcccatcccatcccatcccatccatccccacactgctggcgctgcccgcctcccccctccagtccactctccactcccacactccgttaccaagctgcccgccacgccccctcccctactcctccgccgccgcctcacagccgcagcagctagggttagggttcgttccgccgcggctgccgtcttccccagggcaggctactcccgccgggcccctcccctcccattgcattccccagttcccctgcaacccccccattaccctttctcccacccattccttccttccgcccctctccaggccgcccggactggtcgcgttgcaaggtaagcaaggccacccgcgccgcctctccccgctcttcgcactcgcatccgcatccgccattgcattgcattgcatcgcatctggaggcgagagcgagaccggaggcggtgtccttccgtgcacgctctttggacgcattcgccgtgcctgtgcaactaaaagggtgcgtccctttttattttttttgagctgggctgggcggttccgcccgcggttggtggcgggtttagcggccgaacccaccactttttttttaccgccgttcttgaggaggggttaataaatgtggtctttgtgctgtcagcgaaaaagaagcgtttttttttctgtctatttatgctgcatttccccctcttttttttccgacgaagataaatggtagattcgatctttgggcggccagggcgggtgttgaagctggaatctatgtgcctgagttgacacctttttgctcgtttcaggtttgtttgaaggaatctggacgggtttatgtcgatactaggtgctgctgctgctgctgcagagatcaggtgaaagggacaagtgttgtggctgcgcaattagtacccagagtgtgcacagccataccacctcgctgatagctactacccgcctgtgcgcacgctgcctccaatctcctccaagaaatgcgtcctcgtccttgaatcctactaaccatcaaactcccagctcccctcccagaccagtccgtggaggaaagtgagcg

SEQ ID NO: 1124 - DNA, 374 bp, Zea mays
atggagcgatagatgacacgtcgtcgtctagggctgcttgatacgatcccagtgttgaccggcgtgtattattgtacgtattgttatgatgtgtcctctaacacgtatatgtctctgtgataaccaatggaattgcaacatatgctatgcaagatgtatatatatatataagtatttacgtatctctgctagcgtagcggcgtagaaatcaactctcgcttaattccttggagggtaatcagccaggttcggtgttattccggtgaacaccacttgtggagggatacatagtagcgggcgcgatcgaagcagtcagactggccgtcggcttgcttagcttagcttagcttgttattaaaggagctagcatggac

SEQ ID NO: 1125 - DNA, 1271 bp, Zea mays
aaggaaggaactgaccactgcacgtagtaaggggtgtttgattgaactgaagctaataattagttgttaaatttagttaaagaacagctattagttatttttatcaaattagctaatagttagctagctactgtatttgttagctagctaattagcaaatttttagcaacttattattagctacagtacatttaaataccctgctgatgaacagtggtagtgatcaggggcggacctacagggtgttctaggtgggccctggcacaccctaagccagcccaccaaggtccagcccctatagattttgcgtgtgtatttaggggttggagtagtagtatatattgatcataatggaaatttatggtttaaattatgattattttaagcagtaacgctaattcgtcctagtataccaacactgattatacaaaattgtatataaaaaattgttgtggcacaccctatataaaaagttaggtccgccactggtagtgatatccattcttcctccgtttcgaaataataaatgcattattgacttctctaagcgtgagatgtacacttattttaggtggaataaggtgtgtattctgttgtaactcatatgtatacattttctagtaaaaaatggtagaagggcacatggcagaatcggacaatattaccatgttacaggtttaaacaggattaatatcaaacgacataatcaaaatatgttacagggtttaaaacagaattaatatcaaacgacgtaattaaagtacagggaacatatatatttatagggcagagtatatataggaaaagccgtaagggaactgatataagtctggacagcgtcagtcaacagagattggaatacttctgctagtacattttagcacattagtagcttagagctatgcataataacttgtcaccatggcctttgtggggtttcacaccgtataattgtattaaatcacacacatttgaccaatcaaacataagaacaagcaaatattgccattgcagttgtttctgaaataaaggcagaagcactgcacgattcaataaaaaatgagtaaagactgtatgatttggtcccccacctctctccttattttgaaagacgagatcacacagataagaactggctgttttgtgatatcgcctcataatacaaacttcaagggattgggaagaaaaagaatcggcaggaatggaacggcttattcaggcctccgcttccacttctttcttgccgctgctaatgcttgttgctagtgata

SEQ ID NO: 1126 - DNA, 548 bp, Zea mays
agggaaaaccgacttaaagatgaaaagccaaactagaccttgaagaattactatagagttattgataaatgtaaagggcattaatgaaattttgcatgggctgcgacccgtgcctataaataggtgaacagtattcccgtactgttcacgctgacttggcattcacttttgtgtcacgcttatattctctttccttcaagccaaaggtacatttgcaatttattattgtttgcatgagtaatataaatagaaatagattaataataatgtttacacgaattacattattttctgtactttatttgaatgttcttcatcttttattatgatcttggaggtatgtccttcatgaccttcgtcttaaattcgttatatccgaagggaaataatgatttgaaagacgaagggctttgatatttaacatgttatgttgccttgttcttgactcatagcatttgagaacaagtccccaacattggcgcccacctccggtgaacccacgactattttttgagtcttgaacactttcggcaagcatcaccttcgtc

SEQ ID NO: 1127 - DNA, 319 bp, Zea mays
cgtgacgatggtgtatagaaggaggcaactgattcaagcgccggacaactgatttcaggagcagaatggattaattgattcatgctgtcgtgtttgtgataaatactagaaagtattagttcctgcgcatttttgatcattagtaatacagaactcgagtcgtgtaggtcggcaagccgtcggcaaccaagagtgctgacaacacacaacagtcgaacaatttcaccggcgggcggcggcggccaccagcgcgtcgccgcgacgttagcgcttgatccggcggcggtgactcagcccctttctctcccccaacgctcaa

SEQ ID NO: 1128 - DNA, 1500 bp, Zea mays
cataataattgtctaaaaaacaagtaaaaaccataaatttcatataagtttcatgtgaaatcccacactccaaaatccaataaatcgaagatgccaaaatttgcctcattcacctttcaattacccatgaaaacgaacatcgatgtggcaacccctttaatcaaccaaatgccaataagaagaaatttaaatctaaatacatttctactttgttgtggggcaaaacgggggaacaagtcataacactggtcccacaaattcttagttctcgtttccctccctaatatctattcccctatgacatataatgtggtgcccatgcacattataattgtgatcccaatgacataatgcttaccaatgcctcgactggatgcacaacatggagcgcatgactacctcaaatgacgctgataccatgcacaaaagtcaactatgcattactaaaggtatcattgcgtgattttgctgatacggctagtgaataccaatgcatgacatagatatgccaaagggaaagtataggatgcaggagtatttatgaagagatatgacaatgcggcgtgaggatgcgtattttgactaaagaaaatagtgcgggacaggttggtgagcggaggaagcacgcgaggtctaggattcaaggagtaagagagaagatttgatgactacaaaccaatagatataataaaaagaaagataatataaccatagttacttaggagttgtgaagtatatatttttccaattctacccttatttgagagattatgatattttccattataaagaatgggcttcgcaaaattgtcatcagtctcacgtttcgtatactcagatgagcctacaattcatagatagacttagtggtactaataaccaaagagataatgtttgtaatgacaaataacaaattgccccccttattctaaatctagttcctattttattttcaaccaaatatttctataagtttccatttgaacataaagtcactcaactttcataaatctactgaaagaacatataaaaaataattgaaaactaaatcacatacatttccagtgacatctcccaccgaactccaacacacaaaaaattaccaacaaaatgccttcttcatctttttctgatgacagagattcctagaacagagcacagatgtgtccaaccccacaagcacctgaatagcaatagcaatattaagaaaaaaaaggaaatcgccaccaaaaaaacattcctacttttgagaggggcaaagtgggaagaacaagtcaaaacagcgccccacagattcctcgtccccctcgttgcgtttccctcctcccttatatctctcccctgctttcgctctcctcacaccacaccagttcgtcgcaaaacccaaacccgttccaaccgcaaggagactccgctctgcgaagaacgggacggatctagctcgaccctctagaccggcagacaaaggagacgccttcgtgcggcacgctcttgggggta

SEQ ID NO: 1129 - DNA, 1500 bp, Zea mays
actactactactactttcttgcaggaattcggttcctctgtcccggacaggagcgtcccctgacactgacagcgacgacctttgatctcgtggggattccctctgcattccaacgtcgtaagctgcaccaaccaatcatttgcgagcgcaaaatccttgttgccaagtccaacaacactaggatagtaaaacctctgaaaaagtctcaaaacacagaaaggcgaacggagacaccaccacatgaaaacagtagaatggtgagccagtgcggttaactgtctacgcatgcgccggcgccgcagaccgcgtcacgtttcgacagcaacgcgtgtcccacgtccaatagctgggcggcacctacccaggagatattttcgatcgccggaccccacgcgccccgccggcgccacacgtgtcgacgcgccagggcgccctgacgctgcggtcgtctgtcccggtaccggtccgggcggccaccccgcgggaagcacagaactacagaagcaacccgaagccggttcgaaagatgttgccggcttgccgccggtaataattgggcgccgggtgcgtgcgcccgcggcccccgcgaacccgagggtgagcgccggacacgcgtcctccaccgagggccgcgaaggcacgtggccggcggggcgagcgcgggtgccgggacgcgtgtccggtatacttccgccgtcgcccgtcggcacgtccggttttagcgtggcgtggcgtgtcagcgcgttgaaatcgtccggcgagtgcgtgaggctggtggtgcgatgacgcgacagtgaacgtgaaccatggccggcggataaagcacggtctgggtgatttgcagtgtcctgtgccgttcgcacgcaacgcaaacgcaggcatggttggttcacgttcgctgtcgctgcgccgaccagggcagcaggaacaggacacagtagtacggctaggctggttcgggatcgcgacgccgcgagactgttccagaagcttttaggctgtttggatcaatggtgcaccaccgcaaccaaacaaacaccctttgttttttccgcttgcgtttcgtctcgtccagggaacaacagcacggggggcagtcggccaacgcccaccgtcagtgctcagcgcggcgctcgcacagggagggattagcgcgtaatagtcgagatatttagaggggtggagtgcgttcgatgcctgggagggattggtccccttgtcgcgcgtccataaagacacaaacacgacgcgaatcgggtccgtgtccgtgtccgtgtccgcgcacagcgcactgcacctgaccgccggcagcggacgggcgtatataaccggctacggcctgtgaaaattgcggcacgccgatattggacaccgaatgagcgagctgcgagcaccagtttaggcaagtgagcagctcgccagttgtcggtcgcggcctcctgcgctcagcgcttcgctcgcggtgccggtgcgtgaggtgaggttgatgggcgcggaggg

SEQ ID NO: 1130 - DNA, 258 bp, Zea mays
agaggttgtccattcacgtctggagcctgatgtctcttttgtttgctgtcaggttgcgaagttaggccaatctttagaagtttagttgtggcctcgatcattgcgcatatcattatggttttgtggcctcaaaatatttacatgtaactggtacttaagctgttccaactgccaattttgacagaaatactgagagagattgctgatgtatatttgtagctttcatacatgagtatttgagtttattatcttgcaaaa

SEQ ID NO: 1131 - DNA, 202 bp, Zea mays
ctggggattccttatggcgtttttaattatcaggagaagaaagcggtcagagggaaaggtccagataaaatggtggtccttactccttaaggtgctcctgctttgtgaacggtgaccctaatgcgagatgccacatgctgactcttaaaacctgcaacctgtgcgcatcctggatacttcctgctcgtgaagatcgtgtgcg

SEQ ID NO: 1132 - DNA, 334 bp, Zea mays
ggtttttggtcccttagactccctatgcatattcaagataatagctaattttaccagtcatgcactcatgcctgcagcacatgatcttctggtgaataatcatgctttatacttcctgtattgtcgtcatgactccctatgcatatgtctacattcatttgaatgtagacggaagaaaatagggctagaaaatatgtctacattttcttgcaattgagcttttaattcatctggttgttttgcatttatttatggttggcttcttgagggcttcacctagttctgaaggcctgaattattgaatggctcaataccataggtaacctgcttgaag

SEQ ID NO: 1133 - DNA, 116 bp, Zea mays
ggtaacactatttcttttcttttatacttatcatttcagaaaccttagtgcaccatggttgtgaagaagcacgggcttggataattcgcaatctattggagaaagatggacttttc

SEQ ID NO: 1134 - DNA, 899 bp, Zea mays
gttaaggatatgtgcggtgcggcgcggtgaaattatgtcggtgccggcgctgctgtgtggtgtgtgggtgacaagtcacaagtggggaatgataagggcctctgctttttatggattattacaagctcagtttcggctccgtgagagtgaacccgacatccgagctcgcccgcccggcggctaagtagttgtcatgaaacctgcaacctcgcgtctgcctgctactgcagctgctgcagggcggctgtaatttggatcgccttggtgttttcagctggtttgtgccacgcggggccgtcgctttcggctgggataacgaaagcaacctttgaggcgttatcgaaacgagctgtctgtcttgtgctcctgtcttatctcttatgacaacaatggcagacgcggatgggctgctcgcgtgctggatccgtggatattgataacatgcagatgcaggggaaaatgatggtttgctaattacgttaggcgtactggtagcaggatggtttgctaattacactagcagtacaacacaaacagcacgggagctttaaccgcactacttgtgttaattgtcacattatggtactgcagattgtgcacgtagtgagggccctacccatgctgggatcctaggacggtagtctaattgacaataatgttgattagtgtgtagttggttcattagtcaattgttaagtattgacgtgggatcatgttcctaaattattgaatttagattctttgcaagcgcaaaatcttcttttatactctgttttaggtcaggtgttgtgcaagtgcaatgcaggcagtgtcgtttttttccctaagggttactcaatgctgattgtttcttcacgcttcttttatcatctgtagtctctgccataaacggactgtac

SEQ ID NO: 1135 - DNA, 1491 bp, Zea mays
ggtatcaaagtcttgctgactgtaggactgctaacctagactagaatggtcgctctaaggactatagacccctattctcaccttgacctttggtatcacttcaaaagttggtcatctcaaccaattctatgttatattactactatatactcaccttacaaaatttttatcttattctgcttttggtttacttgctggtcatatagttatgttctcactcttgtgcttacgacatcttctgtagatggctcgtcttagatgcactggatgtaagtcggtgttgggaacttgttctcaaatgctatgaattaagaacaaggcaacatagaatgtcaaatgttaaagtccttcgtccgctgaagcattatttccctgaggatttaatgagcttcggacgaaggttatggatgataaatcacgaaggtcctaccttcatgttcagaaataaaacaatgtgaaatgaaatataaaatataaaacgttaaagaatatcaagaataaataatattacttatttattctttaatacaaactgaaatattaaaacatgatgtttaattacatttataccttcgccttggcagaaaacaataattccagagtaacgcgtttgcaattacgggattgcgtgaacagtaaaggagtactgttcactatttataggcacaagacgcagcctgtaagawattacaatcataccccttacaaaagattataattatgactcagacccttatggactaaaaagtcattccatctttaagtcggttcgatccttcatcttcggatacgctctaatatcgaagctttatgagcggtagcttcggtatcacgttgtcggcgtttcgagaccggggggtccctcgggccgacgagtgagtgtcgccgcgtgccccagcccagatgggtcgagcgcgagggcgagcgcgaaggggggagaagcgaggcggtcggaggccggcgtgagagaggtgggaatcccgcggccttcgtgttcgtcccacgcccaggtcgggtgcgcttgcagtagggggttacaagcgtccacgcgggtgagggagcgagcggcttccaagcgagcgcctgtctcgtcctcgtccccacgcggccaaccccctctaagagggccctggtccttccttttataggtgtaaggagaggatccaggtgtacaatggggtgtagcagagtgctacgtgtctagcaggggagagctagcgccctaagtacatgccgtcgtggcagccggagagattttggcacccagctggtgtgatgtcgtggccgtcgaaggagcgatggagcctggcggagggacagctgtcggagcggttgggtccttgctgacgtcctcttgcttccataagggggctgagagccgccgtcgtcacagatcatgcggggcgccattattgcctatctggcggagctagccagatgggacgccggtctggttccctgcggcccgagtcagctcggggtagggtgatg

SEQ ID NO: 1136 - DNA, 1500 bp, Zea mays
atctcgggtgtgtggggtatatcgtgttcctgacaagactcctccaataagcgctaatcactatagacataagacctgacaagactcctccaataagcgataatcactatagacataagacctaggtaaaggtaaattccagtaaatgacataaaaaatgattcgaccctacatcaagcgatttagacgttatcataattaaacgtaacacagtagaacctctccagattgatctagccaattctaatattcttagtgccggttactcgaccctacatcaagctattttgaagctctccaaattgatatagttaattatactatttttagcgcaggtggcacactgacatgcatttcaagtccagcttagcggtataatcttgacagcgagattgcttcgaagtttgaacccgagcgtgtcacacttcgcaccctttccccgaagttgcgacgcgcccggcacgacaccgtcacggccgtccgttaagtgatggcgcagcccaggaatacaaaaaacagcagccccagcccccagcaacatttctcctttctctctcctcttgccgtttctcgctctcttcttccttgcagtgcactgcaaaccaaccataaacttgccctcttctctgcttgaaccgcggagcaagaccgctcttgttctcttctctgcttgaactgcggagaaagaccgaatccgaagggacgttgggactttctggctgggaagactacataccatttctctaattcgggcgtggtgagttacttttcgtcctccgctcccttgatcgcacgagtcaatcctgccattttcgctgtaacttctgttgaatttagtttttctgcagagtttgaatcgattaggatgatcggatctgagatgtggtactgcaggtttgtgctgggagggaaggaatccatggggctgcagctcgatccgcgctgagggttgaaggaaccggccttgttgtgtgctccacccaatcgaggaaaaggggcaaggattgctgctttgttgtctttggtgagcaatttcacagacttggttacgatttgctggggatttgagtgaattcctgactcatcgctccgccgcaggatccgttacgccattggggattcaaccatcagcagggcgaagtgacggttctgcaccacttttccccttatcctagtatgcaccttctcatccgtttcgcctgtcatctgttttgttttgtatcaagttaattgaatatcaaggtaactgaaagctctccatttttgtgcagattcgattttatttgaacactggatgtgattataatctcggttgctgttctgtgcggctctatctgagggtttcctccgtcctggatcgggaaggaaggcgcccttggatttccgtctccatggcgcccgccttgtaacccacggagtctaacttttaaatttagtgtaaatattagtggtagcagctgttaaggaagccccggtctccttagtagccaccgtgtgaat

SEQ ID NO: 1137 - DNA, 285 bp, Zea mays
tgcagtgaaccaatcttgaagttcttccccctatgcgaggttcggaccaatgtggtgggaggcacaccagaaaacccaaaactgtgaccagatttactatcactaactggatggtcgagaatataagctgcaacctccctgaatgcacctccccctacaattgttcccctcttcatcccctcgccatcagtggacaaaggaagaccccttgggttgtttttggccatgggttcctcatcaataggcttaaacacagcaatattcttctgacctgttgcatctcgc

SEQ ID NO: 1138 - DNA, 1500 bp, Zea mays
agcgtaaaagcttctgaaaatactttagaatactaaaaggaaaaaaatgttgcaaaacgagcacaagtataattcagcaaacaacttagtcagaaagaattggctacatgactcgatctgcaagctctataccaatgcagtagaaacatctactcaactatgtaaagattgtgttttctcagagcaagtatgaaaccggttagcctcaatcacttactaggtatttgtcaagactcaagacgagtctcttatcagctagtggaggaaatgtaggctaagaatcccaaagatagaagggaatttgatggctaatgtgttattttttatggaatatttagaaggaaagaaataaaataatttttcaacgttcaaaatgtcagtcactcaatattgcattcctcgtcaaagaagatgtggaccagttcaagttggcttcaggctcctagggcgtcagctggtgtttagtggtttattttgttttctatttctgttttgtaagaattttttctttgttggagtgaccacttgtctcgagctgagatgtctctgctagttgtattttgtttctgtttttatcccttctaataaaaatttcggcaactctcttatcgttctttaaaaaaaaattcagcaaacaatgtctactgaagtcattcactctttggtaggggcaaagccagaatttagattagggggctattagaagcattttttgcactatttacataaaaattagctaaaaacctaagatatcctgtagaattaggggagcattaggaggacattgccctcccctgtgcccctccccctgccgtcgccctgctctttggttctaggcaatatatgaatataataaggatgagaagaaccattggatcattgcacagtatatctgtatataactggaaacaagattgtttgactgaaataattagcaacgttagaagaatatatgaccagattgtacagtacatttttatcaatgattttccccctttcctattgacacggtccctaagaaaacattttgaccagtcatgcaaatattaacataaatttttacttaatctgtcatgctctgttaggccaaaaaaagaactgtataaaaatattttttttctctattctaccggtgtctggcattctttatgttcttgaaaaaagttttatgttatttggtttgcagttctgttgtataatctctagagatttatctaagggtgaccgaccatagttaattaattcctgacattgaaatcctaacgactagatactagtggctgtgtttggttcggctttttgccgattctggtgaccaaaagcagctttcgtcaaccaaacgcttagattttcgctgggattctcgacgaagcgcttcgtttaaaagcccaaatataacgagtactcagaagcgcgccgaaggtcacgtctggcagaagtcgctcgattcctggctcgcgcgcacccctgcgaccgagtgcctgtccgtagcttttttgc

SEQ ID NO: 1139 - DNA, 120 bp, Zea mays
tgccgtgttcttacagctgctcgcgccctctacaggaaggaagccatccaaccgcggagatgtgggagcccaggaggtcgtagcgaggggtttccttgattggtgaatcttcgatcaagg

SEQ ID NO: 1140 - DNA, 693 bp, Zea mays
accccttgcacagtgcttccatatttaataattgaaaaatagtaataaagatgaatatagttagataatgatattttattgttatattggaatatagggggtatatagagggaaccggagataaaaaaagtagatacgaaatgctggaattcctggacgcaaaaaaatgttaattgggtaaacgctgcggacggtctcagcccgccacgcgacaaccgacaatccttcgcagtcccgcaccgcaccgccgcaccgcaccaccgcaccgcggccaaggccaatagcctcgcctagcgctcactcgctcgccccactaccaccgcaccacgcgctcccgtttccgccgatccgagcgcgcagatcgcggaagcccagcggctcagagtccagggggagggagctcgcggcggctgaggaaggcgttcaccaccgtcgcggtgagtgctcccagtcaagcgcctcttccttcgtagtgtcaacaattccgccccgcgcccgcgcggatctgattgtctcgatcgtccaatcgagcggtatttttctctcctaccgtcctacggctacgacatgattagcttagattggacgctaatgttggccaatatgttcgttcgcttgtctctgctttctcatgcgaatccgattcgatcccgcgcctcgctctggatctcgtaggatttcattgaggaagag

SEQ ID NO: 1141 - DNA, 595 bp, Zea mays
cttattttctaagaatttttatttttccaagtaaaattaacttaatttttgtcagaaaaataaaaatcccttaaaaataggactaaactaaccctaagtatacgaaacccaaagtttacggtcctaaaaatcaattatctcacccacgagcgatcgctttctacctcgctatgcccacgagctcgctttctactagctctcgacgcgtcgccgccgaccacagcacggctggcgtgtggatccctcccgctctcctcgccggatctccacccgcctcgctctctctgagtccagtggggcagagatccgtgagcgcgaggactggtcccttcttgggttggtaagcaaccatcgctcactttcttggatggattccgtccaacaaaacccagattcttctccctgtccattcggtcttagctctgggtatgtgtgctgctaacctgatctgtccattcatggctcgattagggtctcttctccagctcgcgagttcgccactggttgacactgattgtagcacttcgtggtgcctgattggatcgcgggtgcggtttgccctccacaaatttgggtttggttccactgaaccccc

SEQ ID NO: 1142 - DNA, 859 bp, Zea mays
gggtcggtcgacgcattgcatgggcaggagaggctgtacgtggcccttgcggtgccaagcatagcgcaaccacggcgacgtacgacgcgccagcattttgtcattaccatgaatggtgctgcactcatcaccgggcgatcgacatgttgatggtcagcgccgggtccttcacgccggccgccggccaccacaccagtcgcgcgcggcatgcatggtcgtacgtacgtgtaggccaccatctatatgtccgctcgcgcagggactactcatggtaatgtatccgtagctaacgtgctgctgctccaacccacagcgtagtcctgtggtcgatggattaggacatctcataactatcttgacccggccggcgcccgctgctcatccccactctgtcctttcttcctaactaacttcgactagtcgtcaactcgctgtagactctctttaatctgtaagcagtacgaaaggatctcatcgtaatggttaaggcttttgttggatcgacaaatttcgagtttaattaaaaaaatccccacgatgtacctcacttcctgtgtcagagatcgatatcctgcacgccaccttccgactaatctgttgcagagtagtcaattaatcggtccgttagctatagaatcaggattcgtgggttttctggctcgaaccatgttttggtttttttaataatataatacaataccggtacagcgggccgacttattttaatctgtaacaagtaagatcgctatacctgcatgcatatctattgccggtgtgtgtgctcgctgctactcgtatgtcgtatccaccatcatcgtctccaaacttgcctctcgtgctccggcctccggctccggcc

SEQ ID NO: 1143 - DNA, 639 bp, Zea mays
tttataaaaccggtcggggaccgtggttcgtgggtcggtttctcgttcctggtccggtccaggagcaagttgccttgccgattttttaaattttgttcaaaattaaatttattttgaaaaaattgtaaaaaatataggagaaaaattatgaaaaaatattacctattttcctaagtaatttgatatatatcattttaatttttaaaaaataatcggtactttttgtaaaaaacaactatattcgtcgagagacgaggtttttgatcgagaaaaccgaaattggtttttaaaatttgtacatcaaaattttttcaaggaaccccaaatttaaaaaaaatatgagaaccgtccagaaaatacggtttttcggtcgggtgaacactaaaaccatttctctaaatttgaaaatggaaagagacgaggaactcgaaatccgtcgaaaaactggtggtttaccgttttcggtgattagcgagattcaggtaaaaaatagtttggttaactctgaattaaatagataaagaaataaaaaaatatcagaacccaccaaaccgcccgctccgatcggcggacgcacacgcacccactgtggaagaaccgttgagctgagccgagcagggagaaggacgcgagagcagc

SEQ ID NO: 1144 - DNA, 1303 bp, Zea mays
tgtacgcggtaggccgtaggcgttgtagcctgcaggatcttgttgcaacttgcaagatgtcgttggccgtcgcagaccgagcagagcaagatgtcgttgcagccttgctccttgcaggcttgcaggacctccggagccgaccgagtgaccgacggaccgagcaagatgccaagtcgccaagatgtcgttgcagcatagccttgcggccttgcgggacgccggtccggcggtccggcgtgggagcgtcagcggacagcggctcagcgtgtggcgtactagcgtgtccctgtcgcgtgtcgccgctgtcggccaggtcgccagacgccagtccccagccgcccggaattgaggaacagttgttgtcgcgtgtcgccgctgtcggccaggtagccagacgtcagtccccagccgcccggaattgaggaacagttgcgcagcgcacactcgccaggaaccgggagtctgggaagccgaacgatcgagaagttggaacggccgtccggcgtcgggcgaacaggatggccgagtggggtcctcggtaggcctggcttagagtgtgtcagggcctacctggactccccttgggtccgcccctgcttgcatgttgtgttgtcgtcggttaatcgctatttcaatgctcgatagcatgctcagctaatcgtttctgctgtctttacttaggactagtttgggaacattattttctcaagtgattactatttttctaaaggaaaatgaactaattttacttaggaaaatgaaaatccatcgagaaaatagtgttttcaagctagcccttatagtctagatcagtcagccaatattttaatatttttatagggttgagtataaatgcgtaaaaaacattatgttatatccgtatgagtaacaaataaagcggtagttggtcacagaaactggcaaagaaaagggcggggacgagcaccttcgtccacgaaaggacatcacagtttcgtccatgatcttggtagctgcggctgctacctttcctgggtcgagcaaggtgtgacgaccatgctggcgaaatcgataaagcgaccaaaagttccagtcaccggagcggcggcggagccacaacattgaacatacccgtcaagatgaccaggtacagatgcaatcgagagccctgtgcaaatctcaaacgaagcttcccaattcccatgtttataaagcccactggcctcgcacacttacagccagaacagaaccgaaacctcagacactctgcatatatcctctgcgcgtgtatctcgtcgaacagagccgaaagctggagcttcca

SEQ ID NO: 1145 - DNA, 108 bp, Zea mays
tgtcactttcacgatgcgctcgacaccttgctacgtcaggcacttgaccggcgtacctggtctatcgagtatcgctgtgttgtcttccagcatagtcgcggggtttac

SEQ ID NO: 1146 - DNA, 1500 bp, Zea mays
atcgatgaagcccctgttttttatttattaacgaagcctctgttttgcttatttacatgaatggtccctggtatctgttctaaactgaattttcaattagcagtgctttaccagaatttaatattacaaaatctcggtttagaggggttctattgatctctcagatacgaatgaattactgttgcttctaaaaaacctgggtttactttgatgtatatacatcatatctctgttaagctatttctagcagataatgcttatggtcgtgcaaaacacggttttgcactatagactatactacactgttcacatagtgagatttaaaatatgagatgagatgtgagataagatgaataggctgctggagacagccttataactacaaacaccgttgtattgtatccttcaaaaaaagaaagatacatccatgcctcattgtttgttcgttttaaaagtggattgaagaagattagatacgattaaatgtcttttagttaaaattaaatagaaaatgatttagtgccactcaatcctctatccccccgcaaagatgcaaccgaacaaggtaggtctcgtgaagaagtgaaaaaaaactcacccgtcaccattccactctatagaaggacgctacctatctttatctctatatttaaactgtaatctgcgaacaaacagtgttttgcacgacgataagctgttcgatgcagtctaacaatttaaagctcatgttgtttgagatgattttcaaaattgtgcctgtacagtagtaatggatgattcatttttaggagaaaattgagcagcaatgctgagataaaagcgcagttttaaaaatcccccaaataatcagacagagggcagctgttgacatgagttggtggcatgagctgctgaagctgaaccaacctacacaggaccggacagcacaccacttggtggacgtcaaaagctgctgccaggtggccgtatcgaggcctgcaccgcaccagcagctgccgccacccatcatttttgccaacacggctccagtgtgtctgagctgcctgacttggaggagtcgcaggaaggcaaaaaaaaaaaaggggttttggtaattcatcattcacgtcgcctcgcgttatagcacgttcttgtgttcacaaaaaagctacgaggaactttcaactgcacacctcgttggtgtccccctcatgcatgaataaagccagcctgtccaggcggaggcaagctgctgtggctgcggcacaaacaccgcgccagcacaacgcatacgcatacctcaccttcctttcctcctcccgtcctccatcaaaagaaggcagggaaagatctgatctggggggtgagagagcaggaggagaaagccaagccattgccctcccctcttgaaggcttggagcttggttctacatcctcttctcttcccctccgtctctctctctctctctctatttggtttgcttgcttgcctctactagactctagtcgtcgggtccggcc

SEQ ID NO: 1147 - DNA, 1500 bp, Zea mays
ttgcgacatcttaatgagcttctccatatctaacttgaaccagttagatttgtctaagcttcttattgaggttgtacttgtaacttgttgcaatataaagtagatgtacttggactcagtaactcataaacaaacccatatactgccactagggttcttgatgtagaagatcctagaggctagctgagagagcctcaacggccggaagaagggtcccagcatcatgtccctcagcttggagggtctcggtctgagagccctggcccctgtgttagatgaccttatgagtacagactacagagctggctcaatttgaagtttctttctgctattgtgatctttgaaaataatgttttgccggtatccgagcatacgacctctttttttcccggacgccttaaaattccggttatgaactagtagacctatggagctgtttgattcagccattttagacctgtaaccattgccctgtgacagctgatgccgttccttagagtttggttagcgcactgcgtaatggatagcagcgttatcggatacaagcatgtagaatctcattcccattccctacctatcgtcatccgataccctaaaaacagaaaatgttgcccacaacaaccaaacaaagggcggtaatcattactctgcatcggatgacaccggttgctgatcccactgccgttaccgctcctttcgtccaagcaaacagcacctatattgcatctcagttaagggtagcagcaccggggacgtatgaggggagaataagaaaggatgatagtttgccaagaaatgaacacagcaagctgttgttcctcctcctttggcatcctctgcctgtcagtaatcatgcggtcaaaatttaattagcaagtgatctctagtggacaaggtagcagagctgcctgctgttgctggtggatggacgtgtttgacttgtgcagctggacagcgactcctttccttcctgtacagtacgccacgccactaaacaagtcaaaaggatggtctcacgggcagcagcatctcaggcccaggggagggaacataatttttttcccaggggagggcgcgccactgacgactaatacgcatcactgcatcagttcacacacgcaccagttcacacgacaccctgctctgctgcttgcataatttatttagtagtcaaaggggaaaacaagaagatatggatcattttggattagatatcttgattaagacttgaatatacataaagacgtatgaacgggcgggcgaagatagtaagggaaacacggacagaaaagtaataaagatattggctcttttaatattagatatatagatattggtattgaacattgattgatatacagagacggacatgatggggtttggcgtcaataaataaaagaggaagggccaggggaaggagaacgccaaaacaaagcttttgttgtctctcacctactattcttcttgcctcctccctccaccagcatccctgagtctgcc

SEQ ID NO: 1148 - DNA, 217 bp, Zea mays
ctaaaatagtgtgcatatatttgttataaaaagagtgtgcatataaaacgttccaccttataatgtccattatgaatgcatgttgtaggaagttgatgacttggggagttggggtactggatcatgttatagtttctgccaggcttgaccatttgtgacccttttggatattattaccaagaaatttggacatactgccattttacacctgaatctc

SEQ ID NO: 1149 - DNA, 213 bp, Zea mays
gagcttcaaagaatacaaaacgtaggaatttaatgaatacatgatgctcatctgcatcttctacttctgacgtgaatgaagaaacaacttctgctgacttaacaagtgttgcaacacacacctcatcagatacacgccttggtaaactgtctatgtctttctcaggtcattgtatatttaccttatatttatttattctttttataccaatta

SEQ ID NO: 1150 - DNA, 650 bp, Zea mays
tgtggtagagataaacttcatctcttatatttttgagagtaaataaataaaccaaaaattttactaacgtcaaaataagaaattatctttaaaatacacattcttgggcccggccgtcacgcaagcgrgactgcgggaggcgagagccgctcggttcgctcaccgagttgggcactaggctagtaggctagctggctacgcaggccgagtccgttcggtgctgccgtgcgggagcgcttgctgtctccaattccgtcccrtttgctttcgtggaccggttcggaaatcggaaggcgttgcaatgagatgctgcggaggcggcgagaagctcactctcgggcgatgagcatattcacaacagtatcttaatctccctgcctccctcgttccctgtctccccggcaagccttcggtcgcatcggggtggcgagcttgcgctgtcagcggcgaacccctcccctgcccccgcagtgcttccgcctgctggctggactcaggtgagcagtgtggattttcgggttcgtgcgatgcggtcgtgggattgacggatgtattttcccattttatttattcaattttgaactgccaattgaagttctactcttgattttttgttcttcagttcggcccttaacaagagaacgaagacc

SEQ ID NO: 1151 - DNA, 1273 bp, Zea mays
catgtggaaatccgcgagcgaggggggcgtgttcgccttcaccccaacgataatcagttgctatgctagcagtagcttatagtagaacaactcagaaatacatatatgttatatgtaacatttggttgctaattaattagtgcaatttctaatccaaacatacataaactaattgattcacgaattttatatattatagtgatgttgtcgttctgtatctatgttttatactaatttttaactcttatggaaacgcatgggtacatacctagtatatatatatataacataacactgcacttgacaacagccatgggccaacggccaatgccgacggaagtcgtatcaggggtcggtgccaacgatcatggcgtcgacaccctgctatagaagcgccacattagcatgaggtagagctcgacgccatctatattggcgtcgagacgtgtaatctcgacaccaataatgatgatgccaatggcaaaaaagaatgtagttgtaaaaaaactttcgcaaaaagggccaaaaagcaaaaaaggacggcaagaccttaaactcggttgtcacggtctcgcaagactctcgtcccactcagcacaattacaacggctcatgcaagagccgaggggttgtgtggtttttctaaactcactcaactaactaggattcacctagagcaagcgctaaaacggtctaactaacctaagcacttcgcaaagcacctacgctaatcactgagtgattctattaagcacttggatgtatgagcacttggaaatatgcactatgtgtattggaatgttgcttgggctctcacactagagaatggccggttggggtgttatttatagcctccacaccctcaactagccgttggacagaaagcagcagctttctgtcgtcgggtgcaccggacagtccggtgcaccaccggacactgaacagtagatgtccggtgcgcctatgtcagccgaccgttggcgtctgtagcagtcgaccgttggatccgaccgttggattcgaccgttgccgtctgcccgttggcacaccggacagtccggtgcacaccggacagtccggtgctacagcccgagagcgcctgcctgcggcttctctgcgcagaccgtccggttgtcccaccggacagtccggtgcacaccggacaggtactgtgcactgtccggtgcgccaccaggcgctggctgacagccctcttctcaggtttctttgctgatttctatgggcttcttttgttcttgagtcttggacttct

SEQ ID NO: 1152 - DNA, 721 bp, Zea mays
gttaaatatttaaattttaacttgctgaatcatttgactagtttcttggagatgctcttatcattttttttttcgaacaaaatctaatatacacacaacaataggagaacctgcgtgtgtatatataataaagagggatacgatagcttttgtataagatatatattttggtttagttaaaggataaaaaatatataccacataattacgaagaggtatgcgtattataggtattccgttagtataaaattataaaaaattagagacttccatattkgcgtggacatgtggacatttgttctaattgtctcggcgggcggagtgaaaaggagaaaggagaagataaagcagaggatgtgtcatgtgcccctcattaaaaaggaggcacagacgccgctgagctctactagtaccactgctccgctcatctctcctgcggcggtggaagattaggaattgagcccgcggcaagctcggggagttactgtgaatccatctgattcccacccacccgcgcagacgcagctgcattccgcgatcccaggcggcgggaggcggctcttgatgctagagatgctcgctccgcgtcgttctcggcagcaccgacggcgggtaggtggaggcagagggccccggtgagaacagaagtgtcagtggtgctggtgttcccttaccttcgccgcttcgcgagtgctgttctttccttcagttgtcggcggca

SEQ ID NO: 1153 - DNA, 619 bp, Zea mays
ccggagcttccggaggcaaaaaaaaaaggagatcgatggataccactgtggtttccagtaacttggatcagtttgtacagtggacgagtggagttggccgttgctgtttttgatgtcgccatggttgtgggtgaactcaaaccttaaatcgtggtgtgcttagcatctttcttggcgtgtcaaactgtcgttgtgacttgtgagggatgggactagtgagttgggttttgtagagttacttggttatcaatgtgcagacatatatgtatgccgcgatgagtgttagtacatgcctactatggttatcggtgtacgaaagtgtcttagctgctgttgtttgagactgccatggatggatgtggttgtgttttgaaggagctgcccttgtggccatgtgatgaataaaagcacgtaaagcaagcagactagcagagggttacgatgtgcagcagttaggaggagcaggtccggcgacggcgaggcagatgaaacaactcctctgttcctccctctccatcttgttgctagtagtatatatatttggttgctcttgcattgcagcaagcagtacttgatctgactgaggcacccatttccccaagccacaaaagagacgagc

SEQ ID NO: 1154 - DNA, 1428 bp, Zea mays
gtcttcttatccatttactggaaagtggggatttccttgttatgctgaaaatgtgcaactggaagtttagagatggaacctcgtgtgtgatgataatttgagtagcgagttgttggcgtgtggccgtgtgcaaattcaagcaaccacatttgtctgagttgttgcattgtttaaccagacacaaacagattaggatgttaaaacatagttgttgctgcatcttagggctttaagattatatcccattggtcatcggattttaaataaacttcgctagtttgaggacgataagaaggtcttctcccattgttttaaggaccacattttttttcttttgtttcacgatattattcaaagttgcaagctgaacattgtgtagcttttatcatcatcttcatgtatgtgtaaatgctacagtgatacattattacaagtttgcaatgttccatccctttattttgtattgggttatactcctttttatgtgctaatccactggaaaacttagagcaactccaatagttatgtaaattttagctctctaaatcacaaatttaagaagttcctaaataactttgggagtaaacaaatctgagttctctaatagttttctaaatatatgttgtagttttgttttgtatctatccacattaaaaaataagtcacaaatgtcagcaattatcttcattacctacataatgcagccaacatttttgtttagtgagttgctaactggttgccaaatgtaaaaaggaaatgaggttagatgagaagttgctaaatttagaagttagcttagagaactattggagaggagttttatgttagctacctaaattattgatttaggaagtattttagagaattactggagttgctctaaacaaacacctctgactccctaaattaaatgtatgaacctttttctttccaacttcccatggtccgcgtgaaatcggttcacacggaaagacaaacagccagcgtccacctttcaaaattcaaaatccaaagccacaaacgggcccatgcgaagcctacgcgccgatctccgcatcggacggatgtgatcttctgggtttcctcgggaaaccccacgtgccgtccgatccggtgacctatcctcccccccggaaaaaaaaccggccggcgcatttgccttcccaattttaaaaacaggggttcattccgaagtccggttggcaaccgccccccacattccccagagttagcccgatcagatcgtttttccctcgaggtaatgccgcaatcgaaccgatctcaagtttcttcggatccttgaattttggtggatttcgtcgggttttttttgggttcattcgtcttcgggactttttggggatcattagctcttgatttaccctctttcgcgcgttgatctttgcggtgtttacaggtgagagtaag

SEQ ID NO: 1155 - DNA, 1500 bp, Zea mays
attttaacaaactagagcagtagagatgagatatatggggaagaaagcagcctccagaacatctcaacctaatgctctgcagagcggactgtattgcacattagacatgataaagaggttccttccattaaaaacacaagggttaaattttagcatgccactcaaaattttgaaaaattggaaactaattcattttccatgccactcccatggcatcaaaatgaactagccgtccaattttgtgaaagttgaatggcatgtatacaattaatccaaaacacaatgtcagggctaaacagcactgtatcaatagaccagcagcatttgacgtgagatgcagaagttgaatatggtatttaacttgattccctcaaacagaagttgaaacctcaattacacacaaaaagaatcagtgttctatggggcatgagcagcacagaagagacactagcatatttacatctacatatggatgtgaaaaatgcttttgcagttcactagcagcaacttcagaacacttctcccattcacccctaactacgaactgagcaacgcatggtcgcagtctcgcagataaatttcaactttagctaatgcattttttgatccaattccaatctacggaatttcaccatattatccaacactaaaaatcttcacaccactcttgctacgattgacgcacctaaccgcgcacggaccacaataacacagtaacataggaggcgtgagttgaggagcgctcacctggaaggccagcgtcacgggcggcggcgacggggtccagtagccacccgcgcccgtcgcgggcgatgggggtggggtagagctccgcggggaagcggacgagatttgcctggggctcgtgcacaacggaggggcggccgccgagcgacggtggcggcgaggggtggtggaagcggagcgagagccaggtgaggaggacgaagagtgagagaaggaaagggaaggacgccggccgcttcaggaagtggagcagcgacgacgccagagtgtgaggtggaagggcggcggcggtgctggggagaggcggcggctgcgtctggatgtgcagcgcgatggctcgcctcgggttcgccatcgacggtcgccgcacgcgaatcggaggtggcggtgctggcgagccgttcgtggggacgggtaacgggttgctgacttgccgccgccgcaatgggctgagccgctgcgtcgagcccacgagctccacggccagcctggcttgtcagtccccgtctcgtttcgctactcgaatcagttgggacycagacggcagaggcttacaacagtgctccgctttgccacgtcattttgaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccacca

SEQ ID NO: 1156 - DNA, 505 bp, Zea mays
aatcattgatatgtcattaaaaatgctgatgtgtcacagtaattaatgtcatgaaactctccatgaaaccctcattgagaatagcctgagagcgcgtgggtgggagggacagatcacagacgacgaggaggagaatgctccgtctccgcacgcaccacgcgatgcttcgaattcgacaattccttccgtggccctgctccttcccttccctccctccctccttccattccaccgcagctggccaccaccacacaaaaacggcaaaaacacacaccgcgggcaagcaccgccaatctctccacacaaaaaatccatcaactactcaaccccctcctccagcctctgctcgccgcgcgcggcgctgtagcattctgccgtccatcgtcgccccggctccccatccctgctcctggcgtcaacatccyaaccatccccggagcgcgccaggggtggcggcgacacgaggctgcttacgatcgtcggcgacagcgcctcctcccactcc

SEQ ID NO: 1157 - DNA, 131 bp, Zea mays
gggcacgtacgtacgccccaggaattcctgggacctccgaagctgccggcagcacccgagagagtctctccgggactacatccggcgattcttgaagcagcgcaccgagctgcccaacatcaccaactcgg

SEQ ID NO: 1158 - DNA, 88 bp, Zea mays
agagtcgacctgcagatctcccctacaactctgcaagccaatgctagcggcgggccgacatcagagtgtcgcattgtggatgccctaa

SEQ ID NO: 1159 - DNA, 545 bp, Zea mays
cgagacggcaagctataattactcaacttattatacgataatcgtccatgtttagtgaagttgtctctacgatatggcatgtatgttttagattcgttactgtcggttttttcttttcgataatggtaccacaaatttctctcttacaaaaacttcgcgagctcaggttaggattagggttgaggacacagaacccgatgctagctcactcgcgtacgtgtgcttgagtgatccgcaggccaacgacactcactgtcgaccaaagctcccatccggattccagcatggagaagagagaacaacaggccggccggcacctatgcctatgctatgtatatatgctctgagcgtgacctgagctgagctagcgagacgaacgcgattgggaatgtgaatgtgatgctccacctccactaccactctatcgcccatatcgtccgtggtccgtctcgcgccgagcattcgcattggcaaccaaaccaagctgcttgcattgttgcccgtcccttcgttgttcagagatcgaacatccaagtcgttaggaa

SEQ ID NO: 1160 - DNA, 670 bp, Zea mays
ctattgagagagggtatttcattcatctataaatctgatgtggcatttttggaaacagagacatgaaatcctcattgtgagtagccttacgtaacatcaacgtgatgactgatgagacggcaaatcggcgatattatattaattaacctgccgtattattgtctcgctctgtatcagcaacgccgtcgcccatcgcctccgaagccacgatccacgaacggctccgtgctccgcctcgtgactggaccccgacagaacactgaacgggctgctcggtgaccaagactccaaaagcgcgccgcatactaggcatattccggatcccgagtcaaaagccactgcggagacggagggcactgctgcactgctgttgccttgttgcattgcatgtgtgagtgagtggagactggagactggagagtcacactggccgcgcctgcgctccgaggcagcggagcacggacgagagacgccgccagctcagccgttgattgatgccgcacgagcctcgcgacctgcattcgatacaaacaaggccggcgcatcggcattcctccttccttaaacccaccccggcatcgggcacgccgcacgccacgcctcaccgagtcaccttcccagccagctacccttccccctaccaattccaaatctctcacccggcttgagg

SEQ ID NO: 1161 - DNA, 345 bp, Zea mays
agttcatctggagagggcagcataaattcacgcacttcagaaggctcatgccagggaagtccagcaaaccaaacatttgtttgtaagccaatcggcttcaatgttcgcagaacctcaacttaatcaagaggagttcaacaaagaaccttttcaagaaccacaactaccactttcaaggatgctgattgaagattctggtagctccaaagatttgaagaatctcttcacttcaacatcggaccaaccatttttggcccctcccaacaacttggtgtcaatgaagcattcagggactgtaacgataaaggcgagttttaaggaagatattgtgaggttccgtttccc

SEQ ID NO: 1162 - DNA, 647 bp, Zea mays
gctctcatttttgtgtccatattcagatggatgaaaatgaatctagacacatacatcaaatattgtatgaatccactgatatgttaaaacgaatactattttgggacggagagagtatattccaagattgttgaaggctatctttgggttttcatctttttggaattcttctgaccaggagggactctatttatatattccaagaaaattaaggatatatagcggggtacctaaggcatgtcgataataaagactctgactaataggaccgagcaactcggattcggtggagtgactcggacttggactgtgcaactcggattcagccgggatactcaaaatcgaaatccaagggactcggtccataggttaatactcatttaatttatatatatataattagttttatgattaaactatattttaatactcatattttacatctaaacgttcgatgtgcgtggaagcaaacacccccttagacgtgggacaccacctcttgtcgaccatttgtagccttcttcatgttccgttctgccgactgatggatcactcctgcagctgcagctgcagtgcgtcgccgctactccatcgtctattaatggctcgtgtagctccagcgctcggcttagacaagcctctccaac

SEQ ID NO: 1163 - DNA, 200 bp, Zea mays
attcgatctcggtacccctggctttcctttttggcagcggtaagaaaaagatacgggttttgaataggggagcggcgaggggggagcgggttggtaggtaggattaggaagtgtcagttcctgctcaatcttaatctccaggtgctagagagggcagtcaggacactgaaaatgctgatggcattaggcatcttcgagaa

SEQ ID NO: 1164 - DNA, 1260 bp, Zea mays
ccggagcttccggaggcaaaaaaaaaaggagatcgatggataccactgtggtttccagtaacttggatcagtttgtacagtggacgagtggagttggccgttgctgtttttgatgtcgccatggttgtgggtgaactcaaaccttaaatcgtggtgtgcttagcatctttcttggcgtgtcaaactgtcgttgtgacttgtgagggatgggactagtgagttgggttttgtagagttacttggttatcaatgtgcagacatatatgtatgccgcgatgagtgttagtacatgcctactatggttatcggtgtacgaaagtgtcttagctgctgttgtttgagactgccatggatggatgtggttgtgttttgaaggagctgcccttgtggccatgtgatgaataaaagcacgtaaagcaagcagactagcagagggttacgatgtgcagcagttaggaggagcaggtccggcgacggcgaggcagatgaaacaactcctctgttcctccctctccatcttgttgctagtagtatatatatttggttgctcttgcattgcagcaagcagtacttgatctgactgaggcacccatttccccaagccacaaaagagacgagcatgacaagcgaatccgccaccgccaccgtgatccagatggacgacggcagggccccggttgttgcagcgccggcaccagcacaagcactgggagcggcgccgcgcaagacgaccaccggtctcccgttcctgctgcgctcgggcgccaaggggttccggtgctgcctggccgtggtggacttgctgctgaggttggccgccttgggcaccacgctggcggctgccatctccacgggcaccgccgacgagaggctgtccgtgttcaccaccaccttccagttccacgcgaggttcgacgacttcccggccttcacctccctcctggtggccaacgccgtcgccgcggggtacttggtgctgtcgctgcccttctccgtggtgggcatcgtccggcccagtaaggcggcgacgggcgtggggctgctgctgctgcttgtctgcgacgtggtggtcatggcgctgctcacggcgtccggcgccgctgccgcggccatcgtgtacgtggcgcactcaggcaaccggcgcgccaactgggtgcccatctgcatgcagttccacggcttctgccagcgcaccagcggctccgtcgtcgccaccttcctcgccgtgctcatcttcgtcgtgctcgtcctcatggccgc

SEQ ID NO: 1165 - DNA, 1500 bp, Zea mays
acttttaggggtattgtgaacaagaggatgagtaaactctaaaagaacaaagctccaatgaaaatttaggtttttatgtggttagtcatagggcaagttgcaaacaggtgttgatctaaaaaggaagtagtagggaaatgtgaagtgtctttgcgaggaattggaaaatgaagatcacattttctttgggtgcatcatgggaagaaccatttgggactcttttaaggaggcctaagaatgccataaagtttgcaagatctttttgaagagtgtctacctataaacaatagtaaatatcatgtcaaaattttcatcttcgccattattctttaggagaatttagaatgttccgaataaaatatggatagaaaagaagttcccaaagtcatccaattttctacaaaatcttcaactttaagattgagagtgggtgttgtaaagttcttggaagatgagttgaaccccatggaggcgttggctaaagtactgaaagcaatctaaagacatggaggtggaaggcctgacgtagatagagaagatgctcttagctttcattgtctttcttttgtagtcatctgatttacctctctcgtttatacaactggttttttaaacactccttaacttttcaaattgtctctttctttaccctagactagataattttaatggtgattttgctaatgtggcgccatgttagatagaggtaaaatgaactagttaaaagctcagagtgataaatcaggctctcaaaaattcataaactgttttttaaatatccaaatatttttacatggaaaataataaaatttagtttagtattaaaaaattcagttgaatatagttttgtcttcaaaaattatgaaactgatcttaattatttttccttaaaaccgtgctctatctttgatgtctagtttgagacgattatataattttttttgtgcttaactacgacgagctgaagtacgtagaaatactagtggagtcgtgccgcgtgtgcctgtagccactcgtacgctacagcccaagcgctagagcccaagaggccggaggtggaaggcgtcgcggcactatagccactcgccgcaagagcccaagaggccggagctggaaggatgagggtctgggtgttcacgaattgcctggaggcaggaggctcgtcgtccggagccacaggcgtggagacgtccgggataaggtgagcagccgctgcgataggggcgcgtgtgaaccccgtcgcgccccacggatggtataagaataaaggcattccgcgtgcaggattcacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaagg

SEQ ID NO: 1166 - DNA, 245 bp, Zea mays
atatgtcttctttatcgtctcaaacatctataaaaaagtatagactataattgctagatcttctcatagatacaaaacggtaattaaaatcgtaacgaggagaggagatcgcgtagagcagcatgatcgacgatcctcttctagaaccaaaactgtgtttcttgaattataaatattccacctcaattcgcctccccgtttccgagaccaaattaacgcatctctacaggaaataacgatgtgag

SEQ ID NO: 1167 - DNA, 368 bp, Zea mays
tccttgcctcgccttacgcccttaagaacactgataaagagagatggagatagtatgtattggaaaaagagaaaggtgtattgataaaagagaggtgcattgagatcctataaggtcaagtattttgggacaatttgaatcctgtaagatcatccagacggagggagtactacattttgatgtacttttatgtttatgtttttttaaaaaatattcattttttagcttttgaacaatcttttgtatgcaccacttgtcataactttcatgtgaatcagaaaattaaccaaaaattggttgattcactttggagttagattagtgtgcatatataggattcattagctccattaaatccttgtcaccca

SEQ ID NO: 1168 - DNA, 1049 bp, Zea mays
tgcctcaccaattcaaagacctgatgctgtaaaattaaccttttcgaagacatggtgcgggttgaagaccacggagaccgaatcagtgtgatggatacgatttatctgaacgaaaacaaaatgagtacgccagtagatctggtacatgttaatcagaaccttatagtttacgataggaaactagaagcaaacgacgtgaaacgaatcaatatatgaaataataatggggtgtagcaaagcacgatgtctccattcagatcaaatcgaatccacaaacaagggatgtatggtgcaaaccctaaaaccttaaccgacacatatcaaaatggttctacataagaacttacgagttcgggattcagattggaataattgctggcacaaccaccatcttgagctccggctcgttggcggtagtgtgccgcctcccgtcgacttgaaagacaatgaacgcgtatcacatacaacagaaggggtgcgtacgcccgcaatgagaaagggggtgcggatggaggcaaacagggggagcagagtgccttcctatcggtgatggcgagggagtcggcgcgtcgcctgcggcagagggcgggtgggtaaaaccctatcacgtatacatgacacgggagtgacgggcacggagggcggcttatccccaagcagaaatttggtcgatttttaagagccgttgcgagatggtgtttactcgatgtgcggtcgccggaagccatgtcagaatgtggccgtttgacacaacttcgagcatttgacggccagaagctgagccaaagggccatgtttggtttagttttttctgacgagcttttctgataatctggttgtggagagaatctaattataagaaaaaaatctgagtatcgtacggaggaagatgacaagtttgacaattcgtagtaacttttgttaccagaaaacccaaacaaacgcagtctacctcgacagtcgacactcgagagtcgagaccctctcccagcatcaacccgccccgcgctgccctcgtcccgatctccgacccaaatacccgatccacc

SEQ ID NO: 1169 - DNA, 1500 bp, Zea mays
ttaaaatattaaatatagtctaattataaaactaactacacagatgaaaactaaacgataagacaaatctattgaatctaattaattcatgattcgcacatgttatgctgcaatagacatttgctaatcatgtattagttaggcataacaaatttgtcttatcatttagtatttaactgtgtaattagttttataattagactatattgaacattcataataggcattcaaatatccaatgtggcacatgctagactttatatttttagtccatataatcaaacattcctttagactatctctagtagactacatcacaccttttatcctacctcttattttaaccctactctgtaaatagtacaatccatagtagaattaatgttttgatgtacgatatgtggagctcgaccttggaatgaattcctcgagatggttttgatatttagagagttggttttaaagtttactctctaaattattgtttacagaaaaatatagagcgttaattaaataattttttttgtattttagaatcttgtttatattttatacacactttagaaagttgttgtcttataaagacaaaagtgggttttccctgtgttttactagtggggatctagctagaatggaggaccgaggacgtctgtttttacagttctatttaaaaaatgatagttctcgaagaaaatccctatttctataattttaaaaaagattctcacaaaatctctatccgtatatatccatgatttatctcagatgcaacagctactatacatacaatcattagatgcaagcgtgcaaacaggtcttttgttccgttagatatagatataaccatatatgtaattatagtttgttatacttttttataaagctacatgagatatggtgaaaatgttaaaatactaaatatgatatacatttagatctagatctaacagactaaatagatataattgcacacttatatctaatggctgcttggataagtagccgttgcctcaggaagtgactgtcttttctaccggcgtctttctgtcgcggcctgtaatcgtaatctcgaccttttgctcaactcaaatgggtttggcccgaacctaggtaccgagccaaatttggcccattgatgtaaactgaggctgtggacaaccaattttctttctattctgagtctagattgccttccgttttcttactccaaaaggtttttcttactccaaaaagttcggaaacgaatgtggcgcgcgtcacggtcacgcccgtgcatcagctgccgacgtgcaggagaagggaagaccgggagagggaagagcccccgatcaaatctcgcccgcgctgtcagtctcagcttcctttccaacgctctgcttcctttctctcccgccgcttcccgtgcgcctcgtgagtcgtcgtgatacaaggtgtaggtaaggatcgatcgccgattagccgccgcacctatcgcctctcccgcgcggcccgcccaccccc

SEQ ID NO: 1170 - DNA, 279 bp, Zea mays
ggtgagttgtccatccatcctggggccggatcgttcgagatccgcgcgcaagcgcaacccaatcacccgccgccacgtgggccacgtcgaagccgatggcgtcccgcgcagggccccacaccgcagctgccgtggaaagttaaaagcgcccgcggggatacacgacgacaacacgaggagagactgcggcagcggagtgcagagagcggacgcaacgcaacaccgcccactctctgtcactgacgatcgaagtgaggagcgcactgaagccagccgccg

SEQ ID NO: 1171 - DNA, 286 bp, Zea mays
tgcagctactatctcctttggcgtcgctgtccagtagtgcgtcagcggctcagcgcagcgtcgcttccaattataagtagcgtggccagctaccatctccccaacctcgcctccccccactccttccctccctccctcgctcacccagtggggcagccaaagccgagccgcaaccgcaaagatcttgcgcggcctcctttccccagctcgtcactgtgccgctcgtgccatccaccctcggttcacccaaccaacaatccatccgccaccacaccccgctgcggcg

SEQ ID NO: 1172 - DNA, 140 bp, Zea mays
ggcaaagccctcatttttcttggtgtgcatatagcttgcatgcatttgattgggtttaggtttgccagcagcagcaatttaaacgaataaacaggatccctttctttctccaattttcgtgtgcgtattaattagcttgc

SEQ ID NO: 1173 - DNA, 1500 bp, Zea mays
acttgggttaagttttacccctttaaccactatttagggttaagaccttaaccagggttctatttgcaaaacacttaaaacaatacaactttgtttgaaattttttgcctagtgaatgcactctaggtgtgtcaaacatatgcaatgccaatgctcatgatgccatgctcaagttttagttatagtaacaccaggggtgttacaccggattgtctattcattgtccggtgcgctgttagagcaatgactagctgtcagaactagacgttggtgcacaccggtggcacaccgttggcgcaccggactgaccggtgcgcccatgcgcaatagcctacaataacgactagttttggttggtgggggtatttataccccctttaccagtcacatttagtgtcttgctgcccaaatacacttgtattcattgttagtgcattgcaagaccaaatggcctagtgaggtgattagagaatcttaatcccgcatttggacctcattagcgctagagagagccacctagagcacacaccacttgcattaggcttctcttggtcaagcgaaagtctacagcttgttactcttggtgatcggcatcacctagatggcttggtggcgttgggagctcggtgatcaccgtggagatcttgttggtgacccgactcaagtttgtaagcggtcgtgagggatccaccgcgccgaagtggcaaaggatcatctcgtagtgagcacttggttcttgcgaggaccaagggggagcgatacccttgcatgggtgctccaacgaggactagtggagagtgccgactcttcgatacctcgggaaaaattggaggagtcttctaaaccttgctttatattccgatcttaattcaagcattttacattgtgtatttgtttagcaagtatttgaagtattgtcttagcattgttgtatttctagtattattatcttagttctagttgttggggtgaagttgggctcttgcttaggttttaattagtgttgatttttagaaaagcccaattcacccccctcttgggcatcgtgatcctttcagagggtacccgcgggtttcatctccaatatacttgttcttctcataatcaataagtatcgtaatgattaatgatatcatgatccaaaatctatgtaatgaacaacgagttcatgatttggtataaaaattattagtagatagaatgaaatacaaataataagttgtataattaagtgaccttgcactaagttatccatccaccacatatataacgctagtaaaaactataatagcaagcaagcaacactctcaccgactactgatacattcaccaattgataaaaaaatatgaagtaaataaggaataacaagtttgttgttcatttataaaataaaatgacaatatgcactaggtttggtcgggtttaaaaaacccacgggttcacgggtttgggtactataagaacaaacccgtacccataaacccgccgggtatagattt

SEQ ID NO: 1174 - DNA, 597 bp, Zea mays
gaatgaagcatttgcataaatcatagaatatgaaataaacatttgaatattgtcatagaattatctatacttgtactaatgaatataaatgacttcgaattacaaatgtaccttcggtcctgcggaaggcaaaagtacaggcgtgatgcgaaagcaaatgacaggtcagcgtgaacagtacgggagtactgttcatctatttatagacgcgggacgcagcccacgtaaaattacatccatgtccattacatttgttaacggtttatggaaatctattgaggaccccgaagtctttttatctttaagtcggttcccccttgtgctatcgcgccgaagcttccctgcgtacagcttcggctgccctcgaccttcgtctggctcagccttcgtcctggtcgtgctccatatccataattctgaatccgaaaatacctgttcatataattcacttggaaagcattgtcaaatcatgtttttgaggaccttcggaggacgaaggcccccaacagtacctaagaacaaagcctaaacttgttttgtaggtttatacatccgggggctcaagattggatcattgatagcaggtgcacaaaccac

SEQ ID NO: 1175 - DNA, 1500 bp, Zea mays
ttatcttataggaaatggttcgaaaaatcgttattccaccttttaggtttaggtctcatgaaaagtaatacctatgaagatcgtgcatttcagtcacattcaaatcgtgcatttcggttttgatacaaagattggagaaaggagatctaagagggacatatggagaatgtggttagaagtccataatagagtccaaccacaacgacggaattaattaacctcaccgagaaatgtagactactttaaactacttaaatagaaaagatttgaaaatcatggcatgtgtcttcgatggatcgtaccattcgagccttgcttttctcggcggtccggagaaagcagtaatcaatagggcttccctaatcctcccttcctggaggcaccggctgggagattggatctagccaaaagaggaatgctttaaaaaaatggtaacctgccagtaaaccgctaaaacccactgagaaaccagaaaccagttttcctgattgagaaaccgattttcaaatttgtcgaccggtttgcatttcaaatgtaagtaaaatggtttatcggttttctcagcgacaaaccattgctttttacatgttttcattgtgtttttaccggcttcattttttattttttttcaaactttttaaattttagacgagtttaaaaaacacatcactcgaaaaaaactattaccggccggtccggtccaatagcgggaaaccggaccgggtttcgccagttttggagcggatctgtaatccttgacggtgatcccatatggctgggcgtttggctacagcgtagctggaccatgcatgcatgatgccacaccccccatcccccaagctccttttatttttctgagagcgcaaagcgcgcgcgcagacacgacgcatccatcaacttttactctccgtactagccagcttaatttgcatgcatgcatgcgtgcgtgcgtgcccaccgcctttgatcacctgttgttacggctgctttcgctttctcgctaacctttggcgcgcccggcatcatattttcctctgttctcgcgcccattccattccttaacccggggggatatccaccccgtgtcgtgcggtgttaaaccggttgcttttggttccagagtaaccctgaagcttctagcagcacatgcatgcaaacacacaaagcccaccacttgctgagtgctgacctcctcctggctgcaggctccagaatccagatatcctcctcctcgaccctgcccctgtgccctagctccattcctgcccctcaagatgagggcttgtgcccagccgacctctatatatacccacggcgtcccacaggccaaactccatgtccaaccatccaacaacacactccaatcgtcgctagccggccagtactgtccgtcacatacacacacactgacaccaccatccacaaggatctctcctctccacgctacagcggctacatattgcagttgcaagctagcgaggcaagtgtgtaacaactaag

SEQ ID NO: 1176 - DNA, 771 bp, Zea mays
tgctaacttcgagaaaagtttgtaaacttcaggtttcgtctattcaccccctctagacgactttcacttatagctcactcggtcgctcgtacttgctagcggagagctactatatgagagtgttgcactactctagcatgtcgtgttgggtttgggtgactcacggtccatgtatatgtgggcgagaagtaggtgagagaaacaaaactaattcattcgtcccaaaatataatttgttttaaactaatcatacattcattaagtaatattagtcatatggtcgtgcattgctacgacttttatatatgctataggataaattctgttttaataaagtacaaaatatacgttttctattgattaagtgcttgtgaatgtgragccaacaactaagattcaaacactcacttatacataattttaacttatttttttacgtaaactcttatattataatagtagagaagagattatataagtgtgggttgattctaaagaaatgtagggttttttaaaaaatattgttgcaggacgactgtttaaaacgggtgcttagtaaatatatgaatgctttaaaatgggcatagaagagattagaaacgaaattaggaaagggtaagagaagaaaaaggaaggagattagacgtacacgacaaagagacgaagacagtgtggaggggaggcagggtagcccccgcggcgccgctccgctcgaaatccccaaaaaggcaagatcaaatcaaatcagatctctccacccccagcccatcc

SEQ ID NO: 1177 - DNA, 370 bp, Zea mays
ggtacgcaaattgtatgttggatgaccaactagttggctccatggtgcaagtaaagacagagaaggcacagctggcacgccatgtgcagggacctacaaatagcaccagatcaacaattttttaatatggtaccagaaagacacatgtttttaaatatgaaatcggataaatacaaatttatatttaaattaaagatctttacataatttataactctatagttgataacttttaaatttgacatcttttttttttggaatttatttgagatctttcaaacatctccaatatttgtttagaaattaatgcacttacaggtacgacttcctgaaaaaatcctagtgaaattcacaggtccaaatccatgct

SEQ ID NO: 1178 - DNA, 1198 bp, Zea mays
agtttggactcgagtattctattctaatgtattttgtgggatttatcgtctatatttttattaacacaaatataaatatagatagtacactatatattaagcagataactgttgttgatttattagggagtgaggcatggcccctgcaaaccctttttggctttatccctgatgcctaaacatctttaaggcaccaaaatagtcattgttgggactatttgtttcggattctggttatcaaaattggcatctggctgtcaaacgctttgcttctcagttcgcttctatgagaatcacttctttaacaggagttggaaatttcttgcacttagaaacattgaagcctgcaatgttagcaagatggtactttacttttgtaattctatcattgatcaacttgtcacaatagttatactttagtgaatacttctttaaatatggacaatagcaatgcttccatgcaggaccatctgacttgatagttgttgttggtgattgtgttattgaagcagaggcaacactcgatgtggtatctataaaaataaaaatgctaatttgcaattcaataaccaaccaaatttattttttataatgatttgtgaagtaaatgacagcagacaggaaaaaacctatctattagattctaattcaggttcaacaattcaaaatataatgctagattctaatagatgtagaaaaaatgaaattcgttaatccatctagtatctacttcacaattcacatatcaataagcatctaatcacctagtttaaagccggttcatctctaatacgataaatcgtctttatgctgtatacaacgcaaagcgataccgactctgataattcgtatcagtcggtatcacccagtgtggcagcagcgttggcgggttaaatgggtgatcgatgcgacgaccgaccacccgtttctggtctttttggatgagtgcttacccgcctgatttcaaaaaataatctgaaagtaaaaattccaaaaaatctatttttttaaaaaaaaaggatgtggcggctgatagtggaggcagtaaaaaaaagttcacgcgcatggtcggtctgcgactgcctctgaccgctgaccgcactgctcccttctcctgttctctctccccacttcgagacttcctccattcgcggtttgcctctctgcctgcctccctcagatccccgctcgggttgcc

SEQ ID NO: 1179 - DNA, 613 bp, Zea mays
attcagactgaacatggatggtagtacaccaaaagagatttgtgtgaatgtcgaggcaaacccgtaaatcatggagcatgtgatggaatggaaggaccgaaggagccagtagcggaagaagttacttctcgtagcaggcaaaaattggaatatgaaaacctggaagccaagagggttaatccctaattactatattttattccattagtttgtagaagttttggtccctgtattcaatgtaataacgacttacattattttagcctcacaattttctttaatggtctagctttgtaattgataacataattttttttggttgaactgtcataaatttatgacagtatccatatatagtatgtcaaaacttaacatttcctacactttttgttggcagggtttgtccgctggtttgctaaggcaagcaacgtacatagactgctcgtcttggatccttcaggtttgtataatgtgttgctttatgatcaattgaccattcattacctccgcctgatggcccttattaacaacagtaagaactaactaagaatgtgcgctaagatttttcttgctatctgaagtggtaaatttgttagtcctaattctttgttga

SEQ ID NO: 1180 - DNA, 1500 bp, Zea mays
aattgaccattcattacctccgcctgatggcccttattaacaacagtaagaactaactaagaatgtgcgctaagatttttcttgctatctgaagtggtaaatttgttagtcctaattctttgttgaatgggtatggggttttgtgggtggtggatggtgttgtgggatgagatccttttgaaagggaaatgtgcccttgggccatttctaaagtgttttggtgattaagtgcccaacacattttctctaagtgcaaatttgtgccaaagagtgaagaagtgaaaatcgtattacaaggtatgtttctagacttagtacatttgttattgtgtactaatgaagttacctaagtgctagaaacaggaaaagaaaggattggaaaagagttggctgtgtacagccaagactcagctcagtctgggtgcaccggactgtccggtggtgcaccggacagtgtcccatggtgcacaggacagtgtccggtgcgccaggccagctccggtgaactggccactctcgggaaatcttcatcggcgtacgactataattcactggactgtccggtgagtcaacggccgccagcgcaacggtcggtcgcgcaatccgcgcgcgacgcgtggccccagccaacggtcggctgggagcaccggactgtccggtgtgcaccggacagtgtctggtgcgccaacggctacaattctgcagcggtcggctgtgccattttaggaaggagatccgcaccggacaatgaacagtggatgtccggtggtgcatcagactgtccggtgcgccacccgacagaaggcaagaattgccttccaagaatgcctccaacggctcctagctgccttggggctataaaagggtcccctaggcgcatggaggagtaatcgaagcatactttgagcattctaagtcttccacactccgtctccgcgcacttgattgactttcttagtgatttgagctctgttctagtggtgaacttgttgcgattcatttgagctcaagtcttggctgtgtgtgtgcgtattgctgcggatttgtgtgtgttgcttccctcccttactctaagtgctttcactttgatctttgttgtaagggcgagagactccaagttgtggagattcctcgcaaacgggaaagagtataagaaagaaaacaactgtggtattcaagtggatcgttggatcacttgaaaggggttgagtgcaaccctcatccattgggacgccacaacgtggagtaggcaagtgttatacttggtcgaaccatgggataaatcatcgtgtctcttgtgcttgttttctttgtgactattgtgtttcacaagagctcggttcttagccacttgattctattgtgctaacacttaaccaagttttgtggctataagttttaagtttttacaggatcacctattcacccctcccccctctaggtgctttcaattggtatcgaagccgttctcttcatgaaagggactaatcgcccaaagag

SEQ ID NO: 1181 - DNA, 719 bp, Zea mays
ctgcaagaaagcgaaagcatacaaggaaacaacaatcagagatctcgccagcagagcaggctaagaagtctggagtctggactggacctaatagcatctccaagagctcttcataaaatgactccttaaaatcagttttaagggacatctaaataataagtgagggtaaattttaatcctttctccaacagatcccttaaagcagcagtttgtttctggggagcccaaaaaacccctcatttgtagctacaaatgagggagtttaaagggctatgaaaaagttgagggcgctttaggggaactgttggagacatgtttttgtgtttttccccaaaaaatagatttagggggagacttctggggagcttttggagatgctctaaggaatcgagccagagaaccagctcggctcggctcgtttgcgagctcgagctggctcgtttagctcgcgagccacaacaaaaaatagtatacatgtatatatacaacaatataatcaattgttagttaattttatactaatttaacactagaaaacactaacaatattcataattttatatatcacatcatttaaacactaaactaacatagttcgtcacttattaattcatccaatacaagtatatgctttgttttacagataaatgctagctcatttgagctaacgagctggctcgagctcgtgtcgagctggctcgttaacgaaccgagctgag

SEQ ID NO: 1182 - DNA, 430 bp, Zea mays
gatagtccatgacctggcgcaggagctaggtttctgcctgacgagccagacggtcatgtgcttcttttgacatatggtgcttttagttctgtgataactgagttgttgatttcattttctgtgaaaggcacttcatggggggctcaagtcttctgtggcttggagcaggtcgtcgaggtcaaagtactaagtctttctttgtatgcttcaaataatagggaagctctgtctacatggcttccctgtattgtcgcctattattagcacggtctctatctagcatgtgaagaggcctaaataatgtgaggccctcgtctctcgtccctgcaatcaagctcgtcgttaagctttgcctctaccacgacgccatgcgagctaataaacacacgcagtcaactcgttgctgggggcgggatcccggccgagcacc

SEQ ID NO: 1183 - DNA, 496 bp, Zea mays
ggtgcgtgattctttttcgccgccacgtcctcagttcatgctgtgttgttcgcctgcgaccgtgaatccgtgattgccacgcacatttcattagtctgcatttatttctatcttggggataaaagaatgtcgggagctcggaactctccgtgttatttgaatgccaagacaaatgcttagcaccagcgaactcgtggccttgacctgaagaaaaatcgtttttttctctcactcgtagtattaaatatttactatcattatttcttaagtttgcagctaaagctactgattggttcgtactgaccagccaagccaaagagggattctttggaggcaaccagaggtgtttggtttggtcaagctcccttcttttgtcttgcccatggaatgcttgctgtgaactgcttgtattcatgcttgagagaatttcagtgtagcatcttgtggtcttgtcctctctgattggaagagaaaacgtgctgtcttgtggcttgct

SEQ ID NO: 1184 - DNA, 1325 bp, Zea mays
atagcttaatataagatgcatgaaactaagcattaaacattgttgttgaactaaaaacatagattaaaaataaataaaataaataaatagataaaaatgctgtcacacgtctgtagactgcatcctgcatccaccgctccgccgaccgaggccgaggaaggcccgtgatatacgacagaataggtcatcttgtcctaccaggcctgtcggaaaccaggcctcaattgatccagctcaggccagcaaatcctccgaaatgcaagcggcccacctgcttccgacggcatagcgtcttggactctctctcctctctctctgagtctctgtctctgtctcttccgacgcgacggcagatttgggaggtgtcgcggccagagagtgcacaggcacaactgacggtgctcgctcctctgctctgtgactcatcgctcgacgacgaaaacactcgttggatgttgcgctgtgttccaatccaatccgctccgctccgctccgctccgcaacccaattcccatctccgccggtgagggattcgccacaccacacgccaggccgcccctcggtcgcggaacccacttcctgctggcgcgcgccgtcttccgttggtccggtaagaacccagaagccctgctccgctctggccgccatcgctcgtcgggatagggaaagctaacgtgatcgcgaagcactggcctgttcggcacgatcctccctcatagaatgcgatcgcttgcctttgcctcgtcgtgttttcgtcggggctacggatggatctcgggtcggttctctggatcatcatcctcttgctacgatctgggaaggaaccgaggttagatttccgtttcctcctagtcgtaggtgaggtgctgcggccgcaggggggtggcggctgtggactgtggggcgcttcgtttaggtgcgagttggttgtgtggaagacaggcattgacgggtgctcggagcagcgaaggtggaaacgagttgggatgagcgacgttcaggagtctagatgaccttactgctagtcatccttcccttccccttcctagctgcatatgcagccatacagagctactagtaggtgtgctccacagggaaaattaatttctttggtcagcttttagcacagccgcagcaactgcaaatctggtatatatacctaagaccaattaaccggtctacataactccaagttagaatattctcaagtgtcatgctgcatacagttggtctgttctgatgagatggcatttccatgttttttccaggacatgtgtctttgacagatcgttacaggaggaaagaggtgcccctgtttgtccaca

SEQ ID NO: 1185 - DNA, 1104 bp, Zea mays
aactagcataagcaactcgaattctaagaactttagataacatgacactatcctcctttcttttctccctcactccctcagtgctaagatgatttgatgacgtttgccattacatcgaatatttgtcttgttcgagaagatatatgtggttcatgaacttgaaaaggaatctgtaaggagagattgcgtataatgtgtggagaatatataggagtacatgacttggagggcaagaagcctatcctagagataaggaagggagataagaaaggttatcctagatataaggaaggttatctcgggattacaatcaatcctaaaccaaccatatcaggagttgcctaatatactctaacacttagggcagctgtggggagggttagtctaagtgactctatagacggttttttgtattcttgttttccgacctccatgaggatcttgtatctgggttttctttagacctttgtttcttcttaatatataatgaggcgcagttctcctgcgcttttcgagaaaaaaggtcggtatatggaaatgtttcattgaaagtttctagttacttatacccttagtaaccaggaactgggaacttggccacgttcctcgttccgggaacgtgggaacaatcttgttccagtagtgttaaatcctagtttttgtagcgttccgcgtaccacgttcccgttcctcgatcccatcaatccgggaacctggttactaatggggtgtttggtttaaggaatcactacatccaaattgaggtggtgcatcataggttcattcctcaaatttggtgggatgacctcattcctcatattagtactaactaactaactatgaggaatgaggtggtgatggatcaactcattccattccacaaaccaaataaaaatagtgaggagtgagaagatgatgaactagctcattcctcaaaccaaacaccctacatatatcttctctcgttcctggatgtcatcgacactgattcctctttgttttgttggagcagcagtacgtacgcgcagcgcaggcccagctgattgcgccatggaagatcatcatcatcatacagcaacgattgcgcacacgtggttggcggcg

SEQ ID NO: 1186 - DNA, 337 bp, Zea mays
cgtcgtccccggcgccgcggccggatgagcatgagctcttgcgcagcctggcgatcccggagaatatctcctcgagcctggcgcgcgctcggtcgcggcggcggtgagccggggtcggcaggtacgggaagaaaaggctcactaggtgcaggccgccgataagctcgcggaggagcgaggacacctcgtcgtgcatgtgatcccgaacctccttccccagcaggcaccggctcgcaatcagcaagagaacgtcctcaacctgttgcttcagatcgaccgtgccggactgcccccacctggcgaagtactcctccacctcgcggaccatgagacgggc

SEQ ID NO: 1187 - DNA, 1500 bp, Zea mays
gatgtcctggaatgactgttaaatacgcgagtacatgtatacggtgattactcgaagtaggactagtaataaaatttaaggatcggacttgtaagctagaattaattaagttttaagctagaattaattaaggactcaatcaatttgtgaggaaatattcgggttgtgatctattattctattactaactctattcaggagcaacgacgggacggggaagactggatgagaaaatttacatgtagtgacagggtacaactaattaaataggtcggactatattggtcgagcattttagctcagcacatgtactgcatgtcaccacaataaccatactaagtcagtctgaggtccataataagtcgtgcttgggttcacgagacacgaccatttatgcggtctacgtaccttagatcactgatgtcactctgatcgccctttaacaccccaaagggtaattaaaagactacagagattatagcatgtggcacactagatacacacatgacacaaccttctgtatgacacttgttatgcatcgtacggggaccacgctatgccaactccagttttgggatggagcaacctcgggaggtgagtacatacgtcggattgtatagatgattcagcacagagaacaaaaatcctaggcattatctgcaactgtttgcagaagaaaggttgccatcattctgttcgacgaaaactgagcaaggttacctatatatattcttttcaacaacaattagttgttttaaggttgtgagaaagaccatgaacacgagtctcttatgatttaactaatgacctaattacaccaagcgaaagatcaaattgcgccaagagatcgaaatgaacagcatctcctagagaaagcaagcaagaggaccagaaattgcttgacaacacgggcgggggatgattggagcagagtacgcacacgcaatgcaagaggaactaagacgacgacgacgacagcaatgatgacctatagctagcggcaccacggacgggggttgcagcacatgcacgccgggcggcgcgcgcctacgcgccgggcgcggcgtccttggcgcgggtgcgcaggtatccgccgtactcgcgcgcgtagtccttgacgtggctggcggtgtcggcgatccggctgcgcgcgtagtccacccggtcggcgcccacggggtggcggcccgtgaagtagcggtacatccaggtggccacggggagcgcggcggcggcgaaggcgcaggcggagagcgcggcggcgacgatggcggagatcacgacggcgacgggcacccagatggggctggtgagcagcgcgatggggcccaggaagacgagcgccaccacggcgcccgtcagcgtcacccccgtcagcagcagcagcacggcgccagagacgagcagcgtcaggaaccccaccacctgcgtcgagttgggcgcgcgggtctgcacccgccgcagcagcgtcgccgggtcctccacgccgctgccaggccc

SEQ ID NO: 1188 - DNA, 371 bp, Zea mays
ggtacgagatcttgctagcttcttcctctccgtgtgcacggaacggaagtgagcagaggaagcaacctctgcaacggaggaaaccacattcgagcagccacctgaacctggctgtaatctatcacccgagattcctttcttccctcgaaatggcaacggcaggaaccgatccttgcccgccgtctaggagagaaaaactcgcatcataagaggcggatccccccatcgcaagcttcagcggcggatcggagaactcaatcgagctaggatcgcagcagcaccgaagcatttgccgatcatcagttcttccatccaggtacgtacgtgaagttcgttcgactcataattagtttccccttgccaatgtatgt

SEQ ID NO: 1189 - DNA, 1177 bp, Zea mays
aattctgacctagaaacagtatctacatgattggttgcctgcaaagagataacctggctccccgcgtgctttgaccaagcacgagattctgattggttgcttggatacgaggacgctggccaacatgcgggctaggccttttttttttcactaccagcccgcgtgtgaagatggcgctaataaggatcgctttggagccaggctcgcgggaggcctgcgcgcctgcgcgcgggaggcacccaaccaatcagccggcatagtcttcttctcgtcgctgcactgggcccgctccttattaatgaaatacgagcccgacatgcctaaaagaaaccgaggaagacgaagcgtataattcagcatcacacacctctttttgaaaggaaaaaaaatacacagaagctggtggcagccaaacgctgcagtgcacgctggactggagtgcagccgtcccgtcccgtcctcctctggaccgcgcgcgatgcacggcaccggccgccggccgcacttccttcattcgcaggacaaaggacgaagcactacgcatgccaccacaccatgtggcgaccgagatttccccggcgtatcggtttggtaggctcgttgggtttagggtttgttgcggtggagtcgttgagacgtgcagtcgtattagttactactacctcctccggtcctccctagtactagctgtttgcaactgaaagcgtctcttattgtttgcgcttttggttgctccgctgctctgctctaaatcagaaatgcttctgcgtccgtaccggctcggaggctgctgagtgctgactactgatactgatagagagtaccgttgcacagattctggaggcataggatcgggcgagacgagcggaagaatggaagattaaagtaatctcctaggagcagcagggccagctgagctgagactgagagggcagagggaacggtagaaaaatacgtaacggtatgattaggtagggggggcgtcccgaccccgacagcgagccatgtgtgggtggaacggtcgctctcctcccccgcctttataagctcctccgccgagccttcactcgccaccaccaccctccctctctgcctcatcacctactccgcctgcgcctgcgagctgtgctgtgctgtgctgtgctgcgcaacggggagatccaatccacagaacagg

SEQ ID NO: 1190 - DNA, 259 bp, Zea mays
acaacacttttatagaagatggcgagaaagcctaagaaagggaacccaatgcaacgtggctcaccacgtggcacatcacaattcatcgtgtcatccagtaagctgcgctaggcgtgtggccatgtggcatatcttgctagtcaccatgccaagtcatccgccaacggtcctactgtcctagctagtttataaatctcctctctccgccggcaaccttattggtatcaagaaaaacttgtcgaaaaatacacagggcaca

SEQ ID NO: 1191 - DNA, 943 bp, Zea mays
agctacaacacaaatacaatacgctacaagatggccgttacatgcatatacatgtaactgctaggccacgcgtgtatgccacatgctgacacacacacactactgcactattatattataaataaataaaaagatattgcattcccatcagacgagactcttatatatttgcgcacctattgttgctacaaattaaggttagcaagaatagaatccatgcatatcaggcatgcaagaaaattacatgaatagttaggataaatttaatattttaaaatagatatatatgaaatttaatgttaatattttcttacgtgttatcaagcacattgttatcgacaagaataaatttttgcataactgtttttacattatgtgctccaaaaaattaaatgaaaatatccgtatctggtttttatatctatcatttaagaagatatacattagatttgaagtttacattttatgaatcttaacaagctcaatactaaaaacaagaatataaatttgcacatatcttatttaattattcacggtcaaaggaaaagagaacaaaataacaggcacgcggatgagtatttgttttcatccctaaccaagaggatggattagttagagaaaaatttatggacgtgtaaggaaagaaaaaagattaacaacctaacatgtgtaagtaaaggaaatatattcatatagaagaaaaggaaaattcaatcagctgtggaagaattaattagaaaccaggattaatgaaactcgaggaacgtcaatataatgatgtccttctgtaaatttctgtgctatggaaggtgcataggccggctataaatagatgccatgacaccatgcaccacaccccgcatctcctagccccagctagatctttggacacatatcgaaacagctctagctagcgcgctcgtcgtctaacctggcttccggc

SEQ ID NO: 1192 - DNA, 207 bp, Zea mays
aggagttcgagctctgcgtcggccgctccccgatcgtgcacgagctcatgaagcgggccaccaccgcggcctccgcgtccgcctccgggcacgccgcccccgcgtccagcaagccccggaggaagcccggaggcggctggctgcgtggcatcaggcagctggcgggcaccgtcgcctacggccgccgctgcgccgacgagggggact

SEQ ID NO: 1193 - DNA, 1500 bp, Zea mays
aatgtttatgtaggaactgtatgcatgttttagtcatataattcaattatttgatcgcaacaacgaaatatttgtacactatgtaatgcagtgcaaataatgttcatgttctgttttcatttatcctcaattagaaacggtagcttatatttatataataatagcattggatattcttatcgatgaatgatgaactgaatttttaacattgtgctgacttctgtagcgacatcaaaggttagtaagacctttccgtgaggctagctaaaatacgacatcacatcaacctttcgagtcgggtaaatattgacatgataaggaagacgggaacttacagaaggaaaaaaaacgtaccagaaatacaaaagggagataaatatgacggcaacaagaccaaatccaaccgttctccctcttcttcttttttccgtctatgtataagtataaggctctttcgaagcggaatgtattctgctaatgtgcaccaaccttatgtagcctttacatcatatagtaaattatttgtatttgtatagccaaaatattaccaactaatagttgtgctctaacattttatcgaataatttatatacttcttattcaaaaatctataataattctttagagatattttatataatattataatgtttgttcgacatctatttattttatttgagtcagcgtatttataataatattacatattcatatcgttaatataatattaatgttacagtgatattttactatacagattttgtatatcataaaaatatttatcgatacatatctatattttatactattttttaactttctagcaacacggaggtctaatttctacgtttattgggcctgcgtggaagatgcaaacatgccctttccagcctggtacgtaccatggcagcagaaccgaggcctgccgtcacttgtgcgaggccacgcgcgtggcggattgtcagcctcataccgtcacgacgatccaggcatccagccatgcagcaagtgcctccgaactttgaccgttgtgaacgggctcgcccaccttcggccgggccggcccaccttctccccggtgcatgcacgtccccggaatcccagcgcccctgttggcagcaggcggacaagcccatacgagaactctgggcccacgcgccaaaacgtccaaccgcgcgtgactcccccctccctcgggcctcggggagatgccatgcggccgacatccatgggcggggcggggcgcagctgcttggcttrgcgctagcgccacccgtgccggcacgcacccgatgacggcagcacccaccgcctgattgcgtccacggcgaccgtcacacaccgaaccgacctcctcgcagcctgtgcctgcaacgacacaaacgtgtcgtcgccgactcgcctgcatgcatgcgcccgtctatataaggccgcagatgccatgacgactgacgggccaccgatccaagagcgagccgacgacgacgagcagcgagagag

SEQ ID NO: 1194 - DNA, 1455 bp, Zea mays
ttgattaaaattactttcaattgtcatccatctgtccataaacgttctcacccacctgacaattaaaacaaccaagggtattattgtatttgtatgcatatgaataataagccgagtccaaataatttgagctaacaaacagcagcacctaacttatttaatccagagcaaataatctagattatataatctagattataatttagattatataatctataagttgaaacaaacacggcctaagtaagagtgatactctttgagcgagtgctccaacgaggatcagcgaagaaattcttcgagacctcggcaaaatatcgatgagtcttcaaatccttcaattattggattgtagggttcagaactttttggcaaattattaggtattcgagtggagttggaatcgctgattagaattcgagcggcagcagcagcaggcactcatttttcaggtctgcccctaagcttcctcaaacaggcgctggatggttggtatgtcttctggggtcagcccagccggatgcagaggacaacatcgacacttggttctgggcgcgcggcgagcggcagcagcaggctcccgctattcgccttggtaatgcccaatgttatatacgagacgagagagtggaaggcctccctgttgcggttcgcgacaatgctttgatcttgtgcgctggttgtccattcagcaggagtgtagtcatctgatggacaatggatgaagttgtcatacgtagacatatcttcgccatgtatataaaatgaaggcactttggtacaaagacacaccatctccgacatcaatccatctctctcctttttttttcgttttctgtccacgtttgctccgtctcatatttgtttcgtaatttgtgctaaatctcttctattgcagaggtatccatccatccatcattcagaacctccagcgacatgaaagaagacgccttcagttttctctctcgcacgggccgacaagacatgcaccgcagctccaccattgtcaagcatcagacctcctaatgattgccttactaaaaaaagctttaatctgactgctgtgtccttactggcccaagaacgttgagacccgttctccgtctccgtgccgcttttcctcctccacgatctccctttgctttcaagtttcagaaacccctacaacgtcgacgtctctcccgcagagcagcggtagtctgttgctttatttttattcccgacgtggcttctgcatcggcgtttggtcttggccacgttcacaacctccttcgacaacctttgacctgcattacccgcctacagttgttgtccgattggggtgtcgatggttgattggaaatggtaagcttaaatcatggcgcatttcgcaatttccatcgatcaattcgcatcatcgtccccgaccctgagccttcctcgaccaatccctgaacctttcacagggaaatcaca

SEQ ID NO: 1195 - DNA, 232 bp, Zea mays
ggtgattttctgttgcctatacccctgctcatcagaaccttcaagtcctatatctaaatcaactgcagaatttttaaattgagagttatagtaatgtacaaaaccactgtgtgcctatcgaagaatttttgaacaacagggatttaagtaccttgaagtagagtcactgcagaagtgcagattcgccactggggtgaagggatggcttcggcatgcagatggtggagtggag

SEQ ID NO: 1196 - DNA, 1500 bp, Zea mays
ggcctaagaacatgaacttggcttcagtcatccatgttcttttgactatttaataatcttttggatgataatgtcatggatatcttaaccactatttaattaccatgtaataaaacatgtaatgtgttatgtagtattatcctagtgttgctactttatccgattatctatgatgatgttgaatggatggttaaatgatgctagaaattttgtaatggtatttagatggatatacttgacatttgtatcatataatattttgatagatgtttagcttttgtgagtacgggtgacccgatgggtgacccatacccacatgagtatgggtatgggggtaaatccatacccacccgtgtatataggtgacccgatgggattatttttgtgtcgtgggtatgtgtacggggtagtaatacccggtgggtatttacgtattgccatctctagtcgttccaagctaaacgaggtgggctccgccgttcccctttacctgcgtcatgcactcacggcaacgcgtccgtcttttatatttctcacaaacaattgaacaaattaaaagaaaaggtctaattactcgcctctcttgctcgccaacgccagtggccagaggcccagagcttcgtcaaagacacgccgaaaagagggggaggcgactcggccgaggtcyggttccgaactccggtcctccgatttgcgcgtccggatctaccaggtttgccgattcccgctctaatctttcctctacgtcctgtttgttttcctccccgtcggtgcccgctgggtgaggtcacatcacatgtggctgttgggatctcggcagggtctttctggggaacggcggctggggattttggtgattctgtagacggatacgtgcgattcaacagtggggagaagggatatcatgggggcattttggattcatggcgaattctaggattttgatttggtctttctgcgttcagcacgaggcttctacgaattgagtaacgtagtgcagtaggattaataattgctgtgaagagagttatcttgtttcagttctacaagtcagaaamgtgatttgagtctgtcatgattaaatattgacccgtgaccaacaagctgggracaagggacagcatactatagtcatcctcatgttggggttagctgcagcagaggccaactttttttatggcaatggtcactgtaagcttgagtagtcttgtttctcgtaagtgcaacctttaaacttttttatgaaacttgttgtgctcaataatggcattgatagacagaaatgcctagagattgtctgttgataacttgctcacaagagctccctgccttttcagcccagttcttgtggtgctttacattatatgaaagggctctacatgatactagtttattacaatgtaattgtatgataatgggttacaacattgttgtttatgctgttatgcttatccaagttctgctcacatgacgtgttctgtcattttgaattaaccagcc

SEQ ID NO: 1197 - DNA, 332 bp, Zea mays
ctcatttagcgtttcttttttgagataatctaagtgtgggctctagggtgttggtgatgctggcaacaacgacaataatggtggtgtcggcgcgcgaaagcctccaacgaaggtggacatctttctattgttggcgggcagctgtcgtgcatggtatcatcgtgtgcgtagaaggaagaggagcgaggcaccttcgatcccgtgggtcgtgggcgtccctccggtccaacgcacgccgtacctgccacaacaggaaagcttgtccacgaccttccttccctcgatcatatcgggcgtaggcatagggcggaacgggacgcgatagctagaca

SEQ ID NO: 1198 - DNA, 1112 bp, Zea mays
agtgcatatcccatattttttaccatattattcaaaactagagagctaagttttcaaacatgtgaaagtaatacaatatagttaaaactgcagtattgaaaacatagtttttgaagagtctaccaaacactatattagaaaagatatcacaatatctaaaatactacaatattatctaaaaacaaagaaaatactccatttttcaaacaagcccggtctttaattaaggtccagcacgaaatggcctgaaactcaatcccttcctccgttctgagagagaatcgaaaacgaaagacaaaaaaaaacgtttttttatatgtataagctggattagaagaagttcgaattttggttaatcctttggaaggaaactgcagactttgtcacgtcatgatgattaatatactccctccgttccacagtgtaggggtgtttgatttctaggtactaatttttagtccttacattttattccactttagttacaaaattattaaatatatttgtcaatttatatactaaaatggaacaaaatgaagggactagggactaaacattagttcctataaaccaaacacccccgtaatatcatttgtttgagctctcaatttttatgtctatatttaaatgaacatatataaaatatatatgtcaagtattgtatgaatccaataataatctaaaatggattttaacttgggacagacagagagagtatgttggtatgtacaaacaaagcacatgtgcatgctggctggagaggtagatatgacggagatcagacaccaggcaagctgcaagcacgtacaagaggggtcaatcaatcaaaggagtggtaaatcaaaagtgcaagctagcccatcagagaattcaggaccaaaccaatgcagcagcaagggccagccaggccgcaggaatcatcaggtcaggccaccactgcagcagcagcagcagctgctgctgctaactgcatcacctcacatactttcccctctcccttcctcagctccctttaatacctcaccctcctctcctcccttctctgggctggccggatctcttccctgcagatcgagaggcactgccaacaccaccaccaccaccaccacacc

SEQ ID NO: 1199 - DNA, 318 bp, Zea mays
ggcccggtatcttgtcggtactgtcacttgttctttaacaacacctaaagagtatcactgcatcctctgaaatgcggtatataaaacatggtcatgtgcttgtgaaccaacgagtgcaacctgttctccgtatctatcgtcactctgaactacccattgttgaatcagattcgcgtgcagctggagacattgctgtccgagaaatcgaggctggcgcaggaaaactcgacgtatgcccgtgaaaaccgcttcctgcgtgagattgtcgacttccatcagttcaccacccacgacgttgtctcattggatgacggcgac

SEQ ID NO: 1200 - DNA, 1500 bp, Zea mays
cgttcacaatctctacccgaaatttcgggtacccaaaaaattgagttcgggtttccccgaattacccggttgtaatatcaagtagtaaagacaatgaaattaaagtaaatattacatgtaacaaaataatatatttttttttcatcaaacacactacactgctcataagtctcatacatattgattggtgttcattatttatatattagtacaccataaatttgcaatcataatacaataatacaatggttcggataaatcgggtacccaaactcacagtccgtattatccaaactaaatcgggttttcagacttgctatcggaattagtgatcggtaatttggatttagataaatcgggtttacataggtaactttttttggtctgcgctatttcggcttgatgcctcccttccaccggccaccgctagctgcaggacgtatatctcaagtgcaagccaggcagtcaaccgtggtgccatgctttatgcagtgatggttgtgtgggggcgtgtggcatagtatggaattgcacaccactcaatagtgttgcgtgacgccgtgacgatcagggagatcaataactcgtgtagtcttccggcacacccatccggccccggcacacagaaccagaggccagaatacgcgggaaccaacggtctcccgcggcagaagtgggccccgccagacgccgaccctactttgaatcagcccatcagtgcaggtgggctcgcgcggcccaacctctcaccaaagactgagatctggtgaccggttgcgaacttctcgcgatcacgcgatccggtcatcccgccatggacggttgcggttgccctcgcgccgaattcaattgttggccaaaaagccatgcaaccgcacgccgccgcgcacccccatctcctttcctccaagaaagaccccgctcccaccaccacctctctctgactgaatgctgcgcctgcgcggcgaacaaccgacagggcagccgcgacgcgcgcccgatcaggatcgcacggcgacgccagcgtatgtacgatggcgattcggcgatcgggcgtggtcgtcacgtgactggccgcgtctcccgccaccacgcatcacgcgaatccgcgcctcgcctttaaaacgcatcgtccccaagacgctgctgcagctgtagcgttcaagcgttgcactgtgtgtatgtcacgtacggagcaggagggtaccagcaactgcagggccagatgtgtactactagactactagtgcgcgataaagccattaattaggcggtaaaaaagtgaaaattttgcacaatcattcattgccttccaaaatgtacgtactggggtccatggtcgatcatatgccttccagaagaaaccaagggaaaataaagcaggaacctaatcctattcctagcagtactagaagagatcgacttatatactaatagaaggattataataaacaactgagagagggagagaaaaaaaaaagaagcagagaacggactatc

SEQ ID NO: 1201 - DNA, 379 bp, Zea mays
atcctgcgctatatttagagtacatgagcgtatagcgagtgttgctggagacagtctaaatatgagggttgggttcaccactgtcatgaactgatcgtgttacacttctacatcatgtttcataatgattgctggcttcataataatgagttgggcccttgtagttacggactcacgtggcatcatcgaaggatcctatcctatgggtctcggcccaatcctccggcctctaagcgcgtttgtctgtacgggcggcgcgggcttcgctctctcttgctatatataggccttctcgtctcgtcatccacccgctcgcccattcccctatccacgagcaaggcacagcagcaggggagtcggagtgacagccgcccgcagg

SEQ ID NO: 1202 - DNA, 1500 bp, Zea mays
cacggatccgtttgcggctgcagccaatctgcaggtgcggcagggggcaaactgtccgagtagggtagtccggaaaagacagacatgcccgcccaacccaatcagctttctgtaaattgcgagaaggctctatcgtaaaaaaaaaaactgcaacaataccgatcgcaaatgacattctctctcaaatgacagtctaactattaatttatttattttatttgtgatcttaggtatcgtatattttataaaatataacataaatggtaatggtaacgatgcattagcaaacgacagacatccaggcgcgcatcatggcgcaagcggcaagcaccacaatgtatttttttttttttttgcgagagtgtggacgcgcgctccaatccagggatttcggccaccaccaagcaagcgagatggcgcaagaagccgcacgtcccgcgtacgcacgcattgcacataccctgcatctgttgccgcatcaggcccggagtctgaagtctgaacctttaacgtgcacaccagtagttgctactgttagcctgctatactacaactttccaagatactgcaagctggaactggaacctcagcgcagttgatgcggccattcattcagttcagttcaccaagctagagcggccggggtgattggcaatgaaccatcgtcacaagcaagacaaagagttcctttcatgcatcttgcttcccaacctcccgcgggcgcttccatccgcgcttgcgttgctggcaatgcaatgcaagcaggccgcgcgcgcccatggccatgcatgcgccccgtggtgtggcgtaggcgggcttggctggctgcttggccgacgatgcgtgcgagcgtgggctgacaacgctcggccagtcgccaaactaacggatcgtcattgttagctcaatactatgttagccgattcgattcttcgtcatcagaataatgacaaaaacacgcagcagcgaaacgagcgagggaagcagtaggaaacattccttgtttcctagtgtttccggacaagctacagcttcccaaacaaggacgactagagaacgttatcatatatagtagatcgaaccttgtttggaagaatgaaacgggacgatgacgtcagaattccgttatactactattataccattacgcgccacacggcccaagaccattacgcgcgtacccatattttctcccatccgttttgaacatcaaaactaaccaccagccgggagcgggaaccaagcaacccccccggcagctagggccgcgcgcaagttaccggccggtcggccgcggtggtgcagtagccaagaaacctctataaatagatgagccccaagcagatgctgcggcatgcacggtgcaattagctagcctagcactagcagctgcagcgcctggcctcctccctctctctctgcctcttccttcggccatctcagtatacggctgagagagagagagagagagagagagagagagagacggtgagagataac

SEQ ID NO: 1203 - DNA, 301 bp, Zea mays
taggatgatataatgtgggccataagcccataacaaggttctctttctctcctctctcatacatgcataacagcaattccattttctgatgcatctctgtggcacttgcagagatcatttagtgtttgtaaaaactgttattgcctttcctatattttccattgtattcacgcttctatgcacatgttatgtttacaatttcgaactggtaaagatttccccaatagcttctgctacccttattttgttaaatgtgatgaccttaagtttctgcatcttatctattcttctcttatttcag

SEQ ID NO: 1204 - DNA, 1160 bp, Zea mays
cgcttgcgcggaccgtccggcctcttattttggtgcccaacacaaggaaagcgagaaatcaaatatgcataaaaggaaaagaggaataagaggaagcaagcactatttctgaaataagtaaaacaagacgaggtcgccctgttagatgaaggtttaattatgatataatgaactgtagcaaaggaggatttgtaaccgagataaagacgtgctggtattgttgagagacggactttctcagggtgccctgaatgaactgacacgaagactcaaaactgaacacggttcgaaaattctcaccttgcctgcatcctacctgatggcgaggatcatgtccattcccacaaagcgcttgactcgttcattagactgactggacgcagtatgagctaggtgcacccaactgactcacacaaacctgtttcaattgtccatgagtcaataactaaaataatctctcttctggctgtgtgttcctacgtaacagaggccggaagatgtgttttcaaaaacttacaactcattgtataaacttaaaattaatatatcccccatttcaaaaaaaaaactccctttttccaaacgagccccggatagcttattaacatagtcttagctttacgatgcaactgccaactgcctgtgaaagttattaaagtaaaaaaaaaagagagtgatggagatacgaagttgagctatgataagtagaaaacctaatatataatactctacggagtatcaaaatgcttcgtcactgcctttctaatttccactagaaaaaaacgagatggattaggacggaggggaaggaaaacgacggatcgtgtttgactcgacatctacaatcacggtccgtgacgggccatggagtgttccgcggcccaccaccggtggacagacacgtgccgggacactggagagttccgcggtgcgcacggcacgagaccccgcgtgtccggctgtccgcctcgctgtttccctacccgagcccgaccggtaaagacgtaaagtgaaacggagacgaaacccgctcgcgttttcttctttcagaaaacgaaatccactcaggagcgaggaaagagggacagaggagggatagatccccgggctccacgcctccacaaccatccgtcccgatcccgaccagctttgagatcgcg

SEQ ID NO: 1205 - DNA, 191 bp, Zea mays
ggtagttgccaaatttgttgggggcaaacacaagggttccaagacttgtgtttgggtacccaaagttcttgtttctaatgccaaaggacccaaaaccgtttgggtacctaaagtcaagaactaaatttgttttgtaggtttatgcatccgggggctcaagttggatactcgacagcgggtgcacaaaccac

SEQ ID NO: 1206 - DNA, 545 bp, Zea mays
tagggcatcaatacaagacacactcaaagtgatcaatccttctccccaattccacaaaagctttagcgtttaagtgagagtgatttgttgtgttcttttgagctcttgcgcttggattgctttctttctcattctttctgaggatcaaactcactgtaatgagggcaagagacaccaatcgtgtggtgatccttgcgggaactttgtgttccaagtgattgagaagaaaagctcactcggtccgagggaccatttgagagagggaaagggttgaaagacacccggtctttgtgaccacctcaatagggagtaggtttgcaagaaccgaacctcagtaaaacaaatccgcgtgtcacactctttattcgcttgcaattcgttttgcaccctctctctcggactcaattatatttctaacgctaacccggcttgtagttgtaattaactttgtaaattttagtttcgccctattcacccccccctctaggcgactttcaattggtatcagagcccggtgcttcattagagcttaaccgctcgaagtg

SEQ ID NO: 1207 - DNA, 430 bp, Zea mays
ggtctttgtgaaaagtgcgcagagaaatagaatcatggtcacaaatgcattgctgctgctcatcttcatgcactagaagaggtttgggaactcttggtaactgatcaacatgaaactgaatcacagaatccagaggagtctaccacagaataactgtttgtgttagtatccatggctgcttgggggaggtgcagaggggtttcgaactctgaaatttcaaggccaactgcagaatcatctagtcatcatcttgattgatagtggtagctcacatacattcttgcatgagaaatttcgcccattgttcaagaatgtggattttgtgagtgccccactacaagttcgtgtggctaatggtgaattgttacattgccaacacaagatactgtagataccatggcaaattcaggactgcactttatggtcagat

SEQ ID NO: 1208 - DNA, 98 bp, Zea mays
gcttttaagggtaagagcattcagtaacctgtaatccacgcaaaagcgccaggtattgtctttttccgaaccaatagaactggggaagcgaaggggct

SEQ ID NO: 1209 - DNA, 113 bp, Zea mays
ttgcggcggcggcggcggcggcggagggcgcaggcgcgcagcaaacggacgcgacgcgagctcgagacgctcgtgcttgctgatcctccacttcgtgggctcatgagcccaaa

SEQ ID NO: 1210 - DNA, 179 bp, Zea mays
ggccaatggaagaaaaggagggctccttggtatgagaaacctgacgctgttgttcaaacgtcccgcgggtgctcaacttcaacccggaacgcgtgaaagaatttttgctgcgggcggaacaacttggggtgcctcccacttcgaggctattcaggcatgcagtggccgtcgttgcctgt

SEQ ID NO: 1211 - DNA, 903 bp, Zea mays
cggtttattgcttagattgccatgtttgacatacttgacggaataaaaatcgtagaaaatcataaatccaaaatagcagagaaactcatgacccttcgtatttgggctcgtcacgggtgtagtaaatccaaaaaaaaaatttactgtttttagtagaatctagctacgaaaatattgtctatacattctacaggccataatagtgggctaagaaggcctagaactcgatagttacggtacctcggaaaaacaaaaaaaaacagtaacctatagcttacggaaaacagtgaaaacataaaaatcgggtatgagatattaaaaatctaaagctgatactatttatattaataataagttatagatataaattgcatggctttacaggcaatttgttatttgcgaacacaaataataccgaatatttcatatattttttaatatgaatgtagaactatagagaaaatatatagaaaataaatacggatatagaatgtttaggagagagagaggacgaactgatgacggacgccagtagttggtccgtggacccgtgagaccatggtcgagtctcggagtcagagagccaagggcacggccgtcgcaggctgtcctccgagtaactatataaagggggctggggcaggtggctccacccacggttttcttctccctcgtcgcaggccgcaggaagaagcagcccctcagtccatccgcaggcaggtaaagcatcgcagccctcgcgctcgggtggtccgcgcgggccaccgaccgaccgacgaacctcgcaagtcgcaaccgccgccgccgccatgttcccgcctccggctcccgtgatcccggccccggcgatggtgggccgcctccagttcgtgtccgtgggcgcgtccaacttcgccacccgag

SEQ ID NO: 1212 - DNA, 562 bp, Zea mays
aatttgaaaaatacaaaccactcgggattaacggtttttgggcggatttcgttctcgctgttgagcgagaaatatgttgaaaacgggacggtgaaccttgcacgcaagagtatattcgacgtaaataaaatatatgtgatagaaatatgcaacaacgtataaaacaaaatcgcatatccattagcaagcagaatttggtgtggatgtatgtcaaagctatttttctttgtccttgatactatatatatactgtattcgttttgtttgtttttaccaaaaccatggatattccgagacattgaaactcacaggcatcgaaatctgaaacaccccacagttaaatgctaaaactaaccggagaaaaaaaaacggagtaacgcgctggattattattaccatgcagtttcttcaaggtttcaattctagcaaacggtcagatatcatatctccataaataccagggggtgggtgggtgttgctgtgatgaacaaacgaaccaatctagagaaaaagaaagaaaagaaaggaggagggagagatcagggcatagtgaaaaagaaaa

SEQ ID NO: 1213 - DNA, 1500 bp, Zea mays
aagggcggcgggtatagtttctaagaagatcagggttaaaaccataaattctaggactaagttgcattgatctgtttataaagatggactgcgggttgattactatatagagcaggggctctttagcataaatgcctaggcgaaggggtacggtaaaactgtggtcgtctgatctcgaatctagggaccgaattagatctgacccatcgatgaaccagtacacatccaggaccaatggattagagatcaatggctctaatcagctcgcgaactggcatgctcggatccaccaatttctgatctaacggcacaaattttatcaaggtgcggtcgatctaacccatccgatatccgatcaatggcttgccaaatgggtacagagttggatcagacggcacccacgccttctcctacctttctgtctccacggatgccaaccctggcatgccccccggcgacgacggcgaccatcgcagccgcagcgccgcaacggcactcctgaccacacaaccatctgcagatgcgtccaaatcatggtgctggtgcccaacagaaagatgctcacttgtggcgcagcagtaagctctgaccacgcggtgcccgtagtgaatcccgctcgctcgacgacgtaatgcgcatgcacgatgtgggggagatgggggtcccgggtgtcctcggacgtaggcgaagctccccgcggtcgatccccggactccgagcggcgtcgtaagtagggggcgccggcgccggcttcctctcaactcgcccgatggctcagtttcctggcgtgcgcgccgaccggaggtgaggtcgtgggccgcctgtatatgtacggagtgcaggggcgatgagctggcaagacccggaggctacggaagatctcaatgaacaccacgacggcagcgattttgttgagtgaagaaggcgctgatatctcaacggaccgaggttgaagaccaccctgaccgtgggcccttcctggcggtagcacgagagtgggtggtgaggccaggcggccagctaagggcttgttcggttagctctcaatccatgtggattgagtgggattggatgggtttaaaacccaaacaagtcaaacttcttctcatttttttccaatcccatccaatccatgtgttttgggaataaccgaacaagccctaatcaatcagattggagctgacaggctacaatgtctgatagtgcatgaatccctcggaatacattcgttcccctgttttgctgcccagctggttgcgaccccgcctaccgctgcaccctgtttctcatgaattcgaccgacagcacacaaggaacgaccaactctgcgttgaatgtacctctctctgactcgtgtactcgtgtatgccaaaccaagttgctgatgcgtcatgcaatctctctctatatatatggagagagagaccagcagaaaacatagaacttgcgaattcggtattgagaatttgcgataccgatctgggagaagagaagggcgtc

SEQ ID NO: 1214 - DNA, 1500 bp, Zea mays
gaacttgctagaagagcaactctaagagcctctttatatttttcgtaatctatataaatagacttttgtaaaaaaaatacactcaaacaacttatctaaatggttatctatttcgtgtttctcgctagctaaatatagaaaacgtgaatctttttaagatatagaaaggctgttaaaaattgaaaagatatagaaaatgatttttatataaatgactctaaataataatttagagagtaaaatttaaaaaaataacacacttggagatgctatctgtagtcatccgcagactctatctgtagctatctttagagatcaagttaaaaaaaactattggacgttttttcccacccaagcttctatttctatcaaaccgtgaagatataaagaggctctaaattgttttagctttttaatttacatagagtttattatgcatctagacgtatattatgtcaaggtatataatattatgtctagacgtatactacctcggctcataaatacatgacacaatttatttatttttttaaactttgactactcgtattatttaaaatacttatttaaatatataaaatattaagtcaaacgcaaactacatgataaaacatataataaataaataaattataaattattattttttaataaaactattgattaaattttttttaaagtcaacagtgtcatatatttatgaatggaggggagtatttttctatttagaaactgctgacctgacaaaccggtggcaaaggcgctctacagttagctactgagaacgcataggtgcaccgtgaactgatgcccacgttccattcatgtctgtgggtgcccatcgatccctactcatgaaatcagtaggttagtgaaccatgtgcccactattactccaacgctgtagcctgcaactcagcatcctctccagctgcagaccttggccacactgcaaagccctctgccttgagagaggcttttgggcagtgagcaccaccacattttcactggccattcgtccttggctgacggccgtgcaaggacaatgatctgtatataacagaaacatacagtgcagcggaggtgtttgcaaggagatcggtccgggaacatctcaaagtgcacccatccccctgcgcctcacagaattagctctcattgatacaacaggcaacagcaactacaagtctacaacaatgccgtataggacgatgaacccacgataaacatgcaaatgggcaagcactgcccgccggtaaccccactgaccggagaccaaaattagtggcataaatatagacaagacaggcgacgaacatgaaccagctccttcctcaagtaccagccgcggggggcaccatggatggggccagcaaaatccggcccagggtaaaagggacaccggcaaagcgtataaccaacagcaaatggaatcaactcttgtcgcctggaggcgagtagccgccgccaccaggcttgtcatgctcgaacttcacaacg

SEQ ID NO: 1215 - DNA, 1500 bp, Zea mays
aatttaatcaatagttttattaaaaaataataatttataatttatttatttattatatgttttatcatgtagtttgcgtttgacttaatattttatatatttaaataagtattttaaataatacgagtagtcaaagtttaaaaaaataaataaattgtgtcatgtatttatgagccgaggtagtatacgtctagacataatattatataccttgacataatatacgtctagatgcataataaactctatgtaaattaaaaagctaaaacaatttagagcctctttatatcttcacggtttgatagaaatagaagcttgggtgggaaaaaacgtccaatagttttttttaacttgatctctaaagatagctacagatagagtctgcggatgactacagatagcatctccaagtgtgttatttttttaaattttactctctaaattattatttagagtcatttatataaaaatcattttctatatcttttcaatttttaacagcctttctatatcttaaaaagattcacgttttctatatttagctagcgagaaacacgaaatagataaccatttagataagttgtttgagtgtattttttttacaaaagtctatttatatagattacgaaaaatataaagaggctcttagagttgctcttctagcaagttcaatagttatgtaaattttagctctctaatcatagatttaagaagttgctaaataactttaggagtaaataatgtgaattcttctataattctttaaatatatgttgtagttttgttttgtatctatccaaataaaaaaagaataagtcacaaatttcaacaattaacttcattacctacataatgcagtcaacatttttgtttaggaagttgttaaatgtagagagtaaatgtgtttagataagaagttgttaaagttaaaaaatttattragagaactgctggagaaaagtttttatgttaactaactaaattattaatttagaaaatctctatagattatatctgcaacagtatgaacatctgactttaattcaagcgaaaatatatagagaacgttttttagcaagtaataagtagtgctttgaatgatgatttttgttggccttgataccatttttttcttcctcaaatgctgatccgtttgttagcaacgagccaaggacgcacaaacggcatgcttgccagatgtaactgcccacgtccgcgtgtgccttcaaacatgctcgtctggcaacacaaagtgccaagcttgttgcatgtcgtcagggcgcagacctcacggcacggtgccacgtacgcgagagcacctgcaccacctggccgcctccctccaactccaagccgcgccgcattaacacacttacacaccgatcgcgaaactgcttcctagcttcgttccggttccggagcgccagagagagaaagaaagggaaaagaagcgcctttgcccaccgcgcgatcgatcgatccggggtccggcggcctgcc

SEQ ID NO: 1216 - DNA, 1500 bp, Zea mays
tgtcattggatttttattcaattgctcagtattctgttacgcaccagactctgagttttgttttgtttttttataatcctaagattatcctgcgaacaagttcagttcttaacaagttcgtatattttcttaactgttggttttttcttcagttgttcagttcttctgttacgcaccagcggtggacgcggaccatagagacggcacctagcccataacgtactccagcccaaaaggaaggcgatcgcgtgccttccttcaaagcctaataaggcccgacgctcacggtagcttcctcccggatcagcgtaagcccattgtggacccagcgcagcctgcagcccatcgatgattccgcagcccagctaatcccaaacaccgtcgagcggacctcggaagggaacggccggagtcgccggcacccgcgcttcgcagcccgtcggtcatgccgccgccgcagccactgcgtgccttatcttccttccctttacctcgccgccatcctacccatacccccgccactataaccggttgcgcctctacttccgaccgcctaccattcgcaatgccctccggcccggatgtaaggttcgtagtcggaaaccgtcggaaacccttggaccatttgccaccggcccaatgatatcgacctgccccggccgcggcaagatatcatccattgggagttcgaaactccatgtgacggtaaccagccaacctgtcggcatctccctcttgtcaattcaccgtgtcccgccgccgtgcgagtccggagttcctatctacttgatttctctgcatttccttctagtaggaagtaccattctagattggcgcgtcactagcacgatgacccatatgtcagtgttgttcttggtatgcaattctcctcagtagaccagttgcaatgctgaataatccacgattgtactaggctactagctgacaccttcgacatatgaggatgtttggtttctagggactattgtttagttctatcattttattctattttagtctataaattgtcaaatatagaaactaaaaagagttttagtttctatattcggtaattttgaaactaaaatggaataaaatgtagggactaaaaattagtcactagaaaccaaacaccccatgtatatatatttccagcgaggctctggtcatccaatcttccaacagctcatgccgatatcctaagtctccagagttagacatttcatgtatatatcccttcgtcctcagtttgcgcctgaattctcagcttcaccaaacaactgatgacccctgtagtctaattttttttgtccactaagctggattagtcctccaatctcattcaaatttctcaactgacaagaaccgcaaatcggagtactcgacccattccctaccccttcgagttcaaatatctgaggggtcatgggtcttagcgtgctatttccttgctgtctcctccacagcattataccaacttaccaacaaggtctaatcgcc

SEQ ID NO: 1217 - DNA, 1500 bp, Zea mays
ttccttcaatccttcctcgtctgctccgcctaccccgcacgtttcgctccctctcttttaacaacgcccaccaccgccgcagtcgagcagagcggcggcccctcctctccctccctctcccacggctgcagggccgcttctctacctccactccatctgtagagaattttctcctccccacttgcgggcgtctcgctgaactggttgcgccgccgccgtaccggttggggaggctgcgctccgtctccacaggtgattcttgcgctccctcatgtctgtagctttcctagattggattgtcggtgctgctgaggtttctttttcttctcgggcggtttggcttcaccggcgccatgttccgacttccgacactgcgctagaggttggaaactgctcgctcatttttggcactcctaccacaatatggatcgggagggacctgagtctaagcgaagggcgtcggtgcgcggcgcggtgccgtacaatacaaaccgtgaagttttcgtctttcgtttcgttcactgcgtctgcgtctgcgtctgcgtctgccggcccgtcggtgagtctgttgggactggttgcttcgggagcgaattatcccgtcctccttcaatccctgctctgatttggatttgggcctttgaagagcaaagccccctttttgccgtgtcctcctgtcccaggtacgatttgatttgggacatagaaaccactagcagctctgcatgtaggcagctagggaagtatctgctcggttccattccatggggtcctcaaagattcaggcatcctctctcttgttctttcttttttccttccttcctggctcaaaagagttttcaccatgtgtcggtcggcagtcggcaccggacggttaccacaagcaactaggaggactcgtcatcgctatctactgtagctcgctattttcccacgctccggcgggcatgatttggccccgcctgtcgcgttaggtgctggttctttcttttcggagtcgcgagtacatgcgacggtcgggtccttgcttcgcttcttcaggttggtaggcgaattcagggctgatgatgactttgtccttgacttggctaatgcttccttgcagctgaaaactggtaatatcagagggtggtgatctcaatttttttttttatttttttggcattcctatcttcttctacacgtagactttactgtagtgacctgacgataagttcagatgcgataactaaacaagttacttggatatgtcacgacattggccagcgctgtgtctctcatgatcagttttgaacacgcaaattgtgaattgccatgtgcatccagtggctgcttgccaatgctagttgtaaccgtactgcaattcatttctttttgctatgtcagcggatctactgaattgagcccttctctgatagtctctggtcgacacatctctgcttttccagaaactgcttttcctctctgcgggcgcatcgatctgcgactgcgttggtaaag

SEQ ID NO: 1218 - DNA, 442 bp, Zea mays
attcaaacagatttattcattcgtaaacaggaacaaattgcatctagctatttttgcatctcattgtctgcctaaacttatctccgaataacccagcatggaaatatggaactaataagacttgagaccacactaacttgaacaatacactttccatgtaattcggagaatagttaaatgatgggaaataaaactggcacttaggttcgagctcatgactgataaaaagctggcacaccaattatgatttgatcaatggcaggtgaaatttttttaataggtgaaggtttagtcactggcaccaattatcctacaccaaatgcaagttgtccagatatataaataataaataaaagggaaatttggatccataccattaaaagatcaccactttggatccataccattactatctcacttacatgtgggtccacatgagtca

SEQ ID NO: 1219 - DNA, 308 bp, Zea mays
tggttactccgatttactgctttgcgcgggaagtggaggcagcctgctgctcgtctcccgccaaaagggatttgggacgaagcggaagcggcggatgggtaggcaaggaccaaggagagagggcttttaacgcggattagttgggcctcaagacataaaaagcccaaacacatctagttgagcaagcccgtcccattttgggctcatgagcccacgaagtggaggatcagcaagcacgagcgtctcgagctcgcgtcgcgtccgtttgctgcgcgcctgcgccctccgccgccgccgccgccgccgca

SEQ ID NO: 1220 - DNA, 838 bp, Zea mays
tttctgataagacatattgtgaaaaaatgtagtcaatagtaaattctgattagattgaactaaacatttttttggaatttaaaatgaactagttagctaattgtatgttcatacggtttctatatatcatataggtaacaaatcttgcttaaataagaaacttcttcaaataaaattatacgtttgaaatatgattattttttattttctcattaacaatatgtttatagttataatatcgtctctttgtacggtataagcaacctgataagcggtagttaatgccacaaatatttttctttatatccgtattgcacatatatacaatacgttttattaatatagcggtggttaatgccatctcctgcgtccgacgcccatcgccgaggttgagaggcaagatctgtcgtcttcagtgctccagcgcggcgccccaaactcccaggctatgcttttgtttatgttttattgtcatttcatgattcatgacatgacagactccaaactatgctttagacatttaatcagtatattcagctcaaatgaaatgggatctaaaccagagggtaagtctcacatcataccagtaccacccgttcctatttttcctaaagcaggggcagggcaaaccgtattgttggcttcgcctagggtctcccttctactgtcgccgcaacctgaccaacctcccttctactgcccgcctagggtctcccttctactgccgccgcaacggcgcaacctcccttctactgccgccgcaacctcccttcttcgagtcccatccgacctagccctgcaacccgccggacgacgagcagtgaggcccgcggccgag

SEQ ID NO: 1221 - DNA, 848 bp, Zea mays
ggatgactgtacctttaagaaatcggaggcaaggattgtgaatagctcgcgcgaggaggggacacatagggctgagcttactgcttccccaccgttgttgtcgccgacgacgtctgttgggggccttcggcttccgaaggtcctcaaaagtatgatttaacaatgtttctggagtaaagtacattaataggtaccttcggattcggatcagagccacggtacgaagaagtacaaaggatggcgcagagccgaagctgtgtgtagaagagcttcggagtagcggcggaaaaggaaaccgacttaaagatgaaaaaccagattagacctcaaagagttatcatagagttattaataaatgtaaatggcattattgtaattttccatgggctgcgacccgtgcctataaataggtgaacagcatccctatactgttcacattgatttggcattggcttttgcgtcacacttgtacttttaccttcttacgagctgaaggtacacttgtaatttgatatcgtttctattttttcatcataataaaatgggaatgaattgagaataatacacaactgtttatgttattctctatgctttatacaattcctccttcattataacgttctatgtttatgaaggtatgtcctttataaccttcgtccgaagatcattatatccttagggaaataatgcttcgaaggacgaaggatattaacatttaacattttgtgttgccttgttcttgattcatagcatttgagaacaagtccccaacattggcgcccacctccggtgaactcacttccattttttttgagtcttgaacactttcggcaagcatcaccttcgtc

SEQ ID NO: 1222 - DNA, 1257 bp, Zea mays
aggctcacacctagttcctaattgattttggtggttgaattgcccaacacaaataattggactaactagtttgctctagtctatgagttatacaggtgccaaaggttcacacttagctaataaaaagacccaagaaatgggttcaacaaaaaagagcaagggataaccgaaggcagccttggtctggcgcaccggacagtgtccggtgcaccaggggactccaagccaaacttcgcatcttcgggaattttcagaggcgcttcgctataattcactggacagtgtccggtgctccagaggacagaggctctgaactcgccagcttcgggaatccgctccgctataattcatcggacatgtccggtgagccagcggagcaacggctacttcgcgccaacgatcgtctgcaacgcattaaatgcgcgccagcgcgcgcagaggagcagagcacgcgcgggtggcacaccggacagtctacaggacttgtccggtgcaccaccggacagccaggcgggcccacaagacagagctccaacggtcggaacccaacggcctggtgacgtggctggtgcaccggacagtgtccggtgcgccatgcgacagcagcctccaccaaacggctagtttggtggttggggttataaatacccccaaccaccccacattcaagtcatccaagttttcaaccttccaaccacttacaagagctaggcattcaatacaagacacacccaagtgataaaatcctctcccaattccacaaaagctttagtgttaagtgagagtgatttgttgtgttcttttgagctcttgcgcttggatcgctttcttctttctcattctttcttgtgatcaatactcaattgtaaccaaggcaagagacaccaattgtgtggtggtccttgcggaaaagttttgttcccggttgatttgagaagagaaagctcactcggtccgagggaccgtttgagagagggaaggggttgaaaaagactcggcctttgtggcctcctcaacagggagtaggtttgcgagaaccgaacctcggtaaaacaaatccttttgtctcacttccttattcgcttgcgatttgtttttacgccctctctcggactcgattatatttctagcgctaacatggcttgtagttgtgattaactttgtaaatttcagtttcgccctattcaccccccctctaggccactttcaattggtatcggagcccggtacttcattagagcttaatcgctcgaaatg

SEQ ID NO: 1223 - DNA, 1500 bp, Zea mays
cactgaccctagcgtatttgtaccacaggatgctggcatcgctggcctgaacagcaagacgcacatgaagatcctgctgaaatggatgacagggagaaatgtcgtgaagctgacctgcgtgcacgtgggcaacgcgaagaagttcctctactccccgtccactgaaagcagcagcagcagcgccggcgcatcaccgtcatccacatcggcctcgcagtgacggtcagtcgctgttaagccttggtgtggttcttgatgttgctttgtggatcgatggaggttgcctctggtcattcggatcccatgtttaaccttgatgacgaacattggaaaaagcattttgttttatggactggaatagtctgcaaacatcacgatagcaatattgttctgctgctcctcagctgaggatgctgccctgtcctgaactcctgattttgcttttgatctactatgtgatgatttgctcttccttttgtttggatttgattccacttttttttccctctggaatgtgggaacgctgcatcgcattaagcaatggagtgagttgtggtcgtgccttgctactgcttaattcatctatcagagaaatgtgtctgtctgtcagatgcacttgacagaaatcttcaagctggaaattcatacggcacctgcagccgtaattagataggtcgggtctgtttgtaaaatttacttgtgatctttgaaagatgaaacggggaaattctgatcttattccgtacaagcagccatcaggcgtgcaaccgtacaagcaggagctactgtcatcatctatgggggagtctctcaggcaacagaagaaaaaacaacggaccatgactgtcatttgtctgtaataaagataaagataatctaatttctgtttggaattgaaacagatcatgtccatctcaagacatctgaatcatattaacagagtttttgcataaaaccacacacctggcaacagcaaatctaccagaccagtacgacttgagactttgagaggggcagcaccaaaagagcaccggcgacggcgaccggcgacggcgacggcgacgaaaaaaagacggcgggcggcggcgcagactcgcacatggccgttggattagatgggttttgcaagcttggccgttggattcaccatggatagccgcggtcatcctatgacaacttcgatccgacgtgtcgtccttccattggtggcacagacgtcatagcgaccggcgtgcacatctgccactctgccaggcccacaggttcctcccatgggcgcccacaggtcagtgacacgcgcggccattgcgaaaggcacgtcgccttctacccttctccgtcctccccgaacactccacccaacggcccaacccaaccggggcattcaaccaccccgtgtgctccaaccgctcctcgatttgatcaccgattgggggaggccgactagggtttaccggtgagcgcgcgcgcgagagagagtgagggcggaggaaaggggag

SEQ ID NO: 1224 - DNA, 1500 bp, Zea mays
atcaagcaaacagaaaatagataaaagatggcaggacagaaccggtctggccggtttttatgtatcaggctgttgtccggatcagatcatgtaaaataggagattcatacatataacaaagtttaaaataaagaataagacagggaataaagtaaaatagctgctgaagatatccttgaagcggccgggccacttgctaaattgatcagatcggtttacctacactgcatcggctagctcctggtttgagccagtgttttaaatagcgggaaaatgaatttatccccaaactttcaaaaaatgcaaatatcgggatatatcgtgatatagctagatatatcgggatatgtcgggctaaacgacgtaacttttcgctgataaaaaggatatatcgggatatatcgaccgctatagctggctatttaaaatcttgctttagacctccgaagcagtaagccacaagggcattataatcatattcttccgaargtccaaaatttaaataatttgttgagcgggtccctcatagcccatatcttcttcccttcattcgaaagatgcaatcagagcatataatacgcacatgaaattgcatatatacagccccaaccgagaactgcagcgggcattaattcggttgacgttatcctactagcagtgaaattaattgaagattgaaacttgaaaatttccgagctgatcagcagctgacgcgagacattgtcaaaggcagcgagtcgaacgaaggaagagtcgacggggtaggctctaggataataaacaaaactaatttaagggtctgcttagatccctctacttttaaatgaagtcagattcttcaacaccgtggaattgtaacatcctactatcagttttctctgagaattcagaatttagaaactaaccaaaactgatgcaaaagcagtgcctaaatccatgcaggagcaaggtcaaaggcgcggaacatttcgtggtccgtgctcgtgcctcgcggtggccgccccgcgccgtccggcaaccatgtacgacccggtggaccttcgcttccgatcccgcgcgaccaacggtgatctcgctattaatttcgcagcgcgggcgcgggcgcggccgccatatttattttctcttccacttccacaccaaccagagctctggatcaaccaccacctgcgtcaaaccacgctccttgcattgctcacccttcgtaaacagtgctggtagaaaagaatccaccgaaccaagaccggcggcacccacttgtccgtgaacctcgcggctcgtctctcttcttctcctatcttcttcctctcctgtataaaagcttattcgccccccgtcccattctgctccagaacctttcccgttttgaccacagactctttctctctccactttctagccttgtagctagctagctagcttcatgcgtagataggtgcgcagcaggtaaacgacgcgcaaggtgtgctgcgtgctgcgcaggcaggatcaatagaatcc

SEQ ID NO: 1225 - DNA, 1493 bp, Zea mays
tgttttctttcgaaaaacattagcattagactaactgcaacgcaggcctctacgcagcaccctccccttgcatgccgccggtagggggcactccacggccgtagcggtgccccctacagcgcccttacgcactggcccccttctctctccccccagatctagaaaaggagtaactgttcatcaccctaaacactgtgctgtgggtccacgagtaattgttagtagataaaaaattgatagttcgtatagaaaatgatattttatagtggtagtggggtatagggggagtatttagggggaaccgctgcgggagatgaaaaaataggggatggaatgttgatgatgtgacacaaaaaaagtgatatagggggaaaatttaggggaaaccgctgcggatagtctaactcgcgtatccacgactggaactgggccctgtagcaacctcggtgaatgggttgtacgctagtgttcgttgtgggccgagagtaggtgagagggtgaaaatatatataaggagtgttgtggatgtatgtgacatctatcaagaaatacaatattctggctcctctgctgctctatcttcttccttcccagtctccttcctctcctccttcttccccctcctagccgccactaacaatttatttgattactctagtattcatcttaatccatatgatttaaagcaggtgtaaattttgcctcaacccatatagaatgggtgagtatcatgtttaccgttgaggtcttatttggttactctagtattcatctcaatctatatggtttgaggcaggtataaattttgcctcaatccatatggattaggtgaatactaagtatccaaaacctgagggcactgtaaactcttagagctatggacttgtttggatcataccttagcaggcatgcctgcccaggtaaacaatcctgactctatgcgcccaaaattgaacgcctgacaatttctgcctggcccaggcaggttgtcagttggatcagtagaaagcacggtaatcggcaaagcccgtgaagcagcatgaacgttctcataagttgcgcttcaggaagctacgatctgtgcccgtattacatttcacacgtaccatctgcatccagccgtcttggttaaaaaaaagaaagaggacatcaaacaaacaaaccgagactctggtaattttgcgctgttgggacttcagacagaaccatgtctttgaacgattacaagaatatacacaagaatccgccacaggaccaacttattaccacgattacacgaccgacaaagcttcctcctttataacgaaagggaccacatagcaactttcatccctcagcagcaccaacaaaagcatagtaatgtgcagtaatatatcgtacaggattacacatgtcacagcagaagcctcaaaaaccttgaatggaagtacaccaaagaatgctgggctgatggaatatcatgtccccttgatcacaacaacagggcagcccac

SEQ ID NO: 1226 - DNA, 562 bp, Zea mays
ccgtacgcacttccagcccacaccatcctgccaccgccaagtagggcccacgccaacctggctttacaccaaacaccaggcagaaaagggccacagccatgtgggcccgcccatcacaccgcaatcacacgactggccccttcttacctttcctacgcgcacgccagaagcgaagaaaacccataactaggcgcacccctctgccccccgcctcttcgccggcgagcggcgacgagccgccgtggaggagctcagcgtggagtggcttcctctggtgtgggagacgctgccgaatttctttgacctggtcgtcgttacggtgtgccgccgagaaaagagtttttcaaagggtctctctcctttgcggcactggcctcttagagttagtttattaggaggcggctcgcccacgtttcggaagcgacccggtcgtcgccgccgccaccgccgcgtgttcccgtagtcgccgtctcggggctggctgtggtgatgagttcagtcgtatcctagggtttttgaattctgacggcttcgtcgagctgcgcaaggcgtcgagaaggag

SEQ ID NO: 1227 - DNA, 460 bp, Zea mays
ataaaaaaaaattcggcagaaaaaactacgcgcggacagagaaatacgatcggccaagccgtatacggagacgtggcgtgatcctctcagcacagcattccctaggtggtggtgatgtctgccttcaccactatcagatttgcacacgcagccacgcaggacatctgctacagggcacgcggcggctcagaacgaagctacgagcacagcgaggtcgccacctcacggtgcgacgtgcagctccagctgctcaccgaccactgcatgtcgcccacgtaagattcaaccagtccgccactccagatccagactccagagaccggccggcctggccgctagcttttatatacttccggcagccatgcaccctcatgtccagcatatcgacgcagagtcgcagtcgcagcacacactgaattctctttagctagctaagagagggtagccacaccaagacagg

SEQ ID NO: 1228 - DNA, 402 bp, Zea mays
tgctcttaggccccgtttggttttattagttttagaactaaagtttagctaaatacattaaatgtaacacataaagactaaaatacttttttcttgtttcacactagttttttaggcaagggtaattaaagtaaatatcttcctttagtctctactttagctatttagtttggtaaaataaagactaaataaaaataaaagtaagagaataaaaattagtccctctgaccaggccttagattgacccaatttgacaattttctgctgatataggagacccggtaaggtcaagccaactgccaacccgaccgcgtcgcctctctcctcctttcgcgtcgtctccctcctccactctcctctcctctcgcgtccgcagcttcccttgccggctagggtttgcag

SEQ ID NO: 1229 - DNA, 78 bp, Zea mays
ctcgttttgacctccgctgcgcgcgctccctgtccggcggtgcagaatcacccagcggcgcgcgctccctgtccggtc

SEQ ID NO: 1230 - DNA, 371 bp, Zea mays
ttgcggcggcggcggcggcggcggagggcgcaggcgcgcagcaaacggacgcgacgcgagctcgagacgctcgtgcttgctgatcctccacttcgtgggctcatgagcccaaaatgggacgggcttgctcaactagatgtgtttgggctttttatgtcttgaggcccaactaatccgcgttaaaagccctctctccttggtccttgcctacccatccgccgcttccgcttcgtcccaaatcccttttggcgggagacgagcagcaggctgcctccacttcccgcgcaaagcagtaaatcggagtaaccatggacggcggatcctccacaccggcgagccccccaccgacggtatccgcgtcggcggcgaat

SEQ ID NO: 1231 - DNA, 1500 bp, Zea mays
ctgaactctattaataccaggaaaacaaaacacagagatacatcaacgccacgatcacagccgtgtccatccccacgacccacacgatgcccactcttctccgtgtgactcgctcagctcgaacaacctccggctgaacgctaactgactgaatgacgcctaactgaacactagctaactgactaacttgactcagactgaaactcaaacgacagggattgactagccgtgtccagagttatctaacactaacawcttacgggggaatgcaaacagcttgacttttgggggaaataatagaaaagcatatctgtcttttttttatttaccacaatgattgagttgttcctgcttagattggaatagctagagttggatatacatcgacaatcataatatgcaaagttgaaagttgcggtttgacattaacagtattgctaatcatttgtattcatgctatttgtgctaaaacaatctttctttgaacttgttttggtaatgtctgtattgaatgcaatggtatcatattgggcatgtgtaaatttagctagatgtcaaagtgataacagctactcacaagaatatgtttcagtctatctgcaatctaaaattagtacttcctcccttccaaattattggtcaccttgtggaaaacgcaggagagctgtgtttcattatattaagaagaagaataagggtctggaacatacatcttgtcgttagttaaacttctctaactttgaccaagtttttgaaaaaagatattaacatctacaattcaaataaatacaactatctagatttatttcatggagaagttaatgaaattaatttgatgtggtgttggtgtgtttttaaacttgaacaaggataaaagaagtttgacttaggacaaagctaaagtgacctatacttttggaagggggtggtattgagctggtttatgctttttgctaacagtgatcacttccaatggctgaaaatttgtaacatatttctcccataactcatgtgatccatgtgacactttgaacagccataaatgttgactgtccttacttctttgcaaaagataagaagtttgaaaggaagagatggtcattgatctcagtggcggacccaggaattactgacagcctaggcgaaattattaagcagcatgcagcagcagtgcaaaagcctgagctgacagagaaatggactgtaattttttggacttcttacatgcactctcgtggcgtggcaggctggcagcccaggcgacggcctgtactgcctgggcactcggtccgccactgattgatctctagatgttgaactttagttcagcattccttatactttgatggagtttgtggaagtcgttcatattaatatttttcggactttgtgataatgataccaacaaactcatttaaaccttcaagacaacagtggttgtgctacaaagtcatttctcaccatgttcatcattgtttacgatattcctttttctcagat

SEQ ID NO: 1232 - DNA, 1500 bp, Zea mays
attctaaattcacattgatttaaacagttttcacataaatgattctcacaaatagactgaaaaacaaaacatttggtagctaaaagctgatcctgatggtggcctaaagcctaaacaaacacgcacattgggtcttccattccatgttatcttttacggcattaaaacttgaagttaaatagttgggggaaaaacatgagcactcccgtttgattttctccatggacttaaatggcataaagaaaacccaataactccaccataaaagtatcatgtgcccatcctgtcaatgaaagtacatgcataatgcaaaaaaaatggttcctataaatataattttttccctcccagaaatatatatcgagaaagaggaagaaaccaaaacgttatggacaccgtgcaaacttattgcagcgcactcgtctgcagtgcaacacagcacacgcataggaaggggccgtcgccgtgtacgtcggcgtcgcggcgtccacgaagtctccatttctgattctgaaacgcccacggcttcctcgctttgtcgctctcctctgtctgtccgcctgtccgagacctcggagccgacggccggttttaaaagagcctgcgcggtgtaaggattctcgggtcgggctcgggacgggagcaaccgcagtgggagacatgcccccttgcacaggagttggggctggggctggggctgtgcagcgccgagtagtaggagccgggaggcggtgacggacggaacagaaggcgcgggtcctgttgggcggccgcctggttcccgggtcctgttgggcgggcgcgcggctgagcggggccatccatcattgcctcctccgcgtgggtcttggctgcctctgtcgtcgtcctcgcggcgcgggtcgcgcggccgaggtgaaggtgaggactgaggagaacttctcttcccgtctcatggagacgaaggacttcttctactcctcggcgctctcttcggtttcttttctcatcgactctgctctgttcgttcgatttgcgagcggcggagcatagtggtatggtatatccgaattgtgtgggttcttggtgatttttgctttcttgcttggggacccaataagcccagtaaattctgctccttctctcggtttcgatcgacgggtacagtacagtttgtgcgaaggagggcgcgcgcacgaacatgaggagtggtctgcgattgaattaggcgattacgtttgaagataaaataaaactgttaaaaggcgtcttgttgttattcttcttcttttccacggacccaacaagcattggattagttcgtgttcttgaaggtcctgcttcggatcgcgtggatactaactgctggatatgtgtgactcaactttttttttttgtttggggtctattttggtttcagcgaagaccgtcaacttgtactcttccggcgctcgctggcggtggaggggacgaaagtagatagcgtacggaagcatcggcattgggtcgcgcgcgtagggg

SEQ ID NO: 1233 - DNA, 1500 bp, Zea mays
gacctccatgattgacaccaaggagatttggagagttgcgaatccatcgaaggttaaattttcttcacgatcgtaatgcataagactttgggctgaggatcatcataagcgacatgggcttcaatatggtgataagtgcgccctttacaatcaacaaagtgagacgacatatcacttgttactcagttgcatctttacttgagaagtttggtgttgggttctgtgttaggcagggcttgagtgcctcatgtcatcatcttcagacatctagtccattagtggcagcggtccggtcccttgcacaacacaagaatcgatggcataaggcccctaaattttttggggggcccaaattcatgctacaaggtttgattttttttgtttgttgatgatcaagttattactataatgactataaggttcgaacaatatcaggggtatgagaaaatcttcgattttttttacttcacttaagttgtggtctttagataacaaaagtttagtttcttcttatactcaacttgagacaacactaaagaatgtcaacattttgatgtcaacaacaaagacttgtatatggagttaatgttccttcagcagtttatctccaaaatgctaggaccagccctgcttggaaagaaaggaataaccgagttttcaatgaagatgggcaacactagcgaaactcattaagttggtcatggaagaaggaaactgtcggttacatgtggggtttgcaatgttgtcgacgttctcatggcgtcgagttgactgagagctttggtataaacgccacaacttggttcattttcagtgtctcagtgtgtgccgacagtctataggcgagcaactcgctcggcaataggctgagcyttgtaaattttctaccttctcaatgaaataygagcataatcccgtctgctaaaaataaatgttgaattgaatggagttttgcaaatagggtgatgatttttttatggaagaaaagaaacgacatttaaactaagcaaaaacctatagtatggccttagcccaactttataaaagctggcctatgatttacatttaccagcccttctatggcttttcatacagcaggctagtagaacggacattgtttggacgcgggccatctgattcaggaatcaatcactgaaaaaagggtgactaggcccaaacagcagcattttactgttgcgtcttgcgtggaaaaaaaaaaggcagcgacacagtaaaaggtgaaaacaaacggtccggcaagctcgatacccaatgcaatcccgcttccacctcctccgtcctcttcactctcccccatcccagtcagtcctctccatgacctccgccgcggccgcctccccggaccccatggtggcgtaatttctgccgccaattcccttgcctccagacttcaaatccccaccaccatcgaacctccccaacccggcaaatcccgtatccaaatccaatagggtaaacctagccgcccatctgcccgcc

SEQ ID NO: 1234 - DNA, 1500 bp, Zea mays
tcacgtgcttaaatccgtacttattgtcgagcagaatataaacacctggggtgttacacaaagcactattttcaaagtctaaactttccaatctctctaaggtgctcaatatatgttcctaagggcacttagaaattatgtaaacacatcaactactcatagctcatatttttcaaggtatgcccttttagcctggttttgagctattaattgcattagatacttcaatttcattcttatgaacatgcaattgttcacttagcaaactagttagtccataatgttgtgatggtcatcaaacacccaaactaatattgaaatggcttaaagcccatttccctttcaatttgtagatagcgtatacatataaaactaccactcccttggactataaaaggggatgtagagtagcattcaatttaggttcaacacactataagaaattactccaagatccaccaaacccaagacaagggagttcaatccaaccaaggcggcaacaagttagagttagacaagcttgtctcatcccattcctcaacgaggaggtgttgtaacttattgggtaggagcttgtagcctcatgtgtcatttacatacaacaatttatgatcaatatgataacatagagcactacatatgttgtggctcgaacctctataagaagtcttgtgtattaggctcttgatgtcatggcctcgttaacatactatatagtgctagggctcacttcatgttccactaacaaccctttctcaagtactcatgctacattattttctttgttgcagcaatgcccatcagactatatcacactcgatccgatgtaacatagagagctcctagacatttaaaaatgccataggactaagttgacacttcgcataggataaaatctgtcggttcctatatgcataggaatgtccaatgatctacataggaccaatcatatgcctcatttgaatttctaacttagagaaaccaacagactatatggttcacatcacgtctgtgatgttcgccattaattaattatatggatcccccagcattaatttctctccggtgatttattgtttcggtcttgtgctataacgtactcccttcgatcatttgacatgcttggaacttgtaagcacgtcttaacaaaagaccaactcacggtaccagctcatagagtaccttacactgtctcacgtcgtgtacggaatctgaccggcaagaccatcagaagtcaccaccggccagcttcgtctttgcagcaactcgactctcgagtctcgaccaatatttttttccccggtatcttcagagttcagatatacgtgctcccctcaattgcatgttctgccatgtgcatatatatacgtgcacataagcgtccgtcgaccacagcacacgctaatttgcattgctaaccgttgcaccggccatctccatctctcatagcctcacagtcacaagggtgaggagtggagagacgtcggtgagtttcaccat

SEQ ID NO: 1235 - DNA, 124 bp, Zea mays
cggcaactctggtctgcaaaaggccagcgagcaaatctaatccgttggacttggacataacgcaacgcccgccgcgaaaagcactaccggcctgtgctgctgtggtagttagtttcaagcagca

SEQ ID NO: 1236 - DNA, 956 bp, Zea mays
tgtgatggtctgtcaagacgttagaaataaaaaaattgaataataaaagaaaaaaaagaggatagtgtggacttttattctgtggcccatctaaaagcccattaattgagcgcaaatcagttccaccggacactaccctaaccttttcactgctccagcgagggcactagccgccgccgtttccatctccccggcgctccatcgctgggcacgcaggcgacggcgacggcgctcaggctcgtgctctcaggaacggcgtcagctgcttcctttctcgcctcttgccagtcgcctcgcgccctcgcctttggtcctccgcacggctggtgagctctgcgtgcgtgcctctctctctctcctcccttctccggtggatcatcaacggcgcccggccccggcggctgcgccgtgcgcggcctgagggcagcgggagccagcagccgctgcttagtgccgctttttggaaccctgctatttgttcagacagttgttatatatatctgaagaataacatctttcattgaaaggtagaataatatttctgtttgaaggtttttacgagtgattgctctttgcgcttgccatgcggtatttctgtattaggttcactgtagccaatgcttttttttaatttttttttctattagatggctagttgaacttgttgttttgaactctgatttagataatttgcaagtactgttattttctgacatctgagttaaactgaactggatcaaattgtaaatggaaatacagggcagacagcttcaggaaatttttcatgctaaacttgtttctttgtatagcacaccatctttctgttactctggacatcaatcgaagcacagaccttaaaggcacttagtgggatgtcattttcagctactgctttattggctagtgttacactgtttgatggaagctcttgttataatgcagacatacgtagaccg

SEQ ID NO: 1237 - DNA, 1500 bp, Zea mays
cttagatgcattgggagattaacgccctaaaatagattattttttatttttttaattatatatttttaaaagtagtttcaaagaagttaaaataaaaaacattcacaaccggacatatatgaccccacacgtcagtaagctccccctcttccctggcctgtaccccgctagcgtgctgcagctatgctacggctactcccctttttctttcccatctccgatttcaaaattcaaaagtccccttcctcactcgccttctctcttctccacgggagcgaggccgaggccgagacctcgaggcggtcgcgtggcgtctcggaacccgggaggaatccacagaaaaatccgcgcgtggggggccgaatctctgctcctggggcgagccggcgaggcaagcatccgaagcactgccccttgtttgtttccgtcctcctccacgactccacattccgctgggcgctgtccgatctcctttatttagtggttacagcgccactgccgctactgatagcgccagtcgctctctgcctcattattctcaacgccggcggccaccgcggtcgtggctgcggtctttgttggaatagctaggttgagctgattcggggctgtttgtgggcatacccaggtcgaactgattcgaggctcgttctggtagagtggaatgcgtcggatttgagctgcttagggttgggattggggggtttcggtatttctttttcttttttagctgcagttttcgtccctctcctgtggccttcctttactcccgagtcccgacgacgacaggagcccttcaccggcgacgcacccttcgccgggcacttcaccgccgacgaccacgctcctggtatgctcgcccctttcttttcctttccttctgtgcggaacggggcacccccaaacctcaacgcaagctatttttacccggatctgactcagtcgcagtatccatgttctactcttggtcctttacttttccgcgtagtggtagaaagtataggtttacctcaataattttaattatttattctgctgcaagaaaatccagcgactcacagtgagatgattactcaaaagtgctaaacttgactgttcaggcctgtgcaatctccttttgtttcgcattagtgtgcagggataggtgtagtcaatttaatccctaaggaagccttttggggttaaaacttaaggttcaggtctgttccgttattaactgtcccagggataggtctgtttcgcattagttgccgataaaaagttcttttggccgaatactgagttcgatggatgttgtactattgggtatgtctacatatggagagtttggcaatggacacataatcctctaattatttcacaaatcagctgactatattattcacttctatttttcttgtggtgacattgactggtacatatatcactagtaacttccctcatttgtgtgcagtgttgaatggtgtttggagtgtggtaaactggtaatcctgggaaaag

SEQ ID NO: 1238 - DNA, 1427 bp, Zea mays
tggctccgttgcatgggggcttcagcgcgggaaagtcgggtctctgttgcgatttactcgctcgacgttgtgggccgtccgggtttgcactaatccggtctcacgtcgctctgctttgttggttgtctctccccaggcccacgaaagaatgaccttacgatttattgggcccttgggcctttcgtgaggtcttttactcctttagtggacccgggggatatctatcccccacaagcccccgatctttgggttaatttagaagtaatcagcccaaagatcccaggtccaacttgcgggtgttttgaagaagaacgtcttcctgctgtcttctcttgctccgatcactcatttgaccgaagcttagtttcatgcttgtgccttagaggtcggcatttcaattttgtaggattctgaacttcattgggtgcaccggaggtgcacccaatgggtgtagcccccgagctttgagtagattttagaaaataatctactcgaaggtcttccccagaaattatctccatttgtgctcctgcatcttggttgagggttggtcttttaatcttgtcccacgccttagaagtcggcactatctcggcttggaatgataatccatggggtgcaccggaggtgcacccaatgggtgtagcccccgaccttcaaatggattttttaaggataatccattcgaaggtcttcctttcgtgcctctttgctgaaaattatccctttcgtttgtagaaattggcatgaagctatttgcattacgctttggaggtcagcattatgtcatcaatattttgctgcagaggtcagcatatattttgtctttagcagccgagtttgcaatccatccatatcttgctaggtagtgcaatttatttgcttctgcgactgattggacgtttgatggacgttctctgtctagtcttcacgtcgcttctgtcggccatatattgtacttcgctggctatatttggctttcctctgatccttactgatatctcatttttgtcttgaggtattcactgcgtgccctgcacagatgtgaccgttttgaaaaatatactgataattcctgggcgtccccccccaatgggtgtgggcaagggacggcttggtacgctgagtgttttagccggctgcttctgagtagtaatgtgatgggacggcgagtgtaatcatatcctttgcgctgttgactggagtcccaatgggtgtagtgttgcatgaaacggcgtcagccgcctgacgtgtcttcagacgggtggaagtgcttattgaatgctttgcgactgttcagtgaccacggttggaggtgagcggttgcctttcccttctataaataacgccgttgctcctctggttttttcacatctcttcgctgttctttactgcatccttctcttctctccctgtctgcttccgcc

SEQ ID NO: 1239 - DNA, 544 bp, Zea mays
caaatactagtcaagtaggaacggtgtgtgaatgcaaagcctttgcagagagcagcccctgtatccatcttcctctagatctcctagcattctagttctactgctgatcttctgcatggccatggtgaggaacccaagagaccttgaaacatactaggagtactagcagtagaggatttaaacctatcttggagtttgcaactggtatcttcttgcaagatcccaaggccaccgtaaggtccacaaacctcagccctttttgttctctcactctccccaagaatcaatcccttttttttttctcttccttcactttttgagcgccccaaggcatgccagattcttgtttcttcatagtacatcattgcttggaacctccaagctgtcgtcttggcattcacttggccttcctgctgaaattcctgttgttaagtttgtttgtttcaattgtttgtttgtgtgcgtgtgggcgcgcgcgcgcgctattgcagatttgttgcagcgtgagacaggagctgcggctgcggaggaagtgagcaaaagc

SEQ ID NO: 1240 - DNA, 1059 bp, Zea mays
agcttataatattcttcgtattgtggtttatcaatcgatggataacaaaagaatatatggtattacacatcctgtggtccaaatatccctaaactattcgtgcctgcccagattcaacacatcgctctccgatgccctcactctcttggaagctcttctttttaagtactttacttatgccgtatgtgcccacaatgataaaaatctagataatttctcttattcgtcaagaagtggaaatgtggaatgcattatcatctcatctgggtgaaaattgctgaattcaaaaccccttgggagttgagaacatggatggtttcgttgctcaatgggcaactttacatgagcgtggactttgaaaagtcacgtgaagcaagaactttccgtatcttggcccctaagcagggttctgctcctagctagctttaggattagttttctcaactactcatgtctcttgactcttgcatacatcctatttatttttccgagaaaaagaagtttcctcaaattttatttcttgtgttgatcgtttcgtagcagtaaaaccactcgcataaagtccttggaaaaatagtaaacgaaacagcgtagcgtggtggatggtaaaagaaaagtaaaactttgcgcccgcctatacaaaaccgggagcgacgggacgaccatgtcggtgagaagagaatattccacagccagtcggtccaagctggacagcaggaggacagacaggcagcccgcagccgccgccgccgcagcccgttccgttctcctcgctctcttttcacttgccaacgccaacgccaactgcttcttgtgcaattgggtgtgcttgctactgctcgctccccccgcggccgccctcgcttgctccgggcgccaccgtggggtcctccccccctgctctcccacacccaccctgtccttgtcgtccgctctgcgcaaccaaaccggcgaaaccgcccccctttcactccccctcctcctccagatccatccgcctctcctcgaaaccgtctctctgtgcgtccggagtccggggagagggtggcggcggtggag

SEQ ID NO: 1241 - DNA, 1039 bp, Zea mays
caaatttagtaaaactagattcatacaatatatatgtaagtatgataaatacgtatatataaaaatcaaaagtaaaatatacctctaacatagtttatgtataaaagacaagatatatagaacgttattgaagagagaaaataaaaaaaaggtttttatagagaagactatcaacgaatatagatgatgaatataaagaacactactggatataagctaaaggaccaatattttttattgagcgctggttttacgaacatagaaatagagaaaatttatgaaaaaaaaacatcatttgctattcgacggccacttcctcctattttcctatccaacaaatgcgtattgtcgaggccaaggccaaggccaagcaacaatccgtggtatccagagtcagtctagaccgccatacggaggttgggcgtccgacgcgcgccggcggtgcttccagagcccctgcccccctgccgcgcgtccccctccgacttcacccgtgagtcttcttcctcccggtcatgccccttcttccctgagtaggaggcgacagatcagaatcctcctagctcgtgcggcaccgtgcgaggagcacggttcggctccggtgcccccacgcgtggaaggagcgcgggcgaggtgttggcggctccggcggcgcggtgtgcaaggcgagagcgtctccgggctgaggccaccgaaggtcgagcgcgcaggagggctatctgcttccgcgtgcggagctcttatctcagcacgacccacccctcccgacgggatagaggtccgaatttccattcagcggatgagctttccattccctccgcatttccctatcccgcccctcatatcccgttttacaaacggcgcctaagtttggttgcaaattctttccactgctgtttccgatttaattaatttgatcaacagtaggagcaatatcctttgcttgtctgcagtattgaagtacacaagtgcatatgcagctggatttggagtggtaaagacgggaaccgaagagctggtggattagaggtgtggggag

SEQ ID NO: 1242 - DNA, 1500 bp, Zea mays
gcctccctgattggtttactcgtgtaattagcagccttttccagtgtcgctggggagcatctgctgaaggattgcacacctgcacgcctgctcatctcctccggtgtagtacctgacgctcaaaatgttgtaaaaatgttttggtgttgacctcaaatataatgcaatttgctcgctggtaccgtgtgctgtcaccctatactcatttgcacctacaaatcggtgaagagtaactatgacagtttagaacagccgaagaggaaatgatgaagggctaagctgactttctaatccttttctatttccaactccaacgagtttggggttgcggagtaggagcagtacctaactctagccagagctaccaaaataccattaattgcttcatctcgggcgataaagaaaatcagatgatggatagacgcgatccagcagcaccgactggaaacgcagaaaagctcgcagtcgtcagtcaccgatcggatgtgccatgtgggagcgaggcggactgtttgcctgttcatctatcttattccgatcgccctttttctggtatgatatcggatatcctatatatgatccctgtccgctgccacctaaattgcatccaccttaaataaattatatcacgggcataaataaataaaatacgagtacacgactcagtgcacgcaatgcattgtagccaagttctagaggttcggtgacagagaaaggggtgcttttatccactagtagttctctaaccaccgtgacaacgaaattgcctagggtttcgtcaggtgtgcccaatcctttgcgctcttgtacgtcgagacgacaggggtacgaagtggcctccccattggcagatctggtgtccccttccccttgttgggatctgaacctgacgccaccaccccgtaacatttggctggctgccacggtgtactcacgggggaacgccgccggccctggccatgcagtgcaggcgcagataatccccacttctcccagcgaagcagagcagagcacggaggacggcgcccggcccagctacgttgcgggcccgcgcgacagccaccgacaataatggcggcactcaacatcggagtccactcccgacctgacctgacctgcccctccacatcagagcacctaccgcatcgacagtcgccacgcgacagcgacgccccgcatccccgcggacgccgacggctgggcctgccgcctgtgcctctggggcggcgggccccggacgtcagagctacacgcacactagaagagttgtgcggcctgcggcgggcgcgacggctgttggatacttggatcccgtgccgccgcctcgcctcgcctcgctcgttcagtacgccagcgaccccgtcactgtagctgcgtgcctgcgcggccctgcgcccgcttgcttcgccctcgcttcgctccaaatgatagagccggagcaggctgagcgaccgcgagcttgacccgggcgcacgtcggctcgcactgtcgcacccagcc

SEQ ID NO: 1243 - DNA, 1500 bp, Zea mays
tatcattctgattagtagtgtagtgtaacaaaatacaactttcaggggagagtgcttagatcatttttatcggttagctatattagatgatttcaaagttgactgcaaactttgtcatggagcaaaacttaggtgctgtttggttcacgaaatataacgtaaagggtaatggtaatggtttacacttgattacgggcggtaacaagtttgaatagtccggtatcaaattttagtacggtatctgattacggttggactaaaacgaacatgatttaacgttatcacttacccattacgttacaaatatctgaaccaaacggtacccaaattcgattggcccttctgcatcgtatccccgtcagtccttcgtactagcgtggtaagatacttttgaacaatcttgaagatacagcacttgaagaatgcccattcgcctggggttttgcggtgccattacatttacaaaatgtacaatcacagcacctttttacttcatggctctgatccgtgtgctatcatactggctgtaatgtattcactatttcttttagttggagtatttgttttcatccttgcaatatgcaacagtaattaagccacatcattattcttacatagcaagaacctgccaattaatttttttattcaagtcatgcttaatcttaacaccttaagctggcatgaatgcctgcagatgcaccggtgttgtcaagttctttgggcggatctcattccttgtcgaacacaacactcaagcatcatatttcttcatgacagcaaaatgctgcaggtagtttttatttttgcttacatgtcttctctgctgccagtatccctatcaaatagggcactcatatccgtactgaaattgttgccatcgtggtgctggccgtggccagctcttcttcggcaggttgcagcagccacaccacagacaacagctatcagagccgatcaggtttgcgacgtatgtacctgcctgtgcccaatcattttgacccaaaggtgacgtgctgccacgtatggataccaaccggcgggcgtgaaaacgttctgaaaaagagagataaattcctgaaaaccggggagcattctgagtggcaaggcaaagagacaagcctaccgataataagaattcggtttcagaattatcccttggtttcctttggacggcgacgtggacgtggtgcagaagcggatgaggaagcagtgtaggagagccaccctcgcttcccacctccagtgtctcatccgttccgacgacaaacacctccctttccctgcgctcccgtcttccttccagagctgccttgtctgcacatgcagaagcgccaagagcgagcgcctcatctctttatattgctctcacaccctccgtttctcgctcccacccactgccactgtacttgtgttgtgttagtgctgtgctgcgagaagaaggagaagcagaggaagagcaggtgctgagaagcctgccggcgcgcgttacgacaagcatat

SEQ ID NO: 1244 - DNA, 1048 bp, Zea mays
gtgtttacatgtattttatttttatgcaatatttatacttttttgtaggtgtttattccgataaacattcgagggacgcactggtatcttgtcgtttgatcacattgtagcgataaatgttttccatacggattttgcatattatagtgatgtttgtcgttccgtatcaatgttttatacaaattttttactttcgtcgcaacgcacgagcacatacctatattaatataacacacatatgtacataagttattgtattattatacgattccgttgcaacacacgggcactcacctagtagtgttctaagaacatctgggatttgatagttttagcccaaaacacttgaaaccagtgagctatagctcatggaaaattgtgaaaacgtgaaaatttatctgagagcatcagatgtcaaaaatctacaataaaaagtgcccctaagaacgactgcctagattttcatgtttgacatgctagaacaaacaaatatcacatgaatcataaacctaaattagcgaaaaaacttatgtcgtcgggtatttgaactcttcacagatgtagtaaatctaaagaacccgttgtttgtgattgaaactagctacaaaaatgttgtctcatcctatgtacattatatagtctttaataatggcctaagaatgtctaggatttgataattctatacctcaaaaaacacctgaaaactagtgatctatagctcataaaaatgataaaaacataaaatctatccgagagaattaatgtcaaaaatatacaatagaaaatgggcccaaaaagtgtctagattttcatatttgacatgctagaacaaaaaaaatcacaaaacccaaaagagcccaacagggccagaattaattttccgagccggcccactaaaaatgcaaggccattcgacgcgacacagaacacctagcccaaatggatggatcatagatgtcttgcaaaataactctcactcctccttgtattatacgcatggagatggagtctctcttcttctccttccctccgccgcgccgcgaatacg

SEQ ID NO: 1245 - DNA, 1500 bp, Zea mays
attgatcctgtttttggctgttgctaccatctatttaagtttgaaagttcatctgcttatttatagatccataccctttttttttgtgagagaagctatgcactggaagtaatcaagaggaaaacttcagcagtgtcatgtcaattagaggctctgtagaatggagaagaaaacccatctacagaaatttgtgtgttggagttggagcaacatggtctatactacaaatctgtatgttgtgttccttgtttgatctatttttcctgaattatgtggttagtcatgggaataaggacaccataccttaccagctaccagaaacctatataatctatatttgaactaactccctgctatttcagtgttggaaaaagatttggtctagtttattttctgtgggcagaggacttcagtagccaacaaagaaacgctcttgatttcaggacttccgtgctcaggtatgctgattgttgcattttgacttttttttcccttgttactgctactatctttctggcatatctggtaattgtgcttgtacacgactaattatttgttatatctatcttctaaaagaatatcatatggaggaccatggattatctttattttattagatttctgattctgatgtaccgactttcagatataagcatatcctgttcatgagttaagctgtactgctacgcagagaaagttagtttgcaaaagatcaactattgacatttgaattacaaatatcacactcaggatgatcgcatgcataaagcaatggatattttttttttcttctgtttcttacttagagacatctcccatttgtgcatgtctcaaaaatttttttgttagttttagtccctaaatttcagtcggcaatatagatggccaataagcacgaggcccgtgagctcgacacgaagcccgctgtttgggctcgatccgagcccgggccgacccggttctatgcgggcccgggccggcccgacacgaataagcgggtcgggctcgaacaggaaactaagcacgacgggctagcccgacacggcccgtttgctgacgttaagcccgctttttttgcactaaagcgtgcttaccgggccgcttagcccgttttttggcctgttttttccgtgcttaccgggccggcccagcccgtttaagcccgctgcgggccgggctcagccagagaaacgagctcgcgggcttagatggtctgtcccgattttctaaccatgacgracttcacygggccgggcggcccgtttggccatctctagtcggcaagtacaagcaatggaagtcaactttagtgtaggtagttggtactatacagtcttgactcttgagtagcaatgacataaaataggctagaatatctgattgatcacccactccctttgtattctataatatccatgatgtgcttacttataccatcttgtttgcaaggaatgcaatgggcaaacaataatcaagagggagaagaaaattttcagtacc

SEQ ID NO: 1246 - DNA, 628 bp, Zea mays
ggtatgtgtggtttcgacggctggttgattacaaggaagtctaaggaattttttctttcaaaaacgatgacgatgaaaaccgttgaatcatgaaaacatgtggtttaatattataaaagaaagaattgttgtatcatggatttgtcaccacataaattgatcactgcatgatgctgcagctacacatctccatttaatttcttttctatgttatatgcctattatttcaactactttgtttggcttttaaagggactttgtatgcattgtgcttccgttatgtgcttgattggttcttatgggtatgattattatattgagttattgacgaaggaatatggtttatttttattttggatcacaatttgtgtgtatatataaaaggtattttagtctatataatgttaaaaacataacctatgaagcaatatgggtcttatagcaatcggtgaacattttagcgaagcctgacgcgtgcatttttcaaatctcgccccaagccagtaggtactaggtaggccacagtccgcttcacttcattccgaaccgagacaagacgcggaagagaaataaataaaataaaataaaataaaaccctcctttctctctgccggtggcgggcggagcc

SEQ ID NO: 1247 - DNA, 287 bp, Zea mays
tttgactaattttaatagctaaatattagttctagtgcatttaaacaatcataattgaattgctaaaaagcagtactcaattgctcatcaccagttcaccactgaatagtgctgccaaaccacacccactggcaggtgggtcccacgatacattgaccgaagaggatctcgggatttttcaggtggagaatttgggtcgcccccatcgccctcccactccgggaccgcctctcgcgcttcgttgtgcctcgccgccgacgcagcggcattgtcagccagggcgcgcg

SEQ ID NO: 1248 - DNA, 1500 bp, Zea mays
tcgttgcgtgagcctattatccatgatccatgcgtttgcagcggtagttgaccggttgctgtataggaaacccgattgggctaacaccagacgtctccgcgttctcatatacgtacagagaaatccaggttttttttagctcacaacagcgtgtgacctacgcggatcatatcagacaattcgtactacagcactcgggaaagctgcagatgggctagtacacaccttgcatccgctggtttccgtgcattttgaattaaaaaagagagagagaagaattaaacctgtgcctgtctgaacggcgacacagtagagcacattcgtgtcgtgtcgtgtagtgtatctctgctagtgaggagttcagcagagcccttgccaagaacatgcgattgtttgataggaattgcaaaaattaaatgccgaaggtgcatttgataagaaaccaagtgtattacgttataaacatcagggatcagaaaaacctacaattcatatctctcgcatactctcttctttcttcttctatctcagccgccgattgaccgccctacccgacggcgtagttgacaccatagccacacgacaccagctgggtcaaggggtccaagcctgcgctgcgcggccaagcttttgcccagaccatcattgctcctctcatctttagttggggaagtgggaaagtggcaatcatacggacccatcaaaagaggccccttcatctttggtggcctagctggattggatatttggacgagtgttcttcttggcttggccacccgcctactccgtcttcttcatacgagacaagccgtgcgcttcttcttggcctagcccttcgagcaggtgcgtgcgagcggcctcctcgccttcatgattccgtcctcgcatcgcatggccttctgcgtcagcagatgcctgacgggtggagatttgggagaatcccagtgattctgtgaatcctttttgttctctgcttcgtcggttcggggttttaaggtttttgcgctcaatttcttccctgcagttcactttgggcactaatggttgctgctgtctagtcactgaaactctactttgcggtaggttcgtttcagatatattttcttatagattctggcttccccattgctgtcttgaaaaatccaagtagttaatagcgaaattgagttcccctccaccgaatcgtgcagtattcttgaagaaatctagtcactatactgaaatgtctgtttctgcacttcttcatgttcatgcctaatatgctaatcgtaggtttcgttttttttaaaaaaaaggggaactgctaatcgtagacgtcattggagggattgtttctgattgtccatggttccttttgcacattgtttcagtctactactcatgcaagaagaatcgttcacacgctgaagaacaagaatcggtgtgtatttgcagggcaggagaggaggccactctgactgtcactctgagcttcgcgtcacctgagtactgacggacgac

SEQ ID NO: 1249 - DNA, 394 bp, Zea mays
tatagtattgcagtacttgaaaatagcgtagtattattttggaattgtgaaaaactttactcccaagcactctctcacttgtcagaatttgccacgtctaagtttagtcaaatttaaccaacttaaaaatatgtttggtttagagccgtagtcgtggcattatttttcttcgcaagagccattgtcgggggtctattcgtcagcttcggcgccgcccagttctcccacttccggggccgccaaaattccctccccaattctctcgtgctttctctcgaccgccgccaccgcctcctctcctccgccaccgccaccgccaccgacgcctccaaaaccctacaccccagcagagtcagcaagcgttgtagcaggctgcggccgctgcctcgctgcg

SEQ ID NO: 1250 - DNA, 1500 bp, Zea mays
gaattgtatgaagccagatcgaattcgctttgaggacacgaagcccctctgaagaagactctcttcatcgatgatcaaatgaaggcacaaggcacactttgcctcgagataaagtcaaaattgaatgaaggcagaacgattccctcgataaatgtgaagcccctctggcaaataggacatgccaatgtgaaacccagagcatatatttggataaaaagattaaactaccctagtatgaatgaataaatgtaagggaatagtctaagagtattttagactttgtatagggaaaaacaaatttgacaccccctacaaatatatttcttacatgtattgtttatgacatggaacagatacttgagtatgtttattctatcaaattttgtgtttgagtgagttctcttacccaacataggaattttggtttcaaaagatcttatcaatatgaagaggctccaactacgtagcataagtatcaccatcatcactagaagcacaaaattctgttgacaccgatggatagaaagtcagctaacttttacatcaaccatctagcttcttattggcctaactaaagtgccaacttgatgcgataagaaagttgcagccatcggtcagatttctgaagcgcaacaaggaagatgacgtgttgttctcatcgcctatttgttttctctaggctaaaaccaaacagctaaaatttagtcagtgaagagttaaagtaccaaacaccaaaagctaaaagggacaaaaatattttagctacattatccgtccagagccagaagagttaaaagaggctaaaactgctgctttcagctggtccccacacaggtggcgcgtgtagatggtcccacttcttttaatacctgctttagccatctgttctaaatagatggtgactaaattttagttagtcattttagtcactttagtttagccttatagatccaaataggccaccacggtgtagctggtgaagttataactatggatgacaatagtatctaaatttacattgtaagatttaaaaatcgaatcggattaaaagtatgacttatttctatttattttgaactaatatttatttagtctcctattattttgtaacgaatcatcttggtcacgatccattaacacccaagttgtaacactcgcgtgcgcgcaatgccacgagctgacctccacgaccacgaggaccacacaatcgcttgagctcggcggcgtgggcgcgtggccgtcgctgtccatataacactatcgctaggctttgaagcgcgacacggaagacgacgtgttgctcagagagtgagtggtatgattcgaccaatttcaaaatgtggcgacaacggtgcagttgaaaagcatattgtaatgaacactcccttacgtgcagtgccgcgagctgacctccacgaggaccgaaacaattatcgccagattggccgcttcacctcgacagccacgccaccaccactgcgggtctgcggcagtcggcac

SEQ ID NO: 1251 - DNA, 309 bp, Zea mays
aaacaaagacgagacgagacgagacgagacggaaagccgggcttgcccgtccattaatgacctaacggaccccacggcgcgcgcccaccaccagtccaccaccctccaccgccctccctcgcaggcaggcaggcagccagagccagagccagccgggcaagcactgcagcagccattgtactcatcacctccttcccacgcagcgagaggatgacaccacgaggcaaataaacccagacgtagttcagctagccgcttctacctccctctccccccccgcctgcgcgctgccgcgagagctcgttcctg

SEQ ID NO: 1252 - DNA, 184 bp, Zea mays
tttttaggcacgccaaatgcaaagacaatttagttagagaggtccttatccctccatcttaaattaaattaagacttcatttggtacagctcagtttcatcagtgaagcagcttttttcaacttcataccctatgactatgactatgattatgagcagccccacccgcagaattgaaggcattc

SEQ ID NO: 1253 - DNA, 243 bp, Zea mays
cagcctatcatatagatagctcggctcgcaccccgtcggctccccgccacggccctttcaacccaaaagacccgtttctcggacgccgcgccccgcgcctccagcttaaaccccgaagggcagttcctagtgcatcgccgccgcggccgccgctgagagtagtcatgtgctagtgcgccccggcgcagtcctaacggtacgtaggtctctccacggtggtttagtgaagttaagaacaccgcc

SEQ ID NO: 1254 - DNA, 723 bp, Zea mays
atttagttttgaaacctaatagtcatatgcacctacttattttaaaaagtacctttacaaaaatataaatatattaaaagttcatttgtattttaataaaaaatattggtgaaaagtatttatcaatcggcaccaatgcttagccagttgttatttaacaggggcctgaaatattaaaagttcatacgcagtcttcttttccgtcgacatagaatagtcattggattagtggtgtatgtaatcactactagcggcttttctgaatagtcacggactctcgtggtaaaaaatcgtctgagcaaggtaggaaaaatgtaaaataaaaacactgcaagagtggtaggaagctatacgtatccgtgaccagtctagctcgcgctccccagtacrgaaaccacaagacgacaggtagaagaatccggctgttccgtgcttcgtccctgcgacagggacgcgtgacgcgtccctccccggctgcccccctcgcccccatccggcaatcccatcccgtccctccgcgtcaccacccttcggccctccactgaccactgtggcactgctgcagtgctgcactgcgcgcgcgccacctccataaaatccaccccgagccggccgaaacggaaaccccacgcacgaatccaacccaagaacccatcaccaccctcgcgtcacatgcgcgcataggcccccggccgcaccgcaggtcgccatcacatcaccacc

SEQ ID NO: 1255 - DNA, 202 bp, Zea mays
cgtgcccgtyctgtgttgcagaaatttttgccttggagttgtttggttagggaagacttcttatatttgagtagatgatgtcactatggtattgtatttgagatttcatttgtgtgtgtgtgtgtgtaattgttaagttatgtgtctgttttgaggaaaatattgatgtatgcttttgaaatttatatgaagaaaacccacg

SEQ ID NO: 1256 - DNA, 130 bp, Zea mays
agtagctcagactgagggctgatttggtcctcgttggtcaccaaaccagccccgggactttttgcgttctccatgtgtgttttgacttcagtaggacagattcaggttcaactgcacatcaaggtttgca

SEQ ID NO: 1257 - DNA, 89 bp, Zea mays
ggtacctaagacccaagcctaaatttgccttgcagatttatgcatccgggggttcaagctggattatcgacagcggatgcacaaaccat

SEQ ID NO: 1258 - DNA, 536 bp, Zea mays
gtatgttcatttttattaagtttatgtttttctgtgagggtctataatactagctttcactagacccttgtatttgcatatgatcaagctgaaagagtctgatccacttcaatcaatatcattaaatactgctgtgtaccgtcgtaataaatagatattgtattagttatatttcaaatttcaatattatctagagtacaaaacattatttctcacgactccattcatgatgtgctcgacacagtttttaaaaaaaaactcattacggacgcttcgatcgtacggccgctcgccgactcacgtgacctgacgcatctccccctcggtcctcgactcctcgctaggaggctagcgctagcgcaactcagacgctgcaggcaggtcggcactcggtgcgcacccgcaattcgcaaacccgcacaacctccccaccccccaaacccatccctcccgcgagatctctcaccggagtcaccgccccccagatccgcctcccctcgccggcgcgctcgcgtgttttccgctcgtccgccgcc

SEQ ID NO: 1259 - DNA, 1500 bp, Zea mays
tggctcgtttagctcgcgagccagagcagaaaaaaataatatgtgtataataatcaatttctagttaattttaagctaatttaacaacataaaatagtaattatactcatagtttcacagaccatatcaatataacaccaaattaacacaactcatcactcatcaattcactattcacacacatattcagcagtttaacccacacttatattcgtatagaccaatttcatacatagacataattcatcaatcattagtttaacttataggttatatacaccacacatacatataacatattcatcaattgttacataaatgatatgtatatagttttgttttgctgaaatgtgatagctcgtttagctcacgagctggctcgttaacaaaccgagctggctcgttaacgaaccgagctaggatgtcagctcagctcgcgaaaaaattcaaacgagccgatccgagccgagccgagctggccacgaaccgagcgagccgacgagccgcgagcattttgtccagccctaatcgtgcctaatgcgtgattgacacggttatgacgtgtcatatcgaacaacgtagcaacattcaatttcaagttttaataatagatttcttatagtgttgataggaactagatgcactaaaacgagtctaacaaacatgtttagtacaagaatcaccatctcaacagagcctaaccaatgaaatatgaaaatacagttgcaccatctgaatcgtacctagctaaggacctttttatccagaagctaatgcaaaatgattaaagtttagctcatctttagaagttaaaagtgactaaaaagatattttttactatttaagtcacttttagctctttctatttggacctttatctttggctcctaaattaactaaattttagttatttttattttagctttcaggatgcaaaggccctaataacatatttagaaggattttaggagattgaatgagctaaaatcttcttactatttaaaattaaatagcaagtagattttagcccattcaatccttaattatcttgtgttggccaaacgagccacccttgttctgctaagaactgaaagaacgtttcagtgattcactcgcatagttaaaaaatattattttatattatagattatattatttatagaatggagtttaagtaatgagaggatgatgcgtaagctgctggatggaggtagtataaaggtaagaggtaatataaagcgctaaaaaggttcccacctccaacgcccgccttcgtgaacccagctgcgggatggaggatcggacggccagggtctctccggggaggagaactcacagccaccatctcagccaacaggtccggatagcgtctcgtcgtcctcccgcctcgctccctccgtcgccttctccaacgggaaatagccattaccgaaggaggcccgtcagcagcgtcggggcaaaaatttcaccgcgcgcgatcaagcgattgatgcccccgtc

SEQ ID NO: 1260 - DNA, 204 bp, Zea mays
tggaggtgaggaggggtacgatttcggtggccctaggccttgcgggtccggtggatggaagccgtggagctgccattaccagccaaggtggagttcgggaagccaaggtaacgacaacaaaaatatctcttctggcgtgtaactgtgtattgtgaagttgccagtggtttagcgagaaacactgaagaacttactgttctggct

SEQ ID NO: 1261 - DNA, 960 bp, Zea mays
tgagtttccaactagatcctaaaagcaagtataataaggtgatgtaggcgagctgtaggatataacacatcagatttgtgatgatatgaaagaaaaaaaatgaagagagaatgaaagcgaactgttgctcacggactctaagatataatataagaggaagagatgagctaagtattaaatgtataaatatatttttagttagttatatatgataggacaatatcataaaactcactttgtgccatatcgttaaacttgctgtagcttcaccgttaatcgataaaaaatattaaaaaagcatctcccgtttgctcgactgctcgagtgtgcaaaaaaaaaggcacgacggacccgcgcgctgacgcggtgagccgcaagtccgcaacggcgcggccgcgcgctaggaaaaaagcctcgcccgtgaagcgaactccctctccttcgaccttcgttcttccactgcggcctgcgcgacccgtgcagctgcgcgctccacctggccgcgcctggggcccacaccgcctggcatctggagcattgcccccggacttcgcgcggccgcccgcagccccgctccccaccgaaaagcgaagcgcgattgccatccccacgccaccgcgaagcacaaggtccccgccctgcacgatcagcaggacctcgccacgccgccgctggagctgcgcgtgcgcgtgtgcgcttggaccgacgcgcaacggcctgcctcgaccgcccgtgcacgccactgctcatgcagccgtccgcctcgcccccgccccgaactgccgaggtcgcgtgaacgcccactcccctcaccgctcgtctccgtgctatataggcagcccgcgcccctcctaattgtagccctgcagtcacccagagcagacccggatttcgctcttgcggtcgctggggttttagcattggctgatcagttcgatccgatccggctgcgaaggcgag

SEQ ID NO: 1262 - DNA, 675 bp, Zea mays
tgtcctatgctccagctcaccccctctgtttgttctcactactgggtcgggtctgcttggcgggcacaccaccatgcccgtggaattcctcggacctctctcctccgtgttggccgaagccatagaaattccttgctgcgcccagccgagttcgcccaggtcacaagcatctatgtcctcgcctcgtcgtgctcgctggtcgtgcatccttgcagttccttgcttgtgatcgcaagcgctcgaagtggaaaaacagagttgataaagaagaaagcaaaaccgtatagttcgtgcattcatttagtgtggaattggtgctatgaattttggggaaggaattccgagaaattagtggacggtgatgatgatgttcgtgcgatactcgtcagacgctcgaccaaaaagcctaattcgggagtggctactccgtctttttcgtcatgtgggaatcgtcgtgctgacacgtcaataccgtcgatcgtcatcccctgttcgatctcgtcgtcaagcttcgcctcagccctagtcgtcgtctttcacccagcagctcgtcatgagacctcacccagcagctcgtcatgagacctggtgtcgagctcctttcctaacaaatgccgaacctatccctgctcctgcgttcgccaacagtcttaactcgtcaatcacgctcgccag

SEQ ID NO: 1263 - DNA, 786 bp, Zea mays
cttgcatgcctgcagccggcccatatgaaggacaccacgtgaactcccccgacgactcagtgcgtcttcgccgccgttttcgtcgtcgcagattaaggttcccctcctctaacacgccggcgcttccccccctgccaccgcgacactcagtcgtcgccgccgtcggctctgctgccgtggccaagcgcgttggcagcgaggattgctttaggtatggacacttccactcccttgcgcgcgtttctctttgttgtatctgctgctctgaatcggctttctccggcgtgttaacgacttttgtgtcgtttctcctcttaatctgttggttgcagcttgcaggcactttccccacccccaccgccgctgatttcgccgttatgcggtgaagcccttcgcgttgacgggctaatcggctgcctgatttctattatgatggggtaggtgtgctcctggttcgcgtctcggaggaccctcgccgtttatcgatccagtgatgtggagctcacctttctccggctagcgttgtgtcaggggagagtgcttgttgatccctcgggagctggttgagttgtctttcgtttgtgggaaatctgtgcggcagcgtaaggttgctgattcggatggcaccggtgggggatcatattgtggacatcagctccgatgaggaggacttgttcatcggcactttcctaaatatactcctagaacccctcgacccccgttaaatgggtggatgaggtttgcggtgtggctgattatgtggccgggcaggatatcgatgacctc

SEQ ID NO: 1264 - DNA, 121 bp, Zea mays
gtgctgttcagtgtagtgtaggtagtagataaatattattcagaaccttctgatcctgcaaatgatcaaggagatataaaaatgttctgtacgtatgtatgatgctggatataattgactt

SEQ ID NO: 1265 - DNA, 485 bp, Zea mays
tgcagctggactggatcactagcacatcatgtgagtgagccctatttcgcagcatgccactgccatctgattgagacacatcttccctcagttttctgtgggcgtgcctagttttcagtaggaaaggagacaagaaatcctcatcactctgctctgaaatagaaacccaagctgatccgctgatcatttctggccctcactacaaccggcaccggcatgtgccagacactcgactccaatcagaatctcatccaaatcgttcccgcagacgcgtcttgcaacaccacacccgccgcgctcgtggccatgtcccttgcccaaccatttcattccagctgcggactgagctatatatattcagggtcaggtgggctctgaacatcatcacttgcagcttcacaagcaaactaaaacacagcggctaaaggcacagctctccagcattcatccagaaagaagagaaggaaccaagccaacagccaacc

SEQ ID NO: 1266 - DNA, 1500 bp, Zea mays
cctccctccttcctccttgggttcgaactaagcaagttgaattgaacggtccaaaagataagactgttttgaggtagacgacgggcctgtgatctgacgaactgctgccaggcagggaacgcattcaattcaaactgtctcacaaatttaaactcgtggcgtaagtaaaaaaattcaagtaaaacgaagcaagcagcctgcagcatctagcgtgtcaatcattcacgcgatgcaaagttgctgcgcgtagcagcagaccgtctctgcgacgtgctccctctcccagtctccctcccctagtagtagctaaaaaacgtagtaaaaagaaacaaaagcgctcgagatgtgtttgtgtgtgtgatgatgatctaactgtcattggtactgttccaaacagtgtagcatacacagggttccagctacagtcatctgggtctgggcttgtcctctgcactgcaccacacagctaagcaatggaggcatcatcagtctatctacggctttggctatcagtagctactacatgatccctgctacctactgtgtggagactggagagaggcgctgatactgtgtcacagtttttttcttcttcttcccaaagatcacaggttccttggatgagatggagtgggagcgagcctgcatatgtggtatggagtgcagtatggatcggaggtaagacaagcactgaagaaatagagcattgcattgcatacattccagctaccgctgaagaaagaatggaaaagagaggcgagccataaactgggtcctctcatcagaccgtcggaaaaaaaaaacactggctggagatattagaaattcaggtagatgtgcctcactgtatgagcaagcatccgtctttctcagacagccccaaccaccctactgtccgtgcacaatcaaggagctgagaggaggagctcacactttgtttacagccaacttgcattggccactgtatttctcaacgacaccgacgcacgcacgaacgagcggagcagagactaagaaaatggtgggcaacaaaacaatgcagcgtgtcctgtaggaactaggaaggaaggaaacaacgtctctctttctccatgcactgttggtacagagtaactgaactggctaccttacattattatcaggagaccttgcagttgcaggcaggcagttggccttctgaattgctaatggtagcacatccgatcatcaggagacctgcaaattaattattaaaaggaaatcgcatactatttcgtgtggattatttgattggtctgttgttttctagacacacaatgcgcgcgcggaaatgcgcccggtgcatcttggcatcttctctgtcccgtcctctccgggcctacccgcccacctcttgtccttgcctttaaaaacgcctcgctccctgcccctggatgccattgccacctcgtcttcaaactctaagcacggtctccgtcagtcggtcacatttcgcgcgcagcagcagcagcagaagcagcc

SEQ ID NO: 1267 - DNA, 319 bp, Zea mays
ctggaggaggctcgggacaaggtccttactacactcagcgcggtaccggcagtccctgcgacactaccacgccctaggggtccgatccctagacctccaagtgggcgacctgttgcttcggctacgacaagacgcccgatggcggcacaagctcacgcccccctgggaggggccgttcgtcatcgccaaaattctgaagcccggaacgtacaagctggccaacagtcaatgcgaggtctacagcaacgcttggaacatccaacagctacgtcgcttctacccttaagatgttttcaagttgttcatatacctcgctccc

SEQ ID NO: 1268 - DNA, 570 bp, Zea mays
tgcattcatacaagagctctagacttcactccaaaaacacaaacaagaggatcaaatcctctccccaagtctgaaatcactccaaacacttagtggctagtgagagagagattttgtgttcatttgagttcttgtcgcttggatcgcttttcttcttccccatttcttgttctcaacacctttgtaatcaaagcaagagacaccaagttgtggtggtccttgtggggtctaagtgacccatttgatcgaggagaaaatctcactcggtctaggtgaccgtttgagagagggaaagggttgaaaaagatctggtctttgtgaccacctcaacggggagtaggtttgcaagaaccgaacctcggtaaaacaaatcattgtgtcatccgctttcatttgcttgtgatttgttttcgccctctctttcggactcgattttatttataacgctaacccgacttgtagttgtgcttaaagtttataaatttcagatttgcctattcacccccctctaggcgactttcaattggtatcagagcttggtacttcattagagtctaaccactcgaagtg

SEQ ID NO: 1269 - DNA, 1500 bp, Zea mays
actaacaaatacatgtgtgcactaaaatcgagacaagagggggcaggttgccaccccacatctaccggagtgctgtagcatctgctagcatcgtggccgatagaggtgtatttagagggcaccgtgccatgtggaggcacacctgtagccgctactaagggagggggagcgttgaagccagtcgaagtctatggtttctcctaaatttctcctcctatatcacttttttgtcacatcatcaacatttcatcccttacttttttatctcccgcagcggttctccctatattctctcatatatcccactacaaccataaaatattatttcatatactactttttatccactatcaatttgtcttctactaacaattagagccggacccacaacacagtacatgggggagcagacgagcgtgcgctgcatccagggggagagagaagagaagggcacgtgcgctgcgtcgtggagggcaccgtagggggcagcgctgcggcgtataggggctgtctgttgcctctacgggaggggagggagagcggccacgggagccgctgcacacagcctcaccttacctgtttagggatagtttagttgatacccttggagcggtcgagtcagactctcttgatcatatgtaatctttgtttcagtttcggtgtggtgtggatgatgatcttgctcagcaagatcctcatcttgtatgtaggactttcttttctctctaatataaaagatgtccagctcagtttcatcagattagtcgggcgatcatccaacaattgattaggattagcgcaagaaaaatacttttttagataatggatcagaatttcggctttcgcttatttagagggtaagaccaagttcacacaacttgaaataaatctaacagatcacaaaaataggacaaaactgtaaagctaaaggcttgtttggtttatggttaaatatgtcacacttggactaattagtcattygaattaaataaataaacttagacataaaagttagataaaatgtggtaagttagggycaaccacctggggagaaacaggagtgaactacggtgcagcctttgggcggattctgctgaaggtggggggtctttgcttgccttctcctgtttgaccgatggaaatggcctcgtttccttgctccgttgttcgtcgggctcgccgctcgctcgtggcacacacgcttgtccgtgagcaccgaccaccggatttttctggaccacccgcggttcttggaaggattggatgtacaggaacagtagagaaagacagatcgactcacgtgcctaccgtggaccaggtccatggggtgggttggcaggttgctgagactgagagcacgggaccgtgaaggcgtgaaccgagcccacccaccaaccaaattccgcgagaccgcgactgcttctccatccttccacgaactagacgagggaagagcgctgaagctgtggaggaaaacgaaggatctccccgtgcttgtgt

SEQ ID NO: 1270 - DNA, 1500 bp, Zea mays
ttcagagttaaggctgtctgacaggccaatttcaaatctctttttctcccattttcatgtagtactagggcttactcacttaatcaaatttgtaccctttacatagctctacaagtttgatgtattgatctagggcaaaatatttatgaattcagagataccaagctccaaagtttaccccattcaactgaaattcagacttaaccatatagtgttcatgggtactttttgcgaataagtccaaacttcatcactccacttgaaaattcttcaatgtgaaagttacttggtttgtgatgttttatcactttgctatttgcacttcggtccaaaagtgcgtagaatttacatttacccccctagggttccaattagggtttcttttagggttttgaggactttagggtttttgtgcaactaaagcacatcaaatgtgataccttgtgaacatttctcatagcttatgagattcttactcattttggtttcactttaatccataggccctatttacatggttaagtacgctaccttagcattaagtataccttaagtcaagtcatcacaacttattttgaaatttaacctagtgaatgcattctaagtgtaacaaacaacatgacatgtcaatacacatgatgttatgctcaagtttcagtgccagtagcaccagaggtgttacacaaagtggccatgtgacttgcatagttaccgatgcctaggtgcccatagtcatcaacgctctctctcaagcccgaaggcacgaaaagaaaaggcacctggagtacaaactacggggtcaatgagattagcttacttgtactcagttatttttgtactatgaattacactaaacgaggtaggagctatgactacaagatatggattctaacagaggagacagacagaacaaacttgattagcatccatcaccctgaggctatgttcggttaccgggggtccaatccccaagatgattaaatccacccggggaatgagttgatccctgggctctcactcaatccctgttggggatccgttccacgccttttcactcgtgggacaaatcccaggacggggtgagagatttcgccgagaacaggtcgggacaggacccctgcgtgggtgaaacgaacgcgattttcaccatgggccgggattgagtccgcgtcggggtgatccacgggggttggggcttgatcccggccaatcccggcccaaccgaacatagcctgagtgcgcagcgccactaattatgcttcgctggaccactgaacagtaggccgacactgttgacgctgactaactactcgtggcacccttttcacacgtataacagccgcgcacgcactcgcgcaccagccgtcactcccgcggacttcactcccgtctcttccctgtcctctactctactcctgatttcagcttctcggcggctcacctcacttcctcgcatcacagcacagccgaagaagcctccaagaaaaagaaagagagaaa

SEQ ID NO: 1271 - DNA, 1015 bp, Zea mays
ggtttctgtgtttactaggtattggcagaggagaggccaaactaaatgatactgtagatgggctaaaaatgacccaatactgaaaccctagccaggtgaaaatggcccaataccaaaaccctagtcgggcgaccaggaaacactaagcggatgattagtcgccctaattagcgattagtaggtaaactagattgaccagcctatctagtcgagtcatctgcctaatcaaacacaaacatgcgaccagcctgataatcgcgattagtcggacgacttgaaatcattgcttgttattgctggtcagcttgctattgctggttagctggtgtttctcggcatagccatttttctgaccaaccatatataaatgcaaaggtccagcctaaaaaaagctatagatttttagagctaaaagtagtttaactgatatttggttaagttgtctttcttttttcttgacaaaaaggacagttcatcacaccaaagacaaatggaatagagcagaagatctgaaatgtcgttagttcaaatgactcttgtgttacagttcacgacaggaagtaaaagaaaatgaaaaaaggaatagttcaaaagtctggctttcttcttttctcgatgcctagaatgcatgaggtttttctttcgatctatctatccctacgtttgttctaaaagactagactgattcatgtcaaatttctatataatttcaagtggctgctttctagagtgatggtgacagcagcgaggcaggacactgaggtgggaggggcaagtggtgttctcagctcaacggatcagatcgatcatgtgctgagctacactttttgaggtatctcaggtgtgtaattcttgcagggacaatggtgatgggatagcagagcagggcagcatgctcgcagtacctcctcggcgccgcctacgatgccagcgtcaacttcttttgactccgcagagatgtaggctcatttgctccctcatctccctgcctcggtttgtgagtaatgaaaggtga

SEQ ID NO: 1272 - DNA, 1500 bp, Zea mays
tctttaatggccatagcaaaggaatttttagacctaaggaccctaattttcatatggttcacaaggaggataagagatgatagacgataatatccatattttaaggattgcgctactgctctaggtggtatatgaaagggaattaggcttacaccctttttcctaattaattttggtggttgaattgcccaacacaaataattggactaactagtttgctctagtgtataagttatacaggtgccaaaggttcacacttagccaataaaagaccaagaattgggttcatcaaaaagagcaaagggataaccgaagtgtgccctggtctggcgcatcggactgtccgatgtgccaccggaccgtgtccggtgcaccaccggatagtgtccggtgcaccaggggacttcacgctgaactcttcaccttcgggaaaatccagaggtgctccgctataattcaccggactgtccggtgtacaccggacagtgtccggtgccccagggaagagcaactctggaactcgccagcttcgggaattcgctccgctataattcaccggacatgttcggtgtacaccggactgtccggtgagccagcggagcaacgactattcggcgccaacggtcacctgctatagcattaaatgcgtgccagagcgcgtagaagttaggcacgcgcgaaatggcgcaccggacactctacactgcatgtccggtgtgccaccggacatccaggcgggcccagtagtcagagctccaacggtcggaatccaacggcctggtgacgtggctggcgcaccggacactgtccggtgtgcaccggactatccggtgcaccatgcgacagacagccccaccaaacgactagtttggtggttggggctataaatacccccaaccaccccacattcaagtcatccaagttttcctacttcaactacttacaagagctctagcattcaattctagacacacccaagtgatcaaatcctctccaaattccacacaacgccttagtgattagtgagagagatttgcttgtgttcttttgagctcttacgcttggatcgcttcttttcttttgcattctttcttgagatcatactcacttgtaattgaggcaagagacaccaattgtgtggtggtccttgtaggaagctttgtgctccaagtgattgagaagagaagctcactcggtccgagggaccgtttgagagagggaaagggttgaaagagacccggtctttgtgaccacctcaacggggagtaggtttgcgagaaccgaacctcggtaaaacaaatccatgtgtcacactctttatttgcttgcgatttgttttgcaccctctctcgcggacttgattatatttctaacgctaacccggcttgtagttgtgattatttttgagaatttcagtttcgccctattcaccccccctctaggcgactttcaattggtatcaaaacccggtgcttcattagagcctgaccgctcgaagtg

SEQ ID NO: 1273 - DNA, 609 bp, Zea mays
accaatcattatacctctttgggcttcctaccaccacaagcaattgttactagaatttgtcttggtcgtttaagttttgcacactgaatggagcactttgtgctactgattttttggtaaaacgatgatcgtgagaattagattggaaggctttctggaatggttagggtgtaatgttgtacaataatctaattcgcattggtttggccctagttcagttgaatgatgttgacggggttgaaggcaaacataatgtatttgttgtagtcatcaaacgtgttgcgcacaattcacaaacagcaatggcatgtagctgtttatctaaccgatgcacacctgcattgtactttaaaattaaacaaaaaaagtagagcttatggaatcagtgtatatgatatgatgccctccattcgtaagctactaaagtttaagtagtacactttttctctttccaacctctttcgttattctttccattacgaaacgagaaagtaatactttttttcaacacggtcgtaagcaatgacgtggaaatattagactcccacacgtatattacaacagctgtgctgctaggcacccactccccagtcaaggcatatccattcc

SEQ ID NO: 1274 - DNA, 702 bp, Zea mays
gtgcactgcagcaggaccctttaatttgtattgtattttttgtgtagtgcaacagatccctttaaatttacatgcccttttttctgtaataattagtcacatagatgtacagcaagagaaacatacctgtgatcattcaatggtccaatgtgtgcagggaatggctacttttcaaggctgatggatgacaacataatgggggaccttcagtcacaagcatgggaaagatggtagagttgaatcaacaactaatggtgtcttcaatactctgagtgggtttgaagcggcagacagacaaaatagttggcaatattttaagatgctcctctctgataaggagtcgcttttggatgatcttgagggagaaaattctgatcaaagtgattcagaccatgtcacactagcgataagtattgaggacacaggtgttgggataccattgcaagcacaagatcgtgtttttacaccatttatgcaggctgatagttcaacttcaaggaattatggtggtactggcattggtttaagcatcagcaagtgtctagctgaacttatgggtgggcagataagttttgtcagcccgtccttttgttggaagcacattcactttctccgccacactgaagcgctcatacaaagatacttcagttgattcaagtaggagcttgtcagaggcacgcactaccaactgcttttaaggga

SEQ ID NO: 1275 - DNA, 1500 bp, Zea mays
gctactgagaccgcataacaaattcagctagagactccttcrtttatatttatagctccatattaatttattataaaaatatatttatagctaaactaataatatttgtttgatatcataattattgttactctttatttatgattggtcaaacttataggatacaaaaacataacgatatgttagaattaaattctttctaggacgagggagtatagactagtgatagaaaaaaaaggtaatctatttcaaaggacggatcgatgcgccctgatccaaataatatttcatgtaggaggagaacattttacccatgcattaatgcctgacgatcatcgtagtactgttctggagcaacgctctcgtttgggccctcaataataacgcccaatggatcgagcagacaattcgtgggcaagcctaatggtgcctcgagcacgccgatgcccgcgcaatcattccatccagatcaaatcgcgcagcagaggggagctgctgcctccgtccgtccagtgagcactgctcacacactcccaatcattccgccaagtcactgaaaactgacagcagaccagtatgtcctgctgtagatcttcagtttcaaaccaacggtgctgcaaaactgcaagctgcaaagcatggcagagaatcagcaaattaatcaatctatccaaagtggttactttgtgataacggtgaagccaagctcggaagctcttggtaccaacgttttttgaataatagtttcatcagtatctttgcactctgtataggagcctggccgcctggggcatgtggtactgtactgtcatgcttctgaattccagcgaaccgttggtgcgtcttccataaatgcatcaggcaaacagtgcatcgagtaaccaatcttcttgagatcagatccctaccctactcccgaatcaaatggcgccttcccctcctactgaaagagacgaatgctctgaaatctgggcgaagaaaatcgtgctcttttcatgtttcagagttcacacacacacacaccctgttgcagagtagcaagctaggaatagcttccatttccatggaacgtccgatccgattgcaggagcaggagcaggaggaggagctgcttctcccgaaaagagagccctctttccctttgacaattcccctgctgccagccagagttccacggacatgattatggctggactgatgaagaaccttcgtccccaatccatgtctcgcaagtggcgagcttttactgcccccctgtctccaccggggctaatcaacatctctacgagaaacctaatcccgtcctatccctgcaaaaccacacccctacgtacactttcgcccggtaataaaatcacaccatcctgtcatcacgctccctcccgtacaatggcgcatacattattctcctgttatcccagaccgaaacctaaccatgcttctgccacagtgccatgcttcactcacaagtcacagccgtaacagtgcgtccccccgctg

SEQ ID NO: 1276 - DNA, 175 bp, Zea mays
agctcaatcaacatgatcatcatcatcttgcctttagatttcccaatgtggcggtgctaggtagctatcttttttcgctcgctcttgtgatcagctagtggtaagtataaaatgtgtgtccttgtgtaaaggattacagaaaaagggagagggaaggtgtcatctttaggtaaag

SEQ ID NO: 1277 - DNA, 1332 bp, Zea mays
accctgtgtagccccatttcagtgctgtgcttgaactccctcctccctgctcgcttcctagcagtgcccggccccaccggatcaatcacgagtaacggcgaccagcagaccagacacagccgtgtccgtgtccgtgtccgtggacgcgtgccccactccggcccgggtctctcgcccactcccctgccgccggctcccgaaactaccccgggtcggccgccgacgccccggcaccaggcgaggggcagcgccgtaacctctctcgctcgctcgcccgccccccgcgtcgcgtgcgcgtgtgctcggctacccacgcggaccgcgtccgccgcggtcacagtgctggttgctggttgctacctcctcgacgacacaaacaactcggtttcttttactaatcctatccacaattccaaatcctctccctcgtcctgttgatcgctgaaccctgaccagacctggccgtgcggaggatttttagactagtcggattggtggtctccaccgtccatagcgatcccgtcacttcagatagtttaaactaaaaccaacactttatcttttatatcaaagaagaagcaaacgagtagaataatgctccgtctgcaagcacgagctgcacggcacgatgtgatcgcggcctgctgcttgccactgcgcccaatagtctcgtcctcacgcttctgggcttgtggttaaaggtcgcagggagggcgcatttacttagcgcttattaatcactctgccgtctccatctctagctctctgcacggttaaagaaacaaatgtcaaatagtgcgtcaagtttcattcatgaaaatacagcgagtatagtgctacaccatatagtagatccacacaaggagtcgtgagcagcggccatagcaagacctccaaacaaaaaaaaaagaaattttaaacaaaaaccggaaacattccgaaaccagaggaatatttgcgcccacaaaaataatactactccaaccgccatgattagccctgacgatgacagcttcggaccctttcttccccaaccttcccaaaccaataaactaatctcccctcactgatcgcgctatcccccacttatatacgtacccaccacgccaccctccccatcaccattcactcatccaccaccaccaacggcgccgcaacccccacgcaatctcaccggaaaaacgcctcctccagttgagctgagcctgagctgcagctgagccgccatgtgcccgcggacccactgagccaaaacccctcgaccccgcccccactgcaggccgttccctttccaagatccgcgctttgatccgtccgccgccgcccgagacc

SEQ ID NO: 1278 - DNA, 313 bp, Zea mays
aatggctttggctcatctaaagaagtggcttcacctcgtgagccagagccaaagccgtttttggagaagccaaagtcctgccaaagggctctaaggttagttcgaacgattaaccttaggcaaagtatgacatatatagccacgaaccaaactctcctcgccaaccgccatagctttatttctgccaaaccaatatctgatcatcgacccctccgatcccacaccagggcaccactctatccgttccaacttgatcccccatggcgccagaagcagcttcttcccaccgtggcgatgacacgcacatgatgac

SEQ ID NO: 1279 - DNA, 91 bp, Zea mays
accattctcctggacaggtcctgcgaataattataaatcaatgtacttggttgttggttgatcgtgagttgtgagttgtgaccggattgat

SEQ ID NO: 1280 - DNA, 856 bp, Zea mays
cttttggatgtcccttaaaataaaacatgttccttcataaatcgtcaggtactaattttaaaatatatttaaaatttctacttgcatgtgtcttctaaaatcttttttatagtgcaacagagaagctctaaacgacgattgtaaatatatttgtattgacgtttttcgtaaccaccaataaaaatagtattttttttagtgacaaaccattttatttcgtggacgtttgataaccaaaaccgtcggtaaaaattataccctaccatagacatagagctttttcaactagtggtgtttgcaatgaaagccgggttgttccaaaggtttgctaaatccctttgggattacgtcatttctagatcatcctagttcaaaatatattctcccaagagatatagcgtatgtgaagtgataaacaaccacgtatccataatctcatgcatggtctcatctagttcaggtcttccagattctcttattgcatttgatgaccgaggaatacttatttgaccaaagggctcagcagctagagttgcatatatatatcttgtacagtacaatatgttgcagtgcatgccactatatatatcttatatatctaagcatgcatcgaggcatcccattccggatctctcttcactttttcgaaggattgttccaaaattcttttgccagacaacgcctataaatagacaacacagtcgcactcccccataccacgccaaactcagcaagctccatcgatctgcatcaagctggctaattaactagctagcagcatttcagcttggcaaaagctatagctgctagtgcacacgtcgatcgatataataatcagcgatagctagctagcatc

SEQ ID NO: 1281 - DNA, 1500 bp, Zea mays
aatcattcgagtacaagtattaaccttgcggctatttatttaacggcaactactacacttggagttagagatgccgagagcatcaattatggagctgggggagattattggacggattaattaattatggtgggtggggattagtaagtgcggacgcgccgggaccggggctgggccctgcgcggctgctgggaaaccgcctggcaccagcaggcaggccgccgctggaaacggcaccacagctgtcgctgggcccaccacctcctccacttacgcgcctcctacggcaacgaccgtgcgctctctccctctcatgttaattcttccatttttttttctggttgaaagatttgttttctttttgcgaggacaaggctgaaaacgagtcgagcactcgtgcagcttggtggcttcggctcgtacattgcacgagttcaaaaataagggtcacttcgatccggcttgaagttggctcatcaggtggctcggtttaactcgtgagccgcactcttataaattttattatattataaaaataattataaatatataaatgtgtaatataaaatcattattcaatattatgaataatctaaattataaaatgccataaatatataattaaaagctaagaaacgactttgttattcttagaattatctaatatctattattattttgtaaattcattaatttggcatagctctggagtctgaataactttgctcgctcattcgacgacctcgaaaaacaggttcggctttgctacaaattttggcgcgaagttacgactaattacagtactgccaccactgtagttttttttatgataaatacaaaacagtaaaagagccgacacatgttacaacttaaccattattagttcggatatttaccgcaggaaggtttaaatataaatgctgatactgctgctgactattaaatacgtttaaatcaatatagcccgcagacgatattttgattttcccacgagatggactgaagttggcacggccgctcgaaagtagcctcaccgctcaccgtgccgaataatcgggccggccaccatgctgatcacaccgatgagtcacccggccgcgtgcgggccccgctcaacaaaggcgggcggcgccagaaaggggcccaccgcgaacccgcgtcgggcacggcatccgcggccgccgtcccttcgtatccgacggctcccctccccgccacgcacagcccaaaaaatctccccatttaaaattcagtacgaccaggtaaattcggtttccttttcttcaccatcatttgaaacacaaaaataaaaataaaaataatgaaacgaattctggccacgcacgcaacgcaatcgcttaataatccgctccaccgcaacccttccgtctcgtatttgctttgcttcctcttctctccctcctccgcgcccgcctcctctcccctaacgcttagggttagccaggcagcgacctccctcgcgaatcctccatagccgcc

SEQ ID NO: 1282 - DNA, 98 bp, Zea mays
ggtgattgctgcgctcgtttgcaagtgggggttttcggttcctctggctctaactttgttttgttgtcttgttgggtctgctgtggtgaagctggtgg

SEQ ID NO: 1283 - DNA, 778 bp, Zea mays
gagtactcaaagtgtaacttcctccgttcgaatttataattcgttcgattttttttacggcaagtttgatcggctcgtaaaaatcataactattattaattatattgtttagtatataatatactttaagtataagtttgacttttttgttttttttaaaaaaattgaataaaataagtcggtcaaacttgcttggtaaaaaaaatgtcaaacgaattataaattggaacagagagagtatattttaacttgcagcatattcagcgttgaagtttgcgtgtggatggataatggattggtctatgaatcttcacgcttattcttatataatattcatgagacaactctgattctgccgtctctgttttccatcacggataagggtacgccgtgcgaacagaccaaccgggaaggccacgagtaactaccaacgtaccatttccatcgaaactagttgtatgtaatgacttaatgttcaccgcagtcgtttcgagagaagaagagagaaataaacaatgcagatgctactcttcagcgccacaaaggctgaacatagccaagaaactatggcgacgcaacgcaacgaagcaggggggaaaacgatccaggccgccatgggaggcagcttcctgcaacctcgaagaaagaaaaaatcaaacacgcgagagggagcagccagccagccagccagcagcagcagcctataaatcgaggccagcgctgttcctcgtgacaatcatccccatcaacaacacagatcgatttcgatctaaaggca

SEQ ID NO: 1284 - DNA, 121 bp, Zea mays
ggtattatataatctgtggttccaatgtgcgctaagacattagatggatttgtttaatttctgacgtctttttacaataaagtggggtggcatttcttctgaggaacatgatgaagctgtt

SEQ ID NO: 1285 - DNA, 704 bp, Zea mays
tcgtgtcgtcctcttcctccggccggtggtggcgctcgcctccgatctgatctcggctagggttcgcgccttggcgcacgacgcacggaggtagagactggtggtggtggaaacaagaggttgagaaaacatattgggagcggtgggctatgctggcccaatattagcagcccacttgtatatgtaggcttttggctatactttcttgggcctaaaacctctggctagcctgctttcaaataagattgcagcgacataaaataaagatgcattgtaccaattactactctacaagtggaggctacacttaactgtaattctgctatcgttctcccgtgaggccgtgattactgacggctggttttgttactctattagggcctgttcggttgtaccggaatgagccaggattcattccagttcatcaaaatctatataaattagagaagtaatccggctaggaattaatccgggactctaatccggaacaatggaacagagcctcacgaaaatgagtcccagcccttagagagcggtgacaaatttccggaaacgccaaaatccattctcagtttttttagaaaccactctcatcctctcgcaccgcaccgttcgcttcctttcgtcaactccactcctcttggccgccgcattacctcctcttcgccgctgccgccaccgctccaccgggcagccagccagcc

SEQ ID NO: 1286 - DNA, 122 bp, Zea mays
cccccacggcaacacaatcgcaccccaccacggccctctccgccgcatactcaaaccctagtccgaacctgacgctgattgacgggaggggagaagcgtccggcgaccacgctcggcgcccg

SEQ ID NO: 1287 - DNA, 293 bp, Zea mays
gctgtcgcaacgcaaagttataattgcatattagttattgccatcgacacttttttttccgtcacttcgcgccctctaaaattgactttgttattaggaattgctttaaagacaagcttatcctccctaagtcgtccctcgataaacataaacataaactgtacagtctatataaacccgtcaccctcctcatagacccagccgcgtcgcgccgcacaagaggtgagggcacgcgcacggcgcataagagctgggggttgccaagtgttcatccacaaccacaaacatcacga

SEQ ID NO: 1288 - DNA, 82 bp, Zea mays
aacgcaacgcaacttgccaggcaaaaccatactatacatttatactcaactaaagaggtgtgagaaataatacagtacatgc

SEQ ID NO: 1289 - DNA, 383 bp, Zea mays
cagcgccttgccttcttcacttcaccctagctaccagcctgtctgccttttccatcgtcttcctctcccctccacacaaacacagacacagttgcgtcgtcgcccggccgctgtgcgtgcgtgcgtgcgtgctgtgctgcctttctttctcgctttaatttctttccatccatccgctttccccccctcccaatcccaatccctccaaaaatccgctccgcgcgcgcaagcgcggccggcctttatcgatccctcccggcctctagcgctgctccggcggcggagtccggccccaggaaacaaaggccgcgcgcgccgaccggaccgaccggggggccgtccagttccagttccagttccaggccgcacaagcacatgagatc

SEQ ID NO: 1290 - DNA, 765 bp, Zea mays
atccgtgactcgtgtctaaggatttttaattggattgtttctccaacaatttatccaagacagagtaattcaatgttcggttaacagataaaaattttcggatttcaaattaatcaaaacatcttctttaataatgtagttgatagtgttttaatttggtaaatttttgtatctccactaaaactttaacactcatagtatggttataattagaattttgttttctttaaaaagaatggaagaaaagtccattttttaatctccccaccattgtttctttttccactcttatcttgtgacgtagccttatcttcagccaactctggtagctatccaccgcttggcctaatctttttgctcgatattcacctaggcaccgattctctcctccttggtgatcgtccctgctccccttggcaacagctgaaaccagtcgttcctatctccaactctagtgacttctataccgtacgcctgtgagcagtttgtgctgtcttcttcaagctttgaccaccggtcagcccctgctctcagctgctcctcaccctctgttcgttgtctccaacgccccagtctagctcgcccctgtgctcacccagctcacgtctaactcccctgttgccgacgaccgtgtgctctgctcgccggatccgaggtcgtcctcgtctcttccccatctccggtcgccatgccccatcttcggcgttggtctgcacctcacctcaaactgctctgctcggccagggcaccgtcctcgaccctgca

SEQ ID NO: 1291 - DNA, 1500 bp, Zea mays
atatttttcccgttttatctttgttttatgttcgtcccctcgccaccgtgcatgcatacgcgatgtctggatcgttcgttagcatccccatcctggtctgcgctcactgcagtagtatgtcgtgctttcggttgcgggacgctgcaacacatcagcagtcagaacactcgctcgtcgtccagcgtcgtgtcaccatccgggttgttggcatactactcctccgcgatccgctttttcaccctcttgctcgtgctcgcatccgcatccgccgaccacacacacatgcacgctaaaacccgtgcgaaacgcaaaaataattttaatctaatcccacgagctaactaacggttaatgaagctcagtcatagtagtttctgcgaagaggactcaggtgcgcgtgcgcatgctgtcgcggcgtcaccgccacgtcagagcctcgcctcgccgccggtgtgggcggctgcatgcacgcaccaggcaccaccgcaccaccagcacctggtacctcctctctgattgtgctggtcctagctcaccgcactagttaacaggcgttgcttaactttgataaacaagatataagatgagcacgctgctgatgacgacgatgagccagaagccagcagctagcagttgcaggcgttgcgtagagaccagaccagactcgagagcccggccggccctgctgaattcctgggacgcaaacgcaatggctaagaggcaaacgcagtcccagacttctcgcgatgcccaatgcatgccatgccatccatggatccgcgcgcgcctgtcttttcgccagaaagatggcgcggaacgcacaaccgaaagcccccgccccccggccactttcctttcttatgccaacaagcaaaataaaagcacccatcaactcacagcacgcaattcatcactatcgatacatgtgtatctgtattttcagcggcgtacggtatctctatctatagttacgcattgccttggacaccagcatttttttttaaaaaaaaatatttatatgtattgtttttttttttacatgcatatgtcatgtgtgtgtgtgagtgagagagatagagagagtgattgagggcattgtgggagcatgcgcagcatgaataatgaactgcaagtgcaagctcgatctccactagatcgaagcagcgcaacacgcatccagaatgcacattccaccagtttctttctttctttctttgcactgcactgctgctcgcctttatttaatttctcccctgcatcgacctaatattgttatcccctggctggctgggctaggctagcctagcaggtacgtaggctgccctcgcagcaccacgcacaggcgcactagctctctctcttagcgagcggcaaaccactcttcttcctcctccatatccatctccacctatataagccgcgcgccaggcagggttgcttccgccaccactcctacataccggtccctgtccctgtcgacccctcgaggcggatcccacg

SEQ ID NO: 1292 - DNA, 1497 bp, Zea mays
ctcgggtatcgaaccgattttttagttgtgaatgcacctaatgttaattattcatttatttgagttcacacccaaactggaggaaatagaatcgtctctctcttccgacagcctgttcctgaaaggaaatcagatcacaccagctggagtacagcctgttcattcaaagacaagatctccgaagataaaataaaaacaccaaacaggaatgtaaataaacagaaaaagagaggcaaacacgggcctaggccctggatagcccaggagcggcccacgcgagggagaaaccctaccgttcggggtggtggcatccgggattcgtccacacccaggcacataaaagccgcctctcgccgccgactgcaaaccctcgtttttctctctcctgcgctgcgccgtccttcacctccgccgccgaatccgagactctgatctcgggttcaccgcagcgcacagagcacccccgactcccggcccgatccgcgctctcctctccgacgcttcaggtgttcgcctcctccagatctcttgctgtctcgcttgttacttttttgtttgcttttcggcgtccgatctggtgcgacggcgggtctgggtccatctggcggtgctacccgtgcggatctgcgccgattcggtgggaatattagtgattttgacggttctggattgacgcacgggtttgcgcacggaaatactacctttcccccctttctctgacatgcggctttcagctcaatacatgatttttcttacgtaggatttgattgattttgtatgtagatataagcgttttccggtgctaatatgcaaaattgctagttttggtcatataaaactgtcctgggaagctccgtagcttgtgtaccgtgcttgagtattggattcaagctgtttgagctgtgggatgctgcatgcttgatggtaatgaattattctattgtggtaagtcaatttttttgtgaaagtgactatgagatggtcgcaagggtttgctacaggataaggttaaaagactgccctgccctatgtactagacgagccattcataccgtgcgaactgctaaaagctgttgctcgatttatcgagtacttgcaattatatcagcctgctgttaagaaagtgtaaagcatcaattgtcttggtatggttctgtttagattctttataaactgaagattgagttgagcatgcattttgtataaattgtagagcttgaataatcattttaagagtacaactgattccctattgattctgttgtgaattacttgtcttctagcatggtgtttgtcttaaacatttctttgctacacacttttctcgttgtaatctgtaggacagtttgttctaagcttaaactgtgccattgctcattatattgtatacatccttttgatctaggttcatgattaaacctttctttgtatttgtttgtcatattgtcaacatgtgctgtaacttctgtgtattaacatgtttcttttgctgcagtc

SEQ ID NO: 1293 - DNA, 1500 bp, Zea mays
tgtttaatctccgggtatccgggtaggtgggttctggcgggttgggacgagctcgggccagcaaatggttgctgcgaaatactacaaaaaagggagaagagacgaagaaaagctcgatgattaattggcggcgaagccagtacattaaacacttcgtcaaccccaaccgtagtagtgctcaaggggagacggaggaggaggaggaagcggtataaagccgcggcgtcgttcgtcggcagccgcgtcctgagtcgctcgcagtcgcagccgacgccttttcctcctccttgtcttcttcctcgctgcagctctcgccgccgaggtcctgggcgccgtcgacaaaccacctccctcccccgtctctcgtcgtctcggaaggaacggccgcccgtcgcgccaaggattcaaggtgcgtgcaccgcgcttcttgcagagagaaggtgcgctggtataagtatgctgattctctgctactgcctgttacgatttctgccatgttctctcgtttcctcccagctgtgccagtgcctgtgttcgccggtttggggggacagatcaccatgtcttgtcacacaactttgtaatctcgtagtgatggttcgtggtgctcattgtgtgtcggtagggaagatttaatttcacgatgccgcagacaagatcatccaggaaggcccaggacagatctgcaatgagcaacgcccactgttcattccttccgttcctttcctatccccactgttgagaccatgtcgtcacttcatcatctcatcatggatccagcctgtaaccatttcgcccttaaaaaaagatactactaggggttgattaataatagatagatgcacacagacaaaaatagaaaaagtcagctgttgcagtggcgtggttcgttttgcggtgggaggggaagggaggggacatataaggacaagtgcgtttccagcagcatacggcgcccggatacggatagagctatagatggatcacgcattcaggccctgatgcgagcgctccccccgccatttccttcaacttctgctaaatagcctaatacccccatcggccgatcggctcctctacctgcatttgccgattggcgtcttcctcgtcaacgaccagatccatcccctctccacccggggacggggggtctagaacgtcgtcaggtcgtccttatccgcgtgctggccttcggatttcggctgccgcgttggtttaacacaaaccacgcgtccatgcctgccgcttccgcaggctccatgccactgccacctgggtgggttttctttccgggggcacatcacacatggcgtccgtccgcgtaggcacagaaggcttctcctggagttcagtggctattccctactaactgctaactggcagcagcttctggatcgggccatcggggtcggtggatctcactgttttcttttcctgctgcttgctgcatttttcgcagggtgtgggagctgagttgggaggaggactgctgctgcagcc

SEQ ID NO: 1294 - DNA, 1055 bp, Zea mays
ggtgttgtcctcgaggctggacgatccggtggtgctgcagcttggtgacgatgtccacctcccggaggaagtccttggacagttggacgcctccgccgacgccctagacagcttgatcgccatctgctgtccgcaggggtgacgacgacgacagacagatcgtgtgagctgaaacatgagaggcgcgagatcggcgatcaggaaaggaacaaggacccacccataaaacccgctagctaagtatacgtaggtcgctacgatttctatttatgcttacgtttagaatataaaacaaagatacgtgtgttttattggctaattagacgtaaatatgagtttagagtcaacaactatggttgaaattctatttatacataattttagcattttttactatttaaattagggacacaacgacgatggaaactgctgaatcagaaaatttatagcgtgttttgtttgatgaatgagctagtccatcatcttctcactcctcacttttttgtttggtttgtggaatggaatgggttaatccatcaccacctcattcctaatagttagttagttaatactaatatgaggaatgaggtcatcccacaaaatttaaggaatggacccatgatgcaccacctcattttggatggagtaattcctcaaatcaaacaccatattaatgttttaatatagtacagatagagatagagattataacccaatccattagcagttccatggtgcgaaaaaaaggacattccactagatgcatccaaattcgaaggaggcctaagcagactaatgcagtccattaaagcaaagccatgagtccacgatgggccaattaagtatccatgagaccatgacgggtcgaactgccgtttcgcacacgtcgttgacaacatgcagaccggaatagatggccaacaataggtccgtcgactgcattaggcgtcaagcacattcgtcgaatgcaattgcaacgacaaagctttgttccactctctcctactactcctgctgggtctgttatctatcttcgtcaggggcgaggatccctg

SEQ ID NO: 1295 - DNA, 834 bp, Zea mays
tacccctgtcctacaagcaatttttctgttggttttagtgatgatcactacagtaaatcgatgtatatatgtcgtcagaaacattcagcatcatcggaaatatactcgtttcgattagtttatagtagcgagtgaatttggaaaattctattttcaagtgccatgcatggaaaaaccattattgtgctcataaacctcaacattagtgaggtcaagttcggagactaaccaaatcattcggcgagcacatgggatggtattctgttgatgcatatataactataatccctcaattataatgggcggcctcggataatctacgaggtgtttaattggactgtagagctggattaggccaggtccatgtcatgttacgttcaaggacgcggccatgcatgcacgaactaactgtcctttcccaccacgccgtctatatgttctcttcatttgttttgtcgtcttgacctgttcgctcgtcgctgttgtcaatgccttaaaccatggcgtgcatttcattatggagggatgattatgtcgagagggaagttagaacatgcatgtgtgagaacaagcacagcttgtcaaacaacaacaacctacaacgtacgtactcagcagctacatgtatccggcgccgtacctctataaatacggggggcgggagacgcaatggacatgcccacccaacattaattgcatcatcacttgataattaagtacgagtacaacatagctagatacttgttgcctctgccatacgatagagcgcgctttgtgtcaccaatggcgggtcgatccatggcgactcggtgttgcgcagctctgttgctgcca

SEQ ID NO: 1296 - DNA, 160 bp, Zea mays
accgggcgtggacctggttcgttctttacttctattacagtactatagatatctgtaatttcggtactgctattttattgttaataagaaagttctgttttctttatatactgtaaatatgtttatcgcatgatatacattcacatgacaacgcttgcaa

SEQ ID NO: 1297 - DNA, 783 bp, Zea mays
tacccctgtcctacaagcaatttttctgttggttttagtgatgatcactacagtaaatcgatgtatatatgtcgtcagaaacattcagcatcatcggaaatatactcgtttcgattagtttatagtagcgagtgaatttggaaaattctattttcaagtgccatgcatggaaaaaccattattgtgctcataaacctcaacattagtgaggtcaagttcggagactaaccaaatcattcggcgagcacatgggatggtattctgttgatgcatatataactataatccctcaattataatgggcggcctcggataatctacgaggtgtttaattggactgtagagctggattaggccaggtccatgtcatgttacgttcaaggacgcggccatgcatgcacgaactaactgtcctttcccaccacgccgtctatatgttctcttcatttgttttgtcgtcttgacctgttcgctcgtcgctgttgtcaatgccttaaaccatggcgtgcatttcattatggagggatgattatgtcgagagggaagttagaacatgcatgtgtgagaacaagcacagcttgtcaaacaacaacaacctacaacgtacgtactcagcagctacatgtatccggcgccgtacctctataaatacggggggcgggagacgcaatggacatgcccacccaacattaattgcatcatcacttgataattaagtacgagtacaacatagctagatacttgttgcctctgccatacgatagagcgcgctttgtgtcacca

SEQ ID NO: 1298 - DNA, 447 bp, Zea mays
ggcacactcggtaaagagcttttttgtcgagtgtctaaaaaacacactcgacaaaacatttgacacttggtaaagagccaaattccgatagtgacaccttctcctttagaaaatagtaaatatagctgccaagaattaagccgttattttctaaaatagtacacggcaggtctggaatgccgaagcctctccattcctcccatgatttgctccagagccatgtgactcctaccaaaagcacgtcgggtggtgcaacgttaacggccgttgatggcgatcgcggctcacgcactatgcgttccttggcttcatttcctgcctataaataccacggcaaggttgctcttcttggaccatcgacacacagatcgaacttctcctgtcgtctgcctaccagtagctagctctaatacatagcagccctcgctcgcaaggtactgcactacg

SEQ ID NO: 1299 - DNA, 1500 bp, Zea mays
tgagagctttgactagctagaagcttttactactccgtagaggaactagaagagaacattcctctggctttgctgctagctgtcctcttttctgcatgcgtcgaccagcggatcggaggcggagagctagtcgtggtgactgtcttttattagtatcctttttcccaagactgcgtgcagtgcatgcatgtccgtcaatcgaaattgaatcaggagaccgtctcggccatccatctgatgagaggatggaataatcaaacttgagacctcgctcccacacagaatggggctatctttatggagcttttatttggtatgattcggtttttttttgtgcagagaaaaggcatgattaaatagttatcaatgataacatccacaaatggtcgcccccttctcacagagcaaaatttccacgggaactttgtaaaaaatttacaaggaacgattttcagggccggggatgcggagggtgcggccgcaccgggccccaaaaatataggcccccctagccactggacaatagcatttttttgttaaacctattgtcgggaacataattaggggtacccccaagactcctaatctcagctggtaacccccatcagcacaaagctgcaaaggcctgatgggcgcaattaaggtcaaggctcagtccactcaagggacacgatctcgcctcacccgagcccagcctcaggcaaagacagccgaccccagaggattcacgtctcgcccgaggggcccctcaagcaacgaacacaccttcggctcgcccgaggcccagtcttcacagagaagcaaccttggtcagatcgccacgccaaccgaccgtatcgcaggagcatttaatgcaaggatcgcctgacatcttatcctgacgcgcgctccagtcgacagagccgaagtgaccgcagtcacttcgccgctccactgaccgatctgacaggaatacagcgtcgcctgccctgctccgactgtcgtgccactcgccagagcgaggtcgacagcagctaagtccagcctcgggcgacataggaagctccgcctcgctcgaccccagggctcggccccagtctcggctccggaagatgacgaactccgcctcgcccgaccctagggctcggactcggcctcggctctggaagacgacgaactgcgcctcgcccgaccccagggctcggactcggcctcggctccggaagacgacgaactccgcctcgcccgaccctagggattggactcggcctctgctccgaagacgacgaactccgcctcgcccgaccccagggctcggactcgacctcgacctcggaagacagactcgacctcgacctcagaggagcctctgcctcgcccgacccagggctcggaccgaccacgtcacaggaggggccatcattaccctacccctagctagctctggctacggggaacaagaccggcgtcccatctggctcgccccggtaaaacaaataatgatggcgccccgcgtgctcc

SEQ ID NO: 1300 - DNA, 994 bp, Zea mays
cacccttgtgagaagatttgaaatcttgggctcccggtaaatgccaaattttcatgtggttagttgtctgagacaggcgctccacagccaatcagccgcaagaagaggcctcccacacccgacctgttgtcccctttgcgatcaagaggaagaagatatcaatcacctgctatcaacattcatctttgcccgcgaaatctggtccttcctcctgcatagagtggcttgcaagtgcttccccccagtctgatgagactacctttgatgcctggtgagaaagaaattggttgttcacttaagaaagggactcaactccatcgtcatttttgggagcatggattttatggaattctggaatattcataatcggtgtgtgttttatgctgattctccaaacctagatagagctctattgtttgctagtgaagagcttattttttggggtttggcaagggcacaaggaatccattacctccatccttgggccaagtgggagttaattttaggttgaggacatctactttgtgtgacaaggcacatctatttaatttgaacacaatggtgtgaatgggtagtgggtgtcttgtataggtccctttcccattttttcttcttaatttaatgatgtgcagttctcctgcatgtacaataacaacagcaaagccttttagtcccaagcaagttggggtagttctcctgcatgttcgagaaaaaaaaagataaaccacccctgtattagtttatactggataaatgattatcagttatgttttcccaggtatggtttcagcaaagaaattgtggagtgcccaggtgagctctggtgccctccacatctttctaaaatcattttagacatctatatatatcttcaaatttgatgtacctcatttcagtatactttacataacatcattgtaggatattggccgttcaatgctcatgcttgtggcttttggtttctacctatggattggcaattttcttgtgacaa

SEQ ID NO: 1301 - DNA, 1500 bp, Zea mays
gctgtccgctgccaccgggcggtagttcgcctccgggttggccgcgagccgggaaagcgaccgcccctcctcttctcctccctttctctcgtctcgtcggctcctagctcctcctcctcgctcgccaagggagacgcacccggtccattcgtcctctcctcctatcgcctccccctctcctccccggagatccccgctaccgaaggattatcccgtgcagaggtgagttccgcgccgggctcggctcgctctcgctctcttcgccttacttctctcctgagctccacctcaaccccgtgctcgctacgcttcctcgagctccgttcccttcgctctggtttcgcgtggggggctacgctagcgcgggtctacgggtctagatggagtaaattttcattcattctgggcatgtcgcgttgcttttggcggttctggcggcggtgaaaaaagctttcttttttcctttctgggggctcgtgaaggtgaaacgcttatctactactgtctgccccgtgccccgccgacgctgaggcccgacctcagttccaaaatccgtactcggctcggcgtgcctgtccttcggaggattggagtccactgtgctggcggctggcctcgtgcgtcgcttcctggttcgtggctgcgtgtgattgggactggatccaggcagcgagcctctcgtggatttggtaggtgcgctatgcgagagtgggacgcttggtgaatgctgatgcgatagtagctcgtcgcgtgatccattgccagcatgccaaatttgaaactctgttcttggcttttccgggaagttctgaggtttcagtggctcggccggagaatcagtgcgcgattcttgccttgctccatttgtggaatctgttgtttgcttttgcctcatcccagtcctcccctccctccgatgtggctgtttcgaccagaatacaagttgcttctgtctggaggcgctaaagagcgcgtcttgactagagtcagcctattgaaatttgcaattttgctcggtttgatctgttcaaaccaatcactatgccaattttgatgtcctgtgtccgttgcgtgcgtccagaggtgttcgacttgtctgtttggtcaagccccccgaggttctcggtgttgttttttcgcctgtttcgtgccctcctgttgtcaactcacttggatccatttgttctagatgaaattcatcttgatccagtgatatttgtgcattcttgctctagtaaatccagatgatgctgtcggtttgacctcctatgcttttcagtcattaatctgtcagcctttgaccagtttcttgcagtaaaatcccatctgtcttttacttggttgcctcgtttcctattgtggtgtgcgatgttttccctctctctctctctctcattcgcactgtgacagataacatttcggttcaagacaagcagacgtctcatttgtccaacgcttggttctcaggcccactagtatatcagcttggagttgaggaga

SEQ ID NO: 1302 - DNA, 249 bp, Zea mays
agtccagccgagccgcaaccaaaaagcaaagcaacgcccaacaggacagggagaaaagctcgcaggagtgacctccctctgtgtctctccgctcggcgctcggaccaccgcggaacggcggaaccctccgatagaatcatagaaccaaaccctcctcctcgcaccgcgccgctgcagctgaccaccctacttgaccggccggggagagagatagagataaagacatagacaaacagacggcgggcaggc

SEQ ID NO: 1303 - DNA, 608 bp, Zea mays
tttcgcttcggcttggggtcgggtagttgcgggcgccgcgtcggccaccacctggaggaggaggacagacagacagcgcacgggtgcctcatgcatgcttcccttcttgagagagaggaaaaaaacgtgatcgtcctttgttctagccccaccacctacacaacactacacttgccctggtcctgtggtcctcgcgacgacgatgcaacggggatggaaacacacgacgtgatggcagacggctggctgttgttgagttcgtcaggaccagcagctgtggtcaccgaatctcgagggaccattcacggccaccgcacccacccatctcagacagacgcagagagagagagagggggagagcagcggccagcggggtaaaccaaaaaaaaggagggctttctggttccttgcccgaaatggcatgagccgttggtaaacccgggggcgagcacgccgatttcgcccggggggagaagatccgcctgagtgcccagaacgggcacttcttccacgcccaaaaagctcgaggacgatgcaatgctgactgtgtgtggctgtggctgcaggaggccgtggagtgggagcacaggagccgggtccccgggaag

SEQ ID NO: 1304 - DNA, 70 bp, Zea mays
gcatccttacaactctagctagtaaygaacaaactccataaggatctatgctcctgttagttgatgagaa

SEQ ID NO: 1305 - DNA, 132 bp, Zea mays
ggtaaacccaactcccttcctctctccccaccatttcgcccctaatctgaactacacgccgcgtgtccagaggagccgctgctggtgcgcgcggcgcggggcgaggacggcctcccacgcccacccgcgtgg

SEQ ID NO: 1306 - DNA, 166 bp, Zea mays
tctgttgaattcaactctgctctagctagcagtgcagctccatcttctatattatactcaaggcaaggaattaggagcagaccggagacttgggggcttcacctgctgtatctcattaccatctgcatctggttgcccgttgattgagaaggaggagctgagggcc

SEQ ID NO: 1307 - DNA, 334 bp, Zea mays
tattgtttagcagtacatgtgtgttatgtgaacgtaataaatacactgccctctacaaaattcctcactgggttacattacgtgttggatgtgttgataggcaaatgccactttttacctctcgcataacctggttggggtcagtctgagaatcagtgaacgcagaacaatcgcgtcgttgtcgtccagtttacacgtaacccctcgcgcttattcagaattctgaaattccaagcccgatctcctctcctcttccccgaatctcgggcgccgccgtaaccctagcccccgcgatccgctcgccggagggaaggagggatctccgcaggcgccc

SEQ ID NO: 1308 - DNA, 129 bp, Zea mays
ttgcgaaacatcttagactaaaaaaaagaggatagaccctcgaggttagcatcaagtagagcaagctcggttatccctaaaaaccaaccaaaagagcaatctaaccagtcacctttgaggttgagtgcg

SEQ ID NO: 1309 - DNA, 498 bp, Zea mays
tttttttaacaccctggaaactttctagaggggtgctttgtggtataataacttttgtttaagtttaggaagaagctgtgaaattatgtgcgcacctaaaaatcagaaggagaggagccagtaacgaacgattcggggaagagatgggccgcgtcgaagcggagccttaccatcgccagacaagagggccgctgtcctctttgtagacgcttccgcttcggctgcttgaatcgtcggctacgaggttgggctgagccgtcccagcgccgggtccgtcaagcccacgcagtatcatcacccacgcgcgtaggccgtcgggccgggcctctccgcgttcctcgtttcgctagcataagcaacccgtctggaccctcacccgccgcaacgccgaggagacgagaggaggggaggcgcgccagcggaagcggaaacctcgggtgtcgtcgaccaacctcgtcgatccggttgcgacgcggtgtgctagaataactaccgacc

SEQ ID NO: 1310 - DNA, 385 bp, Zea mays
cttcatgctcttcctgctactaattctagaagcctctagcgagtgctaacattcagtttaacccggcctccactcctctcctctggcccgtggcctgggtcagtgtccatccctccctgtccctgcccaccacttcgtctgctctccatccctcatccgtccccatgccgcgcccgccgccgcctacttcttctccacttttttgactgtttttcctgccatcctagctatgggctccgccgaggcggatggaagcgcattgccggacgcggagcagcagtagcagcggcggccaagcaagcgggggatctggatccgaggttctaccatcgggctcctcacggcggcggcggcggagaaggaggcggagcgcagcaagacgcag

SEQ ID NO: 1311 - DNA, 1288 bp, Zea mays
gatcgcaataaagttcagtaggggtatacccctcctgtttgcttcaaaccgcgcctgactctgtctgtcagtccatctccacgcgcctcaggtgacgctgggccaagtcgtggaaatggctaacgggccaggaagcctagtgcgcttgtatctgggctggactgggccaactgaaccggctctttgtcgtctccacctacgcgcgcgtggatacaagcagagccacggctctttgtatcggtactagcttgtacatgttgagaattacgttatcacggatcaccagatccgctctcttccctcccgtcagtagattaggcgcgagaagttgtagaacacccgttccctttcccagaagcacgacagagaacacacatgacacagggtatagggttaggcctctggcctctttctcttctatgtattatgagggatgtacatgttccttatatagagatgtgagactcctcaggggcaaagcaggtatttgcccacataaccctaactagggttacttaacactcccccttgggcgaataccgcgaccaacacatgcctcgttaaaactccgaaaacccagtaggaaaaatgtgaagaaagagtgcatggtgatacaaattgcatttgtacttttgtcggcgtttcgagaccggggggtccctaagccgacgagtgaagtgtcgccgcgtgccccatcccagatgggtcgacgcgaggccgagcgcgaagggggggaagtgaggtggccggagatgggcgtgagagaggtggaaatcccgcggccttcgtgttcgtcccgcgcccaggtcgggtgcgcttgcagtagggggttacaagcgtccacacgggggagggagcgagcggcctcacgcgagcgcccgtctcgtccttgtccccgtgcggccaaccctctctaagagggccctggtccttccttttataggcgcaaggagaggattcaggtgtacaatggggggtgtagcagagtgctacgtgtctagcggaggagagctagcgccctaagtacacgccatcgtggcggccggagagattttggcgcccggtttgtgtgatgtcgtggccgtcggaggagcgctggagcttggcggagggacagctgtcggggccgtcgagtccttgctgacgtcctcttgcttccgtaagggggccgagagccgccatcgtcagggagcgtgcggggcgccatcatcgcctatctggcggagcgagccagatgggacgccggtcttgttccccgtagcctgagtcagcttggagtagggtaatg

SEQ ID NO: 1312 - DNA, 1500 bp, Zea mays
cttcatcagtaatgttgtcaattttaaagaggtaatatccacttcttccacagccccaatagtagatcccaattcacaaattgtgggggatagatatcccccgggtccactaaagaaataaaagatctcccgaaaggcccaagggcccaataaatcgtaagatcgttctttcgtgggcctggggaaagacgatcaacaaagcggagaagacgtaaggctggattggagcaaacccggacggcccacaacgtcgaacaagtaaatcccaacggagacccgactttcccgcgctgaagccccccatgcaatggagccatgcgaggataagtcggcgagggttacgtagggataaactcaagagattcactacctttcagctacttgttgttatcatatccatgtgtactgccccacggtcgagtatataaggcctagggggcaccccttcagaaggatcgaccctatttttgaccaagccacttacgtaaactctctgtgccttcaatccagagagccttcttgtaaccacactcgaatactcacgaggacgtagggtgttacgcatctctaagcggcccgaacctgcaaatcttgtccactgtccctcgtgcaatcaggcacgaaccattttgctacagtcgttgacaccgtcctactcctaaaaacaccttgaggggtaaccccgggtgtgcggtcggacccaaaacaccgacagccacaacgtggagtaggcaagcgttggtcttggccgaaccacgggataaccaccgtgccatctctgtgattgatttcttgtggttattgtgttttgactcctctctagccacttggcaattattgtgctaacgattaaccaagttttgtggcttaagttttcaagtttcacaggatcacctattcaccccccccctctaggtgctctcaccattgcattcaatacaacagctctagacttcactccaagacacaaacaaaagatcaaatcctctcccaagtccaagatcactccaaacaattagtgactagtgagggagagatatttgtgttcatttgagttcttgtcgcttggatcgcttttcttcttccccattcttgttctcaacacctttgtaatcaaagcaagagacaccaagttgtggttgtccttgtggggtctaagtgacccaattgattgaggagaaaagctcactcgatctaggtgactgtttgagagagggaaagggttgaaagagacccggtctttgtgaccacctcaatagggagtaggtttacaagaaccgaacctcggtaaaacaaatcaccgtgtcatccgctttcatttgcttgtgatttgttttcgccctctctttcggactcaattttatttctaatgctaaccccggcttgtagtgtgtgcttaaagtttataattttcagatttgcctatttcacccccccctctaggcgactttcaattggtatcagagctggtgcttcattagagcctaaccgctcgaagtg

SEQ ID NO: 1313 - DNA, 693 bp, Zea mays
tctgtatttggatcggatgtattatgcctactagcttggtggtgctggtgcacatgttgtattggctccacccctggctgatgttgttagattagatcaactccgtgatgccaaaaccatgcatatatgggtttaaatatgatatctgatgcttttagatttatactaacaaagaagcaaatgcttcaatcatgcctagtttcatctatacttgccactattcagatattttgccagaagagacctgggtttcagattcaaattttcatgtcatctgttcagaacttgcaattctgtgattcctcagattagtgacctgtagtctggagccaccgtattcatctgtactgctatgtgcaaataaataaatgcttgctttcatctcctattttttttttttttttggaaaaccagcgggtgtgttgatatttccttgggacatgaaaatgcaagttttttttgtttgtaaaaggtacaagggttatagtagcactgtgttaattggactcatattttgattcccttgtaaaaactttgtttttttggatcaatatataaacgatatactcatctgacaggaatcccgttaagtttatttatgctcaccaatttaagggcagaacttacggacctcaagctcttggttactcctgatcttctctaggcgactaggcacaattgccctctggcaaa

SEQ ID NO: 1314 - DNA, 1500 bp, Zea mays
taagtatttttattggctcaattccaagcaacctttacacttacattatgcaaactagttcaattatgcacctctatatttgctttggtttgtgttggcatcaatcaccaaaaagggggagattgaaagggaattaggcttacacctagtccctaaataattttggtggttgaattgcccaacacaaataattggactaactagtttgcccaagtgtatagactatacaggtgtaaaaggttcacactcagccaataaaaagatcaagttttgattcaacaaaggagcaaagggtcaaccgaaggcacctctagtctggcgcaccggactgtccggtgtgccaccggacagtgtccggtgcaccaccggacatgtctggtgcaccagaggactccaactcgaactcgccaccttcgggaatttccagaggcactcgcgctataattcaccggacagtgtccggtgcaccaaggagaagcagcctcaggaactcgccagcttcgggaatctccaacggctagtccgctataattcaccggacatgtccggtgtgcaccggactgtccggtgcaactccggagcaacggctacctccgcgccaacggctccctgcggtgcattaaatgcgcgcgcagcgcgcgcagaaggcaggcgtgcccatactggcacaccggacaaggaacagtacatgtccggtgtgcaccggacatcctggcgggcccacaagtcagaagctccaacggtcagaatccaacggcagtgatgacgtggcgggggcaccggacatgtccggtgtgcaccggactgtccggtgtgcaccggactgtccggtgcgccatcgaacagacagtctcccaacaaccacttttggtggttgaggctataaataccccaaccacccccaccattcattgcatccaagttttccacttctcaactactacaagagctctagcattcaattctagacacaccaaagagatcaaatcctctccaattccacacaaagccctagtgactagtgagagagatttgcttgtgttctttcgagctcttgcgcttggattgctttctctctttgattctttcttgcgatcaatactcaattgtaaccaaggcaagagacaccaattgtgtggtggtccttgcggggaagttttgttcccggttgatttgagaagagaaagctcactcggtccgagggaccgtttgagagagggaaggggttgaaaaagacccggcctttgtggcctcctcaacggggagtaggtttgcgagaaccgaacctcggtaaaacaaatccttgtgtctcacttccttattcgcttgcgatttgtttttacgccctctctcggactcgattatatttctaacgctaacccggcttgtagttgtgattaactttgtaaatttcagtttcgccctattcaccccccctctaggcgactttcaattggtatcggagcccggtgcttcattagagcctaaccgctcgaagtg

SEQ ID NO: 1315 - DNA, 175 bp, Zea mays
ctcggtacccctggtggcgaatgtggcgcgcgcagcaaatagactctatgtcctagagctcgaggtcgcgcgcccggtttgtctcatggcgcagggcgacaacgcagcctggaggtggcatgcacggtttggccacctcaactttcgtggattgcgctgactagctgaggagaac

SEQ ID NO: 1316 - DNA, 972 bp, Zea mays
tcagaacaagtgacccaacaaaagcatatggctgtgaatactggatagaagcaaactgttcatgcttgtgccatatctaaagccgataaatacatttgaattgcctaaatccaattgaatttaagttaagatgttttctttttcctaaaataccgagttaaacagaaacatgaaaatacttaagaaaataaaaagttaactaatactgatttattacaaattgcgattggtgattgattttgagtcaaaatgacagcgaaggctaccacaaaatatcagagaagtaatccttcaaaggtaaaggaatacatgctgaactgctgatattagatataaaggcacataaacacaacagaagagatggaaggaatccgagggaggcactaagcataaagaacatgaatcaggatgagtaagtaatcaaataatgcatcacaaaggggaatcgcagaccgctgcccatcagatgcttaaccttccttctaaaacagaacttaaaccctaagattcaaacacagacagaagtccacagatcctcacaaccaaaaatacatgggaatcagagcgccaatctcaccatcttccgcgcccgcagcggagatcgcaagcccccactccggacttcacttgagcggcgacggcgtccgcggcgagctgtggcaggcaatgaggcaacagcgaatcgagcctttttcctttttttccgcgtgggtggaatggaacgcgagtccgcgacccgtttttgctctcgcctttccacccaaacggcccaacgtcccatctcagccgtccgatctgaaaactcttctccacgccgtccgattggaacatcctggtcgcttttccttcggtgagacacctccactttcgaacgcctttttactattttttttctgttcccatttccaccctcgcaccgcatccacctccacctccaccgcgccgccgcgagagaggggaggagggtttccg

SEQ ID NO: 1317 - DNA, 792 bp, Zea mays
catcctcagtctaaacatggtccgatgcataatccactcgaaattattttggatcgagtcgtgtttaggttgttttttttgtgctttgaactagcccactgtggtcaaatgtacacctttgtcccggagacgcctggcatagaggcttctctttgatcttccgccagctatgcaactgcaatgctggctggtcggggaaagcaacgtggcgagacgggagagaggctatttctgcgagcgctgaactgctcctgtagctagctgtacgataggcttgaacgaataaggaagagtagaacggaacaaaaagaagcggagaagagaacaaagaaacaaacctctcggaaacggtacgtcacgtcgccatattataaaaaactcctccgttcgtttcaaattaaattgcaacacctgacccgcctgcaaaaaaatcgtattgtggtgctgaagcaactactacttgcgcgctaaataatgccaccgctccgctgccgtccaatctcgccacctatctggatggatttgttttgtttttatttttgggcgaatcatgccccgtcgaagaggcaggatcagctcgggtcgcagtcgcgcggggcccgcggcccgatcgacgcccccacgaccatttccctcgatcgccgcctccacccgctccagtttgaaaaaccgctgtcctcatcgccttcctcaccgagaacccagccactctggtctctctctagtctgactctgctctgctctggggtctcgcgctcgcgactcctcgggcggcgcgcctcgccggtcgcc

SEQ ID NO: 1318 - DNA, 1036 bp, Zea mays
tcttcggaaacactaaaaaactgtttttaaaagccgaagcttcaaagctaaaaacttagcagatcacagtgcacaagagctaaaaaatgagtgagcaggagtggttggccagaaagcgtgcaaaataagtttgcggtatggccgtatttatacgcttgatgcgttgaaagttgaaagaccccacttgtcattgaatgttgctattctagcaaagggaaggtgttttttcggaccttcggcataaagccttcgttcatatcgcaatctgaatttattatttcaaacaaattaatattgcgaggggctactgttgggggccttcggcttccgaaggtcctcaaaaacatgatttaacagtgtttctagagtgtaatgtgtgaacaggtaccttcggacttatatcaaagagggagaacctcaaaagatacgaaggttggcagtgccgaagctgtgaagcaggaaagcttcggcatgttcgcagaaaagggaaccgacttaaagatgaaaaggccatttagacctcgatagattgctatggagttatcaccaaatgtaaagggcatgtatgtaattttgtatgggttgtatcccgtgcctataaataggtgaacagtacccccgtactgttcacgctgacttggcatttgcttttgcgtcacgcttgtactttttatcttctctcaggaccgaaggtacatttgtaatttgaaatcatttctatttttccatgttaataaaatagaaatgattctatgatgatgcttatattatatttcatgctttatatgaatccttcgtcattacttgttatgtttacgaaggtatgtctcttatgaccttcgtccgaaactcattatttcccgaagggacataatgcttcgaaggacgaaggactttaacacttaacactttttatgttgccttgttcttaactcttagcatttgagaacaagtccccaacattggcgcccacctccggtgaactcacttccatttcctgagcttttcgacaccttcggcaagcatcagcttcgtc

SEQ ID NO: 1319 - DNA, 1500 bp, Zea mays
gcatcttctaggggatgtagtaaaatatgatgaaggtacaaattggagaaaataggaagaatggttggaatcagtcttcagacggtacgatgcttaggggcacttcagcacttggagccttttttgaatctgcgcaagttgaatgaacagaccacttgaacagcgtcggcaagatgcagatgcaacgccggcaggtcatcagacagacggcgttgttttcctagccagagcaaaggcacaagaactacgggactaatggcggtgacgacaaccatacgccacacattttgtctttactgacgcgtcctagctttggtctcactcgactacacatttaattaactagtttgtttagatcttagcaacagcagtgacgacagccatacgccgcatttgtcttactgatgcctcgtagccatgtctcactacgtgctcacgtgcatatatatagatagattaaccagctgtgtccagtttgttagtgtttgcaccctagtgctaaacaaaagcactagcctgtccgtgggcgcggcgtgggcaaatgcagctcaagttacgcagtaaacaccgccaccggggaagttattacaggactgcttatttttgactgcttgatacctgatacttttgatcagtggggcagtggctggccgagtttaccgactgcaggaagaatgtggcgtctgcctgactttgcacccacagctgtagaactagaatagcagttcagatctagaactagaatagcaggacggtccatggtggcatagaaaatggacgttaaatgtttggattggaggaagattaatagtagattgatcacatcacatatatatggaggtgactattggactgtccgatccatctataaaagggggcccttatttcatcggttgcacttcttctctctggcgcttctatctctgccacagtgagtagagaaagcaggcgtgcagctaaccagcccagcagccactatccaccattcctcaaggaacacaccatttcatcgacactgacgaacgcatcacgtcattatgctttgtagcacacacatcggtccagctagcgactttcggagcaagacgataactgtggggtgtcggcccaacatgatccatatacgccactggttcgttgtgggctagttttgtagccacggcaaaatggtcacgcaggcccaacactaatccaatggtacccacggccccatgcccccatacgccatcagggttcggatccagtccagtgaggacaggattcgtgctgcggacgcttcgtacagagcgcagagccaagccgcaggccgcggcatatttggcttcactgccaagtgccaactgccaagttcataactgcgtgactgcaccattgaggacgccaattcataacttccttccttccttccttccgagcaccggattcgagcaaaagcatccgcgcgtgcgcccactccctccgcctgccctctgatcctcctcgcctccgcccttggctcca

SEQ ID NO: 1320 - DNA, 597 bp, Zea mays
ataattagatccaaacagcaccaggacactaaaaatagtattatttattagaaacacactaaaatggttgtttttatcaatggcgcaccacaataattaaaaaatttatttcaaaaaagattttttaataaaatcttaccaaaaataaaaatttttgtagtgtgccactaataaaaaagcgtttcccaatgtatccgtgataaatagtactatttcgcgtctcaaagctaaaatcactctttgtcaaagtgccacagttaatttctcttttttcttaactatctcctttgcagatgattttgtaacgctgcttcccccatacaaaaacaatctagggaagctagatgagacatcgatgatgttatgatgagacaaaaaaaactttgggcaaccaaggcgttatagttgggacatccatgttaacaagtggcactggcgagagacaacagtggatcaggttgcagttgaaacacaagcagtgatcacagacaagcacatgaatgatcaaggcatcattaatacaacctagaatcttgcattgtaatcacagtatataacacatataaaagcaatgaattgacctaactcccaacacga

SEQ ID NO: 1321 - DNA, 142 bp, Zea mays
aacttttgacaggttctcaatttagcgttgactagtaagcaggatctgactgctgtagggtatactgtttgtgtggttcgtttcgacatatgttgttgtactgtacatgtaatgcgaggagaggtaaagagcgaggagagaa

SEQ ID NO: 1322 - DNA, 1325 bp, Zea mays
cgcaagaagagagttgttggtataaccaatagtgccaacaaccccaaagaataagattgtaacaaaggcatcaaccggatcgaagctagaaaccgaaggcaggaaaagagaaaagctccggagctcctggttcaggatgatgtcgatgcagagagtaaggggctggaagccatccagaggcacatgaagatacaaaagcagaaactgcttcaggctgctcaacttcgaagacagatagatgaggccatcgaagaaaagaagatctagaacaaagacaagagcaaagtagatgcctcaccacaagtatcttatgatgcagaatgttggtctataaaaatacaacatgtttagcagctaagtattacgggaatgtgtgtgttgcattagatttgtgaccatacaagaaggaaaaaagaatataattatgatatacgtgataggctaggggtaacactgatcaagaaaagattgtccaacatcggcatgtccatcggagacttctagaggcgccacgatagcaatggatagcaatgagaacagggaaataggagaaccggagttgacatggaagaagacagtaaggagagacttaagaatgaaatataaccaaagatttagcctttgttagaaacacatgaaaacagttatccataagcctgaaccttaaattgtgaaaacagttatccatatgtctgaaccttataggttcagttagctttttaactctagcatactctaacttaacttgtttgggagtaaaaagttttattgttgtagcagtagtatttatcaccttcgccaaaaaaaacaaaaaaaaaactatcaccatctgaaactgctaagtgacagctttctgtcctactgcagtgaaacgagcactgcactgtatagtctatcacgataacacaagatgacttgtaacagtaacagaatcagttcacaccagtcagaacccaatagtgcagataatcagtgaatcccaggacggtgatacctttgctctcaaaagtcgaagctcttgaggtacgctggatctttcttggctcgctcctggaacttgcggaaccaccggtccaggatgtccgtgggcactaccagcttgccgccgtcggcaccgcagaacgattgcatgaagttgaacaggttctcgccgacacggagcgccacacgctcggcacgctgctcgtcagggggcggcggtaacgcggccgcgtcctccacggcgacacccagtttagcggggcccacagcaggctccggctcgtcgccggcctycggaagcgggaagctggccgaggggcgcgtgggcccgagcgcacctaaga

SEQ ID NO: 1323 - DNA, 1500 bp, Zea mays
grggcctcttacaatggcttcttccgaaagggagagtaaaaaaggtaaaaaaaatatcactctttggtaacttgccatgcttcactgcccttccttgagtgggtcctcaatcctatcctagagatcttgcggagatggcgcgatctatatcattgatgtgtgccctaggtggtctacaatatggggtttttcccatatctttctcctatgttgaccttccttcttagtagcttgtaggtcctatttcgcatgcaggggtcgtagagccccttagtaggcttagacctaaggggtgtaggtcatgagtggagaaggaatgggttatgcccatgccgtaccttattggccaacgtgataatgagatgtacgtaaagctagcagtgcaattggtctgagttcgccgaatccacttgagtggaccttgactggctcgttcgacccccctgctagttttccgtctcgtccgaccccacggttcgacccgtggagcgacctatgggcaaggtgaaggtcagtggctcaagaatggtttgctcagaacgtcactccttgctgactcatgggctcagggccctagggttttgtactcgacacttagcaaacagttagtctataaatgttgtgatggtcatcaaagcaccaaaatcaatatagaaatggcttaaaacccatttcccttcaatagccatgtatactaagggtctatttggttcagctatagacttctaaaaatctgattctagttgtgaattgtgagaaarctgctatgggtgatagttatgagagaactaaaagttgtttggttgaaacatctgtgaactataaatttgataaaacatgatggcttggcaacatggaaggaggagtgtcgtctagcctcttggacaagtcaagccgacagcatgccatcgttggcaaggaggcagtatgccatgcccatgccacggggccctgcgcttgcagcactaggcccaagcatcgtggatgtagtcatgcccaattcaacacatatatagcaccctacatgagtagcgcgtatgacagtggcaacaactaaaacgatagatgttggacaatgagcaacatcgaaggattaacgaggaagagacataatrgtttaaggatgactaagccacgtcattgacctccgaattcagacatacctgaagggtttctaaatagaaaataaaatgattcgataattagataaacttttgattttttgggataagagaagattaactagaagaatgtatagaattcagatttttttagattatgtactcttttggtaattgaattttggctacaagcaattccttccgagttccgaaccatccagcgaaccttgtaaccttctagaaccctctattcccctccgtgtccgatgcctctcatcgccagaagaccttcccggtacgacgccaccgcaccacggaattaacacgagcactgcatcggtgaatctgcaagcccgcccgcccgtcgctcgccaccgcc

SEQ ID NO: 1324 - DNA, 1500 bp, Zea mays
taagatatattgatttgattattgatacgcgaaatcgactgtaccccttcatatatatataatatatataatgggaaaggtctgaacccgttccttagcattttcctacggaatccacggcggcaaagggataaacacgcgcgggaaagggttaatcacaccttttgtgatctaatcgcgtatcgtccgtgtctagaagcgtaacgttcgaacgtgtccagtgccataaatggtgctcaatattttccaagaaaatttaatttattttctcttggaaaaatgagaattccctagaaaaatgggttaataaactagcttttagataatactccgggtaaaaattaatcggctacaccagagcttttatcacggtggcaggagagggcacgggcgggcgaaacgtggatttagtcagatttagggctagtttggcaacaaaatagacaaaaacctagggaaataatccaccaagggggattttaaatgacactttaattccctgggaggatttttaacactccggtgtatttccctaccactatttggcaactaaggggctaaaacctctcttgagacaaaatacttcaaaaaatcataaaaaatcaaagaaaaataggaaatatttagaaaaaaacacaatgaaacatcactaaaactctaaaaacatgcacaggacatgttggcgtcgcgaatccgatgacagcgcggatgctggcggcgcggatgctggcgggagctggatgctgggggcgcggatgctggcggcgcagatgtgttgagaaaccctaaaaggggtttaatgggctaataccgaaactgcccttagggggtacacaggttatatatatgtacccatacccctcataataaagatagacagaaagagcttccatccactgtgtctcttgttcctctctgtgttgggttgctgggaagagaacgagcttctacaacttctcacgtccctactgctgtcgggagggttcggagtccggatcggggatctgcgacaactacgttgtttaacacgtcatcagcactgctctaccccgactcgtggatccgatcggcaccgactctccatcacgccggcaggtccccggccttgccgaactgtcytacgcgacaggcttcgttcccatttgtcgaatcaggaatcacggtatgaaattttgagtggatctgtgatttactgttcatcgtgtgaccgtgtggttcgagttgcgcccgccgtccttgagttgtggcggcggctcatcggttggagatgtgaaaaaaggaaaacccagtgcatgcggcgagtctgttagacgcgtgaaaaaaggaaaagtagggcggttgatagtgcagacttattttatatgcattatttatcccatgttttcctgctgaaaatagataatgcaagtttattttaatttttacatacaaccatttaaatttctgttatggataattggcacgcctaattaacctggagttaattttgcgtgacaggct

SEQ ID NO: 1325 - DNA, 150 bp, Zea mays
gtataaatgtgcctaagtattatgttttaatacttgtatattcatataataaaaacatatgaaaatattttatactttatatttcatttctcattgattgttgtcttacaaatataatcacgaaggtgaaatcttcgtgatactttactt

SEQ ID NO: 1326 - DNA, 416 bp, Zea mays
ggtaattcattgtcactatttggctatttggtcctggcaaacgcccactcaataagaaagactacaggctaggctaggcgttcgggtttacccgaaatttcgggtcggatttttcgggttttttaaatttcgggtttgtaacagttgaacccgtactcgtacccgaaatttcgggtacccgcaaattcaggtttgggtttgggtaaaatttgggtacccgctattataaatcatgcacaagatttacaggctaaggcaactcggcgtacctgcagccatcgcgcctacttgcgcgggcacgcaccgcacacacccagtcgccactagctagctaatcatatttgcatgcatggcgacgctagttycaagcgcctaatgatggttctaatctgttctgtcgctgtttccctttcctg

SEQ ID NO: 1327 - DNA, 398 bp, Zea mays
ataattatatttgcagcttagacaccgctccacacgctctccagcctcgtggcaacgcacgatcacatatctagtaacagattataatctcaaacaattatccctaacttatgagtttttggaacttatttgagaagtttataagttgatggattagtatgcatccacttgccaagttggcgtatgcggtcaatttattctttcattttttcgcctttgctgttgctacttctacaggaccaccttcgaaggcagtttacgctttcgatgttgcaacacgtaacagcgattgagcagcatctctagcggaaaggcggaaaggctaaacaaaaacgaaccaagccgctaaaaccctagacccccagccgaatggtcgccgtcctcctccgcgcgccgcc

SEQ ID NO: 1328 - DNA, 402 bp, Zea mays
gaagaaaaacgtgtactcaaggtggatcatggatcactggagagggatggagtgcaatcttgaccgaagaaggtcaccacaacgtagagtaggcattggccgaaccacgggataaaatcactgtgcctcttgtttcatattttatggtgattggtttctcttcttgagttctcgcttaatcactgtgctattgttcctaagttcaatactcattctaaaggaacaatcaagtgaagagttctcgctatagcatcttggtttaatattactaacatttcataaccatgtttgggctattaagtgttgttatttacagggtcacctatatattcacccccctctaggtgctctcaattggtatcggagtcgtactcttcatttagggactaaccgcccaaagag

SEQ ID NO: 1329 - DNA, 260 bp, Zea mays
caagctagctcattaacaaactaagttaagatgcttgctaactcgtgataaaattaaaatgaatcgagtcgagacgggctaaccacgagtggaatgaaatcacaagtccggctcaagttgcaaaatcggacgcaaatgctaatgccgtaatgcgccgaataaaaatttatccccacttgtaatcattaaagtctttaggtctcagagtcttggctttcgttgtcaaaactacaaatgccagaactccgggtggtctattg

SEQ ID NO: 1330 - DNA, 107 bp, Zea mays
gagtctggagcatttccgagttgtttccaccgcgcaagcgacgagaaggcggcgcgccaccaccgctgctggcctgccgccacgactcgccggcagactaggctcct

SEQ ID NO: 1331 - DNA, 334 bp, Zea mays
aaacaaaaatgaaaagtgtttagaggtgaacgccaacaacaaggggtgagaaaaagaaaccgccatgtagtgtgggctgctaggggacggccgtgcccccatgtagccccttatcccctgtgatcggatcatcacaaaatatctttggagcgcggttgatattatcactataattgggggtttacacgaaaaatcgcaccatctagaggtttatgaagcctccaaaaaaatatctaaacaacaactacttcctagtataaagtgacagtagcgggggagaagggaaccgaaaccaagcaacccaatccaaaccagacaagcaaggaatcccccg

SEQ ID NO: 1332 - DNA, 1500 bp, Zea mays
taggctcgcttaacttgagctgctccttgccgcgtgcactggratttgagcgtcttctagctggggagaagcgtggggatttagggatgcccctgtagatgccgcacgctttgttcctgttttcccccgtttttttcaatgactttcttgctttcacagctccttcgaactttgagctcttagtgtctcgtctagtggacgcggcagtgcaaaccgcttcctctctgtttcttctgcatcttgaaagtcttcggcagctgcatcccgtgtttatggggccaaaagtctggatctttggcctcaacaggtgtatggagtggtgcttcttcaactggatttttaactacactttctcttgtatttgcttgattttatgccccaagtgttctgtgttatgaactgtagctggttttcaagtgtagtccaacgtgcttgtcgtttgtagtgaacactcggatgtagttattgtgctgtgtgggtagtttattcttttgttgaggtcataggtggttattggcttctaattcaggttcctgtcattttgtgaagtgagagaagcctatcctaatcgtgaaacccgttatatcttttcctgtgctttatcttcattcctgtgcctgtgaaagtacgaccactagtattgacgaggagatctaggatactcaagtacttgctcatgagttgtatgttctttgtcactgtggttgcactagtttacttcacttgccacctacattaagcttaattgacatgatcagttacaatcaagtttttttagatatcaatgcataagctcattttttcatttgaagttctaccactgcgaatttctatgactgctctcgtctgacctgtgtgtgcatttgtgcacacctgcattgaagcatgtgtctcatttatcaaccatgcatctaactttaagcacgaggagatccactttgctattgattgttggtttgaaaacttcaattgtttatctttaaattatgtcattaatcttaaatcgataacatagtgctggcacaaatttgggaaaatctgttgtactactagatgctgtgttctggcattaccttgtatgtctctgactctctgttgctcatgaatttctttaatacactaatgtagcttttttgtatggcttgtggtcttgtggattctcctaaattgagacgattttatgcagctaggatatgggttgtttcttcggttgttacatatttatatgttaataatcgtttgatacagtgattcttccacatttgcagtgtggaggaatggaggacgggcagaatatcagattgcttgcagctagtttatttttccagcccagggtgaacttctgggtagtgtagtttgtcgtgggtttatcttctgcagaatagaagcaaatatttgtaaaagctgcttatagttctatatgatatgaaagtttgggaactatcaactgcaaattggccactctttctcaggcattagaccctaagggatactcaagga

SEQ ID NO: 1333 - DNA, 238 bp, Zea mays
aggctcggctcactttgggagaatggggcagctcagcccagggaacagtcacacaccctcctccattatttgattcagtttcacgattcactgatgatctgatgtaccagtggctattactagtagagtgtattctctaggtcttaataaaaagaggaatatcttctgttatttagtgctgccattctggacagaagctacagtttcaagacaatttacaagctgctatcttatctgg

SEQ ID NO: 1334 - DNA, 455 bp, Zea mays
ggtacgtggtacgcccagcccttgctcttcccttcctgctgtgagaaacagggcatccaaaccctatcttgctatttgcatccggatcttatctaaatagcgtatatatgcatgtattatatgcctactaacttggattctttcccaaaattatcatttccattactgggtccgcccctggttggatcgctggttttggggcaacgcctcgtccatgtgagcctcattccgcaagtggattaagttatttgtacctttcatatgctgtataagtactacgtatttcagcgtcatgtgttctaccagtgttgagatactgctaactagtgaatttccatcatgcatttgtgcacattacttctgtgttacatgacaacttgattgtgtagagtgctcaatgtcttccccttcacccttttgcagaaataggatcaagcgcttgaacttacagcgag

SEQ ID NO: 1335 - DNA, 413 bp, Zea mays
acgttgcaacagcttcaagtatcatggatgccctaccatttctaccacaaaattgacctcgccatgccgttggacagttcctccactcccagtgcatgcaatcgatggatcccaacatgccaggaaaaccccgcgactcactattatgcatgatgcgattaatgtcatcttgagttggagtgcgtaaataccaagcactaaaacaatcaatgattgcgcgacaaaaatgatgaaggcattccctagccgttgattccccaatttgaatatactcgtctaccgcatctgaaggtaagccataagcaagtatccgcatggccgcacawactttttgtaatggtcctagtccgggcataccagttgcgtcaactctttgtgtaaagtaaatatcgtgttgttgaagaccttgcaga

SEQ ID NO: 1336 - DNA, 673 bp, Zea mays
aacagtgggacattatgctcactaccttgtacttcacttgctaataatcatgtgcaacagctaccaccttatctattattcaattgtattgatcttgttgataataaacagaaaatataattcaaattactattatttcagttcctgacacaacttcataatagcaaaatcttgtgtttgagtttttgactgcagatcagtaacgccctgctctctagatgtgcattttttattgtgctattttgtctgctgatgacaaaagtgttgagtttatactgacctgattcttgtcaatgagttctgcaatatttgtatgttatatgcattatcgcatgatttatgcatgatgccatgtatggtaggaatgtaggatgtttgcatatggtctgttcatttggatatatttcttaccgttgggttatataaatcagtaagtggaaaatatatagttgtttcctgtaggcctcatgatctttctatttgtaagaatgatgcaattggtattgttgatatgtgctattggttttgtcgattcctttttgttctctagatcagttgtaatgaaaatagagaacctatacttgcagtgcactcaattatagtatggtttgtcatctttgaatgttctttgcaatagctgacctgcctgcttttatcagaaaaatcatattca

SEQ ID NO: 1337 - DNA, 736 bp, Zea mays
gtctgagctattttctatttagagtataatcttcagttctcagcgccgcgtgcgagtggaggggctagattttaaaaaccgagtccgtactaatgatatttcacttgtcaccgcccctactaccatcgcaaaaaaaccttctttttctcccgtcacatcacctttcactgcatactgtctcctccatctcacgcattcacctgcagtcctgcactgtgccacagcccctccccttctccaatctcgccgccaattaatactcgccccctcccttccatccgctcctcccctccccttctcgccaagctcagcgccgaccgccgaggcatgctgtgagcgagagcgatctgtgcggcgtcagctccggtgatcttggaggcgccgctagcagcttggtgccgcgggctggctggttgtccgtctggccggagctagctacctagctctcgagcgaggagaagagggcgggagccaactgaagtgaagcgaagcgaagcgaggcaagtgtgtgctgtaccagtagtagtggagtggtggtcgcgaacactatttatagcgccccggcccgccccagcgtgcggcgctctctcttctctctcacaggaccacggttcgcgcgcgcgggcaccgactccgaaatagatagatctcagctcagctcagttggcacttgctccgtccgaagcccgccctagctgctcttcttgctgatggtcgtctcttgattgcttgtcag

SEQ ID NO: 1338 - DNA, 183 bp, Zea mays
ggtaacatgtttttttttctgcttctttttttttctgccgggaagagtttgtctcttcgatggaccacggcatctagctcttttgtgtgtgtgtgcctctagccctccagctgatgaaacatcttcttgggcttttttttgatattattcgggtcccagcaaaggattgtgatcaaggtgcag

SEQ ID NO: 1339 - DNA, 696 bp, Zea mays
cattttctagagagctattggagatgctctaacggagatagagtgaaaccacctgtgtaggggagcttaatatcccctattttttaattactgttttaactgtgaaattaattattttctagtttaattatcttataacaatgtgtctattgtactataaatattatatattttttaaaaccctaaaaacagatatataaaagttaaatatctcagttaaagtgtatagaaaaagtatataagaggctgaacagraaaagtagtcggagagaagatgaaataaagaaaaaaaggaggtatttatatataggaatagaaaataagaaaaggagaaatttgagagagtgaatcgtttgagttatagctaacggtcacacgcaccacaaaaccccgttccccaattccccgatcgacgcccctcttatcacaggagggcggcggggctgctgtcggctactcggctccacgagaccacgactggagttcggcgaatcgacagtaggtggaggcggggctcacggccgacggagcctctcaccaacgcccaacgcccaacgccggttccctgggttgggctggccacttgctcctcgccggctggggctgaggtgtggccggcggcagctaggaacagcgacctgcgccagtcgaagcaacattgcgtcagggagcggaagacatgcgcgccgttggtga

SEQ ID NO: 1340 - DNA, 456 bp, Zea mays
aataaaaattataaataaataataataaataaatattttttgaataaaacaagtcggtcaaatttggtgttaaaaagtcaaatgaattataaattgaaacataggaaataacttattttagaggtgggtgttcttattgaacttttgatttgaaaagctcgatgatttttttttgtttaagctttttgtggcggtggataaagactaggtcggttggaaccggattacccagagtaaaagagtagcggtctttattgtggctttcgggccttcggatagagcccaaaggccgaacgcattacatcctttgccgcttgctgggccaacaccgaatccacgcgaccacgctcggcgcccatcgaaaaaccctctcctctcccggacaggcggacagcggcaagctggccaccgcgtcaccgcctctacagccccaggctccactgctaaacgccggta

SEQ ID NO: 1341 - DNA, 806 bp, Zea mays
agtgagaataatggcattgtgacgatagtgagaaagatgtacgcatccgatccatggcagaattcaggacgaccatgcatgacagtaacaggatcagtactcatcagcatgcatccatggatcggcggcgttgtgctcgtgctgtttgttgcctgcctcgcatggcatggtatccttgcttgttttgtttctgttgccgcaacgcaaccaaaacctctcttcatcatcctctcctccttccttccttgagttccttcctcgtagtttccgactcgccgtaacgctccctgtgtcgtgtcgtttcttgcagtcctctcctccctgcctccatatctcccacctcggccctctctccacgcgcttcacttcatccctgacgccgacgccgacgactccggccgctcaccccgacgaacgcgcgcgcgctcgcactttcggacgactccctccccggcccggctgcctgtcactgtctctccccttcgttcacgaagcagcaagtacggcacggtacggttcgacgtcctttttcatgcgactttcttcttcctcgtgcttcttcgtcgtcgtcgcagctcacaccctgggcttgggcctgggcgtgcatgtttcttgatccctgctacctgctggagctggacgttccagcgattcctctctctttctttgacccttgctacttttcttttttttctcagaccagttggagaaagacgcgatccaacatatttcttcccttgtatgcctgccaattctgaacacgtaccaactcaacccttgttcatcgatcttgcagcagctacagg

SEQ ID NO: 1342 - DNA, 1500 bp, Zea mays
actttttttctgacaagcttttctgataatctatttgtgaagagaatatgtctgtatcaaaaatctaagtatcattaagattacatgcgaagaaaaatgaagtggtccaaataattcaggatatagaaagcgatgaattcctactatcacgatgactcgaccgattatgtattcatgttgaatttggacggtttttatcaaaacaattttttataaaagcagtctaaaaaattaggacattttgcagtacacaacaactttcggtagctagaatctaaaaaatggccaaataaacatggtcattatttctggagaaaaacccattcggtctcctttggaatacagattagtaaaaatagacatagaaaaaaacattgttcccgagaaaaccccattcgacttcctttaggatgcagtttagtacctttgattccatagaaaaatgtacaaaagactaaaccttatattaaaatcctccaaaatctcactataataatccattctataaaaaaattataaaatttatagcaactcaatcattcgtttaaagagccacatagaaaaacttcctataatattctaatcctcgaaaatccttcgcttctgaaggaggccaaatgttccctcacccgttctacatttgcttcatattaatgctaactgttcggattattgcagctgtaattaatagagataaaacattgtagtctgtacaagcagtagaaaccgaaacaagcttatatgggagcgctccgacttataaaaatcagagtctgttcgcttagttttaatctataccagcttatactgtttatacaatatttttgtctatgtctgctcatgctgtgccgccgcgggccgcaaccggattgttgaagttgtaattaatagagataaaacattgtagtctgcaaaagaagtagaaatcgaaacaagcttgtatgagagcgctccgacttataaatatcagagtctgtttgcttagttttaatctatatcagcttatactgtttataaaatgtttgtctctatatatattatatgtgcagccgtcaaacagccgattttaatgagcagccttgtgtctgctcatgctgtgccgtggtggccgtgggctgcaagctacagagctgcctcataaaagctccctgcgtttgctcctgtttgcagcttgcacggaggcggggtagtagaggacggcctcgcaaggtagctctgctcgagcgaggcagcagcactactcccgttcaggtactacactcggtagaggtggacgtcagctcactagctgagtcgccagttttcatcagcagtaccactagtaaaaggattctctgcaatcgaggattgcaatttgtatcttctcttctcctaccggttcggcttcgacggagaagtttcttcctctggttagttcgctgacgccgactgttcttgccacggggcttccttctgcaggagaggaggcgttctccaccgggtcataggaatcctgacgag

SEQ ID NO: 1343 - DNA, 227 bp, Zea mays
ggttcctcgacctgtactctaataatctctgctatacagatattgttggctttattacgacttaccgagtttcgctggttatttttgttttgcttaattaattactcatgcataagctaaatatacagaagtgtcctgcatatatacacacacacgagtatatatatacttgtgccccactttaggtcaggagactcggtggatcataggaatgacatttgttgttg

SEQ ID NO: 1344 - DNA, 922 bp, Zea mays
ttagtagagaataacacacatctccctaagtatcacaaaaaaattaattttaagaggcaattttagtttccaaagcaatttattaagatttaagggagggtatttattagaaggaagtacattgatcaaacagagaaaattycatcattatggtcccccatagaaatttgtcactcgattgtcgcaaaaaaagttaccagtaaatttgataaattttggataccggtctgttttaactcatcaagaatagcacgacgaaataatagattgcgtacgttttcattcataacatctctcactaaagcattttttacacacgctattaaaatggttcggaaactgatccttaagcggtctattcatatccatctatcgttctaagattcttcctgtacgtagattctttccgattaaattctcatgaaaaattaaaaacaaacaggtccttaaactagtcgccggaagttctcgcttttgctgtagttgtagtgtcgatgcatgggtggaaacgtggacagatagattcatgaaatgtggacaacccacctggtccagagcatcatgatacattgatacacgtggcacgctgcccactgatgccctcagctttgaagctaacgtgtcaagtgtggccggcccctgcattgcgtcgtgccaatcgtccaagtcccatggcaaaaacccagcgctttgtgccgccgccgtccgccggcccctctgcccttgtacgtgcacctagacacatcgtcatcgatcatcacacgcaatcgacacaagaagttaataaacagcccaaggacgcagagatcagctgatcgagaaggacttgtactactactcagtattgtcgtcacatgcacatatatgtacataaagagctagctacctgagctctacccaaggtcgcgttgatcgatcgatc

SEQ ID NO: 1345 - DNA, 562 bp, Zea mays
cactgcaattctagagataaaatattgtagaagccgtaaccgcaaccagattaaagtcgcagcaggattaaaactacagcaaactacaacgaacaagctaaactgatatgtttaaaattacctcaatttttataaaccaatttcttaaaatctaggtgcttccaaacaagacytaaagccatcaaataatatgagtcatactattctatctctcaactactttcgtatccgacgtgttattatgctaattttgaaccaatcaaatagaaaaaagtcgatttctaacatttttttatttttttttgccatcatcaaacaaatatcacgtattaggatgtcaggagtgtacaccggacccggactgggattaggtgaacccggtccacagggtgcagctatgcgaagggcgaggattgcttataaaagacaaaggcatcacatccgtgccgcacctttggcttttctggctttatataatcattcgttcaccctttatccatcaccacctaatttcccaacaaatttcaatctccatcgatcgattcctcccgaacccgacccg

SEQ ID NO: 1346 - DNA, 1219 bp, Zea mays
aaagaagtccgacttctttttcatagttcgtttgaacacttgtttcacttcagctaacgagatggtactacgtgagagtgttgtattaggtgtaactttttatcgtgttgagcttagtaatttctcattgtccatctaatgtaacagcctatcgaacctattgttattgttagactagagttgagcttagtaatttctcattgtccatctaatgtaacagcctatcgaacctattgttattgttagactagaagcaggatataaaaatagacttacaccctttacacgtgagacacgacgcggttcaagtaaaaatcatagtaacttacagacacactgctgttaaattaaaaaaatgtaggacatgatatacgcaaggggcgaacgagaaagacagcaagcgaactcacgcgcgcgggttcggcgccaccctccaatccaaagggcaaggcaaaagctcgccccacccccaaggccccaacctgcctatacggccagacctgctcgcctgattcgctctcccgcgattccacccccacaaatcctccgacccaacccaatccagcgtctcaaaattcacgcaacttcgcgtcgcgtcggctccaaatttgcccccttcgatccataaatcccttcccccacycccgattttgcgccgaattcggttagcttattactctccgagcttatcgccaaccgtctggttagattcgattccccgtttgttttcgcttgaatgtttagctttcttgatattttcccctttattattttgggttgattgttgttcgttgtttctccctttctgaaatccggattgggcctttttcaaattcgcgatcagtcccgacctcgagatccggctcattttttcaccctcttacgtattcggatcgagcccgagctgccaattcgaggagctccgaacgcgggccgcataaagcgaatcgaatgaatcaagcttgcgcgacgggcagttgatgccacccggcgatggatcgccgcatcctcaggacctcgtcgtgcaacggcagcggtaagaacccgtccccttcctctcccgcggcggtctcacggcctgcgtcctccgggggcatcggctccaaggacgacgccgctgccggcgagcgcaaggcgctgctgccgcggcagcctcctggcggcatggcgcggaagggccgcaaggggtccaaccgccgcgtgcagtggaaagataagc

SEQ ID NO: 1347 - DNA, 482 bp, Zea mays
ccaaaattgcaaaaggacccttatatatgagcctcgcttccgtgaatcctcctctttccccctcccatcgctcgggaaggcgaagggtcaaggcgtctggcacttcagcttgtcccgcttgcagcttgctcctggagtcctggttgctccgtcttctccggtcgggctcttgtccgacgaacgtgtggctgtggcactcggtaggtcccttccgcgatccttcatgatttgttttgctctaaaaaacccttctttatttttatttttattttttgttttttaatctactagtatagcaatgctagatcacgtgttcgaaatcattcgtgtgtctcttctgatccagtagcgctagagcatcttatctttcagattgattgagatttcgtgtgaatggatgagttgggcaaacgaggattttcatttttactgtatccgcattttggccatctacagaggaagtacactgagcagggcattcc

SEQ ID NO: 1348 - DNA, 699 bp, Zea mays
ctgcagtgattgtgagcaacgtatcaacattttgtattctctctttaaaaaggcagcgcaaaaataaaaatgtagagctgcagtgcactgaccatgtaaaaaagtaaaagttttccgctatatatattaaaaaaagataatagaagctttcacagatgataaccatttcaggcccaggcaggctcccggtcgccccaccgtccagtctgtggacctacctaaccaatgcatggacctcgggctcaagtcccgctgcaaagcaccgcgggcaccggatcacggttgccgcctgatcgcgccaccacagaacgttcgtttcccgtagatcgacgtgccgcttagctatggctacgaggcccgccccactacgaacaaacgctcccgtcaatccggtaggtgtgtaggccgcgaagcgaagggtatatcggtgacggtgcacgtacgcgccacgtcggcatgtccttgggccccggcacacttgtacttgtacccttcacctctctcctctttactacttgcctccatccactggcactgatccaccacatcccacgccgagcgcgacgccagcagcaggctagctccgctgtccgctccgccgctcactagctgctggaccgcgcctccctccatcgcgccggcgcgcgcgcctaactagcggagccgccttttcatggtccccgccgtggtcgggacgag

SEQ ID NO: 1349 - DNA, 1161 bp, Zea mays
gttatagttgactattagctagagtgtttagaggtcttaactaattttagctacttactattaactatagtgcatttaaagacccattagatatgtttgataaagataaaataatttcttttcccacaacaggacgagtctgaatttaattggtaatacaacgatttagaaatgcctgcagtatttaatgtttcccaaaccatgtaaggatcaattttaaaagtcctttttaacttatatatttctcggtcatttaactaaggtaaagtgtaatatttatttttattatcaatactagatatagacaatatattctcatagatattaactttatttattatgaatattgtttttgagaaggtccaccataatgatttattagaccctcgtgtatcgctcaactattgcattgccgataaagtctgaatcatgattatgtgccggtgtatgtatgcattggactagtgttaataatgtggcggacggaagtggtcagccacgtaggcaaaatggcaaaagtgtagtatcttttaaactataatggcaaaactgttaagaaaaccgtaaacatgaattttggagagatagttcattatccccgtgactgtccttcccgcggctcacgccgttgaaaccagcctcatccagtcatccttcccgccttctccgtctgaaacccacctgctagacaagcagcctagccctgtgccatgactttttcgtctgtgccagacaagagacaagcagcctagccctgtgctatgccgacgctgtcaccgacgacacggcacgacctttgcctttcgcatctcccgaggccacgccgttttcaccgtcaagactcaagaccgtccgtgactggcccaacacccaccgcaagtttacgccgcgcactcggcatgacggcactgcaactcgagagctgcccgtgccccgtgccgtagcagtggccaccagtcaagcaagcggtcgctctcgagtctcgactagacgccaccgcgttccagagcgagaagcgagaagtcttcccctcgcctcgtctccgcccacaacaaacatcacccgaagccgcgtggagccatcatccagatcggagccagcgcgccgggtgatgctgttccggccacgaaagtagccgtcttgcaccccgacccaagagcc

SEQ ID NO: 1350 - DNA, 272 bp, Zea mays
tgtgtgtgagttctagagtgacacctagcactgtatatgagtgtgattgtgcaccaacactacactagaactctcttggtcaaactactcatcgacaacccctctttatagtacggctaaaagagaataaaagacctaactaaatcgcgagtgtccacatctccttgacactcggactccgtagaccttcaccttttgttccgtcgttttagccgtcgcttcgagttcttatctccgggattgttttcaccgttgtagtactactacctgtc

SEQ ID NO: 1351 - DNA, 1500 bp, Zea mays
catcttgtatctcacatcctatttcaaacttcactaagtaaacaatggtatctacattacaaaaatgtgttttgcacgaccatgtgcacgatgtgctggccacatcatgtgccaagttttattttccagcttatttaaaatgaaatacaatattttatttagtaaaaaaatacatagcatataattaaagaaaaatatatagttcaaacaaagtacataaaatgcaaaaaataaaaatatagcttataaaaaaatcaactactactcgcatcttagagtgctaccgttgataatcacttatcatcaaatagaactacaaaggaaaagttaaccttgtattcgcaagtttcctactccgctgaatctgctgcttagcctgcttctctgttcaatcgatcgttgggtctctactacttatcctcgcccctctttatgacaacaaaagacctctagcttactaatcggctttgttatttgttaacgtgtgatcaccagtttgtggcctccaactcaataatggctagctagcactgccgaaacggccgttggtgccggactttgtcaagctgtctggacagcccatattctaagccccgtttcaatctcacgggataaactttagcttcgtgctaaactttagctatatgaattgaagtgstaaagtttagctttaattaccaccattagctctcctgtttagattacaaatggctaaaagtagctaaaaaaaagmtgytaaagtttatcttgcgagattggaacagggcctaagaatgagcagcagcagacgcctcacgcctgcagcstgcagcaagmtaggtstgaaaaaggcaagcaagaaaaagcttcccgcaagcaacaacaacaacaaaaaaataaagcagcgtgtctgattagagttagcaagctggctagctaaggtcagcactcagcagctgtgcgcctgtgccttcgatcctgtgacagagacccggccgcagaattaacaagtgattaacagaataacagatgccatgctagagagcggcacatacagtgacatccctccctcccacggtcccaccgagacggagcgtccaaatgcatgcaagctgtgtgttttgtccatggggatagctgtctcgcgtcctctcgctgcctgccacgtagtacaagcgcatgcgggcgttggggaggaacttctggaggtgattaaagcgagcgatgcgctttcctgcatcaccagagtaatcaaaatcatttgcttgtcctcttgcatgcatgcgccgcgccaacgactcggcgcttccaccctggcctgcgcctgccgcggcgtcgggcgcggggcgccggccgtatacatacccggcccgtttcaccatctctctagtctctccctggccccaaggcatcgcccgaccgccgtctcgtcccctcctccgacctctcgacccctccccacccccaccccctctgcccctggctgcgcgcgttccagttggtgtgcgtgcgtgcgtgtcc

SEQ ID NO: 1352 - DNA, 1500 bp, Zea mays
gaggcatccaaagttgcttttgaatcttctgccaatgctagagaccactttagttgatattttttaagtataaaaaattattgtagttttttctaccatgtgtttggatgcaatagacattttggttttaaaaaccatggcattgtcaaggtcgttgtattttagtgttttatgtttagtttcttgccataaattaacatcgtttgttataaaaattatgacgcttgtctaagaataagtgctcaaaatatttgtcactacttagtaagacaaaggtgcctccaatggtgactaatgagctagttctaagcatattgtcttatgttttaatagaagagagagaaaaaagttattccttaatcgagaactaggtttttatacacactccaagatcatataaggttgtcatatagaagtattatactacgaactatgggctaaaagttaatattattagagaagttttcttagagctaataactaactcatagtgttgaaggtgtcctaggagaattttatcatgattttataagtcattgacatgtgggacctaatttaatagaaaaaaaaatcttgccactctatagtgacaaccaaagaagtgaacaaccaaagtcaaaattgcctagctttaagtataacagatggttgcaaattatggctagcaaccaaattcccctttagaaaactccattgagagactacttttctataaccgcctcattgcatgttttggcttatataaagctacttcttttttatagcatagttttcaaaaacaacatcgtccttatattttgtttatattttacagagaccactttgttgtgacaaacgtttccctattattccttctattctgaaatataagaaattgatagttcaaaatttataccaaatttgaggtattcggggtgcacaaaacactccaaaatacaatattcacaggcatacctactaccaatatccatcaccaatcttgatttagtaatcagaaaaggttgcatacatcatttatttgggtacttcatatttcaaaacaaatgcagtatatgcaataggtataatcatatctgtgcttattaaaaagatcttatcagatacagctatttaaattagaaacccatgtttaggcagctctagagaaaaattaatgtagtggaaaaaatgcagtttcgtcagagccaaaaaaactgtcacgtcagttgctattgctatagtgcagttacttgtagctatacagtatttattttcctccatatcttgtatcaacgatttttgtagccatttggtatgctatttttttttaaaaaaaataaaggaccagaaagaacctggcgtcccacgcttctcatccccgctcgcgcgctgccccgcgccgcgctacttatcagttatcccggcatctcctcacttggtccccggccaccacaccacctctccagccgccctcctcgtacgcgcggcgcagaggtccttcttcgccagcgcctcggggcc

SEQ ID NO: 1353 - DNA, 798 bp, Zea mays
caaccataattaaataccacactagaaattgatttcgttatattcaaacttattaccactagtattcgattgtgaatcattacccattgtcatttacattacattgtgtgaaccaaacaaccccttactctcctgaaaaacttttgtgcgcgatcaacttctgttagtaagcagtgatttcacagccgtcaaaaactatgaaaggcagcgagcgtaaccagtgggcatgcaatagtcaaaatcttgcatgtccatttcatatattatatttttttaaatgtcaacagtaaactcgcatgtggtgtgccgcttcttccaataagctccatttcttgcgcgtccatcgatcaggtccacgctatttaacctatgtcctggcaaaggtactcagacagaatttaactgtttgtttttcttttgtttctttccccagcaacaatcattttcatcgtaaaagcggccggcatagcgggcactaggagctcgatcaggccggccggagagacccatgaaaacccacgcctcagccatgtcaaccgcatgcattacgcctagccgctaaagcatggagtcactaacatttccttaacaatgaccctaaaaatgaaggtgaaagcaaatcgtcgggcgtgcagagagccggccggcggcgtggatgggcgctgccaccggccggctctgcgccgccgctagtagaaattattgccgttggtgaaggtctggcccagctgccagccagagccggcgacgttgtcgaactgaagaaactggccgttggtggcggtgacccggaaggag

SEQ ID NO: 1354 - DNA, 679 bp, Zea mays
tcgggagtcagctcggaggtctaggccacggaagcaagaacaccttgacgacctcacctcacaggtatatatgtgtgttatttatgtcctatcatataataaggcgatgtttggtttttaaggaaataatttttagtcctttttagcttctaaattgtcaaacacatggactaaaaaaaggattatctctatcttaatctctttgtttgataatttatggactaaaaatgactaaaatggatggacgaaaaattagtccctaaaaatcaaccacccgtaactctattataattcatgatgcaagtttaaatcaaatttagtttgttcagttcagtctttcctcttagttcacttctttattcatgaaggcttgcactcatatgcaggtgaaaaagcaaaatatatgacaacaaagtccaacttgaaaaatctacccaaacaagcgcaataacggtgctcccacaaaccaccaatttcttcctagctaattcactgaacagtgctaataaataaataagtctaccatcagtatctgctctgatcgttaattatttctttttcactaaaattgtctaaacatagcagaaacaagctaggattgaattcatatatctgagcggtgtattattgcggactgaaacaggtaaatcagctgaaggaccagaacaagcagctcagc

SEQ ID NO: 1355 - DNA, 148 bp, Zea mays
gctctaagctctagctctagaagagagaaggtggctgtggcatatgacatagtggtagggccaggaagaaaggaggcgggcaggcatcaagttctgttcaatcgtgtggggcctttgtgtcactgttgatgtgtgcagtgtgtgcttg

SEQ ID NO: 1356 - DNA, 528 bp, Zea mays
ctttattttagtcctgtggatctaaacatgcccttagcgtgacagttctttgaaatagcagttcttgtgggggtgcgagcggcaaatacagcgccggctcttggtttccaagtggccccctacgtggaaccttctgagacggctatcctacgtgtacgctagcctccaaacttcaaagcgcgtctctgcagggctcgcacgtgctctttttccctcctcaccccgaattaacaatcgcgaaatcccaggtttgacctttcccccagccttgttgttccagtggggacccactacacccatgtccccttcttcctcgcacacgcgggacactgcacctgagcctctcaagccctcaacacgccaatttgaccacgtgaccgtaatcttgatccacggcctccttgcacttgcaccgcaccggtgcctatttaacccgcgctcgaacaactctctgccggcaacgcaaccaaaccgctctcgctctcggctctcggctctccaccagtctccgctctctggacgccggaa

SEQ ID NO: 1357 - DNA, 476 bp, Zea mays
cggcgaggccggagtcgctgaccgacgggtccgtgaacctcatggtctggaactgtaccatccccggcaagcacggggtaagccgcggtaacacctattggattcgatttgacctggttacttggttaggtagtatggttgtaatcatgatagataggatttttagggaaatacctctgccctgtgctgaataactacgtaagcttgaccgctttactgatgttgcgatgtgtgcatcagcgcctttatgcagctttgctccattgtgaatttaaattattttattttgccaacacatggtctatagttttgttatttctggactgtactgtttattgaatctagtatttctataatagaaactgtgttccctctttctttcttttttatttactaggaggtagaaaaataaaaaaaactcggccggggagggaaagaccaccctcccggtattatattgagaagagaccgaaaca

SEQ ID NO: 1358 - DNA, 1500 bp, Zea mays
agaggatgtgatagggtagcttctcaagatagctaaatgctaagctagctgagcatatacatttaatcataagctgacactcgcatgaaacgtcaacacttgttcatttttgggaacctttgttgaaatgatttgccaacatgttgaaaggtccgtgtttcaaagaaaaaagtaattgaaggattggggtagattttgagtgtttgattgcatatcttattggtttttcatagttgtcaacttaaagccatatcctaatgacttataagtaattatgatatttttggacttctatactacttctatactttaaaataagacataaaaacaacattagaaaaatattgcaccttcgtgagaaaatgttctacttacaaactaaatgtgcttaccaagaaaagtatagaatatgttttagttctatgaataaaatcttttagatccactatgaaaaacgttgtagcctcatgagaaaaaaaacctagtttcctaaccaaatgttccatatttaggagaaatttaatctagcacatcgaagagatttgttctaatatcaccagaaaaatgctaccgatttggtaaaaaaatgcttatgacatttatgtgaaataaaaaaagattataaaacatgaaccagaacataaagttaaaaagaccaataccaaaatttaccctacggtaatgataaaaaatgaaaaaatccactactggatctggaaaaatagagataactattagatataagttataatgaaatgtaagagcaataaaaacataaaaaatagaaaaataagaacgaagtgtcatggcaaaatgaaagaaaaaaataaaaaggaaatggagaaagaatagtttttctccagtttgatgggccgctttctccaatgaagaagcgtagtcatacgtgcgtgcacgtgcaggaaaagaaaaggagagaggaatcggcccagagagcgggcaacgaaccaagccgtaaacagccccggaaaaattactcttgtgggttcccacctggcgactgtttttcttctccagtacacctcgccagcgcgataacttaactgcggcggcagccgccggcccgccgcccagctgcgcaggtcttcgtcgcgccggccactagaacgcagcacataaggtacgccggcccttccccttctcttccctttccttccctgtgtgcaaaattgagcacccgaaccctaacttgagctacttgctatttgtattcggatctgttctaatcacaagcgtgtacatgtattatgcctacttaacttcggtttttctaccgggtgtgcatgtcgaagcccatgccctttattggctccatctctgttgttgtctggtgccctactgattcagtgcatccatccactggcggccccattaggttcttcgttacggagtaagatcaattttagccatggtgctggcgcagctcgtttttctgaagtttcgggacttcaattgaacccttgagtggacagccacaaaacc

SEQ ID NO: 1359 - DNA, 1126 bp, Zea mays
agactagctaccataataaaatcttttatcgatgttttaactaatcaacttttcaaaggttacaaatatatatgtatagtgttaaataagaactatcttaaaactagattaaaaaaataacatgtaagagtagtgtttgtatttaaataagaacacagttactattacgtaagggctcagtatattcaaatggctcaaataaattctgctatgaagttcagtagaaactacgaagagcatgaaactttaagctgctattactccatattagctgggctggcatttggactttggttaagggtcgaagcactgtttttctttaaaccattcaggactgattttgtatcagagatttggaggggattcctcccataaattccctccaattattcagctgtgtctatcaaatactcccttcgatttttttatatgaggctgcttagtttaaaattcaattgaccagcaacatatataaacgaacggcggtagtaagggcacacaaacaaccttcagcattagtcctgttcaccgctgattctctgaaaggatataactcatttactacttcattgaattatgttacatgatgaaaccagatgtctactaatatgttccaaccactctgatctaccggccaaaacacaaaacaaaaacaagctggaaacgataacacaactacaaacaatcatgttccaggttgtcgtatttacatcaatgactcactaaaattgacaaacttctcagtgaacagctgattgttaataaattaagatgaacactaacgaaattaatcagtacttaaagatcaaagggtgctcaggtagcacagtatcaatctgactgtgtcacatgtcacacgggagacaataccaaggtctcctggacgaattataggcaccatgattgttaaaagaacaatatagacctacccttataccagtttccactttccacaaactcaacgctatcactattagatttatctctaccagtacaataaatgttgtggcccaataacatcagcatgaatacaaaccagccaccaccaataatatacagattcatggtatgaagaataagacctgtgaccagagtgcaaataaactcaataatttggtcttcatca

SEQ ID NO: 1360 - DNA, 1042 bp, Zea mays
gtgggtgagcaacaatcgagtgaaggaaacaagtgttaaggtaagtgagtgaggattttacatctttacatagggttatagtgagacaatttattggattcgatcttcatagatcgcgtgggggaggacataactctcccaatttgggtctctgtcccaccgaggaatttttgtcctcgacctcgccccatttagctttggatccggaaattttagctccatttccctttccattatgtttgggtcccctgcggacctgcccatggagaaatttgtcatccttagaatatcttcaatattctccttatccatctactttagccattgtttgtttaccctctagattatataatacaacttaaataagttaagacgcaaacaaacaatacatatttttaggtgaattatataatctcgatatttagattatgataattcataagcatgtcattagatgcttatataatccatgtataatataggaagaaaacaaacaaggccttaggccatgtttggaagttcttttttgcagttttaaagcaatacatggtattttcatgtatttgatgattatgtgacattgaaagccaaaagatgcttggttgctatagacaaaacacaattttaaataccatgatttatcaaaaacatggtatttttagagttttggaaactcaactcagaacctttgttttttcttctcttctgcctacacgtactttgtatttccaatggtaccaaataaatatcagtttcatgcaataaataatactatagtgtgtcatatacaattataaactatagtatttcaaaactaccgcatttcaaaattgaattaccaaacttgtccttagtctctcttttaactttactctataaacatttttactgcgaactctacttttcttgcggagtaagaagagtggcggcggcgggccggcggcgtgtataggcgtgttcccgagcagaggcccccccaaacgcgcagcgcacacaaacacacaccagcccagctccgagagatcatccggcggccggcgag

SEQ ID NO: 1361 - DNA, 634 bp, Zea mays
ggatggttgcggtgtcgtgtatttttgcgggcaagaaagaggatcggttggaggtcgattttttctattttctccctaaataaggttttagggtaattttaagggagttttaggagttgctcaaggtctgtttggatactctagtatgcactctaattcaccccacacatgtgaattagggtgaatattacagtatccaaacaaaaccttaaaatgtgaatatccctctctaaaactaaatataccaactaaccaaaattaaaattaaaattaaaactattcggtttacctaagtctacattcatcatttatgacaaagaccttataaaagatcctaagtcaactagtcaagcatctaaagatgtccctttgagtctgatgttagcatcctctcatctcatcattcatcagttcaaggagtatctgtctccaggagggtcaacagctgaagcagagcgtacgtaaagcgcaaagcaaaggctctccatgactcttgactccatccatcccgatccagtgcagcttcagcttcagcttcaccgagcgagtgtcacacacacacacacacacacccagctgaagcacatctccaagaaaagctttaaagctccagtgctccacacagcagctcgcg

SEQ ID NO: 1362 - DNA, 1500 bp, Zea mays
aacttcttatctgaacaaaagtaacaccgaaccagttggttatttaggtgtgtgcagtttaaggaataagttagcacgtcgtcgtttttatttttccactttattatttatttggtttgtggaatagaaatagtgtgatgtatcctcgttaaattatagtactaatgtgaagaataaagctattccaccaaatttaacgaatagactaatgatattaccacatcatctagaacggagaaaccaaacacgctgtatattttcagaaaactgtatgtgttttctcgcctgcacacccaatcgcgcggagtggttggcaagacctgaggcgatttcagcctcagaggccagctctgttagcgtctaatttttatcccattttttaaaaccttttttctcggtggcaagtgggcaacagcttgacaaagttgggatactaccttaaaggtagccaatgagtgaagtagccgtgatctatcattgcatcaactactcagtgagccagttttcttcagctaaagcaagcagattggccaaagaaccacgtggggtttttttttcattttttcacgacacatactgacatactggtgtaggacatttgctgaaacatgcttgcgtactactcctacgacacaacgaactgaatcaaactgaagaatctagtatgtaggtatgcaaaagagcctctgttatcgtcctctgcatttctcttcagtttatggccgaacacgagcagggcagtgtgtagagagactcgctagctagttgctacgatgacagacagagtcacgctagccgagttacctcgacaacggtggcatcttccttgcgaaatgcaagtatggcaatttctccgcgacagcgactggaaaaccgaagcattttcacacagagtgtgcgacaaagactcgtgtttggcccttgccgtgcagtctcccgaaaaaaccttcagcaaccacacaaacactcgtccgtcaatacgatgcacatgttcgccggttccccatgcagtttttttttttttgcgcttgtgattcaccaggacaatttgagcaggtactaccctagaagaaaacccatgaaaaggttgctgctggttttgccaaaggccaaagtaaacgatgagaagaggccatggcgttctatattttgactgttgcatgtagcaactagcaatgactcctcttttagcggcgagagactgagagcttggctcaacgcgtcctcggcttctgtggaaggccattccatgcgctccgtgtagccagccattcggtacaaccaactaccctagaagtaacttttcttttcttttttgctctcgagatggatccggttggccccttcctcgtcgcctctataagaagcatccccacacgttctctccacccatcactgcagctctaacacaaagcagcatcacactgactccactgatctgcctccataataagcacagaagcgccccaataatcagcagcgcaggatcgagcgatcgct

SEQ ID NO: 1363 - DNA, 785 bp, Zea mays
cgcttggtcgtaaagattttcggttgtaacccagaccagtacacaagacactacggatacaaaagttttttatcgttagaaatttcaaattattttatatacgatataatctaaayaaaaccagagttcacgctttcggaccggtcgagtccgagcgttcggacccggagattggcggccaccggccagcacccccacccggtgcgattgcgaaccaaacctggcctcgtgcgcgcgggacccggagtgagatgaggataagatcggagaacagattccggagcgaaagccatgcgtggcagcgccgcagtggccagcccgagccaacacgcctttattaacgcagatttacaccccacgtgtcggcgtgggtcgcaggacccgatgtgccatggacgcgacggcactcggcacagtgccacaggcggggagatgcgagggcacgaccacgaaccgctgcaaaaacaaatggtttccgcaccgaatttcgcacgttactcgctcgcgacgcgagatggacagatggtttttgcgttggtcaatccgtcaatggaccgacggagagaaagcgggcggggagggcaggcgcggggcgcgttatctcgccgcggcgtggcgccgggagttatataaaagcgcgcaccgcggaggccgacgcgcagagggagcccaaggaagcgaagcggaagagaccgagagggagaagcgtttctcctgggttgttcgggtgagccgctagcgagagcgagacggagcgaggctttgccgctgcagagcagagcgac

SEQ ID NO: 1364 - DNA, 941 bp, Zea mays
ccagcccgacacggcgaacgggccgggctagcccaggcacgattgaagccgggccgtgccggtgctgggccgggccactttcgtgccgtgtcgtgggccgcccggtgggcccggcccagatggacatctatactgcgggctgcgagcctgcgactgggtcgggtccgcatgccatcctccgtaaatcggctgcgtgcgatgtggggcccagacgtcgatgtcaccgaacccgtcccgtcccactagggcgaagcgaaacggttccgttgcacggtgggggccgcacacagtagctcgtcacagtcacactctccagtggcccgggctctttttttgttattattgattttttttttccgcgcagccgatttcttttcgtctctctcgctctcgccttctcggcgcagcgcagtactacgagctagcagcaccaggcaggaacctcttcccacacttccgcgctcctccctctctctctcgagaatggttgtgtaggcgggcgcaggagggagggaggcgagagggggagctagggtttttcgccgccgccttctgttatcctcaggtgagcgacactcccgtagatccggcgcgcatccttcgcgtcgccgccgctgcctagatctgtgccgtttggggccgtagggcgctctgtttcgcgcgcctccgtgacggtttgggtccgttgcagctcggattcaggtttcttcatgctgcatttgcgggagttcgccgcgcgctcgcgtcggtgttttttttatcctgtgattcttttttggacctccgcgagggttgctttcgttgggagttgctgtagtaagaagctggccagcgtttcctgcggatgaattttggccgtggagtagatctgtgcactgatgtaaggttatgttgcaggctctgaaccccctccggtccggtgcgcggcagattagactccg

SEQ ID NO: 1365 - DNA, 1500 bp, Zea mays
agaatccacaatcatatcaactctataccaactacatcatattatgtcatttttttttcaattctcttttattcaccatcaaactacctccttccatatcacgtcagcgcacaggatttcatggtgccaagagttaaggctcatgtcctctgtaaatgaagtttttttgtggccaactctattttacagtagccgatggtgtacaccgttgccgctcttttcacactgtaatatggactccaactagatacagtagttcgtaaggtggatgactgcagacagcctcaacccaactttaaggtagtagtgtttagttgaggagtcaagtagaacggagtcgttccattcctgattctatgaacggagccgctctgttctgtgtttggtaatctaaaacggagtgactctattttttgtttggttgcagagtgaacggaacggagcgtgactgtgagagcgggatgggaacggagcggctccgtcccgttgatttttttggagcggaatggttctagatctgaggagaatattccctaattggagccattccgttctagttcctttgtaaycaaacagcaacaaaactgggacagaacagctccgttctacttggctcttcaaccaaacactacctaaaactacgtagtttctcgctagctagccacaggcccgcaagagcgagcacagcagataacacatcgccagtccaaatttataattcgttcaacttttttacaatatatatatttgatagacatattttattcatttttaaatccaaagtcatacttaaaagtgtgttactcactctattcttttttatttaatatcttttagtttaaaaatgaattagcgagcgacaaatatttaagaacggagatagtatatactaaacaatatcaaagagaaaaaaatataattatgatttttcaagaaggtgactcggtgaaatttagagtaaaaaagtcaaatgaattataaattagagcaaagtactattgtctctctaaattcgctgcagtaaaagtgttgtttaatgatcaaagcatagcatgccttttattaacaaacttcctggatcaattatgcgagtaggtagaaattgcagcctgtcgtctcacgcggttggcttttgatcggacgtccatggttgtgacttgtgagctcaccatgaaaccatcctaatccaagggcatactaaaaaagaaaaaagagagaaaatgcggcggtaggccccacctggcaggccgctcctcgttcagcggcggcttcacgcgtctctggccggctggccccactccccaacccggggcatctcggtactctgttcctgtatggaacccttccattcttgttcctggaacccagacctcaagccttcgccaccgaccgtcgagtcccgaagggagcagtgtccagaatcatcccccacccggtccgcggcgatcgtgcggaagctggcgacgcgggagagcgagtggcagcgagggttagctggag

SEQ ID NO: 1366 - DNA, 653 bp, Zea mays
agaggtccacaacttattagctgagagagcgctatgcatgtactaggggtccgcatctcagtagatggaagagcgcgggcgctggaggttcacagtacgtacagtagctgagacagcgctgtcacgacgtcaaggtagagcgcgtgagactgtaatctctgtctatatacacttattaaatttctcataattaattgtatagtctttgcatggaacataaaacttgcagatattttgttggagccaactactgccggtcctatctcattaaataggcttttagataatcctcctgcgcagtgcgcacgcatcaagttgcagccacacctgtagcccacagcccaacaaacgacaatagtatgaaaggaattccatgggcgatttcagctgaaacacagtatctaacgtgtcacgagctccgactccctcatgcggttatttataccttgtccaaactaatcacctgcagacctgctccctccaggtgtccagttccaggttacgcctccacagtccacactccctagttccaattccaatccaatccccattactccagctatcagtacggcagtaccaccccacctgaccgccccaacgacggtggttcttttcgcctcatctcctaccccgtgtgctcaccggcgttggct

SEQ ID NO: 1367 - DNA, 166 bp, Zea mays
ggtgagtattcgcccgcggcggccccgtcgagctatgtgtggcttactgctcgcatagcctcttccgccgtgggcttggattgacggcccggttgtttgctgaggtgaggtcctgctgtgtgtgtgttttgtgcagacgaagaagcagcggagggaggcgggggcg

SEQ ID NO: 1368 - DNA, 511 bp, Zea mays
ggtataatctattttatatgtcctcgggtcctttattctaaacatgggttggactgtaacgtattacacatatttgttatttgtcctatattgtaattttgatatagcatacaaattaagccatgtaggtaaacgttacaagctgtgtacttattatrtactacttgactacagtactacagtgaatgctaaactatataaaactcagacgtaacaattctttggattatttggagaaattggctggtttcctgctttgctagtgccaaccactgctgcttgtgacttgttagggttgaattgctagttgctactagttattgcagccttatctcttacttcaaaacatgataaactattggcagcttgtgatgtatctttaagtttccttaaagacagctctgcagacaagatgtcatctgaatttgtgattagacatacagttctattttgtgacactactaagactgtcttcagtagatcgtgtaaaataggggacgcgaaactgtag

SEQ ID NO: 1369 - DNA, 90 bp, Zea mays
tgtacgctttaattcatttttatttgttccacggtttaacattcagcagatgtgtttccattcttttcactgaaacaaacaggcaaacaa

SEQ ID NO: 1370 - DNA, 378 bp, Zea mays
tgctcctaatgtctacaacagtgtttgattaactgtgtaaacgtagcagtttcagactcgcgcagggcgcgagctaagttactggtcataacaagatgacggttttctcaggtcaaacaggaacagggagcaggccagcttccgtgcaatgccaccaagactccgttcccttccgtcctgccaggacttgcaaacataaaaaagagcagcgcacgaggccgaggcatcctcctcctcctctgcttaaatcctagtcactgctgcagtgcggctgccgccgctgctccatcacgacgacgccaaccacctcagctcactagctcccgcggacccgcctgagcgcagccaaaaccggggatcccaggcgcagcagctagc

SEQ ID NO: 1371 - DNA, 1500 bp, Zea mays
tccttaactaggagccgaagcaaagcattggtcagcagcaccgccgtacaaaccgccgcacgtcgctgttgatacggctgcgacgtggactcgcacgcgcgcgcgccggagttttgcctctcgtatgtcgatcgctgctgggccgacgcgccgtcgtagatttaggcactgtagatttaggcattgtctcaatctcgcgagataaactttagtagctttttgtagctacttttagccatttataatctaaacaggaaagctaatggtggtaattgaagctaaactttagcatttcaattcatatagctaaagtttagcaggaagctaaagtttattccgtgagattgaaacggagccttagatagaaaatagaatagccacgcgtcacgtgagcgtgcgtgcaccaggatcatactggggcccgggcgggtctcccatcatcattctgttctacaagcaccggtctttggggaacagcgcatacaggagcggaaccgcctgcgactagccacactagacagagctaccttccagtcatgctcatggcgtgcgaagagggacaaaaagaaaacacataaaacaggattgaaaatgtgctaattctttttcaaacaaagctatagtcatttaaaatagtaaccgcgctagttgtgtttgcttgcgcgggcttatactttgaattcaagcccttttggaatttaaagtccgtccaccaaatgtcatttaaaaatagtttcgtgttcgattggactttgaagatgcacggtgtagatggtaattaaagttggtgttaacatcgaccggcgcatgaagtcgtgacggcatgttgttagaaaactacagctgggcggtgggccggtggcggtgggctgtggtcggccatggacgtgcgctccacaagcaaaatgggtccgtacgcgcatccatcgtcctcgcgtacgccccgcgtcgccccgccaagccagcctgggcctgctggcgaacagcgcgcgtcgaaaccaattagcagcagcagcccatcaaatggccaatgttatgtatacttctactacttacaaatttcgccaaagttgagctggaattgtctcgttcgttcacaattcacaaaagctttacaacttcccttgcagcttcccttgaaccaacgtttgtttgcaacagctaataaactcctgggcaagcaacgccccgatcgcctcaaaatagctgcgcgcagcttcctggcagcttcgccgatctcctcgtagctgggagtatatagatactagtgcgcgtggtgcctgccatcttcctctcccagattacccgcagctgttctcaacttcccgtataagccgtgagcacttgatcagttgtttccgcgaccgggttttgggaatcaataaaccattgcctctcctagcttcatatccgcgcactctatagattcacgagagtttgctttgtccccccaattctcatcggtgtaggcggctcgtcttcattaattcgtgtgaacaa

SEQ ID NO: 1372 - DNA, 229 bp, Zea mays
ggtgtgctcatctctattttgtcacaatgaactaaaatgaaaggcatgcagagcaagttggactttttcagtcatggctgcttcatcttcaacatattttgccccgtgctgttgctgcaggtgcttggagaagaaggccctctcctgtgtcctgccctccatcatagctggtcccgacctcactcctcagcatgttcgtgaacaaggacaagggcgtcgccatcgcccg

SEQ ID NO: 1373 - DNA, 1458 bp, Zea mays
tcacggaggaaattttggtttctaaactagcccttcatatttagttttctaattgatttttaaagaaaaatgctttatgtcgatccactcatatgactagagtacgactaacacttatatatggctgttgttatcttttatactaaactaataaatcatgaaccattaaataattctagtctaatagtcgtatctaaatctattaccggaggcgtacataaaccgctgcttatttttaaaatcttctccaaaattatagcgagatatggattagctgtcctgcatctctttttgaaaatgtagttgtcatagggggaaacctaccaccttgttcccatcaagacactatgaggattgatatcgggtcccactaacacataactacataagccggtaaaggtcttaagggctgtacgagagcctatttaatatctctatctcttgagagacatttaaagagttaaataaacaaataagatataaaaaataagatatagtctatttatgaagagcctttctctatacgatttttcgttatattgtcttttacctacatttacaatatatttgattttaaggacacttcattttatcaagcagtcgtttaattgtgtcgtatacatctatacttgaaaattgatccaaagtgtcaaagttaggattgaacatgttatagggctttattctaaatctctagagataatggttagctaactaataagtagttagctagttttagctagattaggacagctaataactaataactatttaagaggtataactgacacttagtttgtttattttagagggtgtttggtttatagagattaatttttagtcactctattttattctattttagtctttaaattgttaaatatggtattttagtttctatatttaataatttagatactaaataaaataaaataaaatagagaaactaaaaattagttaccctaaactaaacacttttttaatctgttctaaagctctgctcagttttagaggtttgacagcaacccagcaccagctgctcttctcccaagctcgaggatatttttgtccgtataccaacatcccaacaactgacggaggcaacgcccccacgtggcgacatatggttggctgctcggtcgcgtggtgggagaccatgacctgtgagcgcgccacgtcctaacaacccgacggagcactccccgctccactgcgcgccccaagacctggatcccctgcgctgcctttctcttctgcatcattcgcaatctcaggtcacggaactctatccactcgtcagcaccaagctagctagtcctcgtgcccttcggacgagaggcgcatgtgactcggtaacagtcttgaggctttgagctctcctcacctcgtatccgtgtctttctggtgctgagctgagtctgagagacaggtaaggaggaggagggaggagatcaggag

SEQ ID NO: 1374 - DNA, 515 bp, Zea mays
cctcttttttgtgaggagctgcaaacactttagtttgcagcagtgctgcaccaaatttttttccctaccccgtttggcttacggtgcacaccatcccgcagcgcacacacgtagactttgcttccacgcctagcagtagtcgcctacagctacagcttgaggcagctgcccatcggccgcagaagggatggctggacgagagatgcggctattggagcggcgacgtgcgggcgatgatggaggagaaatgccgagctgttcgagcactgacggaaacaccagcagcgctaatgcgagcacgagctcgagcaccactgctagcagcggcgtgcggcggagcggtggcgcagcggaggggcgggagaccagctccaggtcggcgggcaccatcaatctaagtcaggagtacaggctcgcgatccacaccccgtcctaccaagagatctgggataagatccacatagacggggacggggacgaacaacgggaagggggcttcggcggcaacggtgaag

SEQ ID NO: 1375 - DNA, 1500 bp, Zea mays
tatgtacatatttctatggggaatcgtgctttaatttttcattgtattaaatgtcttaaataaaaaaagagggaatttgatctgatatagattatagccagacttttttggcccacctaattgtaattacaatatatcttatgattgtacatgccctaaagtacagatgccctaaaagtacagaactgaagacgggcggagcaaatcaatcagctgcccatcttttgcatggaaaacctcgcatgcaaacaatccgcgcaccgtagagaagaagagacgatacaagttacatgttcacgtttctttcccgacttttggatgcatgcatgatcttgtcgatgcatgcacgcagctcaaacactacctgcaaccacatgatcacgctctctgcatcagcaagcatctccctttttcgtactgactcacatagaattatattcggatcacgatcagcacctagcccaaaggcatgtctcttttttactcggcgagttggcagctcataattcgggtccttacaatatatattttttttttttgcaaacctgctgctctgtgggagaagggggaggagcattgcaaatcgcgtttaggaagagcaggcagcctgcctctctcctgtcaatgcatcatgcaagcaagcagcagttgcgaattgcgttccaaaccgatcccccaactctgactgtccccacgctttcaggccgccaactttttccccgcactccctctggcctctgctccggtcgtccaatcactagacctttccctttccaggaccgcccgctcgggctcgctccacctttgcctttatcttcttcctgcaaccacgatgcggctcgacgcatggagcgtgaagcaaagcacacgccccctctggcccctcttctcacttgcccctccctcgcctcgttccattccatctcgccactccattctctctctctctctctcttcttcgatcgaggagagcccatacacatccagccagcacagtagcctgcctgcgtgcctagtccatctcgtgtgcagcaacttcaactactagtacatcgcggcagctcctgctgtttcggccggctttatggccatcacctcacctgcagcaacttcaactactagtactcgttacagccacagcggctgaccacagcgcgcgcagtaactctgctgcagtcacctccgtcacctgttacgtcgccgtcgcgtcgccatggatcatcggtccttgatggggatgatgcatcatgcatgggaatgggagtgagtgctcgaggcaatatcgagagagattttctggtaccgcgcgctgcattctcgccgccctgtttgtgagttgctcagcaggcagcagctggtgtcggtgctggctcttgatctggatcttgccatcttagatcgcggcagcgagaagcatgatacctgctgggcgtttctttattattgcatctcgttgatccggtccgtggtggtggacgactggtggtgcgcgcgcgcaag

SEQ ID NO: 1376 - DNA, 892 bp, Zea mays
ctagcgtttcttcagatcaaaacaaatataaaagtaaacctttttggcccccaaccaccgttcaaaacccctgtgagaagcggaaacccaagcagtcaccactcaccagtgaggggaatgacgaatgcaaaagaaatggtctgacctttttgatggcgacgcatccagcatcattgtcttccgagatctcctcgatcttgacggtggcgaaggggcatttcttctccttcttgacagccttcacctccttcttctcattcttgttcatggtgatcttcttggccttgttcttgtcggccgcgcgctcctcctcttctttgtcgctgtcgctggcggtgaagtcctcctcccaggtgtaggcctgggaccagggctcgagacatcccttgcccttgaccgcggcaccccacttgagcttcctggcgctggctgcggaggatccgcccttggcctcccacttccacttgcggtcgaagccgtcgtcgtcgggggacttgatctcggcctcccacttgagcgtccgctccccggcgcgcggcttctcgacggaagtccacttgaccttgcggccgccggcctcagtgacataggtgcgcttccgggtggcggggggtccggggcggcggcgcgcggtggcgacggcgacctcgagtgcggcgacacggttggtgaggtctcggagaatgagcggggtgggggtgaaggccaagaaggggtcgagcgccggcgcggggggcaggaggagatcatctaggtcggggaatggggaggcggcggggaacggggacgggtaatctgagacgccgtcarggaggaacgggcaggaggaggaggaaggtggcggcggtgggaagggggagaaggggtcttcgaggaggcgtaggaagtggcg

SEQ ID NO: 1377 - DNA, 285 bp, Zea mays
gattgttatgtgatttgggttgacttgggcatagagctcagcccaagaggaccatcggggttaggctttgtaaccctgtgaagacactacactataatacaattatctcttcacctttcagtcccttcatgctatatcaccatatgatatttgcatccggtcctggatttctatttcacaagattatccttgtccatgtttaagtttttgcatgctatgtcagcgttattgattaattattttgtcttatttctgggcttgttcaggtcagcttgattaggcaat

SEQ ID NO: 1378 - DNA, 466 bp, Zea mays
ggcacaccggactktccggtggtgcaccggacagtgtccggtgcgccaggctggactccggtaaaaaggccactctcgggaaaagtttggcggcgtacggctataattcaccgggaagaaatctataaggaagaacaccatggtattcaagttgatcattggatcacttgaaaggggttgagtgcaaccctcgtccattgggacgccacaacgtggaagtaggcaagtgttagttggccgaaccacgggataaaattccgtgtctcttgtgttgcttctctcttcgattgtctgtgtttgcaagagctcgcctcattgacttgaataacttgtgctaacatctctttgatcaagcttgttggaatttagtgttgaattttgcaggatcacctattcaccccctctaggtgctctcaattggtatcagagtcgttctcttcacataaaggactaatcgcccgaagag

SEQ ID NO: 1379 - DNA, 1500 bp, Zea mays
ttttcagccctaattttttataactgttcatggcaaattgagtgctttgaacgggtataggtctcttcaaatagacacctagatctctttaaataggcatctattcaagatgtctttaaacagacttcttttaaatatgcatttttatgatctttgtaagacgtcttttcgtatagatatcttttcaagattgtttctttaaatagacactttattgcgtgtggattcttatggatttaagatatcgttaaataaatttctttttaagagacgaacatatcatgtgtaaactaattgcttggtgcaaacgattttttcacctcccttgatatatttttaaatgtatcttctcacttgtaccaatatattgatttgcacaagtcttagagcattttcaactgttaggtaaaaaagttactaaatcttagtttaagaagttattagaaaaaacaggtatctaatagtatcctaaacgatgttgctaaatttaagaaattgctattttatcctttcttgctccgccatatttagtaaccaaagagggactcctcaaagcactttttcatgcgaaattagtgttctatgccttctgtttttattcccttttatttttttattaataaactctgggctactatgtggaaattttttttgctgcatgttagacatttttatttctctagtttggaatttaagtcatatttagaatcgattaatcatagagatttgtgtctgttttatacacagatttttctgtatgcagattttagaaccattgcaagaacaataatatcatgtttcatgggaagagcataaaactttatagaacatgagagggacaggagtttctagatgatataatttaaaatatttggtatctaaaaatatagaactaccggagaatacatagtttttttactccctactataatttagtaactcttagcatctaattttagggagttttttttttacaaaactacagatgctgactactcgtttgcttaaggggtcacgcatgccgcatttatattttctggtacacattaaaataccattgattaacaatgtatataggtacggtgcagtgatattggaatttcttgtatataacagcaactttatttttgaagtgttgagtgttgactcaacaatgatttttcaattgttatgttccgcagaatatgcttcatataccgagaacgcgtcgttgtctttcaaaaaaaaaaaacaatgttgaatcaaatgaagatataatggaagaaatgtattgtacccattcaacttcttcgaagcttggtcgtttaagcaagctacagcttgatggacaaagtcagcacttccctaattttatttatcatgaaccttgactctttgagtatgagtggtgctaacttatcacacagcctcatcaagaactgatcgtgacgtgacaaaaatctatcaatcgacacccctcctcgctcgccagttagctaccggtttctctctcgcgcgagg

SEQ ID NO: 1380 - DNA, 1017 bp, Zea mays
ttggcctcttccgatggccatccaaaatagtgcttacctagatagtcgaagtgaaggtggccttttaaggatgcaaacgaattagggggttagatccctccccgcttctcctcacttctttttatataggagatacatgaggggagttttttttatttcttcttatgaagtttgaatttacaaatgaggttccagagctacaaatgacccttagtcattattttacaagcctcttcactatataattagattataaacttagtaataaaaaaggttcctaacatgcaatacattgttgaagacaacatttggcatacattggattatgggatgatatgccaaaagatttatgaaagaaaaaagaaaaaagggacggacagtatggacttatattaggtggcccatctaaaagcccattagtcagcacaaacccaagttccaccagacccacacgtttctttaccctaaccttttcgctgctccagcgaggcatacagccgccgccgtttcttcattcttccttgcagcgccggcgcgccatctcggtacgaaggcgacggcggcggcgacggcggcgttcaggatcgggatctcagcgacgacgtcagaggcttcccatcccgacccccgccagtcgcctcgcgccctcgactccggactccggtcctccgcacaccggccggtgaccctgcgtgcgtgcctctatctcacctaccccctccggtggatcgtcaacggcgcccggccccagcggctgtgccgcgcgcggcctgagggtagctggagtcagcagccgctgctccactaaggcggtcgcgccgctttaggagcgcttatgccccaaagcgaagcgttacccgtcctcaatcgtgtgcttagtgccgctttttggaaccatgtttgatttttaatggagatacatttatttgaaatataattgatcctgagatatattgggtattgcggttttgtttatccttcatattcaggtttgaacctgctatagaaatttataaa

SEQ ID NO: 1381 - DNA, 774 bp, Zea mays
ggtgagtgtttttttgttagcagtggtgaaatagctttctactattcttgctaatatctttatttttgtgcactcagatattggcaagggaaatctgtggttgagccatacgctgttgatctcaaagaaatctgctgtcaacaatatttaacagtggtaaatctgtggtaaatatgtgggaaatctgtcagatatttagcagtggtaaatctgtggttcaacaatatttaatagcgttttgttgtatacttacattgtagagctttcggctgtcaacagggaaatytgctgggatgctttcggccatacgctgttgatctcaaagatcagggaggagtagagatctgtgaaggatgtagtagagatgtgtgaaggcaagataaatttagtactgcaccattatttaaaaacctctacatcctacatgaaaattatgaatccctcattttcagtctgagtactgcaacagaaaaggaagcagcagaaaaggaggttgttctgtaagttctgtgtactgctgttttgtgtactgttgttctgaagttctgtgtacttatttgcaaacttaatatttgtagttctgtgtactgctgttctgaagttcttgtactgattttcataatagatgatttcctttgtaccatatccaatctcatccatgctgaaatcatttgaaaagaagcagtatcactttgtgcttttcatgaaaaggcttagtatcttttgggttggcacttaattacagaaactttattatgtaattaagcaacatag

SEQ ID NO: 1382 - DNA, 172 bp, Zea mays
cctcgatccgtggccccgtcgtgcagcccctcgccctcttctatggtaatgttgttgcttttctagttttctgaacgaataaatatgtatgtgatgatgacagtccacttagtatgatttaccaactattagtaactttgctcatatcattgtgatggataatgacagcgcc

SEQ ID NO: 1383 - DNA, 614 bp, Zea mays
attttttcacttaggccttaaaaatcctcaagaaacccctcatttaatattgtcggatggaaactctgttcttcactagtggctcaagacggtttatggcacgtacaactcacataaatgatttgtatgttaagaggcatataagggaataagtgtaaaaaatcacaaaaacatattttggtgaatgaacatatctagaaggttcttcatatctaagatacaattacacatatataaaccacataaatgagctatattttaacggtttctactgaataagataggcttagatatattagattgtacaaataagtttcttaagtgtatgtactgtttagagaacaacaacacaatatctaggttatacgtgcccttatgtaggtggtaaattaaatgtgtcggacgaagtcgagtttctcctaaaaatcaatttcttagtagagtatgaacaaattaaataccgctacaaataatgatttttgtgtgttgccaagctgacttcaatggagcatgtgattccactctcaccatccggtctataaatgaagccagatcaaggctacgactcccatccaaccgcacaagaattgcatcatcatcgttagctgccacag

SEQ ID NO: 1384 - DNA, 214 bp, Zea mays
ggttaatagttctggttccattttacttcaccgttcttcacattttttgtacaattgtgctctgtattttatccggcttatctgtgctgcagtaagagtgtgcaggatcaagccggtggtgaaccaacggtgggggtggtggccgaggtgaaaccggaaacggatcgaggggatcrcgaggacgrcaagagtgtcgtgtccgagagcgrgagcg

SEQ ID NO: 1385 - DNA, 288 bp, Zea mays
cattaactgatcattatcacatatttaggagatctctgaaatagaatgagccaggacatgcaggcatgcaacaaaacggaacaacgcatgcttgctcaaaacaagaagggccgctccctttaaccccacgtgtcagccgcccccayctcgctttcccggcctctaagctcttcacatccccttgctcgtcctttccctccattaataattacatccgtctccaaaaggtctcctccctcggtctccctcgggctaggctagctagctaggttaccactctggtacaac

SEQ ID NO: 1386 - DNA, 305 bp, Zea mays
ccgagtaaacaacaccttgaattactcagcacctcatcctcgattaccgctgctttgctagtggctaagcatgcttatcttaggcacgaatcctagagagtcacagtcaagtgcccaggtctaaaacaagtgttaaactcggagactgatgcggctcaagtcttctgcaatctgcaaggcgtcttcattttctgtccgctataaaaacaaaccctggtcagggcatggcaatggcgtgagatctcaccttcgcctatctgttcatcgtccccccttcgtcctcctccccgaccccgacgtgcgac

SEQ ID NO: 1387 - DNA, 1500 bp, Zea mays
tgccgtcgattgctgcctgcgcgtcgtctccgcatttctgcgtccaaggcgagagaggcctctgactgagcggcgcccgggtgcgctcgtcgttcctggaacgcatgggcggtccgatggacgcgttctgcctgcgacgctgcccctcagcgaatgctgctgctgcgggcgcgcgttcggttccctggaacatttccttcgttcgttgggttttgccgcgggtgtatgcgcgcgatgttattagttgtgcatgtgacctgtgtaggagtttggcgccggcggcaggaggggcggtggatcaggtgggtgggtgccgggtagtgtgtggccgtgaataagggctcagccctcgggcgaggcgagggaggagggggagatccgttacaaactctccagagcacggagacgtcggctaggatcgtaatcctgctcctgcatggatttctctcgattttttttctgtttccagttatattttgcctgaattgatggtgcagcaaatagtactttgagttcttatacagtctccggctctccgcaagatttcgttcttggttgccgttcccgagacggttgtagtacgtctcttggtcctcgcgggtggaacgggaagtcgacgtgttcttcgacctatctcttattctcttttcgtgtgttcgtctcccaacccaacaacaaaaatgggtcctccgtttcgttcttggatcctgcgctcttggttttattacttgtatttgacttgtggacatccccgtttcatcattgttgtccttaaacaactccaaaagtgctgccttttccccccctcctcgcgtcgagtggctccacgcttccacttggttccgaagcactttctgcaatctcctcccatttctggtatgaatctgtcctgcatacgttttggttagatgcacttgattttaggtgggccgggttgctaatttggggttgtgactattcgttatgactttattcaacctcatgttcttctcctggttgcttttcatccttggatcgtggagtaattttctatcgcaaagttttcctagtacactttgcttctatatgggttcagagtgtacaaggaagaaaagatccaacccaactgggactgagctgttgtgattcacatgtctaactcccgaaaagaaggcagaaggtcctttttatagctttcctcagtctgatgtgtgcttccatccttcgctttcgaaatctcccttgtgtttgtgtacaccattgcaccaccaccytttaatcctttactatccagtccgttattccgcgagtacgttgatgatccctccttacggcagtaaggattctgcaaaagtatggctcccttttcccttgattgttgcggggatttgtcaggaactaggcaagaaagtcagtttttttatatagtcttgccctgcatcttgattcagtacatagtgaaatagatttccaggactgcctggtggttaatggttgtgatcgtgcaggtgtgcttcagct

SEQ ID NO: 1388 - DNA, 1463 bp, Zea mays
cccttaagaggattaaaaaagattaaatcactttgttagtcaaaattgaatagaaaagagtttaatccccttcaaccccctccgatcccagtgcaataaaacaaaggtcttatgatttaatcatccatacatcaatgcagaatgtatgctttttttaaaaaaatatcaacgtgtaccaattttgtcaaacgaatagtccaatcatatggatgtccagtgtacaaagttgtatatcaattggttaacttttgaactactattatgatggtctccaatttgtagcgattgacgatataaaaaaatacttatgcctcaacagaatgatacagtatcccactctactcgtttgagcttgagttgcttaggcttttgtttggatgttatagtgttaaaaactatagttttagaagtcattgatttacaaaaccatacttttaaaaatgaggtctcgaatgaaaaatcttaaaattccaaaagttttaataccattggtttcaaaccataatatttgtttcatttgcatccaattaatatatgcaactctaaaactaaagtatttcacaaagctatgatgttttctaaaattccaaaaaaatattttacatccaaacagggctttagtatttttcttcatcgttacatctaggtgcaagtggaactgcttcatactaaatatgtgcatttccattattagaatgtccaacttaaggaatataaaggtggccaacatctcactttcaatttaccatttttggcttaagattgcatcaattgaccctttatctcattgtctccatcaggcttctgagctgaaaaacacacatcttggtctgggttagtgtttttttaaattgctctgattgtcgttgtttttgttttaaaatttgaagagtataattgacttcctatggatgtggatttaagctcggttcatcttgctaggcttggctagacgttgaaaaatatgataaataaatttcaaggagagctgaaaacacgtgagctggctcatctcatcatccaccctcgtgcatattgcaagcaaaaacaaaaaaaaagttttgcctcatgaaacatttatgggatgatatgactgacaagtgacaagcacgcccgtatcaggtgctgaccaccagccaaccggcaaccgccatccgattcacgtagtttgatcttaaccgtcggattaagattttgacttgacgaaacggatcggttggacaggccgaaaccgcgacgtccacttcggggcatctgtgtcttttgggtttggcccatttcttcgcttccttccgcaaccgcaaccgtgcgttcctcccccgttccaacccccgacaccccccaatcgcaacagtttcactgcgccacagtacaaatcctgtctcgcaccgccccagccggccagaacagcgacaggcccctcgcgccgatcgccgggcaatgggagctgggcgggggcggtg

SEQ ID NO: 1389 - DNA, 705 bp, Zea mays
agtggattcatagaaaacaagttatggctgtctctagcccgctttcactctatttaaacttcgcttgtagaatagtatggactacgagtttaaaaatagtattttatatgatcatatgtacaagcgcaaccttagtccatctccgataacttactcatttatatctattatttacaactctattttatataaatagtgcaatctatagcgtaaaataatattttagacgatcgtatatatattattagttgtctatagccctattataaataaaaaaataagcgttgcatccaggggtggatttagaaagggcgaaggaagagcctaaatcctcgcttatttctatattacaagtagtagattttaaaaaattatcataaatatctctcaacctaacttaaatgttttcactctaatattttagtgattatctctgtacttccactgttatttgtgttggatctgcctctgggccgccaccacgcacgcaccggcaccgcctataaatacttgtggcagccctcgccgagctgctccttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaag

SEQ ID NO: 1390 - DNA, 711 bp, Zea mays
aattctttcttaccgtatgttttcttcactgtttgcacttttctactgctagctaagttaggcaggatatggcgttgtagatagatactggtcgaacttgggtatttcgtggctggcagttttatcttgttaccacttgattttctgttgaaactcttattatcataactgttcaacaaaggaaacgacaagtctggtccaaccttttctttgatttgtgtttcagtgctaggtaaaaaaaactgatcttttatcctaagaaaagtagatacactataagaattttgatgatttactcttatccatttgagcaaggacattggccaaaaatatccataaaattttgtaaccttttctgacgtacaaacgtttgatggtatactcttatccatgagtttgttagtattaactgtacaatcctattgggccttgtagctgtagttggactgggctcttttcttgccgcccaagctagcagcgctgcatatatgtagatataaattgtaccgctttgcatactaaggaaaagagcccagccctgctgcaacacaaggctcaataaggttgtacgagtgcctccttcctgtaacttaaaacactcaaaggaaatgtggcaggttttctttttctttcttttttttttatttgtaagggacgtatttgttgaactgtggttgctgggttcccactttctcaggttctaagaagacc

SEQ ID NO: 1391 - DNA, 1500 bp, Zea mays
gacgcgactagttcaacccgatgaggttcgtggagggcatttttcaagcgtgcaacatctgcgggcgcattcatcctcttcaggcttaggatactttcgtaatgaccttaacaaagatcactcaacgttgtgtgacttttcttaagcttcctcgactaaatccaagtgcttacttcttcaccttagctctgttacctcgatccacaagccatatgtttgatattctcttttgcttagtcccttgaagttcttttccttgctatcttcactccatcaagcttttcttagttcacaccatcttgagattacattgaatattcttcttcttaagatatgatcgatgtcaagatttatttcttccttctaacacatccttttgtccatgagcaaaccttttatgcatgagacttctccaattcatcctcgacttaagtctcatcttgtaagtgttaatcttgtttgctttctctattgctgtgttattccatacagtgctatagaaccgtgtctcctaaaggcatgtacaacctagagacaatagagcggttttctaaatacaagagacagttaagagacggcatacaaccctaaacctttagatcataaatggagttaagaaataataagtatagaaagtcatgaagagacgagcttttcgcgaagagctcgtttcttgattttttttttcacttaacccattatacacctctcaagaaacatctgaattaatggagttgtagatgccctaacatggaagcraattattgatgtactatgtaaacaataactgttaatttaagatatgtttaaatggaaaaaaggaatactagcgtctttgtttggcgccatgtaatctgtctcaagaagtgattagaaatttggttattacgtgatgraggactaccatcaaatcaattataaaatgtatattttcgtaataattgtagtgtgatacaaatgctgaattatattcaccataaacctataattaaagttaaactagtttaatttttacaaattgtgtataattgcatttactttacggacggggtacgtacgcgtcgttggttcgctcgaaggtaggcaggtagctatcgttgcggacaaagataaaactgcgcatgacatgtgctgtgactgtgactgtgactgtgactgtgactgtgaggctactgcgcatgacatgtgctgtgactgtgactgtgactgtgaggctgtgactgtgagttgcatgtcaccatactcatgtgccacgccacacagctcgcgggcaattcactacatgccaaatctggaggcaagagaaccgggagagggcgtgttgggttgctcgtcgtgatcccggacggcaatacctgcccttgcctacttgccactgcttgcgtacactgatgtccttattcaatcccctctagaaagtagaaacattgcttaattggcttggctattgctgttagctccacacaaaagagagaaccggcggcgagctaggagctagcc

SEQ ID NO: 1392 - DNA, 244 bp, Zea mays
aacgccatcacgtgacgtagtacaagaggacacacggaatatattctagtagtattctactggtgattaatcttaatccccacccacccatcatccacatcctccagagaaaccggcgagcggggcttcctggaagctgccgttgacccccgacccggaggcataactagggtgtagggggggcggcctgtagtgtagcgcccctcgactcccgagcagcaaccaaccagcaaccgagccagcc

SEQ ID NO: 1393 - DNA, 215 bp, Zea mays
tgtaaggaatggttcttatttacatgcttgccagctcattaccatgcatttcagaacacgttgagttttactacgaattattaggcaaactgctcaagtataatgccaaagacggttattgggagtgccaatattctaagacacctggtggacgctgttctcacgaagcccgccgttcggagttctacaatcccaaatagcatcgtcatcgcaaa

SEQ ID NO: 1394 - DNA, 1492 bp, Zea mays
ctgcgaatgtagagaaacaagccttcacttctatcatcattgggcggagtcagaacgaacgctcaacaaaataaagaatggcgaacgtcaaaataaactgcaaatgtacaagggaacgattcaacctatcagctaaataaatgttcttatttctttgcatcagacatccaaggaaggattaggcagcactagctctccagcctggcagggcgaaagctcttaggcggcaactgcgaatgtagagaaacaagccttcatttcatcatcatttgcaatcaaaatccatcaagcagacggatgaaacacttggccaagaagacaatgctacacaaaaatatgtatagctcaggcatcgcaagaatttacagcagtagctagctctcgggcctggcagaacaaaagctcttacgtggctacagcgaaagttcgtgtagaaacatgtaatcacattaaccggctctgtggacacatagagaagcagcccccaggttcctatcaacatgtgaaatgttgaaacaactttgttttggcctaatcatagcatctctggtcaatgcgttcgctaacagagacgtggcatcaggcccaaatttcatttcattcagttgcttactcattcggacacataaacaaatgtttgcatttttagagttttaaatttattctaaaataaatacatcactaggtataagattagggtatatataactctgagactctagtccggttttaaaatacaagagacaactaaaagagtgcataatataattctaagactctgaataataaatgcagctaagagacaacatttatagagtcgtgaagagtgaagagacgtgttcttcgcgaagagtcaatctcttttttcacgtagatgctaagagacccgtcaagaaaccacattttaaatgggttgtacatgaccttatacacacactagcattacttttatcctttgcttactcactcggtaacattatttttagaatttatcttctgaattacgaatttctgatgatgatgaaccttcgagacaatcatttatgttgtctcgtgtgtcttgtgtaggtcgtcccacggcacggcaggcaacggtaacaaaactagccgccgtaacacggtcggaatttaagctactgtttcggagcagtgtactatgggttccccactcgtgcgtatggcatacggctcggatatgagtagttgtttcgcgtgcctataagtttgactgctcaggcagctggatacgccacaaagtttcgcggcaggtgtgtcgattcctctccatctccgatcgtgcgcgtgtgcgacccctatatatatctggagttgcccgcatgaccaaaccacgtctccggctccggcgtccgcttccaaccaactcacaccaaagtggcgacatcgccttccgccgcctgacacgtctggagttgttgttttagccgccagctcgctcccatctatctccatggagtctgctcccgccgcggtc

SEQ ID NO: 1395 - DNA, 853 bp, Zea mays
tgcatgcctgcagctcaacctctgataacaagtcccagagttgaagatattctatcaaaacccccactgagagagctcctttaataccagaaacccatctcctagtcaatatagcttcttggacagtcctgttgttgacataccgtttaggaattgtgtcaaacaacttaggagcaaggtctgcaattctttttccatgcagccacttatcactccagaacatggtattggacccatcaccaacttcagtgacgacaacctcagaaaaaaaaaggctcgagctttttggggaacatgaatagggagacctgtccaagggcgacttcaatcagtcttttgcagccataaccatctcatgcgcagagcccagcaaagctctgtaaaactggaaataccaagccctccaagctgcataggccggcacaccttcccccaagccacaagacaatgtccaacactccaactctagcttcttttcggcctctccataagaatccttttctaattttgccaatagcatcgagagcccattttagggatatcaattgccattgctagatacacagtcatgctagtaaggacatgctgaacttggactctccttcctgcccttgttaataggccagccttccaatttggtagctggtctgcaattttgtcaacaaaggacgggaactgctgtctaggctgtaaggataaaggaagccccaaatagcagcaggggaaggaagccatctcacaaggcagcaagttctgagcttccaacaagatctccccagagcaacggataggatatgcattagatttttgagaattattcttcaaaacggaagcatctgcaaagagctgaagg

SEQ ID NO: 1396 - DNA, 1343 bp, Zea mays
cgtggcttataagcgttagtgtatgttgtctgttgctcagactaaaaacgttagtgtgttgtctgttactcagatttttgggcggcgcgggactgtccgtcgatggcagaatgggttggtggcagaacagtcagaggcagactactattacgtacttaataagtagtagagatttagatttaagcgagaggccgtttggatcccttcgttttgaacaaaattgaaatttacttaatatattttgcacaatgttaagtatttgtacaacaactagataaatgcaaatgcaacaactggtaagtagtgtaaatcacgaatgataagaaatgacccaagatatatcctcgaggttcggttacttgctggtaagctatattcttattatgacgattccaagctaggtgcttacacgcaaattagtattatacatcaaaacctataacaagaatgtcataagaaccacactaaagttttcgctgaaaaataaaagaagacttctaagtggaaagatgataggggaacatttcatgtctaaccatgagtagatcttgattagatcactcactggcttctacgacggagatggagggcactttaggccttgttcgtttgtgtcggattgcacccggaatcgttccacctaatcaaagtttatataaattagagaatcaatccggttaggaatcgttccgacccaccaatccggcagagacgaacaaggcctaagggcttgttcgttttgagcggattgggccgttcccggccgtattctaggcagaattaatgagtctggtttggaatacgtagaaccgttcgttttgatgttggccagaaaggaaaccacatgttttggagtcaacccttcaatttttggcctggaacaaacacggacaatccacctcctggattggtttccagcctagaaacagatgagtgaccagaaataagtgtccactcaatcctggactggattggttactcatctggttttgatccacgtctgccgaacggggcctaagctggaaccaatcttgggctgccgaacggcccctaaaccgaacggcaaccggcagggccgggccaaatcaagcagcaaactgcgaatgcgaaagctcatactcgcatacttcaggtctggaatgctctggccgctacgagagtccgattgcccgaaaccgctataaagctatgtcagcccaacgcgcacggcacgcgtccaggctccaacagcacgacgcaaccgaccccacattccctttacgcgaagaagcatcaccgcgagtcgtcctcctctctgtcttcgctcggcgatctatcaaggaggccaggagggtgagggggag

SEQ ID NO: 1397 - DNA, 643 bp, Zea mays
actggataaccgataatgcatgtggttaatccttcctctttatcgttgcacaggttactggtattcttgtgttcatatgttttgcaatcggctaaccatgggcattattttgtgatattcatggtcattctaaggagattggactttatgcgtaatggrtcgtgcaagtatacttgcgtttatttgcttgattaattcggtgagtactcatatgcaggtaccgttgtagatataacgtcatagaatacctattgcatcctttttatccttttgatattttactatcttttaaataacacaaagtcgaaaccaaagaatggtcgacgattagttggttgttgttagaaggatatactatgatatagttggaaacgaggctctaatagactgatacacagtgatattgatgaagaaattccagatccagaggaatagaaacactttttcacaaagggagaagatcatttggtatggtagtatcttcattgaaaataatatgaaaaaaataaaaaattaaacagattattcgttgaggcaaacctatgatcaatcatacatcataggttggtcttctcctttgtagcgctacagtgcgacgacgcccagggccaaggtgctgaaggaggtgaggaacgtcgcagta

SEQ ID NO: 1398 - DNA, 883 bp, Zea mays
gttgagattttagatttttgacagtgaatctratttaagaagctgaaccaaacacacccctacattgtgcattgttacatgttacaacgcaacacgatgttgtgttataccgtatcataataaaatgtgctatgctttttgttccgctaatcccgctttttggtacgcttgttccataccagtggcgaccctgaggatggggcggaggggccgccgccccggacccccaattatataggccccaaacctagttatacatttagtaattagactatcagacacaatagcttaatagtgaaatatcgaataattagcagctatgaagggttcacaacccagtmrtatttaaacatgttaaaagaacttttaaaataatactacaatatatatctttttatttatttgtttgcttgatatgaatatttttatatgtgtcttaagtttatatattgataccatttttatataacaatagtttaatggttctttattttaaatttgccccgggctcctaaaccatccggcccgccgctgttccatacttaccagaccagtctgaccctcccatarcttgccgagccccgtttagagaaacaagcgcacggacctgttagatacggcctgattttttaaccgtgatcttcactgagcccgtacactagtcctcatccggaaaaaagtatcaactcccaaactctcttcctttgccggcctcgtcgcgcgcccggctcgcctatatataaccgtctcgcctcccacctcattcatcaaacggactcacagctcgcagcacctgcaggacattgagaaccagccagctaaccaaccaaccaaccggcggagccaaagccaagaaggaaggcaacgtgcccatccagtcagg

SEQ ID NO: 1399 - DNA, 1500 bp, Zea mays
gcaacctcctggaagcgttcgttggattggaactggacggacggcctctcgcacgcggtcaatgccatgctgtgctgtgctgtatacaccggaaatttcttcggacgttggggctgcaactgcaatgcaagaatcagctctcaatccggtatcccgctactttggttttcctccacgattggttagttgaaaaaaaaagacgagtacgataagtttactttattatactatataataacagaataatggtggtatgcagagaaataaataaactaggaagaagccaacaacagttgggggcaggaggaggattagctggtaggcacctttgcttgaaagggaggttttatcggtcaagctgcagatccagaggcactgaataatagaaactctccgagagaaaagcgcaaaaaaaaaaaaagcaggacggcaatcgcatgcttgtaagtcacataataatctttattattggttggatatttgcgccgggaccaaataaaatatacgtattatatctctccaccatttaatggaaacaggcgacgatgaccgccagcaagtgaagaatccagccacctgcccgcgtaacttcttcttcttcttcttctttcgtcgttctactcccatcgaagctactactgaggacgggcgcaggcggagaacgagcggatccgctagcaggggaacagccggcgcggaggtcagtcgttggtctcttcgcgcgaactctacctcctcctcttcttcttggtggcttgtgtgggggcgattggttccggtacccgaaatcaagaacgcggaaccggcttgtttcggacctttagataataataatatatatatgcacgtaccttgtgttgtctgatgaaattaaaggtgtgggtcgcctttgctgcttggtagaagattggggatttcttgttgaggggattggggatgagtttgcgaataatgcaatgtgagtgagtcatgagagagggcaagggattagtttttgtgttgcgggaaccacaagtacttgtgatggggctcgggcatggggctctcaataccttcttttggaatacaatcttgttcttcaaatagaaatcttggaattgggaccctattattgactcctaactaatctctgccttctctctaggacagcttgctgctcttgttcctatagaactgaagtgaagatagttttagtacctgcattcgatgcaaaacttagctttgttcttattctggataccgatttaccataagatatccatgcctgccattactgagtgaagtttagtcacagtgagatggccactgtatagtatagtcttcatgtttgtttcatctcttcttgataaagttgttgtagatgctgcgcctgctctgagttgtatcctatggttattcacttgggaagcgatgcatatttccctttttttttaatcgtagcgccttgttgacacctttttgtgtgtctctctctctgtgcaagcaggaagggtttggagg

SEQ ID NO: 1400 - DNA, 1011 bp, Zea mays
tttgtggcaaattttgtcttcacattaattgttcaatttaaacctaccattatggaaataaattacatatttatttctatattaggtagtattttccttctttcccttttctttttaagttgatttccaattctctaacttgcagtttagattgaatccttatttgtacattaatactttctattaatatttctatttagtgaatgcacaacacaaaaactcatcatgatgcttagatcattttaggtgttattaggtgattgtttactttaaatatgggtattcccatgttcttttatacaaatagcaaatcacataatggcatatactcttttcacattattcacaatttgggtattacatatgtcttttgcgagtgtcaaacactagtacgctgcatttcgtaatgcaggatagagtctagtcttgtaataacaccgacatcttaagtcccaaatacaacctaatagctaatgtgctcctagcttgcattgcaaccttgcacttgaagtaatcgctgcggtggcatgcatccatgcaccggaaagacacaaggaagccagcctttccgcgttgatggactgaatcgaagggaaaaaaaaggtgtggttccatgaatataatcgtgcactagctcgtgccaattatctaagcaacggtccatatatacattgtttttttaaattcagaatcttcaacccattagaggactcactttatatctttaggtagtgttcgttaaaatactgtatggagcatactaatacaaaggtaaattaaagcatcttggaaaagaaacaagaaaaaaagaaattaatgtaaacgatatctgggatcgggcgtgaaaaggtacggtagccggttgatgagtaaggggagccggcagcagcctatgcttatgaacaagacttgcagcatatgcaccactgaagagttcagctaccctaccatccacactttattcatctcagggcagtagccagtagctagctgtagagggagttatcggcc

SEQ ID NO: 1401 - DNA, 1189 bp, Zea mays
ccttacgaaagcaaggagacgtcagcaagtattcgacagccccgacagctgtccttccgcagggctccagctctcctccgacggccacgacatcacatgaacagggtgccaaaacctctccgactgccacgacggcatgtacttarggctctagctcctctctgctagacacgttagcacactgctacacccccattgtacacctggaccttctccttacgcctataaaaggaaggtccagggctctcgtacgagaaggttggccgcgcgggagaacgtgccgacgcgtaaggctctcccacgcgaacgcttgtaaccccctactgcaagcgcacccgacctgggcgcagggcaacacgaaggccgcgggtttcccctttgcctgtttcttccccccttcgtgctccatctcgcgccgacccatctgggctgggacacgcggcgacaatttacttgtcggtccagggaccccccgaggtcgaaacgccgacaggcttgaaagaaggtaagagtacaagtgtgacgcaaaagcaaaatgccaagtcaacgtgaacagtacgggagcattgttcatctatttataggcacgggacgtagcccatgtaaaattacacccatgccctttacatttgctaatgactctatagttacccatcgaggtctgaatagccttttcctttttaagtcagtttccttttctgctatcgtgccgaagctcttctgcacatagcttcggctctgcgccaaccttcgtgttctttgtgcttctccacactgtggttctggtccgagttcgaagatacctgttcatgtattacactccagaaacattgttaaatcatgtttttgaggaccttcggaagccaaaggcccccaacagtagcccctcgcaatattaatttgttagaatgataaattcagattgcgatatggacgaaggccctaagccgaaggtccgaaaacaccttccctttgctagaatagcaacaatcaatgacaagcggggccctccaacttgcaacgcactaggcgtataaataagagcacaccacgagctcatttggcacgctttttgccatctgctctgcttgctcaatttttagctcttgcctaccaacgcttgcttggctttttagattttctaagcttcggcttttaagagcacattttcaccatttccgaagagaag

SEQ ID NO: 1402 - DNA, 204 bp, Zea mays
tcctcgacttcgcgtcgctttccatgccgtgggactccgagccgttcccgggggttagcatgatgctagagaacgccatgtcggcgccgccgcagccggtgggcgacggcatgagtgaagagaaagccgtgccggaagggaccacagggggagaggaggcctgcatgggatgcgtcggagggggaggagctgccgcggttcttc

SEQ ID NO: 1403 - DNA, 1159 bp, Zea mays
ccatctgtgtttaggagtgttggggtaccctaattacggtatccctaattacggtacccgacaataactattaacaacattttttattatttttaaatttttttaaatgtatatattttccctaaacggaaggagtactagccactaggataaccggataaatggatctttgagtgaagtggcgcgtgcaaatgtctctgcggctggcttgttcgccaaattggcagctcgccacgttcttcttctctcaaccttcccctctttctctacttctcgtcccaactcccaagttgcaacccagccacctcgtctcctcccctccaactccaagcctactcccacccgatcccccctgccccgccccgggcgccgccggttctcgcattcgcggcagtccatctcgttgccccttcccggcggcctctgatccgtgctgctcgtcgcccacgcgaaacctgccgcctcccttgttgccgcgaccgcgagccctctcccctcccctcgcggccctgatctcagttccactgtgccccgaccgtgatccgtccgcacccgcttcatgcccagcagcgttcaacccgtcccctaaatgccgctgcctccaaatagttctccgtgtgctggttcttgcggattgcgctgtcaggtctacataatattgggggcggtgcagagtgtcctccgttttttcctctctcgcacctaaagttttcgggagcagttagttagagtatattcgattccccctgatatagtttgtttatttcacactacgaagtctatgcactcgagagaaaaatcactggtagcgacggcatcaattcttgtgacgtttagtagctagaacaccctcactagcgctcattcatgtttactcgaccttgtccttttcccttccatcttccgtgtgctggtatcaatttgttgtaatttggggagaccaggagttttctcgccttcttgcccttgttctgcccgtagtaagtgcttgccgtttggttgattggaactcccaagtgttcgtcggtcacatttatatagctttacctcactaggataatcataagcaaggtttccccaaaattcttagaccagttgggatcaggacccgaaggtagattgtgttggctatttgccggtagggcattgtgactccgtg

SEQ ID NO: 1404 - DNA, 1500 bp, Zea mays
ggtccgaatattaggttcgaaccgaagtagtgtgcaaggatgggacattcatcgatggtatgatagctcgtggaactgaaagacccataccatgtgatgggtcctcccaacgacgatgacaaaccacctcagacaaagccactaaatcttgtgggtcctcatcatcaattacgggtaagttactcccaaaaaggtggtggaaaggaaacatgatgagctacaaaacataacggtgcgatggatgacaaatgatgcttgagtgaaggacgtgggagagatgtgctcaaatgggataccctatcatggtatatacatgtggatggaggcaaagcttgtggaggaagacacgacacacctgttgaagcagatggattcgccaacgatttcagtcggaaacaatgacgacctactagagaagattcatattgttgtgttgttgtggacgatacagactactattattgtatcatatcctacgtagagattaactaaatcataaatactattccgctaatattttgtcacattaattaacttttgtttttaatttattcaattacgaaattaaaccgtcgattaaatatgtcggttatagaaaaacaaaatacaaaaaaagcgttgttgtgatggttgagaggaaatgtatattatattaggactgtgtgttataggagtgatatattgagaactgttgtacgagccaaaaatatagaagtgagtgagaatcttctctgtagcaagtataggggtgaatttagactatacacaacgctcacctctacgttagaattatagcgcatgtaacgactataaagactatattaaataccgcaccgttcacctctaaatttgctatagtgcgagaggtggcacactgaaccgccacatgaggaggcacgacaaccggccctcttctctcgattgtcgtatccaacggtgcttattaagtaagaaaaaatggtagtgtagtatagggataatttagggggaatcactgtaagagggagaataaaaagagcgtaattttaatgacgggcataaaatgagatataaaaagaaaaaattaggaaagatcgtacagttttagggaagcgctacagttaggttagtgcaggcacgaaaaatgaccgcgataggcgaccttttgccaacgccaggacccacaccaccgcaccatcagactcaggaggcgacgcgcgcttggaggtaacgcgatcacggccgctcgggtgaaggcctgaagggggcacgtcacgtcacgccgctcgcgccgcgtcgttttcgcacccggggaccaggctcgggcgctcggctccgtcctcccccacatccacctgcccgtttctcgctccgaagcttctcctctcgcgtctcgtaccaggtcaggaggggagggagggagacgggagaaccagggagcggaggcgtgcgtgctgcggcctgcggcctgcaggaccagagatcggggactgagctagggtctgggactgggaggcggag

SEQ ID NO: 1405 - DNA, 1500 bp, Zea mays
taggtgtctttaggtcttcttttcatgtgttgcatccttagagtctcagtccaatcgactctgcatcctgtgaactacaaaacacaaatacttggaaaacattagttcactggttatgttgttcatcaaacactaaaatcacttagccaaatggatcggggtctattttgcttactgaaagggaattaggcttacacctagttcctatataattttggtggttgaattgcccaacacaaatctttggactaactagtttgctctagtgtataagttatacaagtgtcaaaggttcacaacaagccaattaaaaagaccaaagttgggttcaaataaagagctaaaggcatcccggaagactccctggtctggcgcaccggactgtccagtggcgcaccggacagggtccggtgcaccaggaggactcgcgctgaactcctcagcctcgggattttcctggagccggcacgctataattcaccggactgtccggtgtacaccggacagtgtccggtgctccgaagaaggcacggctccggaactcgccagtctcgggaattcgcgaaggctgctccgctataattcaccggacatgtccggtgcgttctcggagcaacggctacttcgcgccaacggctacctgcgacggcatttaatgcgcgcgcagcgcgcgcagaagtctgagtcgcccatgccggcgcaccggacagtgaacagtgcatgtccggtgcgccaccggacatcgaggcgggcccagaagtcagaactccaacggtcaatttccaacggcactgatgacgtggagggggcaccggacatgtccggtgcgccatcgaacagacggcctccaccaacggtcaagttggtggttggggctataaataccccaaccaccccaccattcattgcatccaagttttccacttctcaactactacaagagctctagcattcaattctagacacactaaagagatcaaatcctctccaattccacacaaagccctagtgactagtgagagtgatttgccgtgttcatttgagctcttgcgcttggattgcttcttttctttctcacttgttcttgagatcacaactccattgtaatcaaggcaagaggcaccaattgtgtggtggcccttgcggggaagttttgttcccggctttgattagagaagagaagctcactcggtccgagggaccgtttgagagagggaagggttgaaagagacccggcctttgtggcctcctcaacggggagtaggtttgcaagaaccgaacctcggtaaaacaaatctccgtgtctctcttgcttattcgcttgggatttgttttgcgccctctctctcggactcgtttattattactaacgctaaccccggcttgtagttgtgtttatatttgtaaatttcagtttcgccctattcaccccccccctctaggcgactatcaattggtatcagagcccggtgcttcattagagcctaaccgctcgaagtg

SEQ ID NO: 1406 - DNA, 1420 bp, Zea mays
gttttttttttcaaaatgacaaagttttaatatcaagtatatcgggctagtctattcaaatagttgaattatacttttcatacgtttttaattgagtattttaaatccaaacttctaattaattacacctatctttattttttaatatctagtattaggtcgggagtcgagacgatgctataaattatttttttgtgagcctaggccatggtccatgcaatttaagaggacatacccgaggaccccgcatttcagatcgtccctcccacgtcccccacccccaccccgcgctccgcggtccgcgccgacccgccctcgccatcgcgccgcgcgcgcccggtccaacccaaccgtgttcatccggtcatcccctgctcgtgagccgtgaacccacccaggtccacggccctcccggtcccgcctcccgcaattcctccagctccccgaaactttttgcatctcctccaccaccaccgccccctccccttcgccccgacgaacacggcaccacgagccccgcacctcacacagatttagcctacctctcccaccgcggctacattcctcaccccaccctgtcggtacgcgttccggtcgtccccatcacccctctggcctctgcgtgttgatttcttcgtttgtgcttggtaagaacgccctaaattgctgttttccctcccatttgggcctgttgaaccgttcctttgctctgaggccaacaatccgaatgtttgcctatgctttgacgctccgatccatctggtttcgttgtggattgttcgctgcgtggtgaggctattgcaaatgtaaagttttttcttagggtggttcagttgaacacctcgccaccataatacgtacaccgctgagagagagttcattgttgttgccataatattgtatcagaatgtcatgtgtgaagctgtacagtgtacactactggaatattagatgattggtgagcttgatgagccatatgagatgatcaaaccataattttgatagacaaaggtagcttcttgaatgctgtttgtaggatccgtggggctggggaagagcaggaagcttggtagtaggtgggttcttttttgtgctgcatggaattcaggattcaatggttttcatcaaggatttggatgtcactagcccgtcatattggcgacaaccaattcctggtattatggctggaataatcaaatatgggatttttgaaggtcgagaaaccatatattattattattattatcattttacattatgagccatgacagacttgggcggcctagtatttttttcactccatttttgtcatgtttgacttcattattgatttacttcacaccccaatgatttcactaccattatcttggtttgaactcaatttattttcctattgcaggctgcataaacttttaaaaaa

SEQ ID NO: 1407 - DNA, 1500 bp, Zea mays
tatttatgaacatattgttgtttctcctactagtccctcttgtagcactattagtgatggtttcactggcgatgcctcacttatggtagaaaatgtgatcctccagaaggtggatgagctccaatacgccttaggtaaaacttatggcgatagagacgcttgcttaagtgtttaggtaaccgaagattctttctcaaaagagagggattgagatatgaccctaagaatggcaagacgggctttgctactcacaagattaattttgtaaggggtattggtcggtttttctctatattggctacttagagcaacaacacaagaataaagacaatgctatatactcagctaagtttgattcttgttatttacatacaagggtgtgaatagtaagtaaactaagtattattggtgcacctattgtttgccaaaagaagacaatctaggcgccaagagtctaggtactaaccttggattacctaagaaagtttgagtaccaaaaagaaatcaatctaaattataagatcgaaggaagatattgagtgtgataatggatgcactcaacatataaccaaagatcaaggatgttcaattggtacggtggcaaagatgagtttgaaagtgccacgtttggtgagaatagcaaagccatggttaaaggtcttaaaaaattacaagattcaatgatataagtatagcaaatgtgttgctagtggaatgtctcaacttcaggattttactgttttcaccctattattgtttgcacaattgtgaaagcatttatgtggaaactaaaacattcaaaccccagtttagtttttataattaataaaaatataaattaattgtgactgccagaacaaataggttaggtcacaataatacaagatggttaaactaatatagtattcatgtccagatcaatgatcgttaatgtacttgctgatgaagatcgatggtcgttttttaaagaatggtgaatcgttggaaacttagattagtgacagagcacttgacctagacatatctaattaaacatggcggtgcacacttttaaaactagtgctagctaagtaaacccaagagagaccaaaaaagtttaaaacaaaagtcaactcaaaaagccaataagttcacggtgctgaagtagcaaagaatatgtccggtatttcatcacataaagcaaccaaaagaagtgtgccctactgtgtttcagagtaacaccagcaatccactttctaactggcactaccggactatgctacaccaattcaacggaacggaagcccagcaatgaaccccatgcactttctaactggcaccgaccacactatgctacaccaacccaaactagccaagtccttgacctacaacaatactctaatctaaataactgcctactgtcagatttcctaaaccaggcatcttgtacgcctacatcaaccttggggcctaaacacggtatttataagctgcttcaggttgctgcagggcaagatctca

SEQ ID NO: 1408 - DNA, 106 bp, Zea mays
ggtcacttcgacgatcgagcgtttcaactagcttgaccttgctcaaacggtgactcgcaccacactcgacaccatcctggcacgccttgatgcgttgaccacaaag

SEQ ID NO: 1409 - DNA, 299 bp, Zea mays
ggtcacttcgacgatcgagcgtttcaactagcttgaccttgctcaaacggtgactcgcaccacactcgacaccatcctggcacgccttgatgcgttgaccacaaagatggagcaggactacgtcggtgacactgagcaggacgatggagatcgtcgtggtcgtgcatgccgtgtggttcgtcatccccctaatgacttattttctaagattaaatttaaaattccaccttttaatggcaaatatgatcctgctgcatatcttgattgggagttagaggttgaacaaaaattttcatgcc

SEQ ID NO: 1410 - DNA, 117 bp, Zea mays
ggtaagaatgtataagaacttgataacagcattccattgagcgagcaagttgtcaccaccattcccctgttgtcgtcggttttttctccttttggtgttttggtgtttgcgctaact

SEQ ID NO: 1411 - DNA, 519 bp, Zea mays
tttaggggagctaggaaaagaaaactagtccaaccaatggaccaggatgtgcagcatcggacgcgtatgatctctcacttgctcgacttatgggctccacatgctcccgttaggctacgaggcttgatcttggactggattcagaaagaaaaggaaagccagttagcagcaccagtgcaccactgttgcacctgacgttctgaatcaattaacctggagagataacaggaacacatcaaaggttggcttactactcacaaaagggagcaaatctgtcagaaaaataaaagggcggatatacagggaccagggtgatagaaatttgggtcaaaagctatgtttccagtgaagaggatcaaacccataccatgaaggtcttgagttacatatcaatagtttgtgttctgttggtcacaaaaataggaagtactactatcaacctacattagaacttatgaaagtgtaacacatcacttgttctcagtttgagttatgcatatatgaccagctgatcatgtg

SEQ ID NO: 1412 - DNA, 748 bp, Zea mays
tgtgggaaaggttcctgttgggggccttcgtcttccgaaggtcctcaaaaacataatttaacaatgttttccgagtgtaatatgtgaacaggcgccttcggtctcgaatcagaatcacactgtgtgaaaagcatgaataatacgaaggttgacgaggcgccgaagccacgtgcaagggagcttcggcttaacggcagaaaaggggaaccgacttaaaagggaaaaggctatttagacctcggtggattaccttaaagttattagcaaatgtaaagggcctagatgtaattttacacgggctgtgtcccgtgcctataaataggtgaacagtgcccccgtactgttcacgctgacttgtacttgcttttgcgccacgctggtgtttttttgccttctgtcaagccaaagatacttttgtaagtcaatattatttctatctttccatgataatataataagaatgaattgacaatgttatatgattgcttatgttgtctcttacacttcatatatgcttcttcttttattaatacatattgcaatggatgaaggtatgtccttcatgcccttcgtctgaagatcattatatcttaaggggaataatgcttcgaaggacgaagggtattaacacttaaaatcttgtgttgccttgttcttaatgcatagtatttgagaacaagtccccaacattggcacccacctccgatggacccttttcgaccaccttcggcaagcactgaccttcgtc

SEQ ID NO: 1413 - DNA, 640 bp, Zea mays
tgcctcatcaggtagatgcataggtagatccaccatcacatcaaagaaagccgggggaaatattttatcggttatatgtcgttttatggacattgtgttggtatgcataaatgtatatggccattttgagcactgtcctatttgcttgccgggatatgagaacagaaaattgcttcatagcatctagtctcttgtatggatggatacagtttcattctgacatttgttgactttgggcaagggaaagttattggatgtatctagtactgtataaatgtttattttgctggttagtcactactactgcataaatgtttattttgctggttagtcactactactactgcataaatgtttattttcctggttagtcactggataaatattgttttatatgaacattctgttggtatgcatagatgtttatgccaatttctacaatgcaatgatacgacttttatgatgtttccttcacttaccatctatgttggtagggccatataacacaattgaggaattataatgtgtatgagtgtgtagagtgtacaattatttcatataatcactggtgtatatgttgatgtaactcaataaagcacatatgttttacattgttgctccgcacgctgctgcttcaatt

SEQ ID NO: 1414 - DNA, 1500 bp, Zea mays
cgccagttcatgcctggctaggccatgcaccgcccgtcaataggaatggaaacaaacatgaacaggtggaaaactctctgtctctcgttttcgttactatatttttttttatcaaaaatagaagtgggagtgagaaagctagtaacggatacggttgccgagcaaaaactattaagtacgaacgggaatataatggaaacgaacattaaccaggacgtttatatcgtttattggaatcacggggcgtgttcggcaggctgcaagccgacactgttgcagctgtttggactgctgcagctgcaatccatagagagaaaaatactrtagaagccgcagccgcagccggattgcagccgcagcaagccgcagcgaacaagccgaaacacaagttcaactgtcactctgccaaacagtaaataagagcaacaacaaaatcattagttattaaaaagctacagcgattagaagatccactactgacacaaccagcctgcagcaagatgtctggtatgctcctcggatcccgttccagaatccaatactggcttcaagaatccaaccaaaatctattcaaggtggaacctttgttgcaagcccagctgaaaaatctcgtgttcagttcaattacgaggaattatatgtccaaagatgcaacctttgatggattcagtagttcggcatgggctgggagatcttgccctcctcgccaggggtggtgggagtccgccggtccgtggcgcggagccacagacacacggcggagaagctaagcacaaggctgagcagcccgctgccaaggccgatgccaacgatggcgagcacggagagcccccgcgtccgcatcggcggcagcgggtacccgtacaagcccttgttccctacgaaggagctggcgttgaacctcgccgtcccgacggctgccgtgccggcgccggagcggttggcgaggagcacggggatggggccagagaggcggttgtaggagacgtcgaaggtcgagagccggacgaggaggccgagttcctcggggatggggccggacagctggttgccatggagatctatgacgttgaggtaggcgcagctggcgagctcccgcgggatggcgccagagagcgcgttcgcggagaggttgagcacggcgaggttcagcagcgcggagagctccgtcgggatggcgccggacagcgcgttcgcggacaggtccagcgactggaggttggtgcagttggagagctccggcgggacggtgcccccgagcgagagatccgggagggctagcttgtacacgcgcccgttgttgcaggtgacgccttggaggtgcgagaagaagccgtcgcacggcgcagagatcgccgccttggtccagttgagccttccggaggaatcggagagggactggtggaggtgagtcaggcaacgctcgtcgttagggtcggcggcgcaaggaggcgctgtgaggaggaagagcacggcagcagcgatagtggcggcgtggtg

SEQ ID NO: 1415 - DNA, 184 bp, Zea mays
atgtcaatttcatgtgtgccaacgcttctctgtctgtgttctgacaagaacgtggcatgatgtatgcaacttacaattgttccccatgtcagctcttagccttctacacttgtatgtctatcaagttttagatctgttgtagaagcagtaacactaataattattcgaaggatgtggtatttag

SEQ ID NO: 1416 - DNA, 1260 bp, Zea mays
atcgatgaccactgagaccgaccgcgtcaccgcgacactgaatagtgaacgcagagaggaaaaaaaggccactgttccgaacaggaagcatccttgaagcagccaagaattcgtgcagcgcaggcgacatggttttggttgtttctgtttgattagaggcctgtgcatagaggctaggctaaagaaggttagttatataaactactcatacaaacaaagcgaaaggagtagcacaagcggccaacaaacacggggaataataggtagactcaaagcgtctctctctctctctcttttgctttcgtgttgtgaatttgtaatgaaaggaagtacctgtactcatacggtttttcaatggaaccgatgcttggctttgtcatgcagctcatcatttgatacagcgatatgcaatctctccattagtgtgcatgagctgccgatcgtccagataaggtgtgtcccccgtcgagatcagcgctctgccaccgaaggtgttcgcatggcagtagcagcagcgtcttatgagtggccagtgggtgaggtcgcacgatctgcttatggaaggatgagattattagcggctacatgaacaagctccactgtttgagcacaggaactgggagaacccatcagctgtctgttcatcaatcgacaatgaatgggaaatcattttctgtgctcctatatattggtacaaatcctgaaccgaagtagcgcgagacagcaatgtctgtcactgacaagtaacaacgaacccctggtggtccagggttttttttttttttaccatgacaaccgccacaaagaggggcccaaaatttcgacgcggcagcaagaaagcgaaagggtcacgaattcaccaacaggcaggcaggtcaattaggtaggaaaaatctaatcactgctgctgcctgctcaacttttaccatgatatgtgatatcccacccaaaaaaaacaaacatgaacagaaattgtcgcaaacgaagtggtcaaccgtgccaatgatccaatccaagcacaataagaacagtataaacaaagctagaggcccatgagcaagtggtgcacgcgcagaaccttaagaaaaaaacaagtctgagaagccccagagatgaagcgcctatatatatacacacacacaccaaattgaacacacggcaacagcacacactggacacgaagcaagcacacagtagacacagcagcaagcaagcaagacaccaaacattccattccagtggcccgccttataccgttgc

SEQ ID NO: 1417 - DNA, 50 bp, Zea mays
ggtgatgccagctgtcattgtgaggtagcgcaagccatggtgctgaaagg

SEQ ID NO: 1418 - DNA, 490 bp, Zea mays
gtgctttgtaaagctagcaagatacaactaagtgtgtgtgatccttgtggggtcttagtaacccaagtgattaaggagaagcaatcgaccggtctgtgtgaccgattaagagagggaaagggttggaatagacccggcctttgtggcctcctcaacggggactaggttctttggaaccgaacctcggtaaacaaatcaccatgtccatttgtgttgatcgtcacttgatttgtttccctttctttcctctctctaaaagttcccttgctcacatttatttgagttggctccaaaggttatccgcattaattgagcaactcgtagcaaggagaactatcttccgcactctgaattatttctaacgctaaccccgggcatagtgcgtgttcaaagtttataattttcatgtttcgcctattcacccccctcttggagactttcaattggtatcagagctcggtgcttcatttgagtctaacaactcgaagtg

SEQ ID NO: 1419 - DNA, 109 bp, Zea mays
gtcgtaacgagacacccgcgacggcgacagcgacgggggagaggaagcggcattgcaggcacgtgcgcgcgtggttgcctttggctgccgcccagcggagcaagaagcc

SEQ ID NO: 1420 - DNA, 1500 bp, Zea mays
ctaggttttgtttaattatggatgaatcaaggaaagagtaaatgacacttgttgtttgttttcttgataaggatggttttgttagggaacattttcttgatcttatccatgttcatgacacatactctgtttaaacaataattatgctatgttttgtctttacataaattgcatgtaaaaagtgttcgtggacaatgttatgataataaactgtctttacataaaagctgtccgagatagctaaaaaaagctttgtccttcgtaaaaatgaactgtgacaatctatgactaatagactgtagcaaactgtggccgaaagctaagtggcattgaatttgcacccgatcctcggagggggccagacggtaagggctaaaaaatagtttatttcccctctaatcttacgtgatccatttgtcaccaaaactctatgtaaccgtggaagcatggagccacagccactcccgtactaggctaccagtccacaaggccaagcagcgggaaaccattatggctggtggccgtgactgatgagcccgtgaacattttccaagtgatgagtcagttctttggcttgcgggggacgcgtcacgcatccgtccatctctgcacccacccgcccgtcggccgcacttggacgggacccaccgactcccgaggcgctgtgtgttgtccttttgcgagcggccgcagaccacgggcacggctggggcgacgttcgcatcccacgccgcgcgagacggtgggttccggtctccgctcctcgccgtggccaccgcgcccgcgcgcgcatggccgtcggcacgaccgtatgtgtgtcgacacgtccgcgtcagcgctcgcgtagttacgtcagcttcaccttccccggggggcctcccgcacgtgcccccatccttctctgttatctctcgttcgggacacggttaaactgttcctgacagaggtttcgttgcagctgattatttttagcgcgtagtagctgttaactttacggacaaacccctggctctcggctctcctgcgtgcgctccaccgttaacctctctcgcgagtttttgacacataaaacctcagaaaaacacctcttatccccggacccagggcatgccatgcacgagcacgatgcagtgcaccatcccttatcccacgaacgtgggggatccaggccgtcagcgcccaggacaaccaaatcgcagccgttcacacttaagggtacatccgtaaatgctctaaagggtgaggcggatttattccctgggaaaacgcccaactcgtggctgtcgtctcgtcccactcccactcccacactcccactccgacgcttgcgccgcgagaggagaaagtgccggagacagaagcgaggagagagagagagagaagagaagcggggggctcgcagaggcgtagctcgcgatccgggcgccgagctggtgcgtacttggtttggtcgcgcggctcggtcgggaggctagctagctagggctcgcggcgggcggg

SEQ ID NO: 1421 - DNA, 169 bp, Zea mays
atgagtggcctcatggtatgtctagcagcttatgcgaatggaactgggaactaacagtacaaatgatcttgtgatggtgaatgagtgacactgactgactacttagctacttgtagaatccagagtggattgcgataccatgaatcgataaggtcatttcgctgcttag

SEQ ID NO: 1422 - DNA, 1500 bp, Zea mays
cgccgccgccgccgccgccgccccacgcccacggcgcctaggtaaccgtcttaccctcttggttcctctaagtactcctcggaccccttccaccgcgtggagttcgtcaggaaaccgtccgttcgattctgggagctatgattcgcgccctcttccttgacgagtagatctggattagcctgcgagaggacgacaactccactagttcgggcgctaccgctgttattagtcgcgcggggaaacggaggcgtagccctgcgtcttcttctcccgcggcactcctaatcgtggaagtcaaacagtgacgacgattacccagcgccgctcctgcagagcttagctgtagctttactcgctacagctacggctaagctctgcaaatttagagtatttgcttattgctggctgttgtggaactctatatttaggatgttactgtcatgcaaatgtcagtgtttcctgaactggctagttttcctgtatggcacctacagtacttgccatttctgtatgcccatgctttgtccgtgaggtggtgtattactttttttggtcgatgttgattgtgcttgttgttggtcagtgtattattgttttttttgcgggtattgattgtgcttgttggtaaattgtatcagaaccagggtctttctggtgtgcaggggtgggcgcttggcttctgagaacatgtaacgggtgttgatacgaaaataggttcctggaatagcgggttcattagcagtttggcacaactttgaagctgcaggggatttcaaatgccctttgtcatcaggtccacggttccactgagccagaggtatgctgctgtgctggttttctttgacatcgatttcatcatggctttagtttcaaaatttcttcagtatctgtaaaatgtggttcttgaatgcttcacttcgggtctgtatccctatttcaaatgccccattttcttctagctttcttcaatctggtgagccttgtgtacaagaaaaaagaaatgttttatgcatgcgatggaaatgtcagttcgatgtcatgatttttatgatgcagtctgcccttatatgattctggatgtttccataggacgcttatcttatattcctgaatcttcagctttacttgaatgaaaaactaattagaagaaaatgtcattgctctggctgaagaaaatgtccttgtttgacatattagctgttcgaagcctgaaaaattatattaatatttgaaattgtataaccaaactatcaaaaggtttcatatctgtaaggttatataaaatatttatatattagtaacttccagcattattatttctacttcactcacttagtgtgtcaaagttactgatttactactatttccattcctatgatatgtacttatgtaccgtctgtgtctgttatcctttctgtgtaattctggcaactaactatttcattgtcatatctggctgaatttccaggattttttattgtattttcaacttccctgagg

SEQ ID NO: 1423 - DNA, 163 bp, Zea mays
tatgaaactcttacagaccatgtctgaaggatttacggtgtaacccaattcacagcatggtcttcaaacgatgttgtatgcatgtatgcacatggctttgcaagttgcatgcaatttaactgggtcttttgttatcaacagtagactctaaatagatctagcc

SEQ ID NO: 1424 - DNA, 182 bp, Zea mays
agtatgttttgatgagtgatgaactttaccgtcgaatggttaatgatgtcctgcttaagtgcttgggcccaagtgatgctatattagccatggccgaagtacatgaagaaatttatggtacccatcaatcggctctgaagatgaagtggttattgtgaagatctgggttctattggcctaac

SEQ ID NO: 1425 - DNA, 205 bp, Zea mays
caaaaatcatactgttacgccgtcggcaaatcttcagttctagccgcctctcatagtcaacgaggttgcgtgataagaccctgcactcctgcagtgcatgatctgcgtcaaactttaggtgctggctactgctatttagcagatggtccaacaaggcacgcgcaagtgttgatagatcatcgtcgcatccaaatacatcgaatgc

SEQ ID NO: 1426 - DNA, 1298 bp, Zea mays
ctgccacaaaaaaaaaaccaatttacctccctcgaccatctccgtcgtggtaccaaatttttttttaaaaaaaatgactctgtactttcatagatagacaacattttcgttgactgcgaggtagctttagcgactttgactatcgtatctcgagaatttacaagcccagccatgtattatggtatgagcagccatgtagggcgctaataattggctgacacgcgtttgctgcgtcttggcacttggcattggcagcatgctcctcgcccatcttcgtcgtcgtcctagtcctacctacgtgatggtcggtgagcggtgagcctgcctccttcttttcctccccacgtcgcccggccggcgagccctgtgctctgctgcattgcatggcccccccggcctctgcatgctggagctcgaccaccgagcggcagaggcagacacaagacacgtccaaagctagcctgtcctatctccctgctcggctgtttgcttgtccgtatggacagaatccgcaaaacaagcacaggcaaagcatggccaatgttgtcagctgtcttggcttgggggccttgtgcatggcgtggggacgtggggtgctctcgttcgttcagttcaaagtttgaattcaaaaaaaaaatgaacttggcaggaaaaaggtgcaaagcgaaagaaagccaagtccttgccgtgctgcgtgcaaagcaatcatcgtcgcccacacactgcagtgaagtcattcacggcccatcgctttcctcattcccgccggcctaacccaagtgtcggctgacgagactgtgtgagagttggagagctgcggatggatccgtcggtcaaccgctgcctgtaataataattaacaacaagttttctaattcctaataaagtgctgctacaattcgattgccagcagaggctcacatgggaattgaaggcgcagatcgctgaccgcgccgccgtcacttgccgagcacgcaccgcggtagtagccgacaccgccgcgcacaacgttccgttcgtctcccctcgaaccagtcctcccaccaaaaacgcactcccgaacccgactctcctcttgctcgctctcggtggcgtctccgcctccgcagtccgcactcgcgcacgcttcccttcccttcctcgcccacgcggacgcggccacggccgctccaagctagcagcagagcgagagcagccaattttggcgcacctctctcactctccctccctccgttcagcagcgttcgtttcgttgctcactcagatccagccattcaggtgagagactaggggcagcg

SEQ ID NO: 1427 - DNA, 169 bp, Zea mays
actaattgatgagttgccaattcatcgatcaaatggggttatagtgtctattcgattcgatggcgtgtacctgctatgctagctgcttcggttatactcttgtagatgtcatgttcagattgtacatgcaaactccaatcgaaatgcacagcgtaaccctcgtgttctt

SEQ ID NO: 1428 - DNA, 132 bp, Zea mays
ctggtggcctggcctctacctatatataaccccaccccgcaccacaccacagagatccatttcgaggactcgtactaggttcggcgttcgtagctcgtgtcgtttctgaagctagatagctagcgacaggcg

SEQ ID NO: 1429 - DNA, 1436 bp, Zea mays
gtgaatgtaaaagggacgaaaagaggtagaacacaaggatgcatgaactactataggttagtataaagaagacaaaagtgcaatgattgtttgacaacaccaagggaaagatgaaaagacccatgtcgaccacttatataattaagcgccggatgggtaggcctatagtggacccaaggccacaacccattaatcgattgatgaaaccagacagcccaatacttgggtccgttacctaacccaatccttaagggtttgttgatttggatgcatgagaattagaggggattgaggggcatatgactagcaaattattataagcctctcaatccccatgtatataaacaagtcttaaaggttgagaaagactttggaagggtcgtcttgcctctaaacccgttggtactcaattgccaagtaagtgtctcaatgtttaagcaaacttgaatcctactactgatataaatgaaggaaattgttgtggctctttcacattcatatcgtcgtattctcggtcagagagagggagagagtccactgcatgcatcacgacgtttggaccagacctgcacggctcaggtccatcgtgcttcgggccaaacgggcttggaacgagaaatcaaaaaaaaacttggactccatcgtgctatcccaaagagtagaaacagtgaattagcttaacacagcacactgagcattcattagaccatgtcggtcaagcccgaccacatatttaaatcacataaagtccaaatattataaccacataaagtccacaacttactcaattaaagaaattaaacaccgcgggctttattgggctaggccgacccaagcctagcttatgtgcaggctatgtcggggacccgataagccagattttgaggcccaacttaggcctaccttcagactgtattagcacaacttatatgactttgtgttgaatcgtgctttagggttctatttttagaccgtgctcgtagtgataaaaaaactgtccatgatgccagcactatgcagagtactagaaaccacgcgcgtggatccttggcaagctggaacgctggtccggccgcaaccctaggacgcccagcaaaatcaagttgacgcgtttaattatcttgcttaattaacgttgctcgataaaaatcttggttaccgcattcaaattaaaaagatgtcgcattgcgtgtcggtgcatcaaactaaatgcgcacacacatcgtggtctgaaaaatacgagaagggaatgctctcgccacagcacatgtaacctatttgtgcgaccacgctaataaataataattgcatctgcaaagagaccgagatcacgctaaggccttgaagcagattgcagagacgataccctgtaactggagtacttagtacgggcagtctatagcttctccattgcccggtttgcaagcaaggaattg

SEQ ID NO: 1430 - DNA, 875 bp, Zea mays
tgtacggcggcgaactctcctcttggtaacctcccgctatttaaactccccccctctcctccccacccccaattgtcagttgccagaccgcataccgccggcccagtcctcatcggcgccggacgggtaaagagttttatttttacatcaccggaggcattttttttttcttcatcaggcttctggatcttacctggcctccatcatggaacatgacrgcacgaacctgctggctrtcaatgaggttctgcgctcggtacagctgctcaagattgacggctactgcgccaccgctaccatgagcgagctggagttcatcaaatccagatggtgcaccaatggccacgagtgggaggtccgtttccatcctacttacaagtggaacgggcggtgggtagcggtgaagctcatacttatcagtgaacctctgagggacaagctgagggtgagcctgagctgccggatgagacccaacaacttccagcgggatctcggtgcctcttatgagcagagtttgtcccatatatttcccagtgactccaaatgctcgcctgtacttctcctcatgtcaagggctgagctaggatcatcagattacctcgtggaggattcgctgaccgtggaatgcacgctcaccgagctacgtggcttcgacgcctctgtgaaggatccgcccctgccagtgccacagccacagccactgcgctcggacctacaccagcacctcggcgagctcctgcagagcaaggacggagcggacgtcacgttccgtgtctccggggagtccttcgccgcacacagggtcattctcgccgcgaggtccccggttttcaaggccgagttcttcggaggcatgaaggaaagaagctctgctt

SEQ ID NO: 1431 - DNA, 1500 bp, Zea mays
ggaaaaaaacatttgaaacagttagtagagtatcatggaaaatgaatattcatagtaggtatgtatgagggggaaaagaatgaagtttggggtgaaaaatataaatttccttaggaaactggaggccctcctagattggaaaagtattctgcccgtcagatttactaattattttaaaaaaactttacataatgcacaaacgttgaattattgaataagaacagtagaacattcattaataaaaaatcaggtaatgcacaaatattaaattaaataagatttatagaaagttgactcaatgaacgggatgatggtttcaggtgacaaggcagagccgattttgctgtgtcaacaactgtagcgcgcgcgggaaacaaagagatggacgataggggcatgcatcacgatgacatccggacggggcgagccagtgcgacccgatggcttcctgactcctgaggaacgatgctgcaggggcgatggggacggaggtgcgaatggtggaagcagttagcttcggaaaagacgtcgaaataggaagcattctgcgttcggaaaagaaagcgacgctgaggcagcctatcatccgcgagactgggattccgtctcacgcgaactcttcttacttcctcccggagcatagcacctcctggagaactcgaggagtattcccttctagagaactcgatgcttgtacgattcaaaaaaggcagacaaacagtaaacgatagatggacggtaggatcagcttcatggctgtatgaactgacgactaagaaaattctaacgacgtgtccactktgtcttgcgagaaacgagcactactttaatatatagaaattaagtcatttttagaaaacattaagttattattgtttaagccatttttctggtttttttcagacatttttttatattattaattcgatcattctataaaatattaagtcattttaagaaatatgaagtatttcttgtttttcagtcgttcttcatgtttttttagacattttctattttggtttagtcattatgtcattccaacatatacgcaacattatgtcatttccgtttttagacacttttttttatatttcttactttagttgtcattttagataaaatcaaatcattttaaatatttaggtactattaagtcatccacgtacagaaaacattaattatgttatttgagcccattttaacactgttgagtcattcatgctcgatttgtttcccttttgtcgaacttcgagattgttccgattcaccgtcgaaccatccagaagcagccgcctcctgcttctggtcctggactcgtctccggtccggtccggtccggtcatccattccccaatccccagtccccaccctcacaacaagtccacaactcacagcacgaaaccacgcgcagatccaaacgaatgcgagcccgtccaaacacttgaggcctcgagcccgcctctccctcctcttcctctcaacaccaccggcataccc

SEQ ID NO: 1432 - DNA, 1500 bp, Zea mays
tgcacacagacccggcacccgtttccatgcacctccagtcccagaaagcaccaagccacagtactccgtacagtagtgccactggtttcccgggcccacaagaaattattccccgcccactcaattctcccacgcgcaatcacccacgacgcgcgtacacggtacacatcgcggcgcagcccacccactgtgtctatccggccatccgggcccgcatgcataaggacatcacgggcccacgtaataagaacgtcagggacccacctgccattgacaacttgatactttctggtcctgcgattgggacgcgtagccagcgcacgccctccagctttacctttcccaccgcagtagcagacggcggaggcaggtcctactcacacccacgccgctgaagtggcacatcctgtccaggtcctccctcgtcggtcggtcacctccctcctcacccatcgcttcgtgatgcatccattcgtaaaccgacgcccactcgcggggcctacccgtcatcctcacagacactgcggacgcgggcccggcctcaccacacaacccgggacgggatgaggacgccgacagacggggcccagatcgccggcccacagtgaagttggttcacgcgaggcggcaccgtcgccgacaaggaccacggggagccgagccggagccgcctagacgagggactagcgaatggagaactctagccaaccacgtcaccgtccacgtcacgcccacctataaactggagcgagcccgagccaccacccaacctgacccttcgtcccgcatcgtttcctcctcctttttccccgttcgtcccctggattggcgtctacccggcgcgacccggaccgaatcctaagtccgcctgccgccgccgccgccggctcccgttggaaacggtaaaacctccctcctcctggtccgtgtcgccggcgtcgggtccaagcggccgcgcggtttcgccgccggcgccgatctgagcgccgccggcgttgaccccacccgattcgctccgggctgctgctggggcccttcttctcagatgtggagttcctccacctacagattataccgcaactgtttgaggagtcctgatccggactagctaagggctcctgctgtgcacgacctgatactacggattttgcgccttctagaggcatgattcctaaatcggagtcttactgtttaaaccagagtttgctttcgttttgaactgtgggtgaatttccattcccgcagaacgtgaagtcggtttaggccaggcctgtttgatccgtgttcatatatgtatatatgttatatgtatggaggatacagaacgctgttgcttgcgatctgattaagactttttttttgttttgcttgctattctgatttccttttcagagtttggagtaaagaaaccaaccttgcatctgtgttctgtctgtctatgctgctttgctttggattcacaaaaaaataagccttgcatctcactgacttgagataact

SEQ ID NO: 1433 - DNA, 177 bp, Zea mays
ggtaagacctatatatgttatcaatgtcttagcatgaactgtagaaaattcagtcataaaatgttcctagtgttattactgttgttgtatgagtcgattctgatttctcattgtactccatacattctgctgtattttgtcataatcttctcgtttcattatattttctgaggatag

SEQ ID NO: 1434 - DNA, 59 bp, Zea mays
gctggagtacccgcaagagctggcggctggcatcaagagtttcctgcatgagagtggcg

SEQ ID NO: 1435 - DNA, 444 bp, Zea mays
gaaaactaaaataaggtcaaatctgatttggttgttctctcgcctagaatgtgttctgatgagggcatgaggcccaatttgggacgattctcgcacggctctaacaaacaggcccggtagtacaccggctccgaaggtccgcaagaccgcaatcatccggtaacttaccttttcctttcccatttcacttcgagtacacttcacgtctcgtcttcttcgccccactgggtgtctggcccaccgttgccacaggtcacccggggcagtacgagttccttgtctctccttgacggcctccttgctcagcacgatctcggctccgtctctctctagtctctaccaacggtagcaccatctcgctcccactcccaaccactccgccaccaccgctctcctgcgcctgcgtccgcgcctcctccctgcggccccggccgcaccggcgac

SEQ ID NO: 1436 - DNA, 648 bp, Zea mays
tattattttgtattataaataataaagcttgaaataaaatatgaaactgggacacgatataaaatatgttgagatttagcatagaagatcgaactagatttgattttacgattttaataatgaattttgtattttttaggaaaaaagtagtgtgacatctaatgacaaccgtagcgaatggagtagaagagaggcaggcgactaggagcaggttggtaggtcgcagtggcgcagtgagtgcactagtacgctacgcacctttccttcgtgtaataactccagctacttcctgtctagtgtctccgtcgaccgtcgctgccagccagccacagcaagctccgcacgaccgccggtccgccgcctaccagagcgagctcatctctcagccgcgccggggggcctcctcgtcacgccggcgcagcccgcgcttcgttccaccgtagtttgcccggccgtgctggggcaaaaaaaggtccgggcccacgtgttcccagacggagcgagaggacgtcgatcggtcaggccatcagggaccagaccagacaaagccaaaggggccgcggatcggtaggcggccggcgcggatcggaggaagaagggaggaggaggccatccagttggagtacttggagaggtagcaggacgacg

SEQ ID NO: 1437 - DNA, 1500 bp, Zea mays
cgcctgccgcgtgtagtgtgtgcgctcggccgcgctctgaagtcgtgcctcgccggccgctgttgctcgtcgcgcacgccttgatgctggttgctggccgctactatccgctctgctgttggccgctgctcgctcgctgcacacggctatgcagccaaagcctcgccagcgggcagcggccgctgcatgcatgccgagcgcgcgatcgcccgctctggcacgccttggcgaacgcgcatctcgttgctggctggtgctccccgtgccgccgccggtagctgctcgtcactacgcggcggcggcggctcactatcaggctggtcaaggaactaaacggattggacagaagatgaggatggaccccacgtggatagttttagggtcgaatgttgtatagttcctgcacacgcgatttcttggtgatgtggaaaaaaactcgagtattgttggcactgcccctgcattcttactccgtaagaagcttattccttacgtcagcgacgacgctaatgcggcatggaatcgtggcaaaatggcgcgcatgcacagagctaagctccgccgtcgtgcccacgcgtcgaccgtgacgtccgtgacgtcgtccatgccatactacgccggccgcacagtgcgcgcagcatgctgtaagctgatgatccgtctcagaattgcgtgcgaccgccgcgcgctacgtacgtacgtcgtcggaaacatgcacgcggacgcgggacgtgatcacgtgaatgatatattatcgcttctgttgtcgtggtggtagtcgttggatgtttgccagactagcgccgtaccgtaaggaagcttctacactctagtgctcaactggtcatggttccattggtcactgccggctccgccgccgtccgccttcttcttgggtttctgaaatcgtcgatcaggtattcaggtatatggtcatttggtcaaggatcacgtcgtcagtatacagaaaagacatgtctgctacagttacagtccatactgatgtttgctgggttttaatacgtataggcttctacttcttatacaatatttttgtctttttagattgcagccgcaccagtctaaatagttgtctttttagattatagctgcaccagtctaaataatgggctttaatctaaagcaaataggcatgtcgatcggcgccatggctgccaccatcagttcaaagtgatctgcagcaaagctaactagctaagggtaaattgacgagagttagagccagcctagcacgtgcatgctagtaatttgaagtgcgatattatactccctaacaaggcgacgcacggtggcccttccgcctccgaggcgttgccacggcgagttctacaaccttctccgcrccacggagaggttccgcggcacctttttaggcgagctcgagcgtggccagtggccagtgcccccaccatcttttctcagtcatatcagtcactacacgcacgagtgagtacacgatcgtagccaaaccacattatc

SEQ ID NO: 1438 - DNA, 723 bp, Zea mays
gtccaagtgatcttcagttcaatagatagtattttagccagcagtaaatatagggacccaaggctagtttgggaaccaaattttcccaataaatttctagtttttcaagaaaaattagttcattttttctttggaaaaataaaaaactcttaaaaatagagtttctaaactagccctaaataaacaaatttgtctcgtctaacagctaacatatagtaccccaatggaaaatcgtgaactccagctgggataatctctcagttatccgctagcggccacattccttgaccgttattatcggcatctagagaaagaagcttccgatctgcgcttctgcccctcggccaccggtatccgttccgcgctagctcagctctggtgctgcacggatcccagttcgcccgcctccgctccgctgcgcaccaacacacacgctcctcccgcctcgttgccccacggatcctctgacgtactgcaccgtgcagttgggtcactgcgcgtgggccctgtcgcacgcggagcccacgcgacagtggcccatgcagtactgcaggggatccccacctcctccgacgtctctgatcggcatcgcctccgctaagagacccgcggtccacgctcccgtccaaatcccatcgccataaatctcgccacgcccgcgcccgcgcccgcgcgtgtctcttccccccaccactccgccaccggcgccgaagcagagcagcc

SEQ ID NO: 1439 - DNA, 1500 bp, Zea mays
cgatattggcagggtgggcatttctttttttccctatttcatatgtaaattactaattttcactgtttattaatctgtgagccaagtgtagtatgcactattgtataaaatggaagatgtcttgaattaagattcgtgtcttacctacctgagttgttgcattcttcaatgtgtgtttttggcctctagctgagttggttaggtggtcagtgatctaaatagcactcctcatgtcctgatttcgaatcctagtgggagcgaatttcaggccgaggtttaaaaagtcactcactggttctcttggttgtgtgcaaacgagatggactgacctatgagggacggatcctcgtgtaggggttgggagtgctcaaagcacgagtaaagatccagcctatagggggtgggccctcatgctgcacgggggtctagctttcgtaacctttctcggttagggctccgattgagcttcttcttaatataataccgtggcggcggtctttcccctaccggccgagtttcctctagcgtaatggttaaggcttccgagtagcacctccaggtcctgggttcgatccccctcagggcgaatttctgacttagttaaaaaattcccttcgttgtgccccaccacaacttgttgagcgatgaacgtatgtgagctcactcttgctgtctcacacccccccacaggagaagaacaggtggttcaggaggagccacaaggcgaggagtatgatctgatctaggtggcgtttctcagttgacattggcgccaacgatccttagttcgtttatattaattctcttactttgtaataagtcttccgctatgtaataaatactctgatgtatcgtgacatttatctctatacactctgttattatatatgttgtcttcttggcgcatgtatgagatgcacccggctttgttctttaaaaccgggtgttacatcgggcgagccggaagtatgttcgtcgctggaggggggcctcgggcgagacgtagatcctccggggtcggctgcccttgcccgaggctgggctcgggcgaggcgtgatagagtccctcaaatggaccgatccctgacttagtcgcacccatcaggcctttgtagctttgtgctgatgggggttaccagctgagatttaggagtcttgagggtacctctaattatggtccccgacactaacggacggaaagactcccgtgatgtgaattctgaggaccaagtgaacggggaggggaaaattgagcagagaatttggacggggtagaagtgagcaaagcgttcagactaggggcacgcttatgaaaatccctttatataacggtggcggcaagagctcaagtggagcaaatcaccaattctagcaaggcagctcagcagcttttgtagcgagcttcttggagccttgaaatgagtagtagtggtagcctagccaccaccagtagcaagtaggcactataagcactaggaagtagctaaagcagtcataacc

SEQ ID NO: 1440 - DNA, 89 bp, Zea mays
ggtacctaaagtcaagaactaaaattgttttgtaggtttatgcatccgggggctcaagttggatactcgacagcgggtgcacaaaccac

SEQ ID NO: 1441 - DNA, 485 bp, Zea mays
ctcgatgtgcatatataatgcctaaaggactgaactaatttctctggtttacactgccgatagcttgatgtctatttgtatcggtcagaagcaatgtttaaaaagcactaagcacgactgcacgaggcaggcaatcaggctctaccgagcctaggagtttctaggtgcatgtattcttagttgattaattaatggcttgtgaggatctatgacattcaaaacaagaatttgatattatcatgaatatgtgagttccattatcatagttcatcatccgctatcttcagtttgcttaactttcatacatacaggcctaagctacttttaaatgacaaataccttttggtacagagccagaacaatttttttgacatgtcttgtacttacaatttaacattttctaacaatatcaatgatgtttctttcagtcattgcattcaaaatcccctttatttatcggtgataagaaaatcactctgtcatgg

SEQ ID NO: 1442 - DNA, 1500 bp, Zea mays
gttttgaggtgtacatgccctaattctcctttctacactttatttctctgtccctgttcttttagattcttaattaagccattttaattatactaactgttgatttggagttatggatattcctaaaacatccgacttataccacaaatctaatattttaacatagatatacatagaatttaaagctatttttttggcaatgttattaagaatattatgaagtatttaaatattttttgtataattttctatgtacattattttttcctaaaaaaaaagttgaaaaacactcgaatccgtattcagatagacatccaaattttatatcaattatttaaaaagatataaaacgaatttaatgcttatttttttaagattaatagcctcaatgctaaaagcaagaatataaatttacataacaaattctatatattattttttcacaatccaaaaaagaccaaaatttgatatcgaaataagtatccggatccatggttatgagtgcctatttctggcggcattgaagagtcgcatgtttctccataacaatgtccttcagccgtccgcccgtccacatacaatctctggctgagtttatgggtcctgggcctccattcggtagtcaattttattgggctggtccggcctacaccgacgcccttatataaatcccgaaccctagaaggcagcaccttcctccccaacacgccgccgtcttctgcggttctgccgtttactcttccactttggcctcctctcttgcaaggtatcacctcgttcactgtcgctcgacctctgttcttgagctgcttcatgcgatagcgactggaccaaagttgtactctgctgcctccccgtgcctttagtgattcggtcctcggttttgcgtgcaattgtagctattgcacctccattcccttagttgtttttgggttttgtttgcttctttgttccaataacctgtttcttatggattgtttcatctggatcagatgaattacttacgcatcgtcgttggaattggatgacttagtgattgtgcttgtggtcctgttacgtggtcttagtaagtgtcagatcgaatttttaaggtgtagagctactgtagtttctgttttgcagatactttgctctgtatgtgtcttcgcagttcatgtgcagtaagagttgcaaccacaaaatatgaccagatttctgatctggtttatgtagttgtgtccaatttttactggctcaaaattctgtgcgcacacttgctagtttgatattttttctaggcctgctttgtgtttatattatgtcgtttgctttgttttttgtttgctgctttacattttccactgctgatatgtatgatgcttttcttaaagctgatgactgcggtttcaacgttagattcagttttgaccccgtctaataaattttgttagtgggagttgtttactagtgtttctaattattgattcgtatggcttaacagtttaagcttcgcctccagcc

SEQ ID NO: 1443 - DNA, 61 bp, Zea mays
aattgtagcatacatgtgtttatgcatttgatcaggttcattctgcattttgttgcttatt

SEQ ID NO: 1444 - DNA, 1500 bp, Zea mays
agagatagagatttgagtttgatttgcaaaaacaaaccaagtggtggcaaaggatgatccatatatgccaaaattgaataaaactcaaagttagtttttatttgaagtgattttgcacttgttctagttgctttatgttgtgttggcataaatcaccaaaaagggggagattgaaagggaaatgtgcctttgggccatttctaagtattttggtgattgagtgcaaacacaagtgcttaaatgtgaaaatatgcccatggttgaacaaagtgcaaatcacaagtaaaggtatgtttctaagccttagtacattggttttgtgtactaatatcttgtctaagtgttagaaacaggaagaagaagaaaagaaaagaagtggagagtggctgtgtacagccaaaggctgtttcgggctggggcaccggactgtccggtgtgcaccggacagtgtccggtgcgccagaccagcgtggagcaaaccagccgctctcgggtttttctccggcgacttcggctaaaattcaccggactgtccggtgtgcaccggactgtccggtgagccaacggtcggccgggccaacggtcggccgcgcgatcggcgcgcgacacgtggccgagccaacggtcggaaaggtacaccggactgtccggtgtgcaccggacatgtccggtgtgcaccggacatgtccggtgcgccaactgtgcgcagatctgcatcagaaagcaacggtcggatgagctttttatggaaacaaatcgggcaccggacagtgtccggtgtgcaccggactgtccggtgcgcccgacgacagaaggcaaggatagccttccagatgtgctctcaacggctcctagctgccttggggctataaaagggaccccttggcgcatggaggaggacaccaagcattccttgagcactcttgatcactcacacatcaatctcgcgcacttgttcgacattctagtgatttgagctccgttctagtgtgctagtcttttgagctcaagtctgggtcttgtgtgtgcgtattcgctgtgatctttgtgtcgtgtgtgagttgctaatccctcccttgctctgtgattctctgtgaacatcttttgtaagggcgagaggctccaagttgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccactgtgtcatctctgtgattggattcttgtggttattgtgttttgactcctctctagccacttggccataattgtgctaacacttaacaagttttttgtggcttaagttttgaagttttacaggatcacctattcacccccctctaggtgctctcaattggtatcagagccgttctcttcaagaaagggactaaccgcccgaagag

SEQ ID NO: 1445 - DNA, 98 bp, Zea mays
cgacgcaacaacccgcctgccctgccctgcctcacgctcgcacccgcggcggcgcggagggccggaacctaaaccctaaccctagcggcccgcccgcg

SEQ ID NO: 1446 - DNA, 345 bp, Zea mays
tgtgagttcttcattggactgtatataatactgaaaaaacacagtattcgtgaaattggtacctgttgctgtaccctgtttgaagatcccgtcgaatttcattcctgcaattcttgtagtatcgcctattttatatttcgattgtgtggggtagaaatctcatgccctgaataggtcacaacctatatgaatagttaagtccatggtttgggggcatttagtttcaggaactaattcatccatgaacgagttagttcactgtggattattactccatgtttggtgcgatggcatatggtcttcatagactaggagaaggcttatgacaaagtacctaggagtgta

SEQ ID NO: 1447 - DNA, 1494 bp, Zea mays
tttcaacaatacatcatagggggagaacctcaaaagccaactataggcttctcctaggtatagtcaattccttggtggaagagaaacatggaaatgatgagaacactaaactagaaaatagaaaatatatcaatggcttgagaagatgccaccagaaacttgtgttagagccttctttagtaccttccgaaaatgtgatattctgctaaacaatatgtatgatttaagccttaaagcatatgtacttcctcttcttgagtgtttttgggttgttatagatggaagtagccaagtagggtggcccataggcaaacaacttgggcacatcacatggggggtcaacgtcgttgtccctttcatgggaaaattccccattagcctatcattgctagtacttatccaaatcttttcagcaagtcatgttgcatgtgatgtacgattttgggtattctcgaccccagagcagtcaatttagctttgggtatcaaataggaaattgttccatttacgtaaacattcttttgaccatattgtcatgtgatgcgatggacaactaatgccggtgcyagcctaaccaccaggcagcgaggattgtactggagaggctgctgcttcctagggccaaagaggttgtttttgaaaaaaaaaattgcccaaaaagctatgataaatacagttgtttgcttcrtttctatagccttttgagtgtgacttcatgtgtgtgatttgctatatttttgtaataagtggttagatttttcttgtttgccaagaaataacaccaggtgtggtcttttattgaagacctagatgtatttgctattttgaagccacatacttttgctatttctgcacaaaagaaaaatttgttcaccatccatgttgtctggccgtaagcttgagctatatattgtttttagaaataattraatctataccattaaaagattgcaactctaaatatatatcattggctccgcatgttattgactcatgtgaacccccacatgtaagtgagatagtaatgatatatatttaaagttgtaatcttttaatgatacatatccaaatttcccttaaaataatatatatatttaaaaatggaaataatctatataatttagatctgatgaagtgcttaaaaataagtaaaatctttggtaaacacgagtcagcgtcctgttgtcatagcccacgtgcacgcagactgggcccttgtgttagtcaccctgaatccggcccgttggatggccactctctccagagtcctcgtccacgaggaatctctttcggctcgtttcgagtttgaaaagccactcccttctcgtcgtctccggctgccttttctctctctatactaatacggagtacttcggtagaaaagaattctaaaatccacacacaccattcgctctctcgctccactctctctctcgccgagtgagggaaggagggagagagaggaggcagggaagtggggagagcggcgaggac

SEQ ID NO: 1448 - DNA, 1224 bp, Zea mays
ttgccgcggagctggcaccacaactacaatggcaccacacctacaacagaggatgtggtcacgcctttgcagtcgatcgatcgttcctagtggtgaggggagctagattgaagrcaacgacatcggatctgggtgattaggcgagacgactagggtatgttgagggcaaatggcggtggtgcaacaggttttatagtgtagtctaaattttttttgggttrcacctagttggtatgggcctgtgtccatccctgattgagctggtgtgactaaaccgaaagatatcattgactagagcttactctaattattgagagtctatggcttttaatatacaatctctctatacacgtgtgtatgtataataaatataactatagtatactatactatgtgaggcagctgtcagtatcgttgtcgttcaccgtaaagctaggtagtaataattaacgacgagcatgatcatgatggatgcatgcacgtaattgtagacgacggacggacggaggacatgtgaatggatgtgatggagcccgtcgggcgacggagaccacacccgtgacgctgaagcacccacaccgtacgtaccccaccggcggcgaatcgatgcttccatatgcaatagcagagcagcctgtggctgcagctcacagcctatctctgctctagctaggtgctggggatggggtattctccatgatgatgcgtggatagagatatcgaggattggattccatggacgccacactgttcttctccgcactgtgcgtgtgcatgcatggcagtatatgggcaccaccatacgcacgtacgatacgcgtcccagcggatgatgagccggcgggccgccggctgcttgatcacgacgcaagctccgatgatccatacgtgtccgcccgcggataatccccagcaactgtcccccccccccggccctccgtgcgcagcgcattcgatctcggtcgtcggtatggtcgtcacactccagtactccacagtccacagtccacacacacagagagatacgcacggcagctagctagcgtagcgcgcgcgcgcgcctatttatagcccctcctcgcccaccaccctctcccgcacatccggacatcgatccccacagagccagggcgtgcaggcgggcgggcgggcgagcgagcgagaggaaaagccaaggcggcagcagtaggcagccaccatcaataaagaaggtccgaaccaagc

SEQ ID NO: 1449 - DNA, 1339 bp, Zea mays
aacgccactggtctttagatattagtatagtgtagttaaaataatgtagtagtaatgtagagtagtatagtatagtttagtagtagtagtaatgtagagtagaagtagggaagcaccaactcgcgaagagttggtttgtaaacttattaacttccccttaatgaagaactgtcgttggccccttctcgatgactcgctttctctgattgtcgaactgattcttttgatatagtagatgaataacttgcgcatcacattgacgcttccagaagttgctgccgagtgatattgtagtcggtgtcggcgttttagaagcaacgccgagcgattgaaggttgacatcagcgttttagaagtaacaccgagcaatcgaacacgagaccagcgttttagaggcaacgccgagtgattgaaggtcggcgtcggcattttagaagtaatgccgagcgattgaacacgaggtcggcgtgttagaggccacgccgagtgattgaaggtcggtgtcggcattttagaagtaatgccgagcgatagagtacgagttcagcgttttagaggcaactccgagtgatagaaggtcggcgttggctttttagaagtaatgccgagcgatagaatatgagttcagcgttttagaggcaacgccgagtgatagaaggtcggcgtcggctttttagaagtaatgccgagcgattgaacacgaggtcggcgtgttagaggccacgccgagtgattgaaggtcggcgtcggcattttagaagtaatgccgagcgattgaatacgaggtcagcgttttagaggcaactccgagtgatagaaggtcggcgtcggctttttagaagtaatgccgagcgatagaatatgagttcagcgttttagaggcaacgccgagtgatagaaggtcggcgtcggctttttagaagtaatgccgagcgattgaacacgaggtcggcgtgttggaggccacgccgagcgatttgaaggtcggcgtcggcattttagaagtaatgccgagcgattgaacgcgaggtcagcgttttagagacaacaccgagtgatagccagccgcacgagttattttgaggataataaccgagtgatgaagtggcacgtcggcttttttggaaataactgtcggatgtccacgtggcatgctgtgatttcggaaataaccgccgggtgatgactgggcactttttgaaagggtatctggctcaagaatatcccataagagttgcgcttttagccgcctttgctttccgtgccctagttcttgcgttctcgcatctgaattctctctgccactcgcctcctactctattcgccagtgagaagcaag

SEQ ID NO: 1450 - DNA, 91 bp, Zea mays
aagttccttctccactttgcaatttacttgtacagcaaagctcaatgtacaatttgtttatgctgaaatactacagtgcgtacataatctc

SEQ ID NO: 1451 - DNA, 1500 bp, Zea mays
ggagggaaagaagaagaagtgcagaaaagaaacactgggtattcgcatgagcagaactgcagaagtgctcgaatgcaagcttactatctatccatgctcaccgatgctctccacggcgacgaggcagccgccgcacgccggggaccggcccgtggggcggcgggggaagctgctcatcctcccgagtgatcgcgtgctcctcgctgccgtgtccgtgtgagtgtgaggatgagtacagccgccgcgccgcgggagccgaggacgcgcgcgtcgaagctgcagcaaggcgaagcagtgccgtccgcggcatgacctgtaaaaggcactggcggttgtggtggatcctggacgggcacctgggcacgtgctcccctcccaacttccatggcagcaaggcttgcgattggctctatagggaagacaactgctccagatatggcacgggcaatgagtggcatgcccatcttcttcagctgtacaggagtacactcttcgattccggcacgcaaccgagccccaaaacatggccacacaaaaacgcgcagaaagacgtccgcgtccgcggcaacctctacatccagcattgcaaccttgaaaacccaaaaacgtggtctatcagatctcctttccagtccttttttctgaattctaatcaatctctcgaaatttcaatccggtactagtacactctacatgatatttttgaaatatttaaaactccgctacagacctaactttttttttactaaatactaacttcgttctcaaaatttgttgtctattatttcatttttaaactaaaccacaataaataaaaaagaaccaagggtcatggtttaagatactgtcgtcaaacacatattgctaaaagtaatgtaaaaaatattacaattgtgtaatgatattttaaagcgtgtattttaaaaatattacaattatgtcatgatatttgttgtctatcagatctcctttccggtccctttttttctgaattttaatcaatccctcgaaatttcaatccggtactagtacactctacataatatttttgaaatatttaaaattccactataaacctaactttttctcgaatatttgtcgtctgttatttcatttttgaactaaaccgtaacaaataaaaaagaaccaagggtcatggtttaagatactgtcgccaaacacatattactaagagtaatataaaaaatattacaattgtgtcatgatattttaaagccgtagtattttaaaactatagttttgaaatactttacttcaatcacattgtaaagtttatttattttaccgttaattcatgtggactgagtgatattaagtcagtttaaatacatagcaatacaaaattcatcctaatacattctaatacactttaacccacctgaaattggaataaacaaagtgtatcgaagcgaacggggccgacttctccgaatcgcatcccctcccccactcaagcagccaaaccctagattgggcaag

SEQ ID NO: 1452 - DNA, 1453 bp, Zea mays
tcttgcccaatctagggtttggctgcttgagtgggggaggggatgcgattcggagaagtcggccccgttcgcttcgatacactttgtttattccaatttcaggtgggttaaagtgtattagaatgtattaggatgaattttgtattgctatgtatttaaactgacttaatatcactcagtccacatgaattaacggtaaaataaataaactttacaatgtgattgaagtaaagtatttcaaaactatagttttaaaatactacggctttaaaatatcatgacacaattgtaatattttttatattactcttagtaatatgtgtttggcgacagtatcttaaaccatgacccttggttcttttttatttgttacggtttagttcaaaaatgaaataacagacgacaaatattcgagaaaaagttaggtttatagtggaattttaaatatttcaaaaatattatgtagagtgtactagtaccggattgaaatttcgagggattgattaaaattcagaaaaaaagggaccggaaaggagatctgatagacaacaaatatcatgacataattgtaatatttttaaaatacacgctttaaaatatcattacacaattgtaatattttttacattacttttagcaatatgtgtttgacgacagtatcttaaaccatgacccttggttcttttttatttattgtggtttagtttaaaaatgaaataatagacaacaaattttgagaacgaagttagtatttagtaaaaaaaaagttaggtctgtagcggagttttaaatatttcaaaaatatcatgtagagtgtactagtaccggattgaaatttcgagagattgattagaattcagaaaaaaggactggaaaggagatctgatagaccacgtttttgggttttcaaggttgcaatgctggatgtagaggttgccgcggacgcggacgtctttctgcgcgtttttgtgtggccatgttttggggctcggttgcgtgccggaatcgaagagtgtactcctgtacagctgaagaagatgggcatgccactcattgcccgtgccatatctggagcagttgtcttccctatagagccaatcgcaagccttgctgccatggaagttgggaggggagcacgtgcccaggtgcccgtccaggatccaccacaaccgccagtgccttttacaggtcatgccgcggacggcactgcttcgccttgctgcagcttcgacgcgcgcgtcctcggctcccgcggcgcggcggctgtactcatcctcacactcacacggacacggcagcgaggagcacgcgatcactcgggaggatgagcagcttcccccgccgccccacgggccggtccccggcgtgcggcggctgcctcgtcgccgtggagagcatcggtgagcatggatagatagtaagcttgcattcgagcacttctgcagttctgctc

SEQ ID NO: 1453 - DNA, 1500 bp, Zea mays; identical to SEQ ID NO: 1451

SEQ ID NO: 1454 - DNA, 486 bp, Zea mays
tgtaaattttatgcacacgtttatttggacaatcttggaaccgcaaaagattaacatcattctatttttttgctgttattgatttcatcattaaaatagaaatcgtgtcagtgttgcagtcgtgacataagaggcggcaatgaaacttttaacagacaaaaaacatttagcagtcatatgtggctatcaaaaaatagactttgaacaaaattattttagattattttaaaagtatccgtccttaggcttggcagggcgccgcgaagcgcgcaactttttctagtgagataaaagattgaagatagagatacctgaagtatacaacagccagcccaataatgacatatgggacacgtcactatcgaagagcttgtagttgtaggagcagatcgcggtaagcttaccacctaggcaccggcggacccgccagttccgcccctgcatccagtgatccagtcaatcgcggacgcccgcttggccgcttcc

SEQ ID NO: 1455 - DNA, 981 bp, Zea mays
cgaaatgtacatcaactgcgcaatggccgcaatgagatgagcgacagatacacgcgatgggaccaagcacttgacctaaccaaacccagttcaaattagccagtacttgagttggtcaattacttacggcctcgagtgcaattagcaatacaaatcttcaaaacaacgttgctttatataggtctatgaatgaaaacatttgaagtaattagaaaaaatgcttaaattgtttctattttaagcatctttttttaaataaataatcaaatacgatattgctagaaatgaatatgtcaatggaacagttcgatatttgagaccaaacctgaatgtttaaaatcaaactgtaacacacctgttaactctaaatcggatcacacactataaatgaatagaatggacgtagacaagagctgacggtggaggaacaacagaggagaggacaggcagacagagacgaggagaggcggacgtgagcatctgatgaattagatcgtatccttatcatgcatttcatttcaaatgtcagaccagaccacataataatataattagttgcacgagatgtgacaagtttctaaaacgtatgctccagcttgtatcatgatagtggacgagaacaatctcaccagcattctcgctccaaagaattctaagcagactcatgtttacagtagaaccaagaacaatagacgagggtacgcaaaagtttttatctgaacactagaactggaaaaccctattgccgaaagttgccaaagcaaatgtgaaggttactcgaggcactccagttaccacaagcaagggatcaatttggcggcatctgcagtcatttacagtttttacatcggtgggtcttcctacggccggctgccgttcagctgtctcggatcaggttggttggttcactcaaaacatacttgggcagttcatacttagcacctggaatgttaaaagaatgcttccctgtgcttccctccg

SEQ ID NO: 1456 - DNA, 307 bp, Zea mays
cggctgaggttactcctaaggacctcagagatggctttaactccttgatgatcctgggggcttggactatatggagacaccgcaatgactgtgtttcaatggtgctcaaccttctatagctggattgcttaccttagccagtgatgagttcaatatgtggtgttttgcgggggccaaaggcttgacccgtctttcggacctagcttttgtattcaaccccggctaggaggtggttattcctcttgttgtttgtgtgtgtgtgagtggtgtgttaagtctttgtaaataccatccttcttctaatgaa

SEQ ID NO: 1457 - DNA, 1347 bp, Zea mays
taaaacactggatcgcaagttcgctgttatgtttcgtgagcataatgttcgaaaattccggtatgtcttgaaacatgtcgtaacatgtgctaaataacatgaatatcattttcgcattcattgttttctattttttgagtgacttgcagttcaaatctgaattatctgaagaaattcaattaaacgaactaaatctaatagttttagcaaacgctttgataattgtgccaaaattaaaacatgtaggtctatatactatagaaacacaccacaaaaagtttaattatgtcaaaattaaatatgtaggtctatatactataggaacgcaccacaaaaagttcggtgaaaaaaagaaaaaaatattttaccaagtgttaaggaaaagacattcgacaaacactctctttgccgagtgcccaccaaggaacactcgacaaagaagttaatttgcccagtgtcaactccgaacatgcggcataggttaaggtcaccaactatagatagctgctgacggtcctttaccgtgcgtctcgtttcgccgagagacactggacaaagactcttttgctgagtgccagcgtgtgccgagagttttgtgctcggcaaaggaggtctaagccgagtgtcattattcaccgagagtggcactcggcaaaacttgtttcgtcaagtgcccgataaattgctctcgacaaaaagagcctaattccggtaatgcatccacattttatgggttatagctattgtatatatactcaaatataagaaactgcaaagttttgtgtgtgacagggtcaacacgggatcgaagtagttagcactgaagttgaagagcagcgaatttagaatacctgtggcacctgaaactgaccatatcttgagtggaggcacgacaggccaaatacatacatggcgcggatgaaaaggtcagcacgccaaccaatccgcctcgatcgctgccgattcgccgccgttgaaacaacatacgtctatgtttgactcggaccaagtgtacacactaattttcgatcgactctatcggaccaagtatggtcacagcttaatatactagcacattactagtccacaacgcaaagcaagccctgacgtctgagggtacgtacgttacgtataccttgtcacctaccgcgctcccgtggattacatatactcctatgctatatatatgcgcccaaatccaacccgaaggatcaaaccatcacaagctctagttttccagctctgcagcacacaagctagttaagctcctgcaacctccaagaaactaggcaatcgtttcctcctctgcttcagtatctccccttccagcagtagctaagctgccat

SEQ ID NO: 1458 - DNA, 624 bp, Zea mays
gctttaaattttcatacatatgtataatgtatttgttatgcccttaaatatcttacacttcctctgttctaaattagaatttgtttgactttttgtgctatcctattcaattttttttagaaaaatgtaaaattcaaagccatatttatatatattatatgttaaataatacggtagcaaaaattaacaataattctaaattttttaaaataagacgagtcgatgataaaaaaaagtcaaacggattataaataggaatgaagtttttagttttcattaatcgtttatctaaattataaaaatgcatatagcagagaaaagagggtctctctttaaatgagggataggagcatataaaaaagataatgttttgaaaatatagaatgtgtattcccatacgtgcccctaaaatggcgacagaccaccatccgtttctaggcttctacatgaacttcttctatttctgtacaagctgccaaccgtgaaagcagtctgtttttgtagtgcaccagtctgtttcagtcgatttcacgattgaccaataagcagcatgaccactgtgtacctcatatttctctttatatgcaccacgaaacacctccgttgtacactacgccaccacca

SEQ ID NO: 1459 - DNA, 270 bp, Zea mays
ctatcccttacctaggaagccttttagtttccttctcccaccgcggcctcggaaaatttcccccttccccgtagcgaaaccctagccgccgcgccaaaaccaaatcccgccacgcccgaaaatttccggtggtttccttgccgcgaatcgatcgattycgagcgattcggttgatttgatcgatttcgggtgcttcgcgattgattaggccggcaaagccgccaatccttgtgatctctcgaaggggtagagcgcggtcgaccgtcggtc

SEQ ID NO: 1460 - DNA, 577 bp, Zea mays
tccggtttgcttgcttgccttagcgtaccggtcccagtacacggctgcagcactcacgttaactctatccgcatagcgttccggttctagtcattcactgcggctagcctaagagctaatgcaaatactaattcgcgccggatgagtacacaatttatttataataacagaaaaaaaacaaggaaaaaaaaatctgttcgcctccttccatggatcgcgtgggtaaaaacaagatggtgtcgtggtaaaatgcgacgtcgggaagatgttgtaggagacgaagattctattcgcctccctttctcgcccctcctctgctactagcctactactacttcagttctcgccttctctgctctcaccggactccctccttctctctctctctctctctctctctctcgatactaccccctccgctcccctccaagcctctcctttttccaccctcggaggcgccgacgtcctccgacttccagggcggcgccgagcaacaactactacctggtcacccagccaaaaggggattccttttcggtgcgctctccgatcgattgatgagcggcgggcggcagcg

SEQ ID NO: 1461 - DNA, 287 bp, Zea mays
agtgtattaagagtttatctgtatttaaaaaaacactgatcaaaactatattttggagaccatataattgtttaaaacgatattaatagaataccgcactactcaaaaggaaaagaagacaacaactacgtagttatgtaagcagtctccgttagattagtcgtcgaaaaaaacgtgacaagagcgaattcgctaaaactatagagaccaactcgcaggctcgcagccggcctctccgcctccggctctcccctcctcgagcgctttcggcaccgtagttcggtacg

SEQ ID NO: 1462 - DNA, 867 bp, Zea mays
ggtaaagactaaagagtgaactggatggcgcttaagcatttcaccttccgtgtcatcgtgttcttagtttatttgtggtatactattatatgtttttttgccaaaattattgcttaactgatgctttgtttgattggcttgatggaccatcaaaacttaagatttgactatgggcaatgcagaccgggcacatgttctgtttgatttaccaaacggtggcagatttagctaaattttcttgtagtttgttggagggtccatttactttacgatcctctcatgtgggcttcataagttgggcctccatgactgatattagctgtatcaatagctaccctatttttataaaggatttctgtttttttaaatgaactgagaaaatatttttttttggaaaaatagagttgcgaaactcctcggttattcttccatgctcatttttgttcaaagtcgacggctgggttcgtgtttttttcgttgctctgccaatcgttagtttttttgcacgaaattatcatcataaatataaaaaaacaatggtcaaaagtcaggagtatgttttatttctgaattacgatgaagtccatttctgccaaccaaaggggctgtaggagttggtaatcccgtcgaatcggattcgcgggccccaggggccactcagccagtactcaatgactaaagtgccctcccaagttccgcaattcacgcgcgaagtcattctcgtaatctcgtccaaaatgtcgcacaagcactgtttcgtccttcgtattgcccttcctatagccgcacgcatggcgaaccgaagcgaagccaaaacgcccattccccttcgccctcttcgaccctagcaagaagacggcggcggag

SEQ ID NO: 1463 - DNA, 184 bp, Zea mays
atctgcccgccgctctggaatgtaatacactccgatatgatgtgaacacaaactctgtgaattctgacatgtatttatgatccgtttaatagcagtgttggggctgccttgtgcaccgaatcagtgattgggcagcgtaatacaaagagggagcgcttgatcatatgagctggttttgtacaga

SEQ ID NO: 1464 - DNA, 968 bp, Zea mays
aaaggagtgatgttaacgtatcctatcgaaccatctaattttgaggatcattggtggaattcattcttttggagagctttcacgctaccatgtggcggtagcctgggactccagcttgaatcaagttttgcatgcagcaagctgtactttagattcttcatacataggtcacgagagttgtttggagcttgggtcatcgcttactttcccatactactggggggcttatttggaacagttttttacacaaaactcctgacctgtaaatcaattttggaaaaccgtatccggtggtcgatccatgtattaatagagtaataatgttactatgttcatccaaatctcaaagacgtgatggttgtgttgaaaaaacagcttgaatcacttgcttatgctcaactgttttttcttcatgtacatgtgacggaagtttactgctgattgtttattacatccagttatcataatcaaatgtccaacgaggtggccccacctgcagagtccccatcaaaccttacgagrtgggccatccctgactagttaaccacgggatgttacgaggcaggaggtggcaccgcaccgcattccacttccaccgcgccgcgtcatcttcttccttcagcgttgagcggaatcgcgaattgaaaacggaagttaccaattcacccgactcgatagacacaccggctctgctctaagcgagaatccgaggagcgctgccaagcgcctccgcgacgggatcgacgcgacttgattcgcgagtttcaacgtcgcgaggagagcagaaaattacgcaggcagagcggctgccggctgggtgttgaagctagagcggctaggagcaggttcggagcgctaccaaacaggcccttaacctaagcgctcctgcccttcggatccggaagttggaggcgcgcgaggaggcgaggcttgcaaggtctcccttgctagacggcaacggggtgacg

SEQ ID NO: 1465 - DNA, 133 bp, Zea mays
taacgctaaccccggcttgtagtgtgtttaaaattgtaaaattcagttttcgcctatccacccccctctcctaggcgactttcaattggtatcaaagcccgatacttcatttagagtctaaccactcgaagtg

SEQ ID NO: 1466 - DNA, 90 bp, Zea mays
gagctttcgggcacccagaccacacctgggcccagccatcatagtttgcttgcacaacttttaaattatgccctttttttttcacaggga

SEQ ID NO: 1467 - DNA, 210 bp, Zea mays
tgaattaatttatactactgttatatgcttttgccaattaccatcaaaatatgagaagaaacacgcttctgacagraaatcgctttctgttcaggaattttccttcatgatcctgtgagcttcactgccgtacttcatccagagtacttcacattcaagaagggtgtggtgagagtagagacccagggcatttgcactggccacactttg

SEQ ID NO: 1468 - DNA, 326 bp, Zea mays
agtatgtttttttttctctctgagtaactcataaaagattgacccgtctgatgttttttagtttcagcattcttacatacaccacattgatatgacataaatctcaccaaattactttataacttttggagtaagcaaaccaaggcaaaagttaccccacatgatctatatgtttcagcagatttcacacttgtttcttcttgttcctcctatgctgcaggtggaattcagagaacccatggtcagggtataaaccgatttcagttgcatggacggttgatgtgcccaatggtcataagctatataaagaagtttttcttttttcc

SEQ ID NO: 1469 - DNA, 227 bp, Zea mays
ctgcagaagcgctcaggaagagcagccaaggctactgtgttgagccagcctgtgttgagccgtcctgcatcactcaaccgtcgtgtgcagccccaaccacctgcttcggcccacgcctgttctcctccaagtccaagaccaagagagaccggtaaccaaaaccagaagttgccaccccgatcagcccttggcctgagctcatagcggagcccagcgatgcacggtcg

SEQ ID NO: 1470 - DNA, 170 bp, Zea mays
tgcagatgtgaatatcagcgccaactcatcctggaaaagagcctaacgagtttcaagatccacgaagcagatccgtcagttgaaaagagtccaatcaatcaagacagggccatgacaggacgtctagctttagcgagctaagatgctcctaagttttgtgtcaaatgtag

SEQ ID NO: 1471 - DNA, 1129 bp, Zea mays
tgttatctatctcgcaactcggtgtcataacctatgacgcagagcataggtttaaaacctaaacgtaaactttttataagaaaaactaaaatacaaaaaaattcggccgactcacgtgaggccacgacccgtcactacggccgaccccgactcggcggctgcaccgcaatccgaccgaccgccgtccgtccctctccacgccgtctgccgccgcatcaatccagcaggcagcgacctaggggctgtccgtgtccggttgggaggcgccgggcgcactggggtgggcggctgcccgcctggccggccagccgtaagcgccgagcggcgtgccggcatctccgttgcggtgtgggcaaggcaccagcggccaggtccgcaggagctcgggatcgggcttggtatgtgcaggggcgattccagggaggggcacaggggtgcaacgtcccccctaatcctccccaaattccataagagctactacttttttagctaattaccatgtaaataatataaaatacctcttaatagccccccctcaatctgatttaccccctcaaactcaaattctggcttcgcccctgggtatgtgggtgatttggatgctcaagaaaattcaccagctccgccgatgcactcatgccaccaaaagccacatgctagttttctagatccacgtctagatgcatctgtatgttctgagctcctggtacacccttgccggttaattggccactcttattcaaatacatcttcgtaacttcatgcatccggtggttgttttctgttgcaacttgcaaactacataagcacacaatgcttatattggctattctatagtttggctttgtgatacttgttgctattcttgtagtacactaaaatgttgtatgatcatccggcagtttgtttgaataggtataaacatgatatttactgattaccaagtcgaggtttcgatcgatcgatttttacactgcatttaccgattataaagtgcttgccaaatgaactgtatgaatgctactggcatcgctgacctgattatgctgttgcagtgctgagcattgtgggcgcaactgttagagatccgactttattcctgaaggcatttgtctgaactttttcggaa

SEQ ID NO: 1472 - DNA, 671 bp, Zea mays
aattcgttctaccttttaagttaattcataccataattaatatatttgttttatatatgtgtctagatttatcattatttatttgaacataaacataaaaatcaaagagtaatacgactaatattttagaactgagtaagtatatatttatatgtttacacaaacattaggcacagggccctgccagctcccctccttatttacgccactaatggtggtaaacagcatatgctcgcgtcacgtcacgtgacgggcacctgctcgcagttctcagaagtcagaacaagctcggagctcgccctcccagtcccaccggccaccaccgccaccggactgcggaccgacccaccctggccgcgcgccaccacaaaggccaacggcgtacaaaccataaacgaccagcgaaagcggcagactctcaatgacacgcgggcaccatatgccacctgccgtccctcgcccccaccggcaccgacccccgccttcttcaaaaactttattcgccgaaaccccttgccaatgccacctcgccgcctccgcccgacccagcaaaaaggcacgacgacctctacctctacctcgtcgccaccgccgtcaccggtcaccgccgccatataagtaaacgctcgcctcgtcctcctcccagactcgccaccctccgcctccgacac

SEQ ID NO: 1473 - DNA, 1362 bp, Zea mays
ttcacacaaattatgacctcatcatctggaagaattgggcgcctccaaaatgcaagtttttcagctaggaattggccccatgaaccaacttgcgtcttgtgtcgtgctgcccaggaatcggggcttcacctttttgtggaatgtcgtttcatcaaaagaatttgggaggaagttgctgtttgggtagctgttgarggcctgaagccgtctaactgggggcgacccccctcgctggggcatcggtgggaaaaactggtttttttgccgggatgcaatagaaaaggcatcagatcactattgatccttgtaaactgggagatttggcgagaacgaaatgcgaaaatctttgatcgcagattctcgagctgccaacaaatcattrccaaaatcaagagtgaggcagcagcctggaatttggcaggggccaagcacctagttaccccttaacaactatttagtggggtctgttttttatttctgtttacttctcttcaggttagacctttgcctagtgtttcggtcactgtattgacttaaacctcttgttattcttcttatcaatatatcttggcagacctcctgccttttcaaaaaaaaaacaggagggtaacggtaaggtcggaccgaaaacrgttgtgcaccttggatgagaggtatagcatgatcacaactgcggctaggtggaagacccactrgatcagaaaagacttcagcaaattcggtcaacatcctggaaatgtcagggtgaagttggtctgatccttccaaggacctgttagtttcaggtagggaatccagtaacacaacttccacagtagtgccaacaggcacggttggatgcataccatgcagaaaaacagtagagccattataaggtattgccatcaatttgcttgcccaatcaattctcataggactgtgtgcttcaagccaatccattcctacgaccagttataagttgtgataggcaacaacagaaggtctgacacgaaactgaaatcttgtataaaccattccacttgcaatagctgatgttcacagcagagaacatcttcgttggccagtcgaactgataaaggaaatggcctggtagagaaaccatgcaaagaaggtgacaatcgtgtactaaaaaatgtgtgagaactgccagagtctaccagtattaggagaggtgtggactgaatggaacccttcagtttcagtgtttgaggaccctcggtgccagtccatgttgcttgagataaagccatcatgatctaaggagaaacaggctctgggattttctacttcaccatcagtactgaccagctccaacacttcctctaatgcatgaagctgaactgatgatgcacacatgtgccc

SEQ ID NO: 1474 - DNA, 1500 bp, Zea mays
gcttgcttagtgtttattgtttctgagagaacaaaacatttttctgttatcttttgtcttctctattggctttggcttgggttttgttaagtaaaattaaaatgttttctgtgctcaagacttggaatgctggttttggttcttgcctacctggctttgaagaatgtgaacttgtgccgtgccagatatatggtccggatgatggacaatctacatccaccacagaagtcaagtttgtctactgaaaacgaccattctctgtatcttcttccccaacgatggatcagctctatctattccatctaccggtctagtcaattcaaccgcggtacggtagatctagtcatctagctgctggttccccgcctgatcactctcaactcaacgccgacaaagaagaaatcaataatcatgcgttttgcctttcacgtacccgttccagcctcacactcttggccctagctagctatacattccatctgttccatgtcccatttacttaccatgtatgtatggaacaatctgcctaaagttcctagctacgctggattaggtttcgggcagatcagacacacacacacacgcatgcgtatcacatggtggttttcagatgcggccaaataggcacacgggacctgagctcgatctgaagaagctaatggcggacatactataccccggcccacaaacgctgtagctacccccacctccgccaggaacgcatgcattaattcaagtgagctagctgttcatgtcacgcagctatacagcaccacgcgcggcatcaattgattgaccaaatggtgacccggtgagttggaggagcacatgagcaataaataaatcgaacagtccaagtgatcggatcggatgtcaatcaggagggagaaaatagatagaggggaggtggtacaagcaaagcgtacgttgagtagaagccggaggaggaagaggagggggagcaagagtcaattggagaggagtgcttctctgtccaacctctcagctcagaatgtgcatccaaagaaacatgcatctttcgtctcatgccgatacatatatgtccttggttttcttcttcttgtatctctctctctctctctctctctctgtgtgtgtgtgtaaaactgtgctcctacacaattctctggatctccaaaatctgaccagattggatgtgcgattcccgtttcttttcatgtctccctgtcgagacgagacgtcgtcggtgccattaaacggaaataaacctttcccggcatatatgagcagctagccttcctcttccacccacgtcctcctccatatatataaaaagtcccacaccctcctccactccacctccaaggccgtgattgcagtagagcatctccttttctttatttgctatatatatatgcatgttgtgatcttcaagcagctcggccgatcaagctcatcaaacccatagcatcgccaccaaattaaaggtcttctctagatcattacatacacatatat

SEQ ID NO: 1475 - DNA, 912 bp, Zea mays
actgtacatgcccttaagaacacttgtgagggcattttttctccggttcattgtaaccagttccgactcctcgggtcactgtaacgagaaactaaggtaccgtttggttcagatatttgtaacgtaatgggtaaacgataatattaaatcatgtttgttttagtcccttaccattaccctttgcgttacatttattgaaccaaacagcacytaaattcgtttgaagccatgttaaataccccgatccgactatagcatacttaaaagacggcctttattctatttcaaaacgccaatctctcgaagatggacctgggctaaaatataagttcaaaataattgatgcatgagaaaattatcgtttacttacttgctcgtgagagaccgaaaattgcttagcttagctacaaaagctagctaaaagatggacctgggccgaataagatgcttcggacggtaaagttatttgtgaaatgaaactgaaaaaaaaacgtatttttaaatataaaatccaaaaaagttaaattgcaaaaaaaacggccgccgaggtcgaacggacgagccccactccccggctccgctacgcccggacccggattttgccggcgaatgtcctggcatgacacgcgtcgccaggtctcgtgtcctcctcgggatcttcatcccgacgggccccacggaagcaattcgcyattctcccaccgattctgaccctacgctaacttacatgtgggccaagaaaagtggcccgcacaaccgtttccgcgtgggacacgaacgcagcgggaaagagaaaaaagtagaaaaagcgaaaagcctagtagcacaaggctacaagcctacaagcaaccgcgtccgcgtgtggagcaaggaaggcgaggggagccgagcgggcaaccggcggcgacagac

SEQ ID NO: 1476 - DNA, 501 bp, Zea mays
tcttctacttgcttctctatagtataaatgtaatgtataactatctctctaatatgatttaagataatatataaatatgttacatatatataaatatattaaattaattagtttatgtcgattattaatattattaaaatgaaattcaatttcaacaaacggaggctaagataaaaaatgagtaagtagtatgaaatgatttgatttggagtaagatgatataataaaagacatattcagaatcgaagacaaaattactgtaggttcccggacgagtcttctctgcagttctgcaggcgcagaggcactgacaggaggggcctggtgttgaggttagcttccttccgaattcccaaaccgggtatacgctcatcggttcctcggcgctcgcctcgacctccgactcgaagcggccctcctccctcgccggacgacggcgacggccgtggccgtctaacacatccgtggggaaccgctcccttagttgggcctcctccggcc

SEQ ID NO: 1477 - DNA, 241 bp, Zea mays
atttgacgcccccgtttgtttgacttgaccaggcagccgcgggacctcgtgcttgtctcgttcccgtgcacagggctgttcgttgccatcgaccgtcatgatgatgagaggatggatagcttggctgccggttggtcttaactgattttgtttgttctttggagaagacggccgcgggggaggctgtattttttttctttcttttgctcctttttcacaaccgcgatgcaaacaaaacaaa

SEQ ID NO: 1478 - DNA, 839 bp, Zea mays
ctgcaaaatactgttgcagctgcaatccttagagagaaaatactgtagaagccgcagccgcagtcggattaaagccgcagcgaacaagccaatcctcttcttctgaaatatcgtcctcatgtttcctagagctttcctctccaggtttggcctcacctagctttggaagttctttcacaaaattgaattcaaaaccttgaccctcttaccttgtcgatgttcctggacctgatggtctgtctcatcgatacccttactggaccctctcttgtcagttgatagctcatccaccactaggacctctccagccagctcagcatcaagtttgatagcagcctctgttcttgcaacccagccagtttccaacatccaacccatcacccaatccagcacatgagattccactccactcgtattcggatcagccaccatactactgcagacgcagcagaaaaccactggacctcatctgtttctcccctggacgtagctgtagccactagccagtggacggtgccgttacaaaaatataacccggaaaccgacgagctccccccgctgctgccggctgttcccggaggccgggagcgccgtttcacgcgtcgcccagctcaaaggccgccacatctgcttccgcgaaccggcggccctccgtaacccattcctattatatataggcggctttaccaccgttaccttctctctcatcgctcccttcgccgttgctcccgccccaccatccgccactggattttagccaccgcaagtaccggcagctccagcaagagtgccactcccaccccacacccacaytttgatgcgcgtagccgccgcggtcc

SEQ ID NO: 1479 - DNA, 441 bp, Zea mays
acagttgattcataaaacagctcaaggaactccaaaaccttttcagctacataccaatgttgtccattcagtagaggatagccatagtgtgtattaatgaacacagaaaacacagacttatatggcaagagatgttttagcataagataagttgaattccatctaacatccatgtctaaaccaaattttctaggtctacaaccttttgctttgcagtaattactaaatgaaccaattctctggttagaagagtttaagaaattaatagcagtcctaaacacatctaaataatccttaagccttttcaagccacattttactatcaagttaataatgtgacaggcacaacgctgatgaagcacactataagttttgttactggtatctgttggatcaacatcagcacccaaataaccagcaagcataggtgacaatgtgagc

SEQ ID NO: 1480 - DNA, 839 bp, Zea mays; identical to SEQ ID NO: 1478

SEQ ID NO: 1481 - DNA, 49 bp, Zea mays
tctgaaggcccgcccaagatgttcaaaatgaagggcgaagtgagaacag

SEQ ID NO: 1482 - DNA, 979 bp, Zea mays
ttgtctagcatcctcctcccaggaactcattatctattatgtatagagagatataattatcacgactagcttggcattcagatatataattcaaacacaagaaacgctaactgatgacctcagcatagtatgtacgacatattaaataagaaaatcaaattaacatacacaagaacagaaacaaacataaattcaataagcagactacacaatgacataaatgcagcaaacaaacaaacataaattagcataaatgcagactacacataaagtgtgtatgagatagcctaaccatattacaccgagcaaagcaaagctgcgtgacgcggagaggacggcgttggcgtagaagatcccgcagctgtcgttttcaacccttggaagaggagggaggccggaggcgggccgagagacggccccgtttccttctcttctacctccctccctcacctagttgagtttcctgcctttggcttcccccatctcctttcctcttccgtctcggcgtttccgtctccacctccgcctccgccttccctcctcgcctcgccacgccacattcgcatctctggatccccctcccctcgccctctcccattacccgccgccgccgccgcctcgcgcccgcgacccacccggcctcccacttcgatcccgccccgattcccccgctcgcgcccccaacccgattcgtccctctcacgcgcgcgcgggtgggaagacagcgatggcttggggcgggggcctctctccccgccgcgggtgacctctcctcgcgcggggagccctcccgcgtgcccacgcggaggatcccgtcgcggctggtgcactaccacctcctctccattcgccactcccccgtgctctctcgcgcgtcccctcgaccctaggtttgctccttccctcccttcctcgccacccgattcgatctcgctccctccggcctccggctaggctgctccgtctctcctcctccgcc

SEQ ID NO: 1483 - DNA, 639 bp, Zea mays
ggaggagatataaaaaaagattataccattttggaaagttcatcgacgtgcaacattggacatcaccgatttgcttggctttaattcatatcaatttctactatttctatattgatattgtctctatagattacaactatagcaatccaaacaactttattcagaagccaacagctctgacctctgatcgctgttcatccaaaaacaaagcaaactcacccctttacgttgttctattctatttctataaagtagtacaagagattttgctttatcaacgggccacaatttctttccaaatttttcggaggcctgtccaccaccgaaccaccaccccgcgcgccgagctcaccccgatccagatccaccagtcgtccctccggtctgcgacgggcgccctcctcctcgtcctcacgcgcctccggaagccagtgcctgcgcagtgaagcatccatctgcctctcctctcgtcggtaaggacgacggacggagctgctttttcctatttcattttccgatttcgaggaggcggcggaataaacctgctgttttattcgtctgccactcccacgatgagcatatccctgaaatctaaaatctctccgcattaggatccggggccggccaggcggcggcagc

SEQ ID NO: 1484 - DNA, 1500 bp, Zea mays
tcaggctataatttaatacacatatcatgattaataagcactcaattttctatttaggttcgacattgttttgagcaataatttagatataggggggagtgcagacatcgttactaaaaaaaatctcataataggaataaaaaaataaactacgcttggagcctttgcacctcacaatagtaataaaatctcataatagttagtacgatacgattcatagcagtaggcagtcgctccgtggcccgcccaattagctgcgaaagaaaagaaggaaaccggggggccatcatcgcagtggaactggactgtgttctccgggtttttcctcgctgcgttggattcccctgatcccgccgcgggccccgatttcgtgtgcccgcaccggtcgccgccagccgacacggccttaattccttcctgagacacgagtggttggtttggttgctgataaagaaaaggagacgtgtgagtgtgacacaggtcgcagctcgcacgcgtggttcggtggttgtgccacagccagtgacaggtgggcccgcacgttttccgtactactgcttgctactctgctaggttatttgtcattaattaaaacatactagtataagctcaaatgctactgccatttttaacatcctgctaaagcatttctttccatgctcctttacatgcgtgcgtgccagtcatggctcctggcaagctaacgggaaggaaccgagggattttgcagtcatcttttccataggactcggttcttttacgatacgttcccctacgcaattatttcgccatgatcctcttgtgtaaagaaagtgcgagatctttggattgtattacaataagaaagtaatgtgcagcatgcaagtcttattattccaaagtgggggtcagtcttaagcacacgcctatccctttggatcacacgctcttctcaggtacaagtggaacccaccgtaccaccaccgtctgatgatcaaggtattagcttcacctagtgactagtagtattgtagtcactttttttttaatttggatggacatgcatgcagctcagagtgtagactgtgtagaatcccatgccttgttgtgtgttcgcattcactcatcagtcatcaccaacccatagcgccgttgtttctccagtcaattttttaaatgaccagactctccttctgtgtgaaagcttgggaaattttgatagcgccttcgtaccacctcataatttcgtggctgtggtcaccgcatttacgcctctcaattcgacgtccagccgaagcaagaaaagatcataggggagagtatactcggtggggcttgtggttttctggagcattcctactagtacgtagtctcctaaatgaattttgactcttttaaaaatagccgaggcttccttaccctgtctccttccagcttcttctatgcttgcaattcttttctgcttcggtgccaagaagctgagtagtgagcactgcaggtctgtgttgtagctgccaagaa

SEQ ID NO: 1485 - DNA, 483 bp, Zea mays
ccaccgagcatcatgacgaagattcctgatagttccaatggcagacacatctgattgagtcacacctgacaagtcaaaaaaaggcgcaaggacaaaattctatcccagatgcttcaccctctattttttctatctggattgataaaccatgctggatggggccaagaggaatgttttttttccagtaaacactcgagaatgcacccccagcaggcagcagcacaagacagcgagaggtgtgaatgcagtagggacatggatgtgaaagggtgctcatagccccatgtgatgcaaggagtcaagcattggggcaagctttgtccctatctccacgtttcagtgctgctaatcctagcttcaacatggtacagccttgtgtgggggtcattccatgtggcctactgtcgtgatttgtattgtatgtacccctccttgtaggtagtgtctatatctcctgccttgcagcttttgcagtgagctacc

SEQ ID NO: 1486 - DNA, 202 bp, Zea mays
agtaagatgataatgtggttgattgcaatgaaccgctatcacgccgcacagggaaaacccgaacagttcactcttgaaaaggggagaatgtttgacgttgccgataacctgtttcaaggcgctgtgattggcgcccttgccaacaagtatgttgattcttatctaacgtgcacatctgcaaaagagttatggcatgcattag

SEQ ID NO: 1487 - DNA, 1002 bp, Zea mays
cgtgcaatccctctgcctgcctgcacagcagcagcattattgaggtgtcagtcgtccatggagacagaggattcgtcgtagcaacctcgtcggggccacccacccgtaacggaaacaagagaaaaagaggggcagcactgcaacgagaaagctacttgaaaacaccgatcagtaattaacaaattactactcctcgtgcagatttctcacatggtctgagcgctcggctttatttttattttacttgctcgttggcatgcgtagataaaaaatccccggtgcatgtgtaccacgcgcgtgggtggtttcgttataagcaacgacctcggatcccccgtgtgtaaaaagaaaccgacctgtcacccatcgcgcattcacgccttgtcacgtactactactaccaccgcgtcctgctcatcggcgtcacgtggcgcgcgcgtaatcgttcgtcgcagcagcccaatccaccctccgccctcggatcgtccgcggcggcagatttcaaccgtgtgcgtgtgcgtgtccgtccgccgggtcacaaaagcaggggaggggcgcccaacaactcaaccactccgctcttccttcgagaagagcggtccgagcgaacagcggttttgcacgggttctgacgccgtttccgctccgttggtcgatcgaacagtggtttttgcccgggatccgtcgcggttttgctctgctctgctctgcgctgcgccccgcgacagggtcaaggcaggggaggggagggcacgcccccgttccgttagggcgccgcacggtcggacgacctgccctgcccccggcacaccaatacaccatgccgctgccgctatataaacgccattaggcgcgcgtgctctgctgtctcgctcagcagctctctccaactccttcgatcccttccctcctctcgccgccggccgattcacttcttccatcattcgattaagcaagcaaaggcaaggcgcatttccctcgggtgactcgatcggccgcacg

SEQ ID NO: 1488 - DNA, 1275 bp, Zea mays
ccctatgcattgttgcggccaatgatagctgaatccgaagtgtgaaagctctgcacgaactgttaatgatagaatgattgctttaaatgaccgagacaatgactgaggcacattacgtgagacgaactacgactcagtgtgacttaatgaactggagacaaaggtgcttcttaaactgtctatgcctatgggtaaaaaaaaggactcgacgacgaagatctctgccgagtgtcaaaaaacactagtgagtgtaaaaaacaatactcttatcaaatgagctatttagacgagtgtgagtgtttgattgtaccgaggattctttttgcttgtttaccgagcgctctgaataacacttgaacaatattagagactcgggcgagaaccaaatgtgtacttgttccatcacaacacgcgtcactgacgggagctcaggatctctggaggacatatggctactgtgacactcgctcagatattgagacctaccctgtacaatcttaatctttttgtcctgcccatatatagatctgctttacctgttagcacgcaaaggcacctgaacgtacggtacatctcaagaagaagaagaagaagcaaatgtttctatgcccggcggaaccatatcgaattcctagtcccgtgtctcactgaagattgcaccagaatctagctttaattttgatgaaacaaagcccaacattacatggcgcgcgagttatgttctgtgaaccccgacagaagccacctgctacaacctctttggcgccaactccgtacgaaatccaagtattcaatccaacccgacactgccatagatgggtctttcggtacgtgttgctcaaccccggccccgttgctaaaggatcgcatgcacgcatcatgaacgccgccatgggcgacccgacgcacctaccgtccccgcgcgatctttctaattttcttcgccctggagacagagagcgtgcgcgcatgcatgcatggttgctcgatccaagcaagaaccctgacgctctttaatttgcctttgataagatgaggggcggatcggggagctttcgctttccgctgccgtgctgtaatcctcggcggcaaggcaagcatattacccacctgcataaataggcgccgatggaccgccgtctcgtcttcatccaggcacaccgcatcagtgtctggctcacctcacctgcagcaggtctcgtctcggtcatccagcgcattgctctcgatcgctgcagcgcatccagtccaaacacacaccggtcgaatcgagca

SEQ ID NO: 1489 - DNA, 658 bp, Zea mays
gcgtcggctatggcaccaccgcgttggtcatcgactgttgggactatgcttcgtcacgccgaaggtcttgaaggaagaagcagtttcggctgaagctgtccgcgtgcgatgaccgaagcttgctcttcataaagcttcggaattgtgaaccgacttaaaagtagaaagaccttttagtccataagcgtttgagtcgttattgtaaactttcatgaagggcacggttgtaaattctcacaggctgtgtcctgcgcctataaatagtgaacagtattcctctactgttcacgcttttgggggtattctttgccatcacatcgtctgggaaccaacctttgccaaggcagaggtataattgtatccaatacttaaatatattaaatggatataatatgattcatttacctctgatactctatattttatgtcatttcgtataatttattaacatacaattacgaaaactcaaccttcgtaatcgtattgtcgtccgccttcgtccagaatccattatccccgagggaataatgcttcgttggacgaaggatattataatttaacattttatgttgccttgttcttgattcatagcatttgagaacaagtccccaacattggcgcccacctccggtgaactcacttccacttttttgagctg

SEQ ID NO: 1490 - DNA, 1500 bp, Zea mays
ctgccatgtggggcctccccgctcccagggcagcacacgtgacgtggagcgagaaataacctaaccgggctggtgggtcggacgccgtcgtcgcgcaataaataaaataatcgactctccccgtggcgcgggtccacggacagcgacacctgccgcgcccgccccctgccctaattaacaaccccccgtggtcgctatttcgtcgtcaccgaacgcgaggagaaagattagcgggaagacctgtaaaaaaataaaaaaaactggagggttttttttggggccaaggaacaatcagtgaacatgccctgctgcctgctgggctgctaatagcacctcacctaccgcctttatttccttttggcctgcttcccaaattcttatttatttatttatttatttattttgtatatctgctttgtgtttcctgcttgttagttagcgggtacctttcgtctcttttggcactccctttcgtgtttccagacccgcaaaaaaaaaaaaaaactgcactagtcatacgcgatatatctcctgcgctgcgctccaccctcgaacatattttttttgtatttacgtaaaaaaaatgaaataaaatcgcgtatgacgtgaatgagtaggggagcgattttgtccccgtgacccgatagggcgttttttgtgctaggccaggcaggctatgtataacaaacttgttagttaaagcagacatcataacaactagagtagagtcaacagggacacggccgtgtcaccgacactcgcgcgcctttctctcccctctttaatcattttaatacactgtactaacttttttgatatgatataataaaacatgtaccaccgccaccaatctacctcctagaagggaagggaaagagaagcggtggttgagctgtggtcacagctcacggctcgcaagcaaggtattaacggcacggcacggcacggcaccacgccatggtccatggatggatcgatcgagctccaagaaagaatcgtagatagatagagtgcgccagcaggcactagcactagagtccagagcagacgaggcgactagcaaagaaacagaggggagggagagggacagcggcgggcgtgcgcatgtgagcggggagacaccggtggtgccgatgagctgtgcgtgggagggcaagcagtagcagtacaggcggctcgtcctcctcctcctccgtgctactaccatacaccatcccagtcgctccccgggcctcgccaggcaggcgcctgccccacacggccacgcccacccaccaggagccaaagccccacacgggacgggcggggacacgggcagcgaagcgcgccgcgcaggcgcaacgcaacaaagggaaaccccagccggaggagcaaaagctagcaagcgtgtccctccccctccctcactcccgtttcattccattcccccccagacgccgctaccgccgccgccgcacgcacgcttgccccgggatctggagatctggtagcgccaggggg

SEQ ID NO: 1491 - DNA, 1500 bp, Zea mays
gtatatgattaagattttgagaagcattttcaagatttgaaattttctccccttgtttcaaatgcttttcctttgactaaacaaaactccccctcaataaaatcctcctcttagtgttcaagagggttttagatgttagttttgaagagggtttaccaatttgaaattatatcaaaataagataccatattgaaaaatcttttcttaactcaaatttgaaattttgaagttggtggtggtggtgcggtccttttgctttgtgctaatactttctccccctttggcattgaaagggaattaggcttacacctttttcctaattgattttggtggttgaattgcccaacacaaataattggactaactagtttgctctagtctataagttttacaggtgccaaaggttcacaataagccaataaaaagaccaagaaagggttcaaacaaagagagcaaaagacaacccaaaggcaccctggtctggcgcaccggacagtgtccggtgcaccagggcactcaacgctgaactcgctaccttcgggaaaatcagagggcgctccgctataattcactggactgtccggtgtgccagcggagcaacggctacttcgcgcgcaacggtcgactacaaccgcattcaatgcgctacagtgcgcgccagagtcagagcacgcgcagttggcgcaccggacagtctacaggatctgtccggtgcaccaccggacagcccagaggcccccacaagtcagagctccaacggtcgaaccccaacggctggctgacgtggctggcgcaccggacagtgtccgatggcgcaccagactgtccggtgcgccatgcgacatcagtcttcaacagccatattttggtggttggggctataaataccccaaccaccccacattcaatggcatccaagttttccaccttcaacacattacaagagctatagcattcaattctagacactccaaagagatcaaatcctctcccaagtccggaatcactccaaatcaaatagtgactagagagagcgacatttgtgttcatttgagctcttgcgcttggatcgcttcttttctttctcattcttcttgtgatcaaactcaattgtaaccaaggcaagagacaccaattgtgtggtggtccttgcgggaactttgtgttccgtttgattgagaagagaagctcactcggtctaagtgaccgtttgagagagggaaagggttgaaagagacccggtcttcgtgaccacctcaacggggagtaggtttgcaagaaccgaacctcggtaaaacaaatccttgtgtctcactctttatttgcttacgatttgtttttcgccctctctctcggactcgttcttatttctaacgctaacccggcttgtagttgtgcttaagtttataaattttagattcgccctattcaccccgctctaggcgactttcaattggtatcagagcccggtgcttcattagagcctaaccgctcgaagtg

SEQ ID NO: 1492 - DNA, 1090 bp, Zea mays
ttttacttttccgtcgcaacacacgggaatatacctataatatatattgttatcatgttattatacggttccgttgcaacgcacgggcacatacctagtacaaaaataattacgcatcccgcagttgacatctgggagcgctacaaataatgaaggcagctggtccaccacacgaactgacagcgcggagaagggagtgcaccggcccaccgggatggcaccgcgaatcagcctcggcagcgccatactgcccacccattttttctggcgaatccgggtgcggcgggcggttgaggatgaattgaataatactctacttcctaatggtcgtgctagcagaccctggaagctcagtgtggctccaaaacccattaattaattaaaccacaaagccgccgccgttagacctagaaccaccgctgcgctcgccgggcgccggctacccggcgtaactgccgtcaccatccaccacctggccgctccgttctttcctccaccccaagaaggagccggttaacctgtccaatcttacctcatatacgtagtcaactatttttactttcactatatatattaacatttataatttattattattattattattattattattattattattattattataagataaatatttgaatttgtttttataataaacgtattttgacatataaatattggtaatattttttttttacaaatctgactagattttaaatctgtaacgaggagtacatagtacgaaatgttgaaaagtcagcgtgtctttggtcgcgttcgcattcattctttctttacctcagccacccacctgccacaccctgtgggccgtggcgccttcacggaaggttcgccggccacgcatggaggcggctctttataaagctggtgcgcgggcgggaggggagagggcaccagaagcagccagcaagctcatgcccttcaaaagcctccggcagcccagcgccccagccagctagtggtgatctctcatctcagcagcgcgcctgaacgtgtgctccctgctaagctctgcgcctcgataggcaaaggaaaatcaaaccgatcgtcgtcagattaa

SEQ ID NO: 1493 - DNA, 806 bp, Zea mays
ttaccggtgacgacctctccttctgggagcgtcgacggtccctctctcttcccttccagggacagtagctttaacacaagtattagactagtatagatatgaaaaccaaaaactaaaatgaacaatgttttgaaactgagagattgtttaaaattataaatatcattttttatttattactcaaattcaagttacgaaacatgatagtgtgctataatttcacggagtgagtatctacgaagatcgcaacattataacaagttcattgttccgtttgtacctatggcaatttcttatatcattgtaaatattgcaattccttttatgtcattcgaatgtgatttcttacttttttttataccatcactagtgttatagaaaggattcggacatgtaaaaaaaatttatcctccaatgtcactagcacatagaattttctcttgttcctgttgaatacagtatgtatactacacgtcctcgagaattcgcggtaaaacacaagggcagatctgatccttcgacgcgctgatatttccgttttccgacaatatcctaatctacaaactcaaatttcgcagcagctgagccgagttccatgccttctcgggaaacaaagcagtagatggatgaggcacatcgcgtcagcggcaaccgcctgcggtacgcgccagaaataataattaggggatcctgataagtgttggcacaagtagcttgccagcacccaactccaagcaagccataactgcaagaaagcaacggcagcaagaaaccttgtaaacatcggagcatagatcgcggcggtg

SEQ ID NO: 1494 - DNA, 287 bp, Zea mays
aaactacacatgagcccccaccgtaagtgatctcatgaacattattctccacacttgctgagtgttgaccatatgggggctcacccttgatataatcacaccaggagaagaaaaggtatcgccagaggagactactacgatgagatctaggtgtcgtctcctagtcaattgttggcgccgaggaaataattatcttagttcaatttatttattatcaattattttgtaagacattttcattgtgtaataaagattatgacatttgtctctatacactgagtcattgt

SEQ ID NO: 1495 - DNA, 569 bp, Zea mays
ttctccgacggcgctgaccccttcttcggcgaggagctcgacatccttcctacctccgagttcgacgagggtcccatcttcgacgaggaaccctgcttccatcgcagcctcctgaattcagatccagactctctctacgactgagtcgagcgcatcatcgcgctctcgtctgactgcaccgccaccaactccttccgcgtcggctcctgtgacgacaaccacatcggagtcaagcagtcgtctgtggacacccagtctctacgcacggcatcctccgcaggagagttcgaggcgccataccgcgatcggcgcgagcagccacgcaggaacgaggccctcgacgtcgtctgcgagctgtaccgcgaccggcacgagcagacgcacgggtacgaggcccctgatgcgccgtcgttctcgtcaggcatcgatgacgacatcgacgtcgtggaggagctccacgtcctggtgagaggccaccagagggacgctgcgagcgccaacgtggttgacttcgcctccacggtgggggacgccacaccccaggccaccgagacgcggctcaatgccgg

SEQ ID NO: 1496 - DNA, 690 bp, Zea mays
tctgattactgtcatttactgtagaatagagagcacttatagtatgttggatacgaatttgatattaaacttgacatgggaatctgtaaaaacaaatatgatatatttataaccactacaacctttttattggacttgctatgatattgatatatagttaacgtaggatatcttatattaaaaaacattagtggtgtttggagcatttcttcaactatatcctcttaaatttattatagaaggatactaactctttattcctgaaacttatcttcggcaatcatttcctctgactcgatcaattctttcattctttgttatcaaaattctctgtggcctgttgcttgtgaaagctgactttcgaggacttctaaattgttgacactccttttaatgatggaattaggtgtgaaatcatttccctgattataagggcaccactgtttagctaggagtttctattttgtcatttctattttattaagtatcatgaagtgttcaattcaattataatgcatttctatctgatgctatgttctttagtgcagagtcatcaggatttctccttttgccaaccgactctcatttgatgcaccttctgctgttcaacggttgagatgcttggcaaactttgaagccttaaaattctctaaaccaattgtatctttgtctgaaaccttagtttctcga

SEQ ID NO: 1497 - DNA, 798 bp, Zea mays
agaaaaaagaaaaataaaattattaaaaggataaaatgtcaagtaaatcaatatgtcaatcttggggggggggggggttaaatttacggtgtcaatctttggagtgtcaattatgcaaagtcacttgtttagagtgtcaaaaatacaaatttctccggatggaaaggcaagccaatgaacagaacagagagccgcagagacgaaaaataggaaggggtagtgcggtcactttaggagatgaggggaaaataaaaaaacagaaataattaaaaatgcgtgagaatactatttggaggaataagattacttataatactattataaatgatataatgttgtaggtactacattctttcacaaatatatgacaccattgatttttttgaaaactttaactactcgtattattcaaaatttttattcaacaatgtaaaatttttcgtcaaacacaaactatcttaagtgataaaacaaataaaaaaataaatgataacttattattttttaataagatgaatatttattttttttaaaaatcaacagggtcatatacttataaatggagagagtactaaataggagaagcctaaccaaaagagtgctataatagaaaaaaaaactcgatggacagacgtcatagacagatttttcgttgctcgactggcccgacagatgagtccgtctcgacagtgaccggacctcttcgttagggtttcgcgcctcttctcaccgtctgcctactactagggatagacctcyggcaaggcctccctcgcgccggcggcgtcagcagcggat

SEQ ID NO: 1498 - DNA, 1500 bp, Zea mays
ttggtggatagggaaattaagggaatccatgggggaggaatctcatcgctttcattgtccaccaaatcaaaccttaggggaaaattctcccccgataagtaaacaaggacggaatgtggaagcattcctcatccctgttcaccgcgaggatccgttaaacttacatgtgacgatgtttgcatgtaatagttaatgataaaaataaataattacattgttaagagatcatccgttgtacaaatgtgttcatttttaatgtacacataatgatttttacatataacaatatgtataagtgacaatgttttatattaatagtaaatgaaatacaatctaattataattaaagtggggataaggattccgacggggatttatccccgcggggaacagggatgtggaagaaatgtctcccgcaagcgttcatgtgaatgggtatagagagataaaacccgacggagaattccttgttaccatctctaaccatgatggtgttttttatatgtgggtactttccgtatctttctcttttattattcttttttacataccaattattagtttcatatgttactagtcggttgccggtgcgttgcgacggcttacaacaatatccatataaactacccacacaaaaaaaacaagatttttttattgattctctccgctctccatataatattttttgatttggctaactgatgttagagcatctccaagagacactttattttttactctctatttgactctttgtttgtctcttcataaagattaaacagtatatataacatcacatttcaacagactcttcaacatgcaagttagcttggctagcgagagttgctagccaaatttggctagtgaaggagtcaatttagagagccggatagcttggcaagttaaatggctagtccgttggagaactattttactgttaagtagcaaaaatttaccttgacaagctatttagctagtctcttggagatgctcttagccctctaattttctctctacccccttcttccaaactagccataaaaagttgatttccgcaccgcaagtgcaatgccgttccatcttccatggagggaaaggaatgtcccgtagcgccaaacaaactatgatgcggcagtactgtatgtgtgactattggcctcaggtggctgccagatggcgctccgccaatggccgcgctcaccacccacggatcggtatccgcgtgacccctctaaaaccaatctccacccttcgttcaaacgcaatcgaacggcgcgcatcccaccctcccttctcctccctcctcccgcgcacggccaaattcccaaccctccgcgcgcgcagcaccaaatccacccgccgcctcctactttaaccccttcccgcctgcccgcaactcctcaccggccaccgcgaagccagagccccacgccccgtccgaactccgaaccccagaacagagcaaagcctcctcggcctccctgtccccagccttccccg

SEQ ID NO: 1499 - DNA, 1500 bp, Zea mays
cctttttttcttaaaataaataaataaattggcaaactacagcgaaaggggagtgcgatagctacatgcagcaaacgcaataacattacggatgatcaggtgatccatcagggcagacactttgacagctaaaaacaggtgatttgaagcgagtgaagtggtgattggtgacaactgtcatcgcatcatgtggagcatttaacagcttgattagttgccccaccgtcttgtcttttgccactgtatgcattaactttgtttgagcatttgtttgacgcagagtcgcagactacatgagcaaacaagttattttgaggctatttgtctgcatctgctcatacacctcagacagtcatattcaggcacccagactcgcacaagcctggtcacgcacgcataaagatgacaatggggacccattactcggcgggtaattactcctttaggttatggatttggtggtaattatatacttgcgggtctgttaatgrgagaaaaagaggacccaacgggcacaaacattacgggtacatacacagtaaactcgtacccgtgtacccatgggtattttatacccggaatatagccaacaattctctaaaattttagtataactcaatgatttatcttgggctcctagctccttagcacaactatatactacgtaggccttaggacaaatggcagcactatggagacaacaaccaaaatagtaaagcatgtccaaggctccaagcttgtgcgacgcgagtatgcgactctttgttattgtacaatcgaagcgaccaagtcgcgcgtaggcacgtggcacgctcgcacctggaagatggaagacagaaggccggatattaccacttgacactcatcattcgcgctaaattaagttgggcagacatgcgcaactctaccactctagacaagtacgggtacctgtcgggtatagaataaccgacatgttgagatatgtgtgtgaaatcgtacccgtgcacggttgcaggttttagagtggagagtttttaattgatgggatcggatctgggatagcaaaccttcattgttgccatctcttgggtttcggatcatcgtatgttttttttttaaaaaaacttatgtgcccataaattatggcgggccagccccttgatgaccagggcaccactcggtttggccctttttcgttttcgtgtgttcgccgggaacgcacggcgccgcgaacccgtctaggagcgcctcaacggtccggggccacatccgtcgttcgtcgatgcytaccattcctgctgctccagagagacagtttggctcggcctcgcttttcctccactataaaaatccggtcgcgacggagcaaaaaatggaccccagcgtagcggagccggcagccaagcagaaaaatacgagtatcgcacgcgcaaggcgattccgtccccattctccacccaatagggagctagagctacgagacggggaaaggggggacgggaataggcgtcgtcggcc

SEQ ID NO: 1500 - DNA, 1382 bp, Zea mays
ggaaggaagagtggagggcacgggatgggccaggattcggccaggagaccagccacctcacgttagtttttttctttttttttcttttcgaaattctttttattattcattatttataaataaatatatttttttaaatatctctaaaagttcacaataattataccaacaatatttattattaaaaatttatttttaaccaaagttctcatattaattagttgagttttcgtataaaagaattttataaaaacaatcatcaaacaattatgagcaatcaaattttttttcgaaagttaaataagattaaacacttgaaagaaaaattctttaccataattaacactaataatctaaatacattattttagttaatggttttgagatgttacagatgctctcgaagcattgaacaaatattaagcagaaacaaagacctcgagagataaagctgtcactctaaagagttcgaagaagaggatctaaataataattatatttaaataaatatctcaatacgtatttatatgggacttaaggatggtcagctgagcgatgtgtgccaaacgaggaagtgtagctgaatgtgggttagagtgtctaatctgtgtgagttggagtggaccgttgggccatagtggcgtgtgcgttgtaatcaggcgggagccttaattgggctggtccagtaagctgtaatcgaagagaatcgaggattattatcgaataacagaacaccacttacctggtattcatgcgtcgaccatcaccggcgacggcgtatctccgtgctcacgtcccggcgtcccgagccggcggccacgggccataacagacccggaggacatcaccagcgcgagcgccgccagccccaagcaccgaggccgagccgcccgagcgcggagcggcggtaccacgccacccgcccgccgccgcccgttgcggaggctgtgcagcacagccgttggggtgccgaggcaccgatcaggctgcgcaaccgccgaagtcggcctccgggtggcgccaagctgcagagcagcgcgccagcgcccctgtatcggtgagccagcttttgaagttttgagctttcccaaatctgaaatctcataccctagggtttgacagtgagcactggactgtaaatttgggcttattgattgtgtatatgcgaaattggtatgtgattcattattattggttagggatttgttcttgtgcatgaaatcggagcatagaattgaatgaaatttcttgtcatagaatcgaacataatcggatcaatttggttaatttatagtcatgcataccaattttttattttaccatattgcatatatttttttttactaggactacctttttcggcgagaccaccctagtagagg

SEQ ID NO: 1501 - DNA, 119 bp, Zea mays
cctatccatccactctctcacttcactactacggcacccgcactagagcacgtcgagctcaaacgaaagatcctcctcccctcccaaaggtgaggcgttagccaggaattccggcaaca

SEQ ID NO: 1502 - DNA, 465 bp, Zea mays
tcttagtcagttagttatattagaccaatcttagttagttagttatgattacattaatagacattaacttggtaaatttgccttacacaagttttcacacccctcctaacttaacggcatcaggagagccacccgttaaagatgaagctaattcctttgaatgaatttagacctcttatttcagacgatttgatccaataatagtcaagtctcctgtagcgattgtgatgacatttgcatcattggtttgtgtgcaaagtttccatgtctgcatttcgtatgtccttcagcttctgtacatctataattggtatgtcctcctgcttctgtgtgctactgcctgccttagataagatatttttccgctttaagaaacatcatcgccatcgcatcgctgatcatatataccaaccagcaccagcagtacactctacgagacctcgcttcccagaccactccagcacc

SEQ ID NO: 1503 - DNA, 1241 bp, Zea mays
cccaatgattccaatgaaaaggttgaaaactacaaagtttcaaaattacgttatttaaaaaaactcaaaaaatcgatttcaaattatttctactagcgggttttaaagaaaatcaccggtaaaaattcacgatttctactggtggtttattgggtcagacgggccactttatttcactaacgtttgataaccaaaaccatttgtaaaaattataccataccgcaggtattgagctttttttttaatagtgcgcatttctcctgtgttcttcgtagaattgagtagcctaggcttgtctcggcaatatcttttatatctcttctctatatctattgtttatagactgctctaaaaaaattctctcttctatatgcaaaccaaccatttggtgcaaacactcgatggcataagggcctcagagttaccaaactccacatgcgcagatttcagcgctcggagagttaggtgtgtatagtgcttgtatatttgtaagttctcggttttttcatatcaatatctaatttttgctaatcgcacattttagtctatgtaatcaggatgggggatactataaccacatttacaaatttaatctttggtgacgcttctataggtagcggccaaaactctaatcatccgagttgtagctattaaacattcaattttatgtaatatatacgattggtaatttgacttgtattatagatatttatgtgtgatgtttgataaaaaaaattataagatgtatgaatggatatttgtggatagacatttgaactatagatatatctcgatgaaaatatttattggtggtcactaccggaatccgactctttgccgagtgcaatttatcgggcactcagcaaagcatgatttgccaagtgtcacttttagtgaaataagactctcagcacacacctaatttaccgagggtaaaacacttggcatagaaagacattcggcaaagggtctagggtttgcatcactctagctagtagcggcaaaaggaagttaaacagcatcttcagataacttctatcggcgtagattgatgtggagtgcagcccgcccgccctgctggcgttctataaatagagtagctcgccctcccatcttgggacacagcacaagaacactcctagctgaagatctcgagtgcaacgcaacgttggcgcttggcggccagtagtagcagcaaacttagcgtcgctccttcctactagacgagagatcgagaaacc

SEQ ID NO: 1504 - DNA, 973 bp, Zea mays
ggtttgagtgctttcttatggcacctgagcgattcgttaggtgagaagcgagaaagaaaaataaatttaccctacacgtttcgcgtgtggcgtaagatgcacgaaactcgtacattaaaggaatacagaaaatgtagacaagctctgcaacacaaaccaactacgtacaatattcggatgttaattttttttgtcttattttttcgaccgtgaataaataggatataaaatttgttatgtaaatttatatttttttagcattgagcttattaagattcataaaaaatcttaaattcattctatatttttttaagataattgatataaaattcggatacggatactattcggattaagatgttttttaccttttctgttgtacggagaaaatataaaaaatatataaaaaattattcttatcttcaataatatgattaacaacatgactatagattaataccaaatattttatacacacttatgttaaagtattagatttgtctgttttaggaacatccctaaaaataatgaaaagytattagttagcttgcttcagtcatcagcyaacaattaagaggcttctcatattgacggtaccttgttcaaggaaaagtaaccagatcaatcgctgtttccgccgggatcaagatgaacatgaacatggagttcagtaatacagcgttaccatattcaggcccaagtgacggcctttgatttggactgcgttatattttgagcccatgtaaaatgaagtgcaggcccaactgtccaagtaaactgccaagcgaagtaaaaggaatccgaggaggagcagcagggccacgtgtatttgacttggcctgcctatccgcctcgcttcgtcttcacttcccgcccggcgaaagagcacaagcagccgccaccaatggctgcctgagaccttgcgggcgagagcggcggagaaagcagttccagccttccaaagctgccgccg

SEQ ID NO: 1505 - DNA, 937 bp, Zea mays
aactaggtttagagttgctcatgggcttcgaagtcagaagcccaccataacacatatataataagaggtggggcgtgattagtattaaccaaattcacccgtcggcaaactagcagtcgcgcccctctcgccctcaccaagccaccgtcgcgaacctagcagttcggtatgtgacgcttcctccctgtacatgtggatacctcgaaggtgctgcatctaaagcactaggatgaaccgcgcgaggacgtgaaggaaaccggtgacaaagtaactagaacggagtagctccaattagagaatattctcctcagatccggaaccatcccgctccaaaaaatcaaccggacggaaccgctccgttcccagcccgctcgcacagtcacgctccgttctgttcactctgcaaccaaacaaaaaacagagtcgttccgttccagattaccaaacacagaacagagtggctccgttcctagaatcagggatgtaacggctccgttctacttggatcctcaaccaaacactaccttagtcgacgctagttcgaattatttcgtgctgtacgtgatttggtctacagtttttaaacctagcgctgacaaaaaaaaaaaaaccgaaccagccaacaccagcgatcgccaccgtcccgccggcagcgtccgacctgatcgatccacggccgccgccaacgctcatccgtcccccgagcgatccggcggccgcgcggtgtgtcgtcgcatccccagagctcccttggtgacccacccatccggccacctccactgaactcaacaccgcaactgcttctctgcctccctccttccttcccggacccagtctcccagtcgcgtcgcatgctattcaaatctctcaccctcgccgcaaacgcagtccactgacttctaagcaaccctagctagctctgctccggccggcgccc

SEQ ID NO: 1506 - DNA, 1500 bp, Zea mays
gacttagagatagagatttgagtttgatttgcaaaaacaaaccaagtggtggcaaaggatgatccatatatgccaaaaatgaatcaaaatagatttgagttctatttgaagtgattttgcacttgttctagttgctttatgttgtgttggcataaatcaccaaaaagggggagattgaaagggaaatgtgcctttgggccatttctaagtattttggtgattaagtgccaacacaagtgcttaaatgtgaatctatgcccatggatgaacaaagtgcaaatcacaagtaaaggtatgtttctaagccttagtacattggttttgtgtactaatatatttgtctaagtgttagaaacagagagaagaagaaaaggagaatgctggctgtgtacagccaacaggctgtttcggtctggggcaccggactgtccggtggtgcaccggacagtgtccggtgcgccaggctgcctcgacctgaagacgccgctctcgagtttttctccggcgacttcggctaaaattcaccggactgtccggtgtgcaccggactgtccggtgagccaacggtcagccgggccaacggtcggccgcgcgatcggcgcgcgacacgtggccgagccaacggtcgggaaggggcaccggactgtccggtgtgcaccggacatgtccggtgcgccaacggtgcgcagatctgcatcagacagcaacggtcggatgcactggttatggaaacaaatcgggcaccggacagtgtccggtgtgcaccggactgtccggtgcgccacgagacagaaggcaaagatggccttccagatttgttcccaacggctcctagctgccttggggctataaaagggaccccttggcgcatggaggagtacaccaagcattcctacaacattcctgagcaccaagacatcgattccacgcatttggttcattgtgatagcatctagagcccttgttgagttgtgaactcattgagttgtgttgcgagctcttgttgcgacttgtgtgcgtgttgttgctctgattttgagtcttgtgtgcgttgctagttccctccttactccgtatttctttgtgaatctcaagtgtaagggcgagaggctccaaagttgtggagattcctcgcaaacgggatattgagaagaaaagcataacactgtggtattcaagttgatcattggatcacttgagaggagttgggtgcaactctcgtccgttgggacgccacaacgtggagtaggcaagtttttgtacttggccaaaccacgggataaatcactgtgtcttctctgtgttgaacttcttgtgattatcatattgtgcaagatcctcgctctagccacttggcattaactgcgctaacgcttaacaaagtttttgtggctgtaagtttgaattttacaggatcacctattcacccccccccctctaggtgctctcaattggtatcggagccgttctcttcaagaaagggactaacctcccgaagag

SEQ ID NO: 1507 - DNA, 187 bp, Zea mays
actgaccggacatgaattcttgtgcgctgggacgatggacgttgctgacgttgtgtgagtgtcctcgaacatgatgtatgtagtggagtagcgcatctggtggtgcaacggccaggggtactacctcgctgatgagcccggggtgcacttcgtttggcagcccaaccaagagtcatcggtactcgtc

SEQ ID NO: 1508 - DNA, 665 bp, Zea mays
tatagctcgccgtcttccacgcttgtaacaagaacctaggagcggcggcggcagcacgtggaaacaaaaattccaaaaacggaaaccgactggctcgggcaatgcgggtcaacctggatcctatagggggattgagggacgccgtaaagaattggaagggattggaaaggatggaaatcctttctattcgctgcagatttccgtggggggcagagcgcgctaggcggccggtgagcgcgcgtgtgggtgaactggactttgggtggcgttggggactcgttgcctcgttgggttggggacggggaggtgatccaagggaggcggagggaggcggagtgcgatggagaggaatctggtttggtttgcaattgcaacggacagttgacttcgatgaccagtgggaccatgtaaccgaggctcagtgaagtcagagaggagcggcagcgaggacgacgccgagtcagaggcaatggcggaggtggctgccgcactccgggctgtcggggaggggttcctgcgtatggaggagcgcaggctggagctatcgctgcagatggagaaggaacggatggaatcggagatgaaacgcacccagacgatgctggacgcccagcagctcttcctcgaggccttcctcggtaagcaactgcagcacaagaaggcct

SEQ ID NO: 1509 - DNA, 716 bp, Zea mays
gctcctctctgacttcactgagcctcggttacatggtcccactggtcatcgaagtcaactgtccgttgcaattgcaaaccaaaccagattcctctccatcgcactccgcctccctccgcctcccttggatcacctccccgtccccaacccaacgaggcaacgagtccccaacgccacccaaagtccagttcacccacacgcgcgctcaccggccgcctagcgcgctctgccccccacggaaatctgcagcgaatagaaaggatttccatcctttccaatcccttccaattctttacggcgtccctcaatccccctataggatccaggttgacccgcattgcccgagccagtcggtttccgtttttggaatttttgtttccacgtgctgccgccgccgctcctaggttcttgttacaagcgtggaagacggcgagctatatggcgtgcaatcgcggcgtgaaggagcaggaggaccccagcgcggcgtctgcagccccagctccggcggctgtggctagggcgagggcggcgcggcctccgaggccaaggagccgcaaggggctcggcgtgcggcacctgctgaagccctgccgattccttgcagctgtccagagggcgaatgccagggtgagggaagcgggggaggcgaccctcgtggcagcgcttgcggcggcccaaaaggagagcgagagggagaacgaggtggtggccgatgt

SEQ ID NO: 1510 - DNA, 254 bp, Zea mays
atcgatcgatgtatcccggctgctctctgtcaaacttgtgttcatatgcttgcttgatctttgttaactgttgttcatgctggtagttgtggacttcgatgctagtagaattaatcttattgtgtatggatggtgaatttaaccgaacaaaggggtttgggggcaaaggatgttgctgtagggatatagataaggctggaaggatgatgtttgaagtagaaattaggaagtctcggttgtaattagtgaactac

SEQ ID NO: 1511 - DNA, 665 bp, Zea mays; identical to SEQ ID NO: 1508

SEQ ID NO: 1512 - DNA, 1500 bp, Zea mays
gtgtaaagatggttacggcggttaaagttaaaccgccagacggttaaagagtactaaccgcttccgcaaaagatggaggggagagtgagtgggggaagacgacagctctgcaactcggcaaccaacggatccatccttccagttccagcttctttatctctcacgcacgccgttcccttcgcctcctctgggccaaccgcgctcgtctccccccagtcctccctcttccatctgcatctcctctctccctgtccctctcctatcaaaaactgctttgcgccccatatataccagggcgcccacccacacacagagaggtgagagcccagtaccagttcagtcgtctctctcgcaacaggttcttcttcgtggcggtggagggggcaagactgcaagagcctgatttccactgctacgtacaaggtttttgctgccgtggattttttttttgtccgtagaaagacgggtttttttttgtccgcagtcagaagacccgtccgactgctctgttcttatcccgccgcctggtaaaggcggcgcctttgtccatcggagccgacgccatccggtgggctgttcctgttccttggattgtgtaacatgttagaggtttgtttggttccgtaaaaagactgcagatttgggatggcagttaccagtggttgtgctcgtggatcgtatgcttgagtcagaactgtatcttgcagtgttgtggttgggttcagtttcaaatgtcagcgatttacctgttgtggtggtgtttatatatacgcgctctagtgtttatatatatgcgcaactcttgtgttctggtggtgttcatgcataatctcctgggtttagcagtaaagtactctactctcatcgtgtctaagttactttactgttgctgtatactgtgcttgcgcaaaggttgcaccgtttacctgtccatatcctgacttcaagtgtttctgtataattgactgcattgatcttactaacatgactgcgaggttgcaccatttcttctagctatgctaccatgtgccatgtccagcaatatcatttgctttttttttcctacgcacagttgatagaattaccgcacccacctgatcttatactaacatgactgtttagtgtttcaactaaaacaatggttttgctttggacaacctaatggtttcaactaaaacaatgactgttccctgatttctgggacggacaacctaatggattttttttatatataatggaaaaaaccatgttccagccttttgcatcaaggatgcatatggcttcatagtacaatcaacataaacaatccaaaacatcacatactcaacccaactaaaataaaaacatcataacacagtttctcatgaacataaaaaaaacactaataagcctcaattctagcatcgctgcatctccagccatcaccaccacttccattgcacgacaaacatccatccttgatatctcggtgtaaatcatctttttgcagcaacctccaaa

SEQ ID NO: 1513 - DNA, 956 bp, Zea mays
atgccacagtgagtctcgagtctgcacttgcatcccatccacatgtcatcatgcctgggtctttaattgcttcatgtccagacctgctcttcggtgaagtccaacatctttacagcagagtcggagggtccccactaactcatgcatcagtacatgtgtcaacccgcgccccgcttcggcgggaaaagaagggttcaagttggccgcccactaactttcgccaaatgcatctgcaaccttcatgtcttgttggaggtgagatgaggttctattatcgcatgacatgctcacagattcctgtgcatggcatgcctatgatatgtggcccatcatttcctcccctgtatccatcccatgcatcaaagtttggtcagatggccacgtgggacaaaaggcgcagtttcttgctgctgctccagtaagaaagagcgggctcgaatcgcgttgtcacaggattatttttgtatcgatcagggtggccaagtccatttatgtcagacatatcctccctgctgctgctggtaggttgtgaatttcctagcattcttttccctttggccgcttgcattgtctttgcatttcattcttggtcggtctattttgtaagagttgctttgggggcaaaacatgtgtcctgtccggtctgctaccgcacgctatttgtacaagtcaggtccgtgcgtgcattggtttatttcccggtgttatcggagcagcgcgtgtttgtgcctttttccaccgtgtttttggtaatctacatacatgctgctccatttcggtttatgaggagctgtgtgggtgaagaaacagagatagagttatataggtctttgaagtggttcttgctggtggcagaggcaaattgagttgggtgtggtttatgaattgtaccatggtgtggagaagacccactggtaatatttactgtatttggctggtgctccgccgcagagcat

SEQ ID NO: 1514 - DNA, 1130 bp, Zea mays
agtcattaacattgttaggtattcggtgctcttaccaaaagctccactaaaaatgtctaatgcttatataagtcaaagagctcattttacatgctctccaagtgccttgtctagtatgctatatggtgccacatcggacacatctagtgcactatagagttgaacacaaatttgacatgctgtcacggttccatatctaatgggccatctggtgatgcacctaacacgtctagtgaggcatattcgttgcataacagactccattgtgcttggttaaaaaactgtgcaatgtgtgtgagccttacatctatttagtgcaccatcgaaacaatgtctgatgccttctgaaaaactgcactaagaggactttcatcttttcttaagcatgctaactcttaaatgtttttaccgaacacatgagaggattgttagcatttttaaaatgtttttaaacatttttgcttgctctcacatgttacttaggcctatatttgatgcatatgatttcagaacttagtggcactagttgactgagttgtctaattatactccccttttaatagtacaataatctatccttaatctgatcatagactattgcatcttgaccgatgaaacaaaataccctaacttatacatttgtctagagcccttagaaagctccatgtgtgattttgttaattgaggactaccctcaactctaggtattgtgaatgagataggttaagccctctagtgtctcatctcgtctctataattttaagggatagctggtaatatcactgagatagttctattttaatctctggcccttaattaaacaaacttatgccgggatcgtcccatcccattttatcccatcattacaaccaaatgcaccaatggagtttgaggtagggatgatttggttacgtgggttttgtaaattttaaaatggtgaattatataatgatatagatgtcaacaaaatggtgtgtagggaaaaaattcggacaagtaacattatataaccatgtagtatttgtaatggacttgtaaattcttataatagcttacagggaaaagactcttcaatctgaagcaaaatgtaccgggaatgttgaagagcgggactcttaagcagtagtgag

SEQ ID NO: 1515 - DNA, 331 bp, Zea mays
acgaagctgaagtttgacgaagcctagcctgaagcttgatagttgtttaatatactttcctgcaaaaattctggagaaacttttgtaatatagttatggaacaacttatgtaaatttgtacataccttgtaatatattttgtttctgctatctgtgtacaatctgctttgcttgtggatgaaacttctcttttgagccgaaggcgaaaaacaccttcccttcttttcgtacacaacgaagcataaaaattttccttcgaagttcttcctcattgctgaagcacctgtcttttttgtgtggtatgatgatgattctatatatgtctaaatga

SEQ ID NO: 1516 - DNA, 198 bp, Zea mays
cctgcaggtatgaagagtgaatattattagacaagtaaccatgggttgagtagtgtcaaggacaccaaatccccgactggccggaccccggctacgtaacttgtagccgctgtccgtcacgctggcgaggttatacccctcagccgtcggtttgtagagaagagagggagattaggactgacttatttcttattccaa

SEQ ID NO: 1517 - DNA, 147 bp, Zea mays
ggtaatgttgccactgaaaattctaccattctgattctttttcttttgctacaatacaatacacttttacattgtcattttccaacaataacactataatatttttcaaacaagaaatttggtcatgggacatagttgtctgtccta

SEQ ID NO: 1518 - DNA, 1500 bp, Zea mays
aaagagagagtagtgagtgaagtagtacttgatggtttctggaataagaggaagaagaaaacgagaaccggcagttcaatcggcacgagcgggaatctagaaaataccttttgttttgccgagataaatagactgctctggtgggagcgtagtggactaaaaagttggcgctactttgttgaaaacctgctgaaaattgaaatcaactggacttcgaatcccttcttctgctctgcaataattgcaagcacaaaagaaggctaaaacaaggaattgctccttccttctagaggtctttgcgctgggacgttgacgaaattatctcgctcgattgacctctcatctcagctcatatcaccccactgccaccccttggcagttttgcacaaagcttctctcatattcctatcgaattgtacgtttagtagcgagtatcacatggtcacagagcacctgtagtttgtgaaaaaagaacagtggcctttctgcaaaaggccgcgcatcctttttatatcttgcctttcccctcccgttccgttcccgtctcgctctcgcatcggccaacaacgcttcacggcaaaatccttccacaggcgggggagtcgcctcacctcacttcaccccgttcatcyccagcgaagaaggtaactaccgccatctcccggtaatgatcctcggtatcttccggccagaaaagatttgttttcggtacggatagggtttctgatcaagtgcgcgcgagcccaggagctaagaagaatcccagttctttgttcgccgactcgagtttgacattatggtacgtgcctagctattagtaccccccgcaccacctgcttcctttcccgtttgcacttcgccgtgaccgggtgagttatcagaccacaacttcttcgttggttccagtattggggctgacactgacagtgggttccaattagatgtaccaaatgtgcgttcgcttgaacgcactctccgatctatggcagtcatgaatctaggctatcggtaaagatgcaaattgtcaaatcgtgcaggctcttacgttttttttttcacactggatactgcttctgttctctgtcccaagtttgttagccctcacgtttgcctgagatctttcagccacaattcctccagatcttagcccaatacctaaaagttagtttcctgattacagactagccaggggccaacgtatgcttctgtctggttcagctatttattttaaatctagagctagcagctgccctacttttcagtcttacatgattgtgctctgaaaattgtgagcccgaagatgtagatccgatcgttttagctaagtactgaaacagatctatgactatcagtttgacctaggctgaactttccatcattatatttttttcttacaaggctacaggctgtgttatttgtccaagcaactttctttatgatctggcattgaacctatttcttttttttttggtatgtagcaaaatacttagcacaccagtg

SEQ ID NO: 1519 - DNA, 917 bp, Zea mays
gaaaaccaggcccaaaacctacacagagcgcacagtgcgcacagtagaaaaaccagcgaacgagctaacaaacaacctagacaagcggattgaaaggattaaattctcttctatttaatccctttcaatctacttctaattgaacaagtgttgtagtttgcgatgtttgctctccgtagcacaatactccaatactccatgagtactttgctgcggcaatgggcccatttagctgcccttaagaacactgtgactcttgttgtatccattgtgaagagagaaatcttatagcatgattgttagtccacatgaactagaatccaaacatgtccaataacacccttgtctgcatgaattggacagagaacatccatattaactcggtgatcatgacatagagcacaagtacatgagccgagactagaaaaatatgtggaagtgctatatgaaccacgcaatattttatctttactcaagaacaaataaaatatgtagtaaaattaaaaacaaattaaaaataagaatgtggcctgaaaagtaaaccgactcgaggctggtccctgtgacccggtacgatccgtatgtagatcgtccagccgacggctctgatgtgactgagcagtgagcacaggcgcgtcaacccgggtgccttcacgcttgacaggcacccatcccacgccacgggctcctcctcccctccgcttctcctctaggtccctctcctacagaacccttccaatccaaagcgaatcctccgggccgccgcggcggcgtctccccgggcgcccctagcacagctcgcgttccggtggaacagagaagaggtaaactttctattcttttctctgctacccgcatgcgccttacggcccccggcgtggttcgaattgatttctgctgattccagaggcgagagg

SEQ ID NO: 1520 - DNA, 1500 bp, Zea mays
ggaaacgccgtgtagcctatcctcttcgaatgtcgacccgtttggcgctccacttttttcaacctgtccgcggtcacagtggcgtcactgacgacctgtccactcgctctctcgtaacgctgacatctgaaaataactcgggtcacgggtaattaggcagtcaggcctggccataccataatccatggctacggtaatccagtccaccgcgtaccctgctgtgccggcgatcggacggacggcggatccggcggccgtgcggcctggcccaaccgtccacccgagtagttcccaacggaaaggggcaacccgggcgtgtttggtttgacccggaggtgcacgctgcctgcccctggcccggtggccccctagtttacgccatccgagcccaccaacgctaccaaactccgcaagctaactgggcgcgcgaactacctaatcaggattcaggactagtagtaaattattgttggctccgtccgctccggtccaccacggagaggcagagagggatgggaattaaacaaggaggagggggctagccacacacgccgaaacgctaggagcgcatctcattggggtagctagccaatcggtggcggttgctccaccagaattcggaaacgagtactaccaaactgattccctcccatccttctctctaatcatgaactggcccgcccgcccttgtttatggctttcccgctgctctgctggggttagctaaccaccaggagaaaaaaaatgtctccgctagcgggagaggtaaagtacggaaagagaagctatgctggtacaattgtaacaaagggggagttgcgcgtagctaacaagtaacaacccgctccaccgagggtggtggacggatttggctcggctggcctaatacacagtactcgtacttaggacggtatgacttaggaacgcagcacgtatctaaaaagttggctgaaatatagagcgaaccctgactttggcaatggctaaacttggcgtgtttttttttttttgtgcttcgaaagaaacactcactgctgtcccatgaatgacccatccgccagaaaatacaccgaagaaaggcgcacgcgcacggacggggtcggcggatcaagagagcaaggcgtgcgacgtgactcgcgcacgggccagcgcgatcaaatggaacgcctcctgtagggtcgtcggtcggtccagtcaatgggtgtgagaaatgaagcgaaaatttagaataaaatccacgcttcatcacagtagcgtctacacgcactgcgccccggcctgctgcccggctcccatatgtatgccctccgttgcacttgcactgcacccccctgtctgtccccacccttctgccctggcttatctctttccgcttccccctgttataatagcaaccaaaccaaaccaaaccagagctcaggaggagcttccacgcaaactcagggggaggcgcgcgcaagcaagcacacgagggagcagcgggcaggcaggcaggcagcc

SEQ ID NO: 1521 - DNA, 1500 bp, Zea mays
atgctatgtacattgcaatgttacaatgagaggtgatgaataacgccaccgctaggaatatggggtcttttgtattggggagtgctaggatgagattaccacagtgttagggttagagtggtaggatgtagatctagtgaccatggggcattagagagagagagaggaggaggaggaggaacttgaatgttggttttttggggtgggggaaggggagggatctcatgcgtaacagccgacctagtacaatgtaagaatagaggtatatataactacatatgagccattggattttaataggatggctttaaaaatcaaatgttcagtaattacaatgctaaaattaactgatgagaagtagatattgttacaaagttaacaggacccaagattaatttgatcagattgggtaatacataaaggaatacagatctactagcatataaccaaaccaatgctaatactcgatagatatttattaagccatgacaataaacgcacagaagataaatgaagaccagatctattcaaaagatctgcatcgcgataaatacaaaatgcaggtctacttacaacgctttacaggactaaagatgaagaacatgagtggacgtgtgaggcacacttcccataaacctaattcgccgacacccatgcaggtcatcaaattgtcggtgtcgatttggagacactgctctcccttgatatgttgcacgatagacataaggacgacggggcatcgaattgaaaaaaagaagacgagtcagttggttcctatgtgccgttcgtgtgaaggacgcctcccctttatagaagggtcgctactgttgggggtatgcttcgtagccgaagatcctaaagaaagaaacaccttcggcagatcctctcaaaagcagtgccgaagctatcgcctataaagcttcggcacagtgacatgtctcaagacgaaggggtgaaccgacttaaagatgaaatgacctaaagacccatgatattctgtgtcattattgtagttgattgtaaagggcataaatgtaattatacacaggctgcgccctgtgcctataaataggtgaacagtacccctgtactgttcacgcaatcttataatcgctgacacattacgctggaattattgctttctgccaaggcgaaggtataaatgtacctaaatattatgttttaatatttaggtttgtataataaaatatgtgaataatcttatgtgtttttgatatatcattcccttatgtttcatattttttatatttcatcctacattgttttataactctaatcacgaaggtatgaccttcgtgatatcttgctcatggccttcgtccgaagttcattaaatccttggggagataatgcttcagtggacgaagggcattaatatttaacattttatgttgccttgttcttaattcatagcatttgagaacaagtccccaacattggcgcccacctccggtgaactcacttccactttttgagttg

SEQ ID NO: 1522 - DNA, 1133 bp, Zea mays
ctcctgtttatagtagcttactcgttcatacctagcacctatttctcaacgatttatgttgatttcaaacggtttttattaaaatgatttttatagaaacgagctgaaaaggtaaaacgtttaatagtcagtccacaacagcttttggtgacccgtcgatgaccagaagataaacaaaagacacaaacagagagcgccatagcatctccgtggagcggacctattcctctgaaccaatgatttttcagcttgcgtttctcctgctccctatccgacgtagtgaatcccttcccaggcaccactcgccgacggaacgcctcccttcctaggcaccactcgccggagcgcatcccttcccagccactgatggccctgacccgccagcgcgcttccctccccaccgttgacggccccgacccgccggtggactgcgctcctcatcgaccagcgtggccatattttgcatttgttcctgtttcagcttgtgagcaactgatactactgtcccggcccatcgttactggaccaagaactttgagatgtggtaattagtttatgattttgcatttgtcccggttggtgctactactgttgccatagcaggaaacgctgcaaaacaaaaaataagagtcccaaaattcattttaatctttaatttgctcatgattttgcattagcttatgattcactaaactgttatggccatgcagaatcaatcatttttggctctttcatgcaccacatatttcagcagcacagaaagtttatgggtgaaaatggtcatttggttcaggcccaaactaaaaccattcaggattattgaccaactgaattcaattaaaaattcttcagataggaactggtttttcaggaatgcttcaaacaaaaattcgttaagaaataatccatatttaatctgggccttcagtttactcaatttgtcttttaccacatcaatgaaaaagttcaacgagaaattaaataagccatcaggcttctgaggaacaggagcagtttgtggaggtataaacaaaatcaacctccatgattaaacaaaagttcaacgagtaattaaataagcgcccgctgggtcgttcgttgccagatcatgtttttcaggtctgtctacctcc

SEQ ID NO: 1523 - DNA, 430 bp, Zea mays
ggtgcgccgccgcatcctcgacagcatcagctcctcgtcctcgctcaatcctgaccgcgctgcctgcctcggagcgtgtccaggtcgcggccggccgtacaccagccgtagttgccagcatgtgtaccagtgccctagctcctgaacacacccatgcatggacgtgcgtgcttcgttcctactccagtccggccggcggcagctcgtccagcagtgcatccgattttttttttgtctttgtttttaattaccatcgtaagagctagccaaacgcatgatgtgtgccgttgttgcagcaacaacgatataacctgtataccagcgcatcagcctagctactagtccaaaactgttggcattcgtcttttgttgcatttggacttcccaaacttctccaaatgcacggtgtcgaagagattaattaggacgc

SEQ ID NO: 1524 - DNA, 1020 bp, Zea mays
ctgcagcagtcatggatatagtggctgttctacctgctaatgagcaactcgttctacctgctatattagtcaaccagtgctgtatgatactgagcaagccagccagctgctgtgcatgtgccatgcagcacaaatgggggatttgttttgtgcaaagccctcgaaatgtttgttatccaacatattggtggacagctacaaaaatttattcatgatgagcttcagggtttttttgctggctgcaacctgccctacctagtacctacaaggttgctagtgaccataatctcagctgtcaatgcctgttaaaatgttgattgtgagggcaacttatcatgtgctgcttcattgcttctggacattagattattaaggttctgtttggtagagcttcatatccaattattttttgaagctgtgcattccctagctccaggaacacatgatcatggatctgggacctgccaaacagggattcagttgtatcattgattttagttttgtgcactcgatatatgcattgccattaaatcatcggttaccatgtccattttttctctgatttttattacctttgttgacaatcagggaagaatcctgtggaaagtgtctcagttgagtttgaggccaagtcagctcgtgatggtgcatggtaccaaaatattaccatttctcatacttctttaggattaattgtatacatcccactctacttttgcttaaagcattgaaattacattatatccatactccatagcaaaatgtttgaaagaaaagaaggggaagggatgacgtttgtgaggaatgtttttctaaatttatttgttacatgtggtgtgacccattagtggcacacatagagaaccataaatgtacctttgaattcattcactgtaagttcataagcgcttttattggcaacagaagtggtttctggcttcctgctctatgcccttgaaattatctcatccgtttctattttccttttcttttaaaacatttgtattctaatattcttac

SEQ ID NO: 1525 - DNA, 257 bp, Zea mays
ggtaggtggtctcatctcccgccctcgtcctcctccgttccttcgcactctaccgcgcacgggcggcgctgccggtctcttgatctgccccgacccatcgctccgggatccagccttttgtggcgggccacgtcgttctcctctcgcccgtgtcccccagattcggctctcctttttttttttctctttgccgcaagcgctatgggatctgcgaatggtggtggcctcggtttgttaaagggtcgagcgtttgtttg

SEQ ID NO: 1526 - DNA, 901 bp, Zea mays
tttcgggctggaccgggccgggccggacggcacgaatgtacacctatatctagagctaatagttaactgtaaaattacatacagagattctaacactcccaactaattgttagctaacgtatgactaataattaattcattacctgattcaacatagctaacaatttgttagctggttaaggctaactaatacctctagaagttccaaacatggccaaaggttattcttaatagatagttttatcgcactattacaaggatgtcatatcaacatttgtttagaaaacatcatatctaaagtttcattcccatgaaactctatcgtctttcataaaactctctcatatatctcttyattaaattgcatgtcatgtcattatgtttgcttatatgagatgtccattatttaatgagaatgaaattcacctaataatgacctaaaatactttgtcatttcaaactaatgagccgaaggtggtgaaactggtagattagcaataagacaaaattatgcttatttagaagagcaggaatttaaatccaaataaaccaaagtacctcagttatttattggtacatatatgggtccaatggtcgaagcagggttgatcaaatcgaggcatggaaccgtcgaaataaggccgaaactgcacgtcggcctagcatggcagacaccaggagagacactatgggcgagaaatgcaagcccaacgtagaatgggcttccagttgccaccgtggcaccgcaggcttcccttccgtttcgtcatcctccggtcgaccggtcctccccaaaacgtccgcacgccgttttccccatctcgcgcagcgctactgccggctgtcccgagtcccgaccaccgtcctccgctcccggacgtgaatccttcctcctaccgcg

SEQ ID NO: 1527 - DNA, 1477 bp, Zea mays
gtatgtagggcactattcaactatttatagggaagatgaacagattcgtaagaaattacaaatatgcycataaagtttacacatatgatttacaaataaaacagggacataacagccttttctctttatttcttgctgctcaagtcttggacttgttctccttcaccactttgtgcccgaagttttctccacgccgaagctaacggcttcggctcgcaccttcgccgcttgtatgtatagaacgaagcttccctacacaccacttcttattattttcttatgccgaagtaaaggtattttaatgacctttggcaaggtaggcccccaaacatctcaaatgtgatatctctgttatattcttctatcttgcgggtggcttttatttgtatatgacaatatgcacagtttattggtcacgaccatatgcactgtctgttggttacaacctaaaaagaagttcctcccttgcacaccatctcgagcaagctacctcacatgcgagccatttacatatcgtgtcggctcaagcacaaacagacactcagtgccgccgtgccatatggtacgctggaccaaaagttatggctcagcccaacgttcataacggactggcatatataattcaatcaatttcacttcgtactcttagctttagaccgtgtccggacggttccaactcacccggtgcaaaatttcacttgtatctcccacctcgatcgatcggtgtcggactcagaggaagcgagcgccatttgttggaaataccttgtccacaaaggccgctctcaggcgttactgacggtgtctctttctctcgctggcacgattacacgcgtcttgttgctagtaaactgtaccacgagagagagagagagagagagagagagagagagagtgagagggccgcatcgcatacatacatccgtccggagataagagaggagtggaagaaaagaggagaaggtgagcagctgcctttgcctcccgcgtgtcgttataaaaaggatcggagcgggggtcaccgaaggcgtccaattcatccaccttgtccgtccctccctgagaaccagaaggccacccaccttccaaggtccgtcccctcctccccccctccctcggcccctgtaccatcctgcacacactgcaatctccgtccatccctccgtttccttttttcctctgttgccatcagttcagtagtagcctgcagctctcccaccttctcgctgcgctgtactgtgctggtgcaaagaagatccctgttcccgcttttagatcacctttgtgcatgcttttccctgtggtccgtgggcgaggaggccaaaaactgcatcatgcccctcgccctctctctctctctatcatgctgcctgtatcgcaatcacgagcgagcaggttggtcgtctttctggagacggcgagctgaccggccgacggtgtctctgtggctgttgatgttgcaggcaggggaggggcc

SEQ ID NO: 1528 - DNA, 1500 bp, Zea mays
ccttctgtttccactcaaccacctcacgcgcggcgcaggcaggaggatcgctcgctgcctggccgtaccgtataaacacgcaggccccagagcagcagcctcggggtggcctcaccgcatcctgtgcttgtggtctctgctgtggccacggcatacggagtactactaggcttttagtgtttgccaggacacctttttactgtttcgtttccatttttatatattttatatataacgtttttcttttgacgttgacagaaaacctgataaacacattcgattgatcagctgccatgagcagcgaagccaaacaacgctgcggtagcaacaatcacggcaaggcaaggatattctctgaaaaaagaagtgcgtaaacacaacatacatcaaagaaaaagaaaagaccgcagggacctcacacaaaaacgtgcgagacatggtcactgtgtgtgtgagaggtcaccctcctcctcccgcctttcacgaatcccctggcgaacagcgggcgtcccacgccgccagccgctgccggccaagccatcgcctcgctccacgcggttggccaggccccgtgcgcggtgtttggccctgcgcaccagctgggtcatggtaatccgggcctaatcaagcacctccaatccccacgcctccgagcctactcctctgcctccgaacctctctccctctctctctctttctgtacgtacgccgaatcgcagtttggcccttccacgtttggaatatgacgagctagcacaaatatctccattcctaacaatactattgctaccattatattattatatgaacatcaatcacatcatcaagaagatatattttctttttcaaaaaggaggttgttgcatcaaaaatttatttaaaggtcctcgcaaccagggatatgaatttcgaaatacttgctgtacgagtaattattagtctagtcgaggatctttgtgcaaaactgtctgacgcctgcctgcctgtcatctgaaccttcctgaaccggagtactggctcaccctaccgagccgagtcgacccatgcctcttctccttcactctctgctatgctatgcttaccccgttctctctctcctccctttctttctcatctactactactagactactagtaactccgcttcgcttcttccgaagcggcgcgggcggaagcgagggcagctcacaccaccgtgccgcgcgcgcgcgctctccacccaccacctaattccgccgccgagctcgccgacgcggccacccgcgatcgggcatttggacccgtccccgctcgccgcccgcacggcggctcgttgcgggaaaagtttctcgaggccgtctgtgaccccgctccctcggccgcgagatcccgcccagccggtaatgtgggctctgatcccttgttccccttcgagttcggcaccgaatcgcctgcccccggccctaatctctgctgcttttgcctcttttgttccgttccgcttcggccagcggtcgcaga

SEQ ID NO: 1529 - DNA, 246 bp, Zea mays
cctagagataatcatagagatgagcatatttctttgtatccatgatatatatattgcttaattgaatatccatggaaggcaccttgtattgattagcaattatgtgaattgtttgtgagattctttacttatatggttattctaaatgatgtccctggtcagagtcgatgactagcacatgtattagttgatgactacatttcacaagtcatgaacatggagatgttaaactaataatgtgggcgc

SEQ ID NO: 1530 - DNA, 375 bp, Zea mays
agtgagctaagcacttgacatgagactatagacaaccttagaaatgagaattctaatttgttagctaaggttgattctattgcttgtaatgtttcaattcccaatcttaggaatgataatgatgatttgcttgctaagattgaagaattgaacttatctcttgttagccttaagaatgaaaatgaaaaattaattgctaaggctaaagattttgatgtttgcaatgctactatttccgaccttagaactaagaatgatatattgcatgctaaggttgtagaattaaaatcttgcaaaccctctacatctaccgttgagcacacttgtatttgcactagatgtagagatattgatgttaatgctattcatgatcac

SEQ ID NO: 1531 - DNA, 582 bp, Zea mays
cagcccatctgtcttcaacacgtgtgtcgttctgctcggactcgaaatacagtcttggacagtcgtcgcatacagtcgtcacagtctcgggtagacacgcacccacctccatccctcccatcctagacctgctcccccgccgccatgatgatccttcgtcggccgtcgcacacccgccgaccctaccatcgcagacctcctccccattgccagatcgatccttcatcgcccctcgatgacaacggcttctcagaactaggcatcctgttcactctatatccatggaggcggcgatgcagatgattctcgtcgggatggcgcacatggagttccgcttgaccaaggcgcttgtcgggcaatggcggcgaacaggctcccgcctactcttccttcgcctcgctattcggctcgttcgagtcagagtccgctcctcctcccgtcctctacgactgctacgacgagccgaacgacgacgagattgtcgaggtgctcgcgctactagagtacaacgaggggacttcgtcggccacagtcctcgtcgactgtaacaccaccagcaagtcgcctaccaagtgttcgaca

SEQ ID NO: 1532 - DNA, 294 bp, Zea mays
actaaccatccatagagtagcaacaacaagtgccccatgagtccggcaactgggaggtgtacgtggcggagccctccggctcaccatgcccctcgtggctcgaggccccaatcacgtacgatcgacgtgatcacctaaataaggtctcgcatcttggaacctacctcctatcatcgaagcaatcgttggcccaaagtgtcaccaaagtcctcatgagcaggggagcagtcttaacatcatgcacctaggaagttttgatgccttagggatcacacactcgcgccgtgctaaact

SEQ ID NO: 1533 - DNA, 1500 bp, Zea mays
gctcccggctttaatatatagaaaaaactccttaaggaaagtgatgagttttgctttggtgtctttagcgagcttgacatatagtacgtgtgacttgtttatcgaggtttcctttgaaaatggagagttttttggtttattgtatgggcttagcttgactctttagcgactttatgttgtattggcaagattcacttgtctctttatttcttgctttagaggctctgtacacttcgttgaccatgtgcacgttgcatggcccaagcagaggctttctcatttttcttacttcagccgcacacttctagaataaaaaatggcagctgcatgcacgcagcttctcaaatgaaaaataacagtgcttcttttgtaccggcgactccatgatccaacacgagccggaatcaaggtatgggcgagtccgcaagtgtcatacatcgccgtagagtcctccgccgctgcgggttgtcgtccacgagagcggcgccacggatgaccagcgcggggtcccttgccgcgcatggactcctccatcaaaatttgcaagtcaatatcaccaagtacgtacagtacagagagcactagctagctacttgagctgaatgtctgaatggagtatgaagacaaagaggaactgatcagttgaccctcttgtcttgggaaaagcaaaatttgctgtcaagcgcatgtgctcttccgatgtgcaacatttagcgcgtagcagacaattcatagaataggaggaagagtcagctgttatgtacacagtacacccaaccccatgtacatctcatcatttgaggaatcaatcaacatctagtttgactatatttataaacaatagtaaggtcctctttggtaggacttttcctctcccagctccagctctgctagttctgtgacttctctaataaaacagttcattccttatttttaggaagagctattgaaatagtaccgtatttggttagaaatatagcttctccgatcctgcagcttcttctacaatgtagtgccgacgaagagaaaaaatgtaagaggaaccaatagaagctactttttctggctcccggctcctgttggttttttcgaggaactactctctcttttctagaaagagcctattaaaaaaccttcttttgatagattttttgaagtagctgttggaggagcctacgagggctcacatttgaaaaaaaatccattttgacgtcatctaaaaaacattttgtataaactgatcatgtggaagaagcataagctcagataatcaatgttatcaccatcatcctagctactccaagtctccaaccatccacccagattttaattctgcgctggtgttgggggtaccatgtctaacaacaacagagaccgtcacaatattagactaattgaaaaaagtatgcacacttgctaacgataaaagtcaacatcgtcgtctcatatctatctaccaaaaagtacgcaagcaagccaagtgctcaccgttgatcgata

SEQ ID NO: 1534 - DNA, 1360 bp, Zea mays
cgtcacacctgactcgaagttttgcgggtgtgggtgcgagtttctattccaccttggtgacacgcacccgacccgaatttagttggttctttattttgcgtaaaaatgattaaaatacaatagtaatgacttgtccaatgattcatgaaatatattgttgttgctcaacgtgataatgcttaaaattgtgtgtgtatatatatataacttaattattgttggtactaaattgcttataactaaattatttttttaaaagtgtacactaaataaaaatccacgggtgacttgaaacccgacaggttcgggagtgggtttggaattgcatccgctagagcgatcacaagcgagtttagttacgttagacttcatggatacgatcgtgggtaggtttttgctccacccaaatccgaacccgatccattgccatccgtaccacctcaacggatgtgacctgattccaagtccacacctaggacacttagatcaatatagtaggttaagtgtaggtattgttctattatttttgcttaagggttcatcgttcttaattggtaatctaattttaagaataagattagagtagtaatcaatagctagcgtatatgcatggtgtctaggctgtgggttacctttctttgcctcgtactcgtacatcatgaagtgtaagggtagacagcaagtggtgacagccttgtatctctttcgtagcccgcgcgttcgagtacgggttacctttcttattgtccttgtatagccatagataaaaaacacatatatatttcttacgcagtacagcagtcagcagggtcagcgtatgcagcagtagagaagcttgccccgcccgtgatgactgacctgcatgcgctgcgtggaaaaccatgccgccaatggcccctcacaacgacgccgtcgtcggcccctcagtcgacgacgtcgctgccgcgacgacctcagtatgttttccctgaccatggcgcccctagcgacgacgaccgcgccgggcacaacaatcgaagacgtcgtcgctaaccgtggtgtgacccacccctatcagctggggctcatcaattaaagacgtcatcgctgtaggtgttcgtgatctcggcataatagttgtataaataaacatataaataggtgcttgaagctaacaactcttggcatcagtagcaggagcacaaagtgcagaagcagagccagtcctaactgcttagccaggaaaggtacgtgtactcatcgttttgtagagacctttgggtagacatggttaaaaaaaatggccactacatatacaagttaagtctaacttgaatttcgtgaaaataatctgtgtagcagaagcagagcgtgcttagcc

SEQ ID NO: 1535 - DNA, 478 bp, Zea mays
aggacttgatttgtcacaaatcagatgtgagttgtttttgttagacacttccttggacaaatgtaaaatggaatctgaatgaccacctcccgataacattggtctgcttatactgtctaatgcctcagcagaagatgctacagaattctgggccacatgctcatgcaaaaggctgtcaaaagaagtgctcgctggcactacaaccaaactggtgctacaagaaacattgacagctgcattggatttatcattcacaaaaagaggtttagcaatgccactacactcgattgtatttgacgacggatcaagctggatataattttgagtcgatttctgaattacaggctctttaacttccgatgctttggaccttgtcttggaatcaatggcatcagatcctaaggcaggacaaccgttgagagatctacccaagctgtgaggttctgcatacgttggcagtttagttctacggggtcgg

SEQ ID NO: 1536 - DNA, 1500 bp, Zea mays
tgcaaaacgatgcaaaaaaaatatttttgatgaccatatgggtgaaccactgtacattaaacctatatagtcactaaaaacaccgttttgcatcgttttacattttagattgcactatttataaagtgtagtttaaatatggatatggataagctgctggagatgatgttactaccgtttagcctcgtcaagcaaaaattgggttttgttgggcgaccttgcttgtggttgcaaggattttttggctgcacaggtaagcgtatatccgacgtgttttctagatcatctctcatctctcgttcttctccttctataggtaggattatacctcacgggcaacttgaatcttgatagcaattaatagagggtgagacctggtcatctgtaaggtaggataacttaattaggtggaggtttcgatgttgatgatccaaggctttgggtggacggatccttacaatcactacatcaattctctgttggttatcaccagtgacacataagtgacctcgccaagaatgctttactttaatttggtttgaatgaacaagactcacgaataaattggacttcaactccaatttggtttgacactctatcattgattgggccttgatcatatagttggtgtccatgtcctcatcatagggggcgaatcctcatgttgcacgggggccagatttcgtgacttttatcaaccaaggttccaatgagtttcttcttaatataataccataggggcagtctttcccctaaccactgagttctagacctaactttacccactctataaatagttgatctatatcaaatctcaatgctagatttgacatgttatctataccactatataatccaccactttaaactttgcaaaacccacaaaaacaaatcaccctcacacccataacctccactaaaatctaccaaacaaattgcacccaggcttaacacattattaaaatcaatggttcaaatcgctggataacatcctttctcttacttactcaaatcaatgaaaaatatatttgaatcatacttcatcattcatttgtctccctctccctcctgctccatctcccggtccccaccacccctcctacccactcgtgtcrtcgccgtcgtcacaaccgttaacctctcctcttaggctaccgtcgctgttgaccctccatctttagaatcgtagcgttagaacgaggtacatgctaggtatcatatatgttagagtcccatcacccatgggcgtgttctttgctttatttaccgtctctcgtctctctcctgtaaccaaagcgccttcttcccggactctccccagcatctcgctccatgacaaatcccaccgcgggtagatcacagcacgccatgccgcttcacgcgcgcgtgcgcgcagctagttagctagcgaacaaacccagcagaaacagacgccgccgccgacaacaagcgatctagaagagcacaggaaggagcaaggtgttgctgaggaaggcgaca

SEQ ID NO: 1537 - DNA, 915 bp, Zea mays
gcatggatactgccacggataccttattatatacatacctataccctttggataataaattttagcatactcgttttttatggataattatccgcggttaattacccatacccttagataataaattccactatggtctatcatcgacaaccaaaaagagatggctaccatgatcttcttgagtcaaagagcatcaacaaatttggtttcacatggaaagattccataattgtagctcaggctattcatttttttcattttaagttggttgttgctttaactttgtttaactatgctattaaggttatgtttggttcctttagtttagagactaaagtttagtcgggggactaaagtttagtccctaccctatttagttatagtgactaaaagtattaagaacatattaaatgactcataaaaagaccaaaatgcgccttaataatctcctaccattagtacaactaaaatgaatgagaggcaaatgtggaattaatatgatttagtcattttagtcacctgttacgggattagggactacattagtttagtcactgttttagactctccgtttaattttaagaactaaatgagactaaaatgaaaagattaatgtttagttccttaaaccaaaggggcctaaattggaccttcatgtattcacaagttggttgcaagttgcaacctcaccacgtcatgaagtgatgaccacaccaaacttcatgcaacaaaccaaataatggcaattcatagcagccatctgttgactgctgccttaagttgagcaacctacctgctccctgctcggtgtctgtctccgagaggcgagactcacccgactgtcgttcaatcagagcgcggagcattcaagaatcactccctccaccatcaggagggaccacagcggccgaagcg

SEQ ID NO: 1538 - DNA, 125 bp, Zea mays
ggtgtagcagaaaactcttgttctacttatcggcaaaactgcgccagactatagcccgttaaggcgaaaagccagttcggcccgctccgggcgtgtagaccgcaagtgatgatcgcgcccctatc

SEQ ID NO: 1539 - DNA, 422 bp, Zea mays
cctccacacgtaattctctcaatattcagattctctcaacagccagattttctccatagctagattctcagaaaagctcgttaaaaataaaaactgaaacaaacaggcccaatagcgataagaaatatccatgctcgcatctgagttagcccattacatcccgtgaaagtttctgggtccgcggaaacctctgaaatgacggcccatattgctcaagcttgctaaacctcctgctgtcctgccctagtgctcctctcctgttgtttcccggccccctccttcctcccacggtcccaccatcccagggccgccgcgctgcttctctttcccgtcgcacctccaacgctgccgccgcggcagattawtccaacaccgggccgggatacgtgacaggtttctgagctcgcagctctacgccagcg

SEQ ID NO: 1540 - DNA, 876 bp, Zea mays
tatatagcaaatataagagaagtagtgaggagtagagaaaaggtgtatgcattgcatgcatacataagagatgcccggtaggtcaacacgcaggacataacattccaagatatgttccttgggccctatattgaaaagacggctcatccattatccaaacatatactgatcgcatgcatgcacacgatccttttcaacaaattaaagcagcgaccaacaagccaaagctctaccaataggaatggtgtaccgcattgcattgatcttattttaaatatattattaattactaagcatcgttaaatagtcaaagatgtgcatggccatgcatgtgtgtgtatggtactatgctcgtagctctagctactagccagctagtagtacgtagcctgcagctggccattactgcacacactgttacctccggccagcttaaagattccttggaaccattttttccatatttttttttccagaaactccgagagaggtcatcagctcatcacactaaccgaccacagaggagggtacgtacaagcctgccttgcccgaacaagtacaagaaattccgtgctaactgtccggccgagcagctgcctgcaaactctataaaaggcagccacccttgtgctcccaaaccatcagtcatccatactcactactactactagctactcatcgaccaatctccacgtgcatcgttccacagcttgcagcgcggcttgttgacagttgacacacacacacacacagagagagagagagagagagagagagagaaaagtcaattgagagggacgacagagtgagttagcttgcattggacagagagagccaaaccagaaccaaaagcaagcaaggagagattgttactta

SEQ ID NO: 1541 - DNA, 510 bp, Zea mays
tgcagccaggtaccgagcgaggcgctcatgataccgccgccaatcagcagcacgtcggttttttctggtgcgttctcagcgtgaaccgctgaagagacaagcagtgccgtcagcgaaagcgcggacacaagttttttggtctgagtcatgccagtcctgtttattctttgcagatgaacgttaaaaattcggttggcaaattaaaagattgttacgaaaagattaacttgtttttagttaattaactattgatggcaattaattaactttcataaaagcgggatggcgaaataaacggcaggaatacagcagaaatgcgggaaaaagcaacaatatatccgctaacggagcgcggttattatttataacgacgggcacgacttaggtcaaattaaatccgctgccgcgatgacaaatcatgcactatcactgcacggagcgtgttgatgatctgacgccgaatgggtttaccctaaggtctctgatgacttgtttaactttcgcgtggac

SEQ ID NO: 1542 - DNA, 1500 bp, Zea mays
gcgccgccatgaagctaaatcatcgctgtcagatcggagacgtcggacagcgaccaccacgctgggcacatccgcccccgttccatcgagcaggctggaggcacagggcataactgcacattgctacagtactatctaattgtttactgtacttttaaaaatggtttgtattttttttccaaaatttcatcacagctggggcatgccggagctcgtccgtagagcagtgctggctacggatggatgggcctcgacatgactctagcaggagctcgagagtgcctccatggtagcacaattcaagtttctagtactgcttgtccgttgcgtgacgggtaaaaacgtctcctataccacaaatacatggagatgaattggaaaacggaagcaaatacgttaaatggtagtagaatcaattaaaaatatttgtagtcccttttttacgaaataattgtttggaatggcattattgcgaagcagattgtttgtagtcccaataatacaattgtctcactagtatatatgatggaatcgatcggatatgcagcatcttgtgccggcctccttgcgcgcgagttgactggcgggcgggaatgcaattgccaacaacgaagcttcggaagttcggatgcatgcctacatatatatgcgcgtagtgcgcatgcacgcacttgcacgtatatgcgcgtactacacgttaagtgagtagtgcgtgtgctaataggtaagtaattgtctgttggccatggtgagctagctagcacgcatagcttttcgggttctcctggtttgactacgcggccaatgaatgtgtccgtgtcctgtcaacgacgcatgcatgggctttattttgtggcgtgcgtgatcacttgacaagggcgcgcgcgtggacaggtagatggtggattgaccattcaaaaagtacgtacgtgcaaatgcgtgctatagctagctttcctacgagatcgatcgctgatgcgcgagcgagatgacctcctgcttgtggttagcatattctacttgcgaccattcaacgtcgtacaaactaatgcttgtcgctcttacttgtgcggttccagctgcctgcctatgtacgtacgtagcttagtaactattttctcaaagcacaccttgtttcgattatttccattccacggaggttggagtgttagaatagataagtatctagaatagattagtctgtagcaagttgcatgcgtccatcactgattacatgccgaagcttactgagaaggttagtttaaataagaatgttactttcgataagctttggcaagtatatcttatggcactcgttctgtaaactgaaatagcgcgtttcgtcgcctatattaacatgcatgcagcacacggtaaagatgctctatttccaccaaaaatcttccgctcctctgattttacatggtaatcggagccttgaagtagatccaatccacggccatggctagcagtccttcctccgtatctggacttgcctcc

SEQ ID NO: 1543 - DNA, 200 bp, Zea mays
ctagtctaggtgacaccatacctgaaaactttattgcattacactgaaatgtagtgttttgttcttatcagatgcctttggtttctgaagttatacacgactttgccttgcagaaggattggagagagaagcgggatgagttcaagaagaaggttaggcaatgtgtccgcaggtctcaggaaatgctgtgaaggaggaac

SEQ ID NO: 1544 - DNA, 156 bp, Zea mays
cccctgcggacgcgccgctctaaccggagatccgttaagagtccgccgcccccatctcagcgcctgagtcagccgttctctccccgtgctcgcagccactggtttccgcgggtctagggttcgtggaggcagcgtggagcttagggtttcggcggg

SEQ ID NO: 1545 - DNA, 797 bp, Zea mays
aagaaaaggtggctgatagcatgtgtgtagtgcaggactgcagggcagggtatgacatgacgggataagaaactactcaaactagacataatgtctcggtagtaattatgttttacagtccaatatacacaattcacactcctataagtatggtaatatcttgtgatcagaaactaagactaaaacacatgatgcatatgaggttacaagacactggagaacaagaaagcaaagttgatcgataagaaaatagaaaggttattgactacacattttatacaaaatattaactgatatgtatcaaaattgtagagtgaaaacatgcctttgctccttttgctcccttaatagtctttgcccacttattttcttctacatcctttaacttcttcttcttaggcattttccgcaagacaatgaataaaataacagcagctattattaaagttataactgcaccaccaacagcagaaccaacaattatccccgttcgactgcttgaattggcagtgcaatcattgcttagaggcctcccacaaaggtcttgatttgcaaaatcagatgctggaaacttgctcaaagatgaaggaatctgccctgacaattgattgtcagcaacattaaactgcgctaggcgactgagtgcagcaagctgaactgggattgttccagtcaatttgttatgttgtaaattgacaatgttgagataagaacaattggctagtgcttctggtatctctcccgagaagctattaaatgacagatcaaggtttgtaacaaatggaagtctcctcgag

SEQ ID NO: 1546 - DNA, 317 bp, Zea mays
gattaattaaacctaatctcctaggaccagctgagcagagagagagaaggcaggcaacgccgcaacggtagaaaaatacgtagctgatccgggtaacggtatgattaggggcgtcccgaccccgacagcgagccatggacggacttcaacaaacggtcggtctccgtctcgtccgtcgtcgcctttataagcgcctccgccgcgccttcactcgccaccaccatcctcttcctacaatcctacctcacctactctattcgcttcctcatctgcgagctgtgagctgcggcaaggatccaagccacaggcaggacagg

SEQ ID NO: 1547 - DNA, 912 bp, Zea mays
catccagtcaatgcatggagagaacttaggggcaagactccagctgctgttgatttgctgaagtctttatcttattatgagaaagaaacttgcacatggtttccatgagacacaaaccctgtgctatcagtcgggattccgagcattacaggaataatatttatttttgacgtgaaaattaccgtgacttgtcggtcgtgagtactttataagttgcatatagcgttcaggcttcaggggagagatgttggcaagcaccggggatcctgctgtgcccggaccacggaggaagctattgcaatactaacttcaattgaactctgtttatgatatcccatgtggcaaacatgattcagttcaatctccgaatagaacttcgctatgagaatgggtttgccgaggatttttcgacaataaatttatagacaatgcacaaatcttcgtgtctaccgtttatttagcttcagcggtctcgtgatcgacttacaatctgttgcggacccggggaccatagcccagttcaagcacaatctaccccagtctactggacaaaactgcagaaaatcttctcttgtagcccggtatgagcagagcataggttgggtctgtgccgggccggaccggcaggccgtttgcacatgtatatagctgctctgttgcgcgtttccctggcctctgctgcgaacctgcaggtgcggacttgcggctgcggcgccccactgcagcactgctgtactgtactggccgcagcgttcgccgtcctccgccacagaaaattcacgcacgattccgagcagccgccctccgccacaatttcgccatgggcgcgccctagccccgcccttcttatccccgctcttccccgcctatggctgccgctgctacagctgacgcctccgcgcagcccctccc

SEQ ID NO: 1548 - DNA, 94 bp, Zea mays
cacccccgcacccacccacccacccacgcacccggagcgaaggggagaccggccgcaacagaaggcagagagagctagagccccgcgcgcggca

SEQ ID NO: 1549 - DNA, 67 bp, Zea mays
aggcggacaagcttatttgcattgttgatggccaatatttgatgagcattgtagagtcaatcgtttt

SEQ ID NO: 1550 - DNA, 168 bp, Zea mays
ggtgctggcctatcggacagggatactgttgaatcccatcaggcttaagaagataaccaggatgctccactggtacagatatatgatgctagtatacagcaaggccaggcaggtcaaaatactgaggaaaatttggcagatcttatcagtaccgatttgactgagttg

SEQ ID NO: 1551 - DNA, 1334 bp, Zea mays
aataaaaaaacaccaacatatataacaactctgcctagctaggtttatttccttcatctaacaaagccacttaccacagataattttgacacgccagacgacgctgatttcacagtgaaaaagttgaaggtagaactttcgggatacgtacccggatatgtcaaaaaaaataacacagtctccatgcgtagaatgatcaaccgtacgtcagctctgtacatattgcatatcacatgggcgcatgcatggcaactaccatatattatatttatgtcattatatggaccatgtatatgcatagcaggttgcacttgtacggttcccatatcaaactggttggccggaggatacctactccctatgaagtctgaactcgagatgagatgccactagagcagtagctagaagaacaactgggctcagtggctacgcttctgcatgcatattagactcaactgacgagcaggttttactactagaagccggtgaacgacgacgatggcctcagcttcacgtcgccgccagcatttgcaataaaacaacgaaggttcctggcacacgcggtgaaamcactggtccagcagcagtacatgtgcagctctgttagtcagtggttaaatagtcgcagcaaatccaagcctacgccggcgcggccacggctaactaatcaggcgtgcggctctgaagtttactcctgctgacgtcggtgcgcgagatgctgacgagacacgcggggctcgtctcgtcaaagttttacatgatggaataccgaatacacaatacaatacgcggctcgcgctttcctccgcgtccctgtcatctcaagttcagcgccaacccggcgcggacgcgtgaaaattccttctagaacagcacgacctgtgccgatagcaacggtggtcaatggtcgccggggagggggagcgcccccctttcctctgcccttcctcggaggggagccggcgtgggatctgtctggctttccccggccggttcctttttcacgtcggataggataggagatcgaaacctgctgccgctttcagctagtaacttgagtcgattgtttctcagctccatgaaacggcccacgacagcccatgattgttgcctgttttcagttccaaaaacaaaaatcgcaaaaaacaaaaaaaaaacgctatgggccgagccgactgctgcctcgcatcgctccacccgtcgcgccatcccggcgtgccgcggcagacgtgtcgacagagctggcacgtgccgtcgcggggcgcatccttataactcacttccttcctcgccactcgccagccactctctcaggctctctgcaagcgagcagg

SEQ ID NO: 1552 - DNA, 746 bp, Zea mays
acactcgtggtattgtgcaagagaggattttcttaccaaggaatccttctgaagctgcagaatcacccttgcaagttgactttatatatggaaaatatggaagcgccaagcgggtatggacctatgattggattcctgcgtggtgcagctgggccctcagtgaaagggaaagattctaacaaataaataaaaacaaaattacgatggtgtccccacaacctttgttgtaacgacgacgccaaaaaataagggcaacaccaagcgaagcccggccaagcaattttttttgttctcctttccgtttcgcagcgcagcaggatccactaggaccactagatgcagtggagcatcgagccatttccgggggtgagttgaggtgagcagaaccgagctacctggtggaggctggcacctagctaatccacaggaggaagagaggagaacgggagcctttttgatgacaagaacggaggcgtcaggcgtgtgattaacagtgagctgcttgctacctaactatcaatctctttcgctgcttgctttccattgaaaatgatgtgttctcccacaccctgcaacctgaaggcaacatgcctagcacaaaattctcccaaggattcccatggtttcctagcccaagatgtgcatggagccttgcttcttgatctccagcagaacagaagtgaagcactgtggccttgcatgcccaagttttgttgttagcgttaccaagatcatagctaccactg

SEQ ID NO: 1553 - DNA, 156 bp, Zea mays
tacataatctcccatgcaaaaaagttgaaaacatgaatcaaaggaaaatgagacgaggaaggtgggggtgccggatgtatcggaccggagaaatgggccagatacggtgcagaactgcagatgcaggccgtcaaataatgagtttcgaaagcgata

SEQ ID NO: 1554 - DNA, 821 bp, Zea mays
gagtcatcaaacgtgacacagaaaagtcaaacgaattataatttgtgacagatggagtatattcaaatcgatttaatctctcattatttttccatacaagatcgatattttattgcattagtatttattatggatcataaaatttgttatattcaaagttagattaagtctaactaaatccaaataacaatgatcacattattatttccaatatttacaacacygaataaatattatccaattaattataattttttaatattaaattgatttaacgtcataaacatgaatttatttactaaaatgaataaaacataaattactttaacggtcattttaacagtcacaaaatgaataattgataattggattcattttggaaagcgagtgtacaaagtagtagaacgtgtttcacttcacttggatagttgaatccaagcgaactttcttcttttttacaaacaaatcgttaggtctgcctctgaccgttctctgctccagcgcgcgcgcctgatcggccggaaattgttcgtacgaacaagtgcggacgcgggcagatctggctcctcgtcggcagcccggcgtcaacgaaccaatccgggcaggcagtcagttgtcagcatcagccacgaccagcaaacctccgtccccggggtccagcgtcgccctcctcccacgcgctgcggcgctggagaataatttgggcaaaaggcaaacgcattgtcggctgtaaagggtagaacgtctccactctcccgtacgccgatacccactgacgccaccgcccgaagcctccccgagaaacaggagccggcgcgggg

SEQ ID NO: 1555 - DNA, 73 bp, Zea mays
aaaaccgcaccttgccgcaactgaatcgggtcagatcgggccatcggggaggcgagggagctcacgcggcgcc

SEQ ID NO: 1556 - DNA, 189 bp, Zea mays
ctccctggaagtcaaaccaaagggaccctaagtgtctatagacctggatgtggtgagtggtgatgctcgggtggtgattggcattgtcactcgggctcttctttgttctcgtcgtcgtggtcaccatagagcgcgtctgcaagcgctcccaccccaaaaccccgcggacgcaccgacgcgcgagccata

SEQ ID NO: 1557 - DNA, 972 bp, Zea mays
tgtgtagtgttactgtttggtaataaagggctagccatggaagaactagctagttgcatgtagggataaaaacagtttaaatttttttcggttttccggaaaccgttttcgaattttttttgatctgatccaacgttcgaatgttttttatccgatccaacggtaacggtagttctcgaaaacaaaatcggtaatcggtattgaatttcagaatcagtatcgaaatcgatttaacgtcttaccgactgtttacttcggttaccgattttaatcggaatttaccgaatttaagtttcgaaattttccgaaaataaaaaaacaaattaattggcccaaggcccacatctcccactcagtctagctgggcagatagaaacatggcgtcaagcatcttgatatagaaacattgtgccttgtgctcttttgactggacgaggtggtactaaactcttgtaatgttggttgtatcgtgttatctgcatgttcgcctattggtgttgggcctatttggaggctgtgggtcgtcggtgcacacccatgcggcatttcaaattagcgtgggagctgccaggaccgcatgagcaaggttgttgtgtatacgtgggtgcagattgtaggcgtccatagtactggtggtgcacggttttgccaccctccgcgcgtccgcgccccgaaatctcgcaccgcgcgtccgcgcccctacgccgccaccacctccttctctccccctaactgcgtcgccacctcctcggttccgcgcgtccgcgactcctcacagaaaccgcccttccccctggtcctctctctcgcccccatcccccacgaatcccacctccgtgatgcctgatatgcgacgagcacaacatcgaccacaccggaaagtacgccggcgactccgacctccagctcgagcgcatcaacgtctactacaacgaggccagcggcggccgcttcgtcccgcgcgccgtcctg

SEQ ID NO: 1558 - DNA, 376 bp, Zea mays
gctccgaagtcaagattgttttttataactaatagcagataaatacattaaattctatgtctagattgctttttaagtatttttaaaggagcaaaatagatacttcaaaaaaaaaaatgtactgcaggtctcaaaactctacatgccctaatcgaaccatccttgtgcttcggcattatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctacc

SEQ ID NO: 1559 - DNA, 152 bp, Zea mays
gtacgtcatcattgatgcggattggcttacttgtactaataatttctgcaggagtattagtaacaggtactcccttaattacggaccgtgagtgaccaaattaacctcccttcggttacccttgcagggtggacgcggacgcggacggcagg

SEQ ID NO: 1560 - DNA, 321 bp, Zea mays
agtcgatctgcagccacacgcacaaggactagagcggacataatacggtgcaagcggagggaccaaaccgcaaaagcgcacagttcccgttccccctccgacccgttcattccgcttggttttctcctcctccgtcctcttcgctccccgtcagaccatccctgtgaggctgtgacgcaaccgggcgccggcggtctctcctgcaccacagggcacgccgcctcccgcgcacgtgttctcctcttccggggattcagatctggggattgctattctgtccgtctgactccgtccgtcccgaggcgcggcgaggggagcgag

SEQ ID NO: 1561 - DNA, 1287 bp, Zea mays
cctgcaaatggcaaagaaaattaaatgcaagaaagtaaactccatattctgcattattccattactccacaacattgtgtgcaactataagattctaagatttgcaaattgcatttaaagagtgaatcatttacacaaatacttcataaggcattacttttagagatcaaagaaagcaacatctgaagtaaaatgaatatctcatagttatgtacataaggtgcacgttaagcattttcagttaccaaaaaatatttagtccctttttaagcgtactaattaaatataattcaaatattcaatacctgatctttattttttcttgctgatcgcgaaggaggaatcttctgagaacaatgggaaacataagttgagtcagaaacatctccagactgagagaatttagctcgcatctcagccttgctccgttctaggctctcatgcatagcctttaacattgcttccttctcctctctctgtagcttccagccttccttcagttttgcatccctcttctgcatataatgctcataaaacttccctctcgactcttctaaacttagaatgccaagtttttgtggtgtgctaatgttaaattcttgattattcaccatcttcagaagctcaccggcatcaaaatcattgacagttatactctcctttacaacttgttttgtatgaattgtctcatgaagaaccattgtcggctttacctcactcaccataggtgtgctttcaacctgcacatctgtaggtttacctcgtcgggaggatgttaacttgtgttcagcaaataatttctccaactcattggccttcatttgcaattcaccatgccgatcttggttcccttttcctggtcttgtcactctagcctgcaagtttagttcctgatcggtaatggatgattgcctgctcaaattttttccctgacgaccagagcaatctgaatcagaaccagctgtaacctttttccctacatcttctgacttccgtggtagacgattccgctgcaaactaacgtcacggaactcagtttctgtagaggcaatcgcatccctaacagatgagcctttagcattagctcgggaattggatgaggcttttggtttaggattaacaccaccagatacccttccaaatgatcgtgaaggctgatccttccttccagtcacttctgcttcagtgtgaatatcttttgtatggagacctctaatatcattctggggaatctgttcacttgcaactggtacttcatgagcaacagctgtgattcccttgtctatc

SEQ ID NO: 1562 - DNA, 200 bp, Zea mays
gtgaaggtgatgacctagaattttgtggatgatatgaaaatgatcagatttatttggttttttttcagttatgttattgatgattaactcctttatatctttgtttcagttatgttattgatgattaactcctttatatctttgtttcagttatgttattgatgattgactcctttatatctttgttgtaggtctatgac

SEQ ID NO: 1563 - DNA, 652 bp, Zea mays
ggtaatattcactcagtaaattagatgtgtagtctaacagacaataagtacaagaactaaccctacctcttgtaatccttttaaaaaccaatcctcccaaacctagacggtgacggtatatgtgtcacctcgtttttgctgttttgtatgattaaacaatgtttttcttgtctgatgtcaaatttattggtaatgtattgttggtggatgtcgtataactgttaatatcatataaattataatgtgataatgtttttcttgtagagaatgttgacccaatacttgaatgtttatgagtataagatgaatcctatattaatatatatataagtatgaagatgagaaggaatataacttggatagatatgagacgtcctccttgagcttggacacggaattggctatttccctcatttcgtagtccgatcaaaacctcctcaaacccaacgcaccgactagtcgctacgctcgcacgtcgtacccgacctcattcccttcccttcccttccgcccgaagtctccacgctccctttctcccgtttaaaaccttcgcttcgtctcgactctacttggccggccatttcctctcgcccagtcctcgctcacgtcaaaccctagggcccggggcctcctactcgtaggctcagatcca

SEQ ID NO: 1564 - DNA, 1012 bp, Zea mays
ctgcccacatatttcacttggaaaacattgtcaaatcatgtttttaaggaccttcggaagccgaaggcccccaacatatatagaagacaatattctggtatcttcaatgtcagataatatatattctcatcttcttcaatggcagattggtgaacctattcaagtcgggttgtgccatcaccaattgagaggagcgcgtggataaaattatctaaggtagttcttttagattccaaaaggtgggagcatcgaagcctcatgtttgcaattccaccgtaaatgatatcatgtgattgatgtgtcaagatctttttttttgtacttggagtaattgtgagtctctaaaatcacatgtaagtaattgggatctttttttttttgcaaagtttctgcattgatattactatagttctggtacatatgtgagtaatcgtctgtctaggccaagaaaatcaagttgcagtttttcttaagcacacaggaggtagtaggaatgtagctcttccccaaataaattgattgtgccgttgcaacgtatgtaatttgagaaaccgtatcttatcaagtcgtgtcttataaaaagagagagagagagagagtggaaccagtatttataagcaatatgtgatgcatcatatcgtaaacttcagatcggataggaaagcgccaagacgctcacgctgccagctcagctcgtgttcgacccatgctttccacgaagcatgggcaagaccaagacggcaggagcaggggagcagcagctgatgataagctagctagccagagtcccactccactttacctccttgtcagctgctcgcacttgcagcgtcccgttcccgcacttctcttccttctcgtttcgtcctgcacagcgcacgcaactgccaccggccaccgcgcaaactccattgcgcgcagatcaagaccgccacacccaccaccagcgcttcagcgggagacgtgacgactgacgagacgaagcctctccccacggcgcctccccctccac

SEQ ID NO: 1565 - DNA, 466 bp, Zea mays
tcctagctcgcacacgtagggataggctgctgccccggcaacagcacagcagggtccgctccagtgtcgtcgtcatgcgtggtttttaggcactcgcaacagtccaaggtgtccgtcccttccctagccattgccatgggaccctggttggtcatcactgatttctaggcatgcatgcatgcataatatgaccaccaatggagtaaaggagccggcaccccagcctgtcatgctcccctcccagtcctccgctaggcgacaaattaaatcctccccctacccgtctccaccaagtccacctccactccaccgcgcgcctataaatcacccgccccgccgcctccaccgtcattctcatccccgcgcacaacggcgccggcaacagcattagcaacctaaccctcgcccaaccgacacacttcaacagtcaacacactgtacacccgaccggaccctcccaccaccc

SEQ ID NO: 1566 - DNA, 121 bp, Zea mays
ggtacccctgcctgtgtatataagccaatggcaagtcgccaagataaccagactggaaaagcatcggcacgggcggtaggataaagtagcatagcataccacaaaaggtgctgcttgacag

SEQ ID NO: 1567 - DNA, 1500 bp, Zea mays
ttatggctcgcgagctaaacgagtcgagccgagctggttctctggctcagttgcttaacgagtcgagccaagccagctcgttcccttaacgagtcagctcgagctcggtcgagtcgagccgagctggctcgatatccacccgtatttaggtcgcaggttcaaccaatcgaaattaaccgaaggtgctccagaaagcaaactacgtgccaagggtgctctagaaactagactgtgtgcaagaatatgcttgcttttcatcagcaacacatctcaaggtacataagagcatcttcaaaaggatccaaaactcatttccaatcttggttttagggaaggttaaaaaattgctctctaaaattaaaaatattatgttcacttcaaaactcattttcaaatatgctcactatctcaacttttctagccttttcatccataggaaaatcaactaaaacgcacagacacggatatatacaaactcacatccataggytaatctgaaggtgaaaaaacatagaaaagaactaggaatagaataggttattgatactaatcttaaaaatataaaagttaaagtaatagtggaacgaatgagcctctaacttaacatagaaaataacgaagaatagaatatgttacttatacagatactaaaaatataaaaagatacaataatagtggaacgaatgagcctgtaagagcaccttcaagagtatttttaaatttcactctctaaattatcatttggagagtcatttatattaaaaccactttctatatattttcaatctccaacggtaaaatatctatttatatagattatgaaggatataaagagtctcttggagttgctctaactgatatagttgtcgtccagggttaatctcattttacttatccataatttagaatattagtataaatatagatagagaagaaattaattatcaacaaaaaaaatcatacaatgtttgtcattccgtagctatgtttcgtacaattttttttttgcgcaccgcaccgcacggacctagttaaggagataaaccaattagccgctgcacatgcgtacagggcaacaggcccgtcaccagtttggaacaagaaggcccattaagggcccaactaaaccagccagatatatattactgcgaagtaaccctaaccgccaacagtctcggcctctcctcccggcttcctcacacggcactccagccgctagccctcactcaaccagacaaccagtacaccaccgccaccaagcccgggccgaataagtctacagggcagcagggctaccgctgccgccttacttcgccggcaaagaacgccctccaggtattcccaaccatctctttcctgcctgcagtgcgaaactgacttttcaaaccctaacatcaagttatttggctgtttcatgcttatttaccttctacctttttgctaaaaaactatggtggtatttacgctcatctccctctactagatccaccccggcctgct

SEQ ID NO: 1568 - DNA, 1500 bp, Zea mays
ttatccaaaaacgaatttcgactattactccaactcgggcccggatacacactcacgccctaaagatgacccgcacatgtcaatgcgccgacactagcgatcatgtggtcaaatcacctctaagccgagtcctcagacgacgcaactaaagagcctttgacaactcagctaaacgagatctacaccaacctgtcaggtttaactgcaccttccaacgacatccttcgagatctagaaccgtgcagacaggaaggaaaatcgaactccatgattttgatggccccacctgtagaaacggcttagacaaacaattaaggtcagtttgggttgcatgttcagctcactacgcacatacgaaacagctttggtttgctatcttatcacaatttaacatgcttaaattagataagtttgactaaattagacatacatttggtctcctgctacatgaatcctactcctcatgacatataaaagtgtgacaagatttctttagacatggcaaactgtgccatatggactgtttggttctatatctatagtgccaaaaattgctacacaattttatgtcacacttgtcgaggttagaatctcaaattatgtgcaacagtttgtcacacctaaaggaatcttgccacatttttaccggtcactgacgagtgagacctacgtagcaagaaaaaaaatcttgccacaactgcgacttcaaaccaaacacatatctaacttggtcaaacttgaatattgtcacacctaaaggaatcttgccacatttttaccggtcactgacgagtgagacctacgtagcaagaaaaaaaatcttgccacaactgtgaaaagttagacagcaaaccaaacaacacctagataggtcaattgttgctcgtgtgcgccctaagagtttagggactgacataacacaactggacaagttactcattagcaatgtagcccaacgtagtaccagtatcttccaagcggataggaaaggggtggatctcctacatttgccagagagcggtgtggattttaaatagttaatttggatgggaatattatattacgagtaataatttgtgtggagtaactacaagcctgccccggtcccgcgtgagcctgtcgaaccactgcgcgccgttacgtctcgtgatctagcgcgcggcaagctcgctggcacactgtggcttcacatggagaaaaggctgaaggatctggatatcgacaagtaaagattcaatcagtacgagattccatggatttcccattcagtgaacaatacggccggagtacagcactttctttttcgccgtcataaatggcggccagatagcacgggctaggaagcacggcatgacgcccctcccggtcccagtcgtcgatcaaaattgttagcgataactcagcgtcaccgtgctcaaactcaaagcctcgatatatacgctcgagacagcgcgcgcctctctccttattgctcaccccaaagcaaagcaatcacgagca

SEQ ID NO: 1569 - DNA, 445 bp, Zea mays
tgtgtgtatgccataaatctgaattcattataaacacaaaaaatgaaaatggaaccatgagtacaatttgattcaacagtataattttatactcccaaacacctacaaaatactaaaacttagtggcacacccgctgatgtataaagtgtccccatctttgtcttagtttccttattgtattttggcaatttgacaatacttctgttgtgccttgatgtcaaatgttttgccttgtagcacgatgaatttgttggtgtattgtatcaaaaaattaaattttgtgtgcatatttgaggtggtctgccttcattttgatgataatgattgtcctccagtacaacttgtcatatcattctgtcacagtgcctactcatgattgaaggatgatatagaaaatgtggtggttgctcattaaaaaaatccggtaaggcaaagacatgattt

SEQ ID NO: 1570 - DNA, 684 bp, Zea mays
agtgcgtaccgtattggtacaagcaggggcatagggcaaaaaaacgtttgtgttgtgtacagatggtgggccgacccacataatagaggtcggattagtggcccaaacaatcataactagttgaccataacccctagtcggacgactaatcgcgattagtcggcgactaggacgactaatctctatctagtcgctctagtcgagtcggagaccctaatcgagctcggactagagataaggccgactcgcgactaatcgcgattagtcggacgactttaaaaccttgcttcagtagctcaacccctgctgctctgtaattatatgctgcacaattcattgtggattgcatttcttgtagatttcggaaggctacaagatttccacttaataattccaatcataccggttcttttgatgatcttactgtggatgcaccttagcctcctttccatgttgttttcttctttctatgccgatgcggtacccctagctccctctgtaggcttagagtgcacctgtctatagattgtctgtccatttatttattgaaaacaactttattattgttattgtctttctgtacagctaggcggtgttgagttgtgacatttgtatcacatgaatgaactcagagcatctcattgttaaaactgtgagcatatcaattcccctcctttaagcaat

SEQ ID NO: 1571 - DNA, 167 bp, Zea mays
tttgtggatgatgcttcactgcagtgcctaatgaaaatcacgaggctggaaacgaggatgaagtgcgcagggctagggaaaggagcttcagaggtgatgatgtgtcaagctctgtagatcatgacggcaaggtgacaaaacctctcccagaggaacaattgaacatc

SEQ ID NO: 1572 - DNA, 1045 bp, Zea mays
acttaaaagaatgcagatatcacacgtaacccatgtcccatccacccaagcaactttcaactacatatatctgtttccctccgaaaggaaggaatatgctccgagcaaacatcaagtggtttaacatcgctgtcactgtcagccatagttatgtgtccgagtaaatatcaataaataggcttccaagccactcaatctggtcacctatgaccacacagttgatcatatcatacattaactaatgtgaatataacatttacagtcatatggttcccactgaacttgcaagtgtgcaacatccaggcataatccgtaattccctgaacatgtatgacaggcagttccagtttcccttgtccttctttctctttcccctaggttactagtttaataaaaccaaggcatgaacaacaattattcagtggtaaacctatcagattgggttgaagcatgccgcggcctgaagaacggaagcctgaaatcacttgcaaagcacaggtaaaacatggcatggatacccaacccaaccgacgacatgtcttcagacaaacatgagcactagtgaagtaagagtacgtatatccagtgctggtccaaccaagcaagaaaacctgacctgaaactagttgcatgtctctttcagagtttcagttcaactacctagaacagcaactctcaccaactatgctccgacaaggcacagtttcttttttgactaccaataataataataataaacaacgttgcaacatgtcagtttcgcaccacccagagtcccagacaaaaaaaaaaaacctccaatcccggatcgaaattgaagggatcttacggcgagatttctcaggattgaggaacacgaggcgtgaggaaggaaggaaaggacggaggacgggaggaggacgtaccgagtggcccgagcggcgagtgcagcgcgggcgtcggcgcggacacgaccaccgccggggtgggcgcggcggccgtcaccgccatcgatatcggcgtggcgcggctgacgaacccgaccgggcggcccctgccccgcttc

SEQ ID NO: 1573 - DNA, 616 bp, Zea mays
tgccacgcctgtgccttccgccggtcctcctctgtgtgcctgtgccttccgagctgtaacagtaagcaaagcaaacaactgcttgtctgttgaataatttgattgtttgaatgttgatgtttgtcacaaacttgcagagttgatatatttggaggattgttcaaagggcttgatcttcaaaatattaagaaggcatttcaaaagaaggataggcaaatacaattgcctaggtctccaagacatatatagcaaaatcagaggtatgacagttacatgttttgtagcgatttattcttattttagacaatgttctatttttttatatatatcgcgagttgttctacaagttaattggttatatgctaaatattatacggtccagttgtgtagagccatacctaaatttttatccgtcctccgccactgctgctgggctttgtggaagcggagaaataggctaatcttctatggcggcatcgcatgaaaattgaagagcgttgggtagttgatgtctggtgtgcaaaactaatagtggcaatgtaaggcctcgtgtgctcttgtttttttttttttactaaaacacttgtaaacattatgatgtgggccactaaaggca

SEQ ID NO: 1574 - DNA, 109 bp, Zea mays
ggtatgctctactcttttagttgatggtccttaattagtttcagctgcatatcacatctcttagctttgtctgctgatactaatttgcatatgttcatctgctgcttta

SEQ ID NO: 1575 - DNA, 800 bp, Zea mays
gcaacacatgagccacattagattttgtcattaaattttcttgttacaacttatataatatacaacattttgaatgatgctaacaaaagaagaataacaattaatgtttgtacatattggttccgtagcaacgcacgggcatacacctagtatagaaagaaggcgggtcgaatggaacgggcggagggaggggtgcacctgcacttggcaagtgcgtgctaccacgtgccgtgcatcgatgggtgtccccttcgtaatcgttaacagcgcgccgccgcctatgctagtgaggtgcgcttcgctcgcccgcggcggccggtcaggctacttctcctgcgcaacagcgcagtggcagactggcagccatgtagcccatagttcgaacccacggccgcgcacaaggcgactagcccacggacataagaaccaacgttcttgggtcagtctctttaggcccattttgaggaacgggcacggactttgtggccacgaagcggcccattctcccagagtcaagtccaatttcaacgcaaaactcagacaagttttctttcttctctcccaagtcccaatccacaaaaactgtctacgggcccacgtgccatgacacagacccgccgcttccgaccttcttatctcgcaagaaatgggcggacctaacgcgcaagcgcaataaaacccctgcaaaaacccgccactctcagatccgcacagcgacgccgccagccagacccgatcccctccctcgctagggttttcgtccccgcgccgccgcgctcccggatcccaccgaaacaacc

SEQ ID NO: 1576 - DNA, 124 bp, Zea mays
ggacgcccccccccccccaagttcccacgagatcccgactcggacgaagctctcctcgccggccaccgtcgcggcagcttgctacgcacagggagtctgcggcgcgcgaggaatacagcgaggg

SEQ ID NO: 1577 - DNA, 790 bp, Zea mays
cttgcaattgcaacgcaagcataaacggacccatgagcagaagctcatcagacgggcccgcccgcctcagggcgccacgtggtaggttattgaaccaaccaacggtgctgacggccgcccgggccccgccgctcaggttcatggattcgacgacgtcacacttacgcacgcaagctgctaaccactaccacgacatcccttgtttttgtgaaatactagcatatagatctcagtagtaagcggtttgaccgcgacggcgacaacgacggcgatagtggcgcgaggaaggtgccggctgcggtgacaagagtgagatgtaggggcggggtcgtaggagagacaagagatgagcgatgaaggatgatttaaataatattgattatcatatttgattgattaagggaggatgagttatccagtaatctgatctgttgattttaatagtatattaaatctggctacaatttattgagtgagttttgcaaagtttaaactgttagattatataatggtatagatagataaatagcgtggtcgatggatcacgcatagtcgacgcatgacatgcattacggttaatagtatatctatgtacgtgcatgtcctctcccatgctccgccccgttgccttataaaggcacgcagcaggacggaactgcactgcacctcgagcaccccccggcccgtcgtctacagtctacagcacacatcgcagcagctcgcgaccatcgtccatccgctcaattgtgatcgatcgagctgcgagcccatcgcctctagctaagctacc

SEQ ID NO: 1578 - DNA, 112 bp, Zea mays
gattacatatatattatctgaagatgatgtaaagctcattgttgttaccctcgtcctcatggtgtcatttcagtttgttatgtgatcatagcttgcagaaacaaaataggag

SEQ ID NO: 1579 - DNA, 853 bp, Zea mays
atatttaaggctaatttggaaacactatttttctaagggattcttatttttccaatgaaaaatgaactaattttctttgaaaatagaaatctcttgaaaaaattgggttcccaaactagcccttagggatagtttaaaaactccatttttctaaaaggtttttattttactaagagaaattagttcattttccttaggaaattgaaaatcgcataggaaaatgtgagtgccaaactagaccttagaggtacgtggtatttttttttgttatgtcagtgacccaacgtaaatgagtgctacaataaagtggcaaaaaaaatcgaatgtcctcacaatttggggtctcaaacagaacgcgaagtctcgccgactccgacaaccttgcgttcctgtctctgcgtctcgtcgcctcagattcacccccaccacttcctccctccccttggatggaggcaggcagattcccgttccattccagactcgcagtacagtacacacagcaaaagcaccacccgggccggcttcctctagactagattagtgttgctaagagcctttttaactacgggattacgcaagtctcgtatactcatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgc

SEQ ID NO: 1580 - DNA, 121 bp, Zea mays
ggtgaaaacacgctccctcctcttctccaaagtttgcactactgtgggttttttccctctaatagttcgctgcagtcctacagctagcaaaagtctaaccccttccctcgtgcgaacgcac

SEQ ID NO: 1581 - DNA, 229 bp, Zea mays
tgtacgctacaaagctttctcttccctcccggcctcctccacactttccaaaccctacgcaccaccattatattgatcgatctatgctgctgctggtcgcaaccgcaccgcagcttcacgggccgccctctcccaaaaatcgagcaccagagtgtttcaattccttctccatatattgttggtgttagtttcctgctttccctagtccctcgcaatcaacagatacctc

SEQ ID NO: 1582 - DNA, 1461 bp, Zea mays
ctatagaaaatatgattatatccttccatcgtctttatacgtccaaccatacacacgaaaaaacagtatcatcccacttgacaattatttttaattcttttccttttctataatgtagataaattatgtaattacacctatacggtaccgagtagtcttttgattgttaataaagttcacacctttttacggacctcaaaatcttaggcatgacgagttaattttaatgtttttctttcggctaattccaccatttaacatttttcgcttatttttaatgcatacggactacggtttggcgaatcattacaggtacggtcagtctttttttccctgaagacaggcagcactaaaacatttctctgcctaactacttccctgtacgtggacgaggaccaaggagacagagagaaagcctggccgcgccgcccaccgtcgcctcgtcagtcgcctcctccatcctccctccccatcgacttcccaaatcccagccaggtaattcttggagctcgtctttccggttgtctcctctttcctgtgcatcctgctgctccgaaaatctctcagatctcctcgtcctctggcccattctcttcatctccatgcatggatgaacaagagacggagggagacagatgcaaacatcgagactgggtaggtgtggcgtcgtgctgatcttcctcccaccttacttgaccatggaacctttagagctaaaaggcaccaggcactgattatattaggttacttgttaattaacaattagcatcgcgattagactagaccagttggttactaacaatcaaacaattggtatcgagatgtcaaaggcagtcacctttagtgggatcgatactgttcttttagtctattcaattcagtagcagtctaatcagaagacgccacttgtttccctcgcttcaacggcgctgtcacgggttcagacgtgtttctatttttcttcttttccagccttacttttgattaaactaattatttgtttctggtcttcgttacgtgtactttctcgctcctacaatttttttcgcgtgtgccatatgtgttcccggaaaagtttcctgtccctttcgggtactccggatggttcccattttttttctttcataaaagttctattttgaagcttggagaacagtgatgtacatgtactgtgagctatttgatttgactgaaggaaaaaaaatgttgctgcagtctcctcgatcttcagagctgtgatgtgatttgtccagatacctacaaaaacgtaccaaatcctatctttttgtcctacccattgtttggttcccgtgcttccagaatttatatggactgtggattttaatggaagaaaagaaaggaaaaatatgaatcataaactactgactcatgtcataacattgactttttgtgtagggttgttatctgtctttgtagcagaagaaacagtcctaaaaaaga

SEQ ID NO: 1583 - DNA, 748 bp, Zea mays
ctctttatcctctgttttctacttgcttgaacatgtcagcattctcgcctgttggtaatctattggtaatcatgtggacataatacagtagagctattagcataataagaattattgtaagggtttgaaacgggagtcactgctatcgcgtgaagtcttctccaccaacgacgctagagttcgagtcaagccaccttctggttttaggtgagatgatggttgggttcacggggaagaggaatgagatggagcaagcggtgaatagcctctcttatttctccctctccggtcccgctgcaaagagccacagactgctgagtcggtgagctgtctgtgctttcttttagtggactcctgactaggctggttgattatagggattaggacttggctaattgtttttgttgtttcagaatcctgaagaataccatgagtcaaccaacacagtaagtctagctgctcgttcatgtcatattgagaatttcaccagttcaagcaaacaagaaattcccaatgtcaagatcgacatggaagccaaattacgagcatggttggaatcaaaggggaaaacaaagtgcatccaaaaaatggatggtcttttctccccaattgccagcaagactctattgtctatgacccatatattacatggaaccatacatagttcttatttctttatcttctcctgcacaagatactttttgatccagtagtccttgttcccactgaaaatatactacgagagcac

SEQ ID NO: 1584 - DNA, 174 bp, Zea mays
tgtactgtaagtgagctagaattctatgaagatctcaattagaactcatttcccttcctcatgtagtcatgttattttgtttagacgatgcagtttctattggctcttgatattacctcatcagagtttttttctgcgctattgcagtaactctatttcttgatcaacatcaac

SEQ ID NO: 1585 - DNA, 1500 bp, Zea mays
acaatccatgcatatcttgtaagtatttatattggctcaattccaagcaacctttacacttacatcatacaaactagttcaattatgcacttctatatttgctttggtttgtgttggcatcaatcaccaaaaatggggagattgaaagggaattaggcttacacctagttcctatataattttggtggttgaattgcccaacacaaataattggactaactagtttgttctagtgtataagttatacaggtgcaaaaggttcacatcaagccaattaaaaagaccaaagttgggttcaaatagagagctaaaggcaaccgaaggcacctctggtctggggggcaccggactgtccggtgcaccaccgggacagtgtccggtgcaccagaggactccagcgcaaactcgacgccttcgggaaaatccagaggcagctccactataattcaccggactgtccggtgtacaccggactgtccggtgctccaaggaagagcggcctcaggaactcgctagcttcgggaaactgcaacggctgctccgctataattcaccggacatgtccggtgtacactggactgtccggtgtaactacggagcaacggctatttcggcgccaacggctacctgcagcgcatttattgcgcgccagcgcgcgcagaagtcaggcacgcccatgctggtgcaccggacactctacagtacatgtccggtgcgccatcggacatccaggcgagcccagaagacagaactccaacggtcgaatcccaacgactttggtgacgtggctggcgcaccggacatgtccggtgtgcaccggactgtccggtgcaccatacgacagtcagccccaccaaacggctagtttggtggttggggctataaataccccaaccaccccaccattcattgcatccaagttttccacttctcaaccacttacaagagctaggcattcaattctagacacaccaaagagatcaaatcctctccaattccacaaaaggctttagtgattagcgagagagatttgccgtgttcttttgagctcttgcgcttggattgcttcttttctttctcacttgttcttgtgatcaaaactccattgtaatcaaggcaagaggcaccaattgtgtggtggcccttgcggggaagttttgttcccggctttgatttgagaagagaagctcactcggtccgagggaccgtttgagagagggaaagggttgaaagagacccggcctttgtggcctcctcaacggggagtaggtttgcgagaaccgaacctcggtaaaacaaatccgcgtgtcacactcttcatttgcttgcgatttgttttgcgccctctctcgcggactcgtttatatttctaacgctaacccggcttgtagttgtgtttatatttgtaaatttcagtttcgccctattcaccccccctctaggcgactatcaattggtatcggagcccggtgcttcattagagcctaaccgctcgaagtg

SEQ ID NO: 1586 - DNA, 1500 bp, Zea mays
tatattggctcaattccaagcaacctttacactcacattctacaaactagttcaattatgcacttctatatttgctttggtttgtgttggcatcaatcaccaaaaagggggagattgaaagggaattaggcttacacctagttcctatataattttggtggttgaattgcccaacacaaatctttggactaactagtttgctctagtgtataagttatacaggtgtcaaaggttcacaacatagccaataaaatgaccaagtgttgggttcaacaaaagggcaaagagccaaccgtaggccctctggtctgggcgcaccggactgtccggtgtgccaccggacagtgtccggtgcaccaccggacagtgtccggtgcaccaggggactccagctcgaactcgccaccttcgggaatttccaggggctctcgcgctataattcaccggactgtccggtgtacaccggacagtgtccggtgcgccatggagaagcggcctcaggaactcttcagcttcgggaaaagccaacggctcgtccgctataattcaccggacatgtccggtgtgcaccggactgtccggtgtgactccagcgcaacggctatcccgcgccaacggctacctgcagaggcattaaatgcgccgcagcgcgcgcagacgtcaggtttgcccatactggcgcaccggacaatgaacaggagctgtccggtgcgccaccggacatcaagggtggcccacaagtcagaactccaacggtcagattccaacggcactgatgacgtggcaggggcaccggacatgtccggtgtgcaccggactgtccggtgcgccatcgagcagactggctccccaacggccacatttggtggttgggggtataaataccccaaccaccccactttcatgatgatccaagttttccacttctcaactactacaagagctctaggcattcaattctagacacattcaaagagatcaaatcctctccaattccacacaaaaccctagtgactagagagagtgatttgccgtgttcatttgagctcttgcgcttggattgcttcttttctttctcacttgttcttgagatcacaactccattgtaatcaaggcaagaggcaccaattgtgtggtggcccttgcggggaagttttgttcccggctttgattagagaagagaagctcactcggtccgtgggaccgtttgagagagggaagggttgaaagagacccggccctttgtggcctcctcaacggggagtaggtttgcaagaaccgaacctcggtaaaacaaatctccgtgtctcacttgcttattcgcttgggatttgtttttgcgccctctctcgcggactcgtttatatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 1587 - DNA, 229 bp, Zea mays
gatacacaaattcttttatttagtctaactttcgattaggcatgatttctaaccatctcgttgtttttcttgcagtcagggtcacatggtggctaaccttgctccatcttcttggcgtatataatggcctacaagggcaaggcgacatccgacatcatcgacaacccagaggacggcccaaggcatacaacaaccccgtcgtccatagccgcctcgtgagtacaccacc

SEQ ID NO: 1588 - DNA, 1441 bp, Zea mays
ccttttactagtctttggatctgctaaaccctcgcctcactaggttgtcgctgttgccgaaggaaaactgtcatcaccacctccttgaatacgctacggctttgtttgggtactctaggaataagagggaatggagcggattgagatgtatcgtgagagtttttgacttattggggatttaaatactctctaatcccttcaaaccacttcaatccaagagtatccaaactaggtctacggaggcaccaaatctcaagatttaagaagttaaaccatgtctgtctcaagatttaagaagttattgtagagaactttgttgttgccagcaatgccatttaccacttagaaataaataccaagaacccctgtcagatcaggtccaggaccttaattaatcttcaatacacatttcccaccacaagaaacccatattaccattcatgtgacagaaatcctagtcaaatagaggccatattatgctgtgcaagagagaacaaaaaacaaagcagaaaaggcaagaaacacaaacctccttattagctataggcatatgctccacgccaccaaggaggcaccagcatttgtgctaatttttttgcttggttttccatgtgctcaaaactccaccgatctccaccggagctggcctttacatgcgtccacactagctatagttggctcgtattttctacgctcaaatcagtagcccggccttcccccttttttttttcctcaagccggtcccacgtcccgcgcgccgagcgcgtgccccgcgagctctgctgcctccatgcccatggtgcggtgcgagtgcgagtgagctagccggggacaggggcccaggcgatggagtcaaccagtcaaactccctcctacttacccgtgtacgctagccgatcgattaattagctgttaactaaaatataataatccccagtaattaatccaccatgcatccagtctgaaaaaaataattaatcgcctccgattaacccctgaacttttggctttaatagaagggggacgaaatgaaaagggataaactaatctccctggttgcggcgtgctcccccccaacatgctcctttcttcccacccaagtccaccagcctacctccctttctcctggccgggccggctcgctccgtccgtctgcgtctctcgtctatataagccagacccctcctctcccgccccgccccacctcatctcactcttcttcctcttccttcctggcctgccttctcttctcccgccttctcctcctcccagcacagcagcagctgtgaccacatcaccacacacacacacatatatacttggtcatcatccagcttccagcagccagctgcccgccgatcaacgtgtaggcggttcaaagggaaatctgctgatggacatggcgcacgagagatcagacgccagcagcgaggaggaggtg

SEQ ID NO: 1589 - DNA, 749 bp, Zea mays
ctgcaaatgaacaagatctccctagccatgcatccgtagggtagaccaagcaaattagtaatgcttggcggcggaggctagaggcgagaggctaaaacatcccaacaacagaggagagagggtttcattccaatgaaacttaggatacattgttttatagacaaaactgatgcatcacttttggaaaccgtgcaatgaaacttccattgagaacggccttaggacatgtacaaccctgagacaccagttcagttttctaagtataagagacgactaaaagactgcatggtacaatttctgagaccatggatcataaatatagctaagaattacagtatatataaagtcgtaaaaagacgagatcatgtctcttatattttttttacttagccccttaaagactattaaataagatggtataataacggtgcgaccgctcctatatattggattacgaccgcccacaggccagccggcaataactgctccaccaccaccactcgcatatatacttatatgcatataacaaacaaagaatccaacagcaggcatatatatattcgcgtatagacatacatacgtagctcaataaggactgcatgcacgcaaacgcagcagcagctaaagtcctattccggcaggaggggcagcacgcacaggcacagctagcagctgtctgctagcgcgcgagagaggagagcagcttggaaccgtacgtacgcggtgcgcccaccccaccggcggatgcc

SEQ ID NO: 1590 - DNA, 548 bp, Zea mays
ctgaagcagcaagcaagcccacgcacgcatcgaccgacgcggcgcgggccggggccattctggagaccgtgaaagcgacatttaccgttgatggatagcatccctacatgaccgaccgcactagaggccaaaaaaaaaagaaaggtggacccatctgccgaccacagaggcgaggagcgaaccaatgagctcctcgtcaccgcgtccagcaggcagcaggccgggtggggtgatggactgtgatgaatgcccgcgcatcccggccaagttccgcggggcgtcagatggggatgcatgcacagctcagcgcacccgatgctctctgcccacgcatcttggcaccccggacccccgcccgctccccgcctttataagcggcagcagccacggcaggtggagctcatcgcatccatccaccacgcaccccaccaacccatacccataccagaggctctctgattttacttctcagcggtagatcggctgagcgagcgagcgagcgaggcacacggagctagctaaacagagcacacggatagaaaagcaag

SEQ ID NO: 1591 - DNA, 1500 bp, Zea mays
attgcttgatcagttcagcgcttggaatgctcgcggttgaagtcctcttctttttctgctaattccatttttgagttgctcagttgcttttcgtgaaacatgaaaattggagtttgattgccgctgaatttgcttccgttatttttttaaaaaagttcttaattatttttgtggtccatagagtcggtacgtataactctgatgactaaaaaaagccatcgtcgaattgaatttttttaattgactcacattcgctatctgtctctgtctggtcatctccttcacatttcgaataaaacattctaactcgaaaggtgacagacgcacgttctaacccgaaagatgatgcgccccttgccggagcacatcgtcaaaaagcccctgaatccaagcgaaagtttagacgtttagtcattagcccatcaccaacaccgggccgcacggctctgagtctgttgctagcataatgtttcctaaacaaaagtgaatgcggaaaatagaagattgtgtataatgttcatattttcagcagaacacggatatagacgcacacaaaaaagacgtcagctatgctcgtacctcaaatacataggtttttttcagcttatagattatataatctaaattataatctaaattatataatttagattataatctatgaagattataatttatatgtagctatttggtagtccaaattatatatatacagattattgttatctgatacacaaaggctctgtttggcacagctgctgaaaaagcagcttatctgataagctggtgaaaagcacctttttcttgttggctgtttttactgtattctgataagcagctaaactgataagctgctgcagaagttagctgtttggttgaacttctgcttaaatttgtgaagaagctgaaaataagctgtgccaaacaggaccaaagataacaatatcttagtccgccgctaaggtacagctacgcgacggccgtgaacaggatgtgagccaccaatcccgttgtctgttcagacgagtagcagggagagaagaagtgttgtgcgtggtgttgtgcgatttggggagagaaagaataacgtatgagattatcataatctagcttctagattatataatctgattgtttattacgctaaattatataatctaggcagcaaacagccccatagtccatatttgcggaaaaaaatttactgcaacctagctgcaaaccagagagttgtgttattgacctgcaggtggggtctattctcctttttgtgaggggctgtaaacatcttggtttgtagccgggctgtagcaaatttttttcgcatctagtaaaaaaaattgaacccataaattactagtagtacgtagcagctctaccaatgaatctgccttgtacatgcacaatcacaagctggagaattgtgctgggaacatgtccatctcctggcggtgctaaaaaaactaaaaagtgtttcgttcaactccatcagccgtgaac

SEQ ID NO: 1592 - DNA, 361 bp, Zea mays
tatttatatagtttaattataaaactaattatatatacggatttattaaatctaattaagtctatatttactctttatttataaaaacttgggcgaaataatactccaatggagacgtgagccaagtccgaagcaaaccggatcgcagttgcccgttgtaattgtagcgccgcgtgccagctgcgactttgttgcaacaaggaactgaaacgggtttgacccccaccacaccactggccactagttgccaaccccacgcacgttctgcgacgagctaccccatttccccacccccagcaccccactccccgcttccatttccttggaccccaccaccgcgcctacatccctcagagctcag

SEQ ID NO: 1593 - DNA, 1079 bp, Zea mays
cgacctgcaggtgcaacaacacagttaaaacgttacctgataaacttatagatggggcctatcctcctttttgtgaggggctgcaaatattctgttttgcagcgggctgcacccaattttttttccggggggcagggggcgttcctatagccttcagcgtttggattgcggagaccctttctggaagagccgagtcttcgattatattggtagctgttgctgtaggatctgatggtcgagaaataagatagtgacgtggatggcttgaacatgcgccattgctccggcgtttaatatataatactccctccatttttttagttgtcgctggatagtttaattttgtattattcggcgacaactaaaacgaaatgaagggagtagatagaaaatagaaataaaaactgctttgtcatgcaggccggaaaagaaatgtcatggtttcatgtcttgtgtgtttgttcgagtttggagaacacaacaacaacaatgtatatgttcatcttgaagattgaagtttgctagctatatccatatccatgcattttttttcgaataataccatgcatggttgcctggaaactaaatacaagttcaagcgggggaaaaataagcgaaatggagggtttctgtgacgcatctcttccctgtgcgtttctctctccaaaacaaccatggcgtgacttgtagcaccgaaacagcaaggggcctgatgaggcgtcgcccagagtggcagagccctgctactagcggacaagcaacacgccaaaagttttaatgctagtaaccaacgggcacaacacgcgacacgaacacgagggggggcacacacactctctctctctctcctcccccactgcctttttaaccaacccccgcggcagcggcctccctccactcgatcgctctcacaatcactcaaccactgcctccagctccagcagcagctagctcagctcgatcgtcctcccgacccgatccatccaccccactccccgtgctccaccatctcggcatctcgctcgctcacttagctcgagctgcggcaaacagccggccggcagtccggcacacgggag

SEQ ID NO: 1594 - DNA, 524 bp, Zea mays
ccccgcgcgtcagttaccgcaggcgcgcggacgcagcgccggatgatccaaaaaaacaaaaacaaataaaaaaacccgcaggaaaacgcgagagagcacagcacaaggccgccggtcccttctccccaagttcttcccactactcgccgcttcctgctcggaccgccgcggcgactggccggagatccagccgccgggagcgcggaggtcggccggtagctgccgtttcctgctggtgagcgcggaggccgtccgggctcctgctggggaggggtggatggattcccttgttcaaggagttgtttccccccctctctctatctctttgttctgcgaaggaatccgaatctccctccgctccggctcggtttggtgcgcccagtggtgccttactgacctattcctctattcgggtggtttgattaggtggttgctgctggagatcggcggacggaagcagttggtgccacagggcttcgtgctgccgaatttcccagatattttgggggttcggttgaaccccc

SEQ ID NO: 1595 - DNA, 1390 bp, Zea mays
tgtgggattggaacaggcccttatatggacaaactcaagcatagctgtattgaccgacaaaaaaaatggcctccattatgaaatatcaagaagaaattgttttggttggaattgatttttttttttgcgcttagaaacttcctttgatagttcagaccagttatgataaatcgatatttctcaaccatctaaggaaggctaaatatatatacagaaagaaggtaatctctcctgtcatttttcagaaatttttccctgcgttttgcttagcatgcaattattgcacataagccatacaattcttcaatcatatcttctactgtctatgcctctcgcgccaccgaaaagccaaacggctctttatctatccacgcccgtgttcccatatttcgtagactgggtccatacaccagcgtgacactactcttatgttagacgcttcacttgtgtgctctgttcatccgcttcaccgatcaatcgctggaagacagcttttttactctaaatttcagcggtctaaacgaagaggatgtgggtagcacaccgaaggcgcatattcgttacgaagacttctatgacaaattttaacatatgctactaatgtttatgctggtattatcatggattaacctataaatttttcatcatagagtaaactatgaaatgttggtgaccagtattcttgttaagatgtatttagcggatcttgtatatgatcgataacattttttatagtgtgactgttaaaatagagagattagatataagatgagatagccttacccctcattttaagagtgcacatccgacttctctaaaaatcaatcagtataaagtttatgatgttggataagtattattatattaattatataataccaatgtttttcatagtaaataaagatacatataatgatattattttctattaaatatagtttaagttaaaattgaatgaattttcaaaaagtaattttaggaggagtatacagtatacattgtatcataatagcaaaaatttcttgtgacacgaaggggctcctacgaagtgacaaaggctgrccactggtggaaagtgcttccacccagagtatacacatgaatgtgtgtttagcagttggaagtctaaatctcttaatctacttctagtgtgtgtaaaggacgcacacgagtgtgtgcgcgcttattgtgagttcgtgtcatgcttaaaaattccttgtgtcggtgtatgtagacctgacctagcgaacctcagaacatgtgtgtccagtgtccacttgagaagagaacataataaccaccccctctgctgtcatctccccacggttggtccacctcctcctgctcctctggcctctgcggtgcctcctcccggtcccgagtcccggcc

SEQ ID NO: 1596 - DNA, 1500 bp, Zea mays
ctatctatctatctaactctctatctctctgtctatctatctgtctatctatctatctatctatgtctgtctgtctactatattaaaacatcagtttcgatggtcgtcccgcgtcatatttttacaaataaccccttttattgtttgaaatggcccacaagacatattttcttcacatcgatcgtatctaatccaattcatctatccactccctgtccttagcgaatccacgccccgcacgtcgcgcgagcgtcttagtcacccacacaatgacacaaacccacgcgtgccatgtcttccgttcatagcaaagaccggcatggcaagtgggtctacgccaaatgtaccgcgactggagcccaacaacccatgcacgccgctccgtaggggacggggaaaatggtttcagcaaccccaaacatgtcgcgtcttccatgcatagaaacgtgggaaaagcggttcagcagctgcgggggtggagccgttttactcatcctaatttgcacaccaacctggctacaaaaagctgtactgagacccctcaagcgatagcggtggtggatatgctcgccgccgatggcctgacgctctccatctactccaactcgcctacgtcctccaaggtacacatgtacgtacgtctgatttttttggctcactgactccacgagcatcttcataggcctgtccaccgagttcgtgttgcgtttgtgggacctaatggagactgacgctgtcgggatggagggcatcaacggttaggcacgggacacacggagggcatcggtggcaaatcaccaaccttaggcatgatgacgggcattggcgataaggcgccaacattcgacatgatggagggcattggtggcagcgtcacttttggcatgacggcgggtactacagccagcataggggtcaatgcggcggtgttcggcaccacatggatctgtggcacgtcgcccaccatgggaaccgtcagtatggcgagcattagtggaagggtggccacgagcacgatcgcgcgacttcagcacaataggaatgcccgggacgacgacaggagcgatggggcacgggagcatgagcaagatgttgcatggaatgacacatagtgctgccgtcgccgatgagcatgatgagcgccatcgtcacgagcgctgtggcagagaagagagacgaggtgtcacaagtcattgctagtggctaggagaagtgcttcctcaggagtgaggagctacaaggctgtcacgtgcttgcgaagggtccttggcgagcataggtcccgtgcagacgcccaccacgatccggtctctccccaaatccgcggaggcctgccgcccaccaattccccggtaccccgaagaaagcaagattcaatcgcaattgacaggaggaacaaaaatctacgtgcctatttccccccctaagaaagcaccttgagaaggcggcggtggccgtcgtggaggcggtcaaaagtgccgccgaggaccaccgaaccgt

SEQ ID NO: 1597 - DNA, 292 bp, Zea mays
gacatagcacattgattttgatttcactaacatttcataaaccaagtttgtgttatttagttttaatttttataggtattcacccctttaggtgctctcataaatactattctatggttttgcaatagaactgtaaaaatacgtggctaccaatactcgaacagggcctaatgtgtaggcatggcactaggttggatttgggcctaaacaggctttggtgggacatccacatccttgtccgcggcgaaacaaaatttcccacagcgagcgaggttcccctcccgactcggtg

SEQ ID NO: 1598 - DNA, 270 bp, Zea mays
ctgtgaatgttctactttgcgatgaagtaataaaaataatgtagttactctacagtaacttatcataaaaaaaaggtatcgcgttgcttgcggcgccgcataccgcgggcccgtcgattcgcttcgtctccgctgctttgcacttgcgctgtactcctacttaaacttccaattccagtcctttaaaaaaacttccaattccagtcctttaaaaaaacttccaatttcagtttcggaggagttggttcttggatcgaggcgccgggagcc

SEQ ID NO: 1599 - DNA, 1500 bp, Zea mays
ggtagcgatagatgacggcaagcgacacccattgtcgtgttgcaacgacgcggtgagactctaatgagttagcgagggacatatgacaccacggtcccaccaacaacttgctcatctgctggtgcggactaggaggcaaaatatcaacgttgtctgcaggatcccgacgagtcgacgagctgataagtgatgagaaggtaaggtgcgctgcaacgggcgggttaggtcaccgacttactggtcagtcgatgaccgaagaccgaagaagtgagtgagccacgactgggcttgcgctagggaagagaatcaaatggctcagataaagagtggactgagtagtgaagcgtcgatagaaaaatagatcaaaacctagttttaattagatttgtccacgctaactatacaaaaagtttgtttattttggtgtgtacctaaacctaggtataaggggttaaaaaattgaggtggggccatggcccaccttgcccaccccttggatccgcccttgagccggaggactggcaaactgtttggccattagccatttaaccttactaataggtgctaatagatcgtgtaaagagaaaagacatctattagtcaacacttcaaacatatcctagctaattgttgctagctaattatttatcggctaattgttagccactagcaaacaattagcctcgaggaaycaaacagagcattattttgataagcaaattgtrtgtgctagtgcaagtgcaactagtattatttattgtgcaactcgaattaatataatttaaggaaaacacaacaaatttcgccgagaaaacgtgattcgggtttttagatttgaaaatatattccggtggtgaaattcgaatttcgccttatttccgttttcgctgtccaatgcaaaatttaaaaaatccgacatggtaaacctgactgtgagctctgtgacacatgagtcagcgctgtagcctctcgcctttcacgtacgcagaggccgcctggcgcggtccaccaaccgtccgtcgcatcgccgtcgccgtcttcgtctcgggcctctcggcgctcacctcaccttccgcctccgccatagaccacctactgataataataatctctctcacggcgagtcggcgaatgagcgaaaggaaaaaatgctgaccggaaaagtccaaggcaagatgaccaggacgggggcggacgccggacgcgccaccgcggcgtgtgtatataaaatgcccctcctctgctcctccccagtctccacttcccccaaaccccggccgaccaaccccaaccacggacccggactggctgtccgcctatcacccgccactattgctcttgcagcctgcttctctccccccttctcgccgcgtacgcacgggtcgcacgcacgcacaccccgttcgtgccacactgccacctaacccccctcccccacgatcccgaggctactagcactaggcgtcgtcctcggcagcaacggcggctgggctcccgccg

SEQ ID NO: 1600 - DNA, 1500 bp, Zea mays
gtcactctaggttagggcatgtttggttacggggactaaaagtattcagaacgtattaaatgattcgtaagaaaactaaaatgccccttaacattctccagctactagtgtaactgaaataaatgagtgacaaaaagtgaaattaatagtttcttgtagtcatcccttgagggaatatatactaaatcagtttagtctctgttttagtctcattgtttagctatttagtaactaaataacattaaaatggaaggactaatgtttagtcactcaaactaaaagaagccttactccagaggttcttgttcttgttggacgcagcggtttattagacttgggactgtacttgaaaccgacatgattcctcaggctttcactccaaacggttaatcagaactggcaattgcatttttttttaaattggctcgcactccaaatacaatagtactagtagttatgcaacagaccaggtgagagcgaaacggtgcagaagatggcgaccccgacgtcgcagatgatcggcgggaagattcttcttatcaggatgtatgtgctcatcggaatcgatcgattcactgatgaatggagagaaatgcagcagctgagcagcagcagcaaaagcaacgcagaatcgatacagtagtgaagggccatccatgaccacggtttccaaagcaaagagcacaagactacaagcccggccatcaccactactgtactcgctcgtctcagcaggacagaaacggaatcgttcatttgcaagggaatcgcacaggcagcgtcgcgtcgggctcacgcgcacgcgcttgtctttgtctctacgccctccggtgggtgggtgggtgggtgaatgaatgagaaattctgcagagacaacggacaagaatcaaatttcctcataatgaaaagacgcataaataaataatggtaatgtaatgtactgcatataaggaaatttggcattcgtgtcggccaaaaggagattctgcgcgtcatcaggcattgcgtgctctctgcttctctgaaaacaagaaaataaagaagtcaaaaacgtgtttttcagacttttttttttgagacggttcgtactgggttctacttttatctttatgaattacagccgcatctactaacccatcacgctagctagagacatgcatggctcactgcaccaaatctgccagtacactcgtacccagccagatatcaaacggctatattatcatcaagacctgccaaagttgccaaattacagcacggctactagtggagacgagagaagcgtttcagccgtagtacacgtacaccgtcaccgggtgagtcatcatccaggtagccgttggcgttgggtggtggcctggtgggcgccgctcgctagtagagtagagcctactagccttttgtcctataaaacgcggcggcgggggcagcgcctcttcctcgcaccaccaccgtcactcaacacagcacaggcagctcgagagagagagagagagaaag

SEQ ID NO: 1601 - DNA, 345 bp, Zea mays
ggttagagctccaccttccgcgctcccgccctcgccgttcttccgccctccctcctggcctgcaccagcctcacgtccctgacacttcggctcgaccgctacgcacttccgctcccttctttcaccacattcacccgcctatcccgcctccacatcgcttgtgtctcgctcaatgcggaggatgacttcttcggggacctcttcttgcactgcaaagaggtccgctacctgattcttgaaaaatgccgcgtcggtgctcttcgccttaccggtccgtcgcggctttgctcgctcgccatcacggactgttcttggacggaggagtcggctcttgctgtttttgag

SEQ ID NO: 1602 - DNA, 102 bp, Zea mays
tgggctcggtctcgcgaggctagggtttggtcggtcgtctcgccggcgtcgaggccgccagcgctgctagctagctctctcgcgttagggttccccgtagcc

SEQ ID NO: 1603 - DNA, 64 bp, Zea mays
attttgcatcatatgtagcccagatacactaaagagctagctgactgggatctcagtgtcaagc

SEQ ID NO: 1604 - DNA, 1399 bp, Zea mays
catcccattcaatccatgtataatggggaataaccgaacaagggctaaaatggaacgatgctatatttattctatgcaatatccagacgacattttcgcatctgggcgaacatgaaattcgtgatggcagggtaccatctgaataagaaaccacatactacactactatattattcatggcgtctgaataagaaaccatgtatactacttacttaatatcaaaattgagtgtaacttgtagtctggtggattagggttaaaatggacagatttgaaaacgaaaacttaagtttgaattatgatcatatatcacgtcaatcactcaatcagtacattctaataaggtcacgtatgccttgtcatgctgtaacttgctggcgactgcacgtgcacggcatgcctaactgctgatgcgcagcgcctaggacgaagctagaatcataaatagtatttatagctgcatcagtttaaacaactagtttaaagtcgcagtgaacataatcatgagcagcaagtatcaacacactgtaccctgctcctgtcgggcggtgcgaagtgcgagcatccggcataaggttcgtagaataataatgaactcgctcagtcgctcttggtcttggatttgaacatgcacatccatatccattctttgatttggttcgatacgaggcataaaattctttctaggcgcacgttcattcttcgctttggttgttggttcgagtcaaaaataaaccttcctttttttttaccagcaccaggagcctgcaaagtttgaacgaacgagcaagcatgcatgcggatgaatccaattccgggcatccttccagatgcatgaggttgaggagatgctgctgtccggcgaggcgagttatatcgactggtctgttgcaacggtgaccgagttatatcgacggagtgatgcatggatcgacgaagcgaacagccagcttccaggaacgctgcatggcctcttactaggctgctttggcaactggtctcttgcaattgtttgagcaacacctaagtctgaatgtctgatcatggtcatattgctgatgtcaaatagacagatgcttcagttccgtaacccatccttctccgcagcaatctggttggtccagaaaccgtttccgaagccaggacgctattcggcccagaactattccgcccacaacccacaaacaggccagccgtagtgtcccagccccaaatacacagcctaggcccacctattcggacacaccagaaaagagagagagagaggaaaagaacccaacacgctctctcgcgcggcaagagcttcccggcccgaaaccgaaagcaccaccaccaccaccaccaatctctgcgtttttcgtctgcggcggcggcggcagcagcggaggaggtagacgag

SEQ ID NO: 1605 - DNA, 90 bp, Zea mays
agtcccatccttttttactgttatagtgttatgataatcatgatgctgtgcatggtttcatgataacatccatgtgcatatattcaggtt

SEQ ID NO: 1606 - DNA, 1500 bp, Zea mays
aagacatatatataaagttaaaatgccataagataccgaagtttggagtccctccagtcctattatgatggatgagaaaagaacaatttcatcgatgagaaatgaacgtttcagtttcagcattacactgattgtgatcgaatcacaattgtattggtggtaactgaaatggtctcctatcaccaccctttgagtgccagtctggccccatggactgtcatgagtcgagccagccaactcgcagctcctacctcgcctcaccgtattccatgtacggaaacacgaagccttcctacacctctagagttacgcgtattccatttacggaaacacgaagccttcctacacctagagttaggaaatgagtcgtctcaactcgtaccatttccatattttgacccatctattcaggggtgaagccagaattcaaaattaggaggaccaaattagattagggggctattagaagcatttttacactatttacataaaaattagctaaaaacctaagatatcctgtagaattaggggagcattaggggagacattgcccctctgccgtcgcccctgcatatattttcgtatttagaaaaaaaatcaaaaataagatgaacatgggaagatgatctatctcatccatttttgtacaatccctttttattcggcttgagcccgtatttattctatatataaaaaatccagaatcggcccagtatgtactagtgcaatagctaaagtctcatatacttacgtcacaaattataatatgagatattattcctagccatgggtctccctcgatgacaaagtgcctaaaaactcaaacaacaatcagtccatagtaatatatacatcactaacaagtaaaacaacggataaaaaatattacctctttgtatctatattatttcacgttattatcttgttagtcagtcaccgtttagccatcaataaaatgcatatttacattaaagtataagttttcgcttaatagttcagttcccgttcattttctataccgtttattccttttagttttcgcttttgactattctaaatccgatcctttttagtcataaaatatggaaataaaaactggagagaggttttaacagccgttttcgtcgctagcacctagccttgtggcgttgttgatccctacatcagagatcagacgcacatacctgggcacctggcttcgcgatccagtcgattggtattacccgcctacgtgcaccgggcacaagggagcggtcgctgtggacctgggacgccgcggtgccccgtgcccccagacccttctctccctctcgcacgacctcagaggctcaracaagcgcgaaccccgcgaagctgccaagccgcgactgcccctcgacctgcccgcttcctccgacgcctagggttttctaccggacgccgccgccgccgcagccgcggccggggatgcaggtggccctgcgcagttagccgcttttggatccaccgccgccgcgcgcc

SEQ ID NO: 1607 - DNA, 1181 bp, Zea mays
aatttggtagctagacaatgatagctagaaaatgttttatttgttaagatgagctctattaaatggttatagttgtattgatgcggatatattttacccatggatagacgagtatgagtagtaccaatctataccagtctgcctcaataggtaaatactcttgcctattaacatatccgcaattagagaaatcacctcgtacccgctttcatatcgaatattcggtgcgcattaccagctgtggttggacctcatcttctcacacgggaagatttgtatggactgcactgtgctcattctagttgggccatcctttcatatattgcttttctggttggattcctgcaggccctctttgctagaccgggctgaatagccgttttgcaggtccaaagcgcccaaacggttaatcccgatgaggtgaaatcaattggcgagttttctaatttttttctcttctctgttttccttcaccggactaccaggggcgaatcgcggacgccgcccacctcccccatctccttccccagcacgtcgcaaacccttcgtcgccacccccgcctcccgccgcggctcccgtcgtcgcgtggccgtcgcgagccaccgctggcgtctctcgtccggttctctgagtctcggcgacctgttcctccgccgagttctcggggccctgctgtcgccaccgccgaatcctgctgtcctcgccgcagccggggaacgcggtgtgttgcgggagctggcaccgcctccttcgaggtgcgtcgtcacggagggtagtttccgtttcgtctccatctccccaaggatcggtcatggtcatgctcagcttcgttgggatttctaagaccgttgagcattctgccgagcctatggtcccaatccataaccgaaatcgcttcatggatcctaatgggcgcgtcgaacatctcggggtttctattttcactggcacaattttattgcacgttgaaacatatagttagggttttatgacaaatgtatttaatggccatggtatccgtacgaaaatggcactacattttgtacagttttgcatgcttaccatatgctgtgccctcttgaaattttggtgtagctagaccaggagagagagtcgcactgtgatttcatgcatgtaattaaaatggactttaattgcatggtacaagccaaaatgtggt

SEQ ID NO: 1608 - DNA, 300 bp, Zea mays
cagactctgaccctacgatctctccttggcgtgcacggtcttcaggatttgagcttatgcttgatatatcctagatattagatctgcgcgaaacgtctcaatatatacttcagtgttctttatagagagacttcgcttacccattcggtacagcacacaattcgaatgcggatgtaatgaccagttcgttaatatggtactttttctgttcatttagctgtaaaattccgaaagtggtgacattgccaatgcttttgatcctgttggaagtgccccttgaatccttgatctattattgcc

SEQ ID NO: 1609 - DNA, 1386 bp, Zea mays
taatccgttgttctgttgtcctgtactgttcataagtttgaatatatttgtaggtgttagtgctatactctaaaggcaacccagataattacttctcatcaagggctagttgatactgtgttatttaatctcttcagttttaagtttttaaaaagagttagaaaaaatgggagcaggtgataaagcacaattcctcccatggaagacagaaacggaacacttaagtcacggtgaatcgagtgttggaactatccaagaacaagatttgagctgaacgtggcaccaagtcaccaacatcatctttaaggcattgagaacgagatttgagctaaatttggcactaacatcgtcgttaaggcattgagaattatgcttgcgagttcagtatacagtagaccacattgcacagtaccactaaatattttggatgaattgcgcactgtggtatacaacactgtgctgtcctgttttcctggagttggaaataagaatggaaaacatttacttaaggggtgtttggatggactaaactaaacatgaactaattatggtctaacaaaaactattagaggctaattgatgagtagaattcattagaaaaaaaagaaatatttaattagtccatgtttaacctattatccaaggacggactactagcatgtttgcttcttttccagagttagctacacccaggttttggcggcacccaaagtgtggccctctttcttgacgccagaattttggcaagaaacagcatcaaatgaactaaaggaacagctgaacaagtttggcacaccgaaaatctggctggaaagcaaacggctgcctaagtaactcgggcgtgctgaacttgcggcatggccacctgtggacaacatccaaacaggccctaaactttagtctggtgatccaaacaggggcgttatgattggcggacttgcttcaagttcacagcagtgtgtagttcgttgtaacctaaataatttgcacgtctgtcagtggtgtttgtttgaggacttaggccttgtttgtttaccctctagattatataattcagcttaaataagttaatggacaaacaaacaacacagattattagatggattatataatctagatacctagattataataatccataagcaggtcgttaggtgcttatataattcataagctagattatataatcttggaaggaaacaaacagggccttaatattctacatgtgatattttccaactagaacaaatcattttgtaccatgttcaacgtttctgatactcacatctgacacacctttttttgttccttcagatccgtgcactagagaagaggcagaaggcaggcaaatatgccaagaaggtgaaggccaaggtgaggaggaag

SEQ ID NO: 1610 - DNA, 484 bp, Zea mays
tggctcgtgctgtggctggcgttggagccgcgtggatggagccgggtgaggttgtgaggaaatgggagatcggaggtggcgcggcggtcggcggaggcggactcgagcggtcgggccgtgtggtgtcggagagccgcctgcacaaagtgtcaaagagcccactaagggccccggctcctcttccacttcgcggttggatttgggctgtatggcgcagtggccacgattccaaataggctttttacgggtattttattccacatggactctttgctccatccaaattctacatgggcctggccgtcttcagttcttcacccttcaccaccagaagcttctaggaagtaggaactcgaacggccggcagcattccgacgagacgagtcacgaatccggatagagcgccgccccccaacctgctgcgccgaccctgctcgccgccggcccgagtagagagagagagagagagaggagagaaggaagc

SEQ ID NO: 1611 - DNA, 615 bp, Zea mays
tgtgagtccgttttccgcttcggaatgccctctgtcggtttagggtcagagtcgaactttgatgcaaccttcatcttcaatctgctgttggatgacgtggccgattcatagtttgtcagaggttttgttcaataaatggcgtgacgtttgtaattttgcagtttatcatagtatgggattgcgaagttggattcataaaattggagatgaaaaatcaattgttttggtcttttagcaatcatatcatctgttgtagtcctttgacatttcaccagacttcagtttattccagttgcaattatctttgcgtgatagcaatgctccatatgcctagatgtttttttttcctaaacctttatagtatatcggaactatgtacttataacctttcttacaaaccattctggtagccatttttatcccatctatgtatgcagagcagcagaggctaaatcgtttttcacgaagtgtgacccgtgcccaatgaatttggttaacctcttggcgccgggaggaggttgcttcgcggcctaactactactcctcgggaccggcggccgtttcatccgtttctctctggcgactgcctagagtcctcttcccggaggaggaatc

SEQ ID NO: 1612 - DNA, 713 bp, Zea mays
ccgacacttttcggactaacgtctggtgaggtgtctctcggtttgcagctactctggatgaacttcattctccgcttgcgtgctctcttcgtgtatgtatctagtggtatactacctatatcgcctccagatgtccatgtcttcgtcgtgtccttctccggcaacgaacaagtatgattgcctcttccaatctacaaaaccttgaaagtgggggaggcgagggatgaggtccctgatttgctgcctatggtacccattcgatagctcgacattgtctgtttacatgacctttcctttaccacgatgtcgactcgcttagtcaaataaaaaaattatgtggagagaagagacaatcaataaaaaactttgacaattaataaaaaactttgagatctttttgatggatactttatgtggttattattgtgagccgtcgcaaggtagggtaacccgctagtatccatcgagaatgacttcattctgagtgaaaccattctccgttcaacgtgtactggtctggtctaccccgggcccggtccgcaccccgccgccgcacccgcacggccccccttcgtcccttccgcaagaaaggaaacgagagagaaaatcgagtgaaaaggaagggaaacaacataacaaatcgcaaagaggcgtcttccaagcttgtagggttaccggatcggaggagcatccccgcctaggtcaccacagcc

SEQ ID NO: 1613 - DNA, 1500 bp, Zea mays
cactgatgggcaacctgttcatcactatgcccgccttgtgtacgttgtcgctgtccacgctgttcgcgctacacttgtccattcacgctgcatttgtccatccctatcggtgggatgaggtagtcgaactgcgcaagtgcgaaaagtaggaaaaaagaataaccatggtggatgagcaagatgagtaagaaaatgatggacaacctctttcctcggccaaacaccctattgttgcatttaaggggaacatgttatataaataatgaaagggaaatagagtttaacctttttcctataaataattttggtggttgaatgcccaacacaaatattggactaactagtttgctctagattatatattctacatgtgcataaaggttcaacacaaaccaataaaagatcaaagttagggatcaaatgcaaaggagcaaaagaatcgagggtgccctagtctggcgcaccggactgtctggtgtgccaccggacagtgtccggtgcaccaggaccgtacaagtccaaacttgccaccctcgggtttttccagcgccgcaccgctataattcaccggactgtccagtgcaccagcggagcaacgactaccagtgcaacggtcgaacgcaacggacacctgcaaacgctacagtgcgtgcacagtgcgcgcagccatcagaggcgcatcgggcagtgaacagtacttgtccggtgcggcaccggactgttcggtgccactagaaaacaaaacctccaatggtcgtctgcgcccgaaccctaacggttgggtgacgtggctggcgcatcggacagcgtctggtggcgcaccggactgtccgatgcgcccatcgacaacagcccctccccaacggttgtttggtggttgagggctataaaccacctccactccaaccatccaagcattccatacattgcattcaatacaagagcaatagacttcactccaagacacaaatcaaagcaatcgatccactcgaagtcccaaattcaactctagcgcattagggcttgtgagaggatcacttgtgtttcttgttgctcttgtttgcttggttggctttcttttcttttcatttgttactctcaagtgctttgtaagcaaggcaagagacaccaattgtgtggtggtccttgcagggtctaagtgacccgtgagaagtaagaagaaagctcattcggtctaagtgaccgtttgagagagggaaagggttgaaagagacccgatctttgtgaccacctcaacgaggactaggttctttagaactgaacctcggtaaaacaaatcaccgtgttcatccactttatttttttggttgatttgtttttccctatctttcgaactcgaatttaattctaacgctatccccggcttgtagtgtgcgcttaagtttataattttcagattccgcctattcacccccctctaggcgactttcaattggtatcagagcctggcggttcattagagtctaacaactcgaagtg

SEQ ID NO: 1614 - DNA, 1500 bp, Zea mays
cactactctagaaacctaatactatggttgactaaactaggatacgtcaaactaatgccaatgtcaatgccccacgagtaagattgacatagacaatactgtttatggagtgaattttaaaataggagctatgatgagtaagggtgatggagataatctaatgaagccatgcaaattgccttctatcctatatttagagaagatttccttttgtatacgctcgaacggtgtactttaaagcgttctttcaatatagagaatgtttctacatcctctctatgtatagagactttctctcctcttatctatctattttttatactttagataatagattaataaaaacttaaatatatataagatagatgagagcgtgacaaatacatacatataaaaatctagagtaaaataaatctctaatatatggttttaatgtgtaaatggtgatatatagaaaatattgttggagaaaattagatgtagaggagagaatcattttaaagaatttgtaaaagagagatatagatgggtaatttagagaatatggttgaagatctaagcacgtcggccgatggaatcgacgacacaacaccacacgctatctatggatgttcattcaaaccggcgctatgtatggcttgacattgacagatgaacaaagccaatgacgagacatgtataatggccatgtttggcacattttattcagagcttctctatagatttaggccactttgtagcaaattttcagtttatctatttctcagaataaactaaaagcatataataaacaaaagatactttttactagtttctcatataagctacttagttgtgccattatcgtgtaaatccttttgttttcattgcacaatcctccttattttgtcttgatggggattctcatgatgtatattttataccaatgttgcatacaggcagcctcgtacaatagcaaatataagaatttttttctccagttgcaacataccgataatctagattatattaaattttgatctgacgaaggagttgtttggttttattttattttctaaattatcaaatacgaaaagtaagaaatgaagaaatacataggccctgtttggcacagctgctgcttgttgaaaaagcagcttatctgataagctggtgaaaagcagcttctgcttgttggctgcttttagtgtattctgagaagcagctgaactgataagctgctgtagaagctagctgtttggcagaacttctgcttaaatttgtgaagaagctgaaaataagctgtgccaaacagggccataagacgtagaagatacagcgagaagagaccgtaaaagacccgtaaaaaccggttcaggaaaagggtacgtaaggcagccgcccccaccatcaccacgctcctccgcctcgcctcgcctcgcccatcgttccatgtctctctcctccgccggccaccaccccctcccggcccgaccaaccccgaaccccacttccaattag

SEQ ID NO: 1615 - DNA, 272 bp, Zea mays
cgcatccagtggacctcgccgctctgggrtccaggcaggtgaggccagcgcgaatccgccgtcctggtttccacggccgcaccgcaccctacctctcgtcgtcttgccgccgatcctttttccgaaacctagctcgcccgcccgacctccgaccttctagaaccttgcctccgaggtgccgccctccccgccccgcctgcgccgcttgctcatcgcttctctccccgcggcggcctcccagatccggttggatcgaggggcaaggtcaagag

SEQ ID NO: 1616 - DNA, 933 bp, Zea mays
aaaagtctaaattactactctcacttatggataatgttcatgtaacctctaaagtatttttagttcattttatctatcctttcctttttagatggttcaatttaccccttaacaattttttatttctttatgtacaaactgagtttttagttcaaattttgttagcatagctaatagcataatttagccttaaaatatattataattttttataattattttgatagattagatatcggataataattttaatgatatagaactaaatataaaataatgatgaaaaattgttagaatattttctaacataaattacgatgtccttagtcaccttaaaaatatgaacataaaattcaacttgtatctatgaacataaaattcaacttgtatctagacaaacaaaaaagacaaatctcttcctaataaaatttgactttttcgtttttttcatttacaagttgaatttgaagttcatatcttctaaggttattgaggttatcacaatttgatatttagttttgtactattaaaattatcttagttgatttctaacctatcaaaataattttaagttatattattatatagatttacatgttacttttctaatatacaatttatagtacatttttctatttgattctctataacgtaaatttaatgtataattatcttaatcaaatgatttaaaataatatataaatatattacatagataaatatattaatttaattaattttatctaaattataattattagaatgaaattcgatttcaacaaaacaaactgaccgtagtggttttataaacatcgtggaagggagtaatttgcttcgtccaaaaaaaaaaaatctccaactcgtcacttcgcttccccacttctccattccattgcggttctgcgagcccctacctccctgtggtgctcggcc

SEQ ID NO: 1617 - DNA, 114 bp, Zea mays
ggtattgatttcttagttcatccttatatttatttgcagttatgtcatgaaaacgtgttatatggatggttctataatttgagtgagtaatggaaactgtaggaaaatgctctc

SEQ ID NO: 1618 - DNA, 75 bp, Zea mays
ggtgacgtggaggaggccagcaagctccggtcggcgctcgaatcctggggcctcttcaaggtgaccggccacggc

SEQ ID NO: 1619 - DNA, 1032 bp, Zea mays
ctgccgttctttatcgagtgctacattcggtaaagcttgttttgtcgagtgtccgataaatagctcttggtaaagagcttgacactcgtcaaagagctggattctggtagtgtaacaattccctattcaattcaattcaacgtttgatagatatccaagaaactagaagasgtaattgcacgctttcatgctaggtctgcttgcacgttagtcgatgccataataatcattgctagctcaagtagctatccacgggacgggtatcactaccgcgcgccggttatactacaagttactaattggatcactgtcgctttacccagccggtagtgatcttaaccttatccctgtcgaattagtagaaccggcgcagcagtgatatgtaaccattattgtcgggtcgttagaggaatcaacagtggtaggcaagagcctcatgccacatgccgactgccaccggcttgttttttcagcagtgacgagaggttgtgccaacttattttacagcagtgaccagggattaagaccgcagtgattgctactcgttaaaaatctgtgaatatgcaaaattactccggtgattataaaatatttaacccatgcataggaaatgagagatggctgcgcctgcgcatgcgcatgcgcagggagacgtccacgtcaaccccaactacctgcacgctctagctaggcaaaacatgctgcccttctatcatatcgccactataaaacgaagggcgggcatataggtatggttctggctggtcatatctatctctgctggtcagcatcggatcgagggcatatatacaggtatcaccatcttcaattcgtttcgtgaactgctagactgaaatggttgaggcgtgcttatatatatatcgccttgatcttgctgcgagagtgcgatcgagcaagtcgtgcgtgagtcgcgcgtgtttcttgctgctcaccgtatcatccagttagttagattacttgtttatttgcgatgcaaataacaggatgcaaagggggcaagagcagcgggcg

SEQ ID NO: 1620 - DNA, 526 bp, Zea mays
gatccccctggtgcaagaaactactgcttcttcttcctgggccggggccacccccacgataaaaaaacagactacctaccttttgaagcagttttctaggtaaagctaggttattttaaagggattatttaacaaaaataacgtaactaagatggggaaataaaggagaaaactgcaaaaaaactactctttttttatttctttgtacaagcatttaaaaagaaaaaaacatctatagagctattttaaaaagtatgtagagaaaaaaaacagtttacaataactcatgacgttgtaaataaagccgtgccaaatacggcctaattcgaaacgccgaaagcgaccccatcttccccgttcaaagcaaccggtcctcctcccttttcctcattccaagcgtccaaaccccccatacaaccaactcgcaactcctcgcgcggttcctcgatcgaagtctccagacgcccagcgtcgatcgcgacgacgtacgccaagccgcagcaaagctccggcggtgtgcggtgag

SEQ ID NO: 1621 - DNA, 335 bp, Zea mays
cggggactaggttctttggaacggaactcgggtaaaacaaatcaccgtgttcactgcatgatttcttcgctgatttgtttgcccttctttcctctctctaaagttttcttgctaatattgatttgagttgcaccccaaccgtcatccacattaattgagcaactcatagcaagagaaacaatcttccacacttgaatttaattctaacgctaaccccgaccttagtgtgtgtttaagtttataaaattcaggtttcacctattcacccctctctaggcgactatcaattggtatcaaagtcagtggttcattaagagtctaacaaactcgaagtg

SEQ ID NO: 1622 - DNA, 1500 bp, Zea mays
ttccaacagtacgagccaatcactatgctactagctagcagctagcaacaacacaaaacctcatgttgtccttttatcgatgtcacagtgtgcacatttgatagcaagaggcgttcggcccgcaacacctttcgttttacccgccgctaccctagaatatctggcagtgaaaaacttggtaaaaatgccctccagtagtacaatcatagaatgcatggctatacatgtggcgttagaaatgttgttagttagtgtttccaaacactccatcttttaccgcgcaaacgtgcgagatatatagttgcaacaatataataatataacacgttaaaaatatataattctggtcttgtttttgccaaacttaacttcatcttgatttattgtacgacaaaagcaacccatcgtccaaaccagtgctagaaatatgggccacgttttttaggctagcacgagcaccattcaaaaatagaaacttaaagcatgctccagcatgaaataatatgagtcaagctaatacagtccaaagacgagcctcaaattccaacccgtcggacctaaaatttcgtcccgtcgccgtcgccctgggacggctcgcacgtatgggctgggcttgggttggcacggtctaataaagcttattgtttttttagtttagtaagctatagagtttatatgtttgtaatatttagattttatgtggttaaatgatgctcgcattgtttaatatctttaattagtaagatatgaactttatgtgattgcaatatttggattttatatggtttaaatatatggatcggacattgaccgacgcaggccaacaaagacaggacatgttttaggatcggactagaccactgtttctactctttaggctcgcacgacacgacctaaaattttttagaccttcttagtccaaacccgtttggaacgaaccacaaagtggacccggccaattcccatcactagtccaaacacacaatccaggacatacgacatacactacacacacagagtcacagacagaccagcgctctgcatggccatcattctggtgaccacgcaaaaaggaccagccattcccgggcaaagatggtttcagaagccagcgagcttggcattggcacacactatacacactggtcgctgatatttcgattccccacgtgcgacacggcatctacccgtcgaggaactccacatctctccatgaagctcgctatatatgcatgtgagcttggcattggcacaccacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagca

SEQ ID NO: 1623 - DNA, 328 bp, Zea mays
ctaaaccaacactaaggggaaataaatcgattcctctcctaatcccctttaacccgtgatcgttggtcatcaaatcagcctttgcctttgaggttattttgacgtgcatgatctcattcatacttttactaggccaaacaacgttgcaacttgtagcaccctagaaagtagaaaccaagcgggcgcatatggttgcattcaatgcagtaatggccacacgacacgaccgacaaggccgtcctacattacgaattagcttagctagatctacaaggcagtgcatacggtatatgcaatgcatgcacacgagcacgggtggtggagctag

SEQ ID NO: 1624 - DNA, 828 bp, Zea mays
ctgactccgtgcacgcaccggtagaatataccgtgcggatttgaggcaactggaaagaccagtcggcgagtcgaggagcagacgccgttaggttaccggaattaccgggcaggcgggcacgctgtttcatctcacctttccggtcgcaacctgtccgttggccgttacacatcgcgacctcgcaccggcaccaccagccaagccgtttccgactaccccacgaccgaaagaaaatagagagagagagagcaggagaccgacggtttggccgatggccgttacacatcgcgaccgggcaacggcaccaccaccaccaccagccaagcggtttcccactgccccacgtacgtagagggcgcagagagagagagaccaggagacacggttcaaatttcaaatcgaaccgccccactcccacaaccaccgggtcaaaccgccgtaccctcactgacccagggccccacggacactcggcccccacatgccataccgctggagaaaacgacaagcgcaggcggtacgggcgtgtgaggtggctccggggctcgcgacgcgtgcgttgggtgccagctgtattgccggtcaggtcaccggccgccggcgctgctataaatacccgccgctccccccgtcactattgctccaaccaaacttccggtcttctcttctccactacccacccgcctgcccgcccgccttctcctccaccactgccccgccgctaaccaaccactcgtgcgccacaagtctcccgtcgtggaatagggcaaaggccaggcatctcgcttctgtcctctgtcgaggggatcggacccgatcggagaaaga

SEQ ID NO: 1625 - DNA, 746 bp, Zea mays
ggggttattgtccatgttatctagttatccttatactcccctctcaatatctataatgcaacattgctgattttagagggttactatgtgtgctttcaacttcaaacttttctaatatggccatttgcaatgcgtccgctatgactagagtggaagaggacggtagagccagcagactggatgacaaagtttggttaattaaaatgaagaaaaaataaaaagttttggagagattgaaatgaagaaattttagttaatggagaaaaaaagggattttggaggatcgaatttctacatagagcgctttttataagagtctttagaacaaaagagtgaatcctacgtattcttttgaaattcctacaaattaacctttttaggtcactataaaacgagctgtcctatgggaccttttttttacggaatcctatggaactttaaaactcatgtttctctccggcccaaattcctatacggcccaggtggacttgggcgatgcagccatgcagggaccaccggaccaggaccatccccttacggccttacccgccggacacgtcacataccgaacccggacgcgcctcgtcgtagcgaggcgatgaccagcgcagctgcagcatcctttcttgccataaaaaaccccgcgactctggtcagagagggagagcgagctagaagcctagaaccggcaggaagccagacgagcggagccaccacgcgtgagctgcaacgtaggcggcgggggc

SEQ ID NO: 1626 - DNA, 1500 bp, Zea mays
gtcaacaatcactttcattacctatatgatacagtcaacatttttgtttaggagttgctaaatggttgycaaatgtagagagaaaatagggttagatgagaaattgctaaatttagaaagttaatttagagaaattgctacatccatcactgcctgccaaaataataattatcagttgttacaacctcttccgcatctcgctcactcataaactaacacagaagtataatgcaagtggggatcgatggtcagcgtcaccaaaaaaatctggtggtgtgtttgtgggtagcatagttcatttgtccctctaaattagggggtgtttggtttctagggactaatttttagtccctacattttattccatttagttgcaaaattgctaaatatagaaactaaaattctattctagtttctaaatttggcaatttatagtctaaagtggaatacaataatgggactaaggccccgtttggttaggggtaactaaagtttagtgactaaattttagtcacttttagtccctaaagaagcaaacatggtgactaaaatgggatgactaaactttagttctttagtcaccaaggggtgactaaaagggactaaagtagtatttttaccttatttgccctctcaattttcttcttatagtaaacatctattaattaataggggtaaaacagtcattattcacagcaattaatgctctttagttcggtttagtcactggaatcaaacaggatactttagcaactaaactttagtcactaaaatttagtcgagtgactaaagaaaccaaacagggcctaaacattagtccctacaaaccaaacacccccttaataattcccttaataatgtcgcaagccattggcgttccctagctgctgacctattgtggacgatgcaccaatggcaagtttctactctcccacacggccacaccctagcttactgatgaagactccatggatgttggccgcgccaggactcgcgctggtcgacgccggcgcaatgccgccgactgccgtggaccgtgtctgctccaatcaatgcccagcgcagggacaataaaacccagccatcgctgtaagcgtcagcgtctgctctgtcgcggctctccgagccacgtctcggcgcgacggcaaccatgcgcatgttcatctctgtccggcactatctgaaatcagatagccttgttacgtgatgtgttggagcagaagtgtaacgagctttccaaacaaaaaacaaaaaaaaaacatgaggtggtgatgagcaatgatccaaagagccgtatcgattgcgtcgtctctccttgatcgcaagcgccttggcttttctcagtttctgtctgcttcgctcgtgatgtccgtccttctcgccatatatgccctactactataccgacatgccgtaacagattcatggtgaccatcgccacatctctccgacggttaaatatccctcccagaacgcccatcatctgcggcgtcatccaac

SEQ ID NO: 1627 - DNA, 137 bp, Zea mays
gccacacccacactcctcttcactcactaacggccgtgcttgcactcgcagcgcatcacttgctactttggtagtggagagcagaaagaacagagctagattattcccaacaagctacagcaaattagttgctcttc

SEQ ID NO: 1628 - DNA, 966 bp, Zea mays
tgtcctgcaacactcgatcggttaccgagatgaaacatgcatgggtacagaggctcaaaaaagcgtccatcgagagttgttgttgatctctggatcacgaaatcacctgagaagatctgcgcgcatttcctcgcatgcatgcggcacctgtcgtggatcgagttgggccggcacgtgagagagagagtcgtagactcgtagtcgacgacgacgacgaacacagacaagaagagagccagcccaaggcaaaaagatagagcgagacgacagatgagccgtcacacattcacacgctagggcgcagccaggctagctagcacaatagctcctcgtgccgccagaggctggcaggaggggccccggcccggctgagccgctggtgagctgcatgccatgccatgccacacccgcactggacactgcaagacgtttccactgacggatggcacggcacggcatggcgtctgcgtggcacggcccccaagacaaaaaggaaaacgccggtccacggcgctcgcatctgttgcatgcaatgcaatgcatagttgcacagttgcactgcacaccgaaaccttttgttttgcatgggctcttctcgtcaagcgagtcgtcacctacgtatgctaaacgcttcttgggctgcttgcagctcgcattcatatcgttgccacctacacagcactccccccgtagccatatatagcttgctcgcataaacgtcaaaaaggagactcttttggccctcttccggcaccggcaccggcaccggcaccagcgccaatctagctagtcagtttagcttcgctccttcgcttgcttgcaagtaacagcctctctcgtgtccaaaaagaaagtctttctctggaaaggagagaaggatcatcatcaccaggatcaagaaagaactcgtcgattccttaccccttccgtcttcttctgatctcagctctatccactagctaggag

SEQ ID NO: 1629 - DNA, 268 bp, Zea mays
attgtggcaatggcaacctggttggtagagtacgtagtagttagtgaagaaatgcatgtcattgcacctgcatgcgcatgcgcgagcacgaggtgtaataactttcggcagtagaagtggcggtgaagaagtggacgacacggcctggggaaggacatgcatggcgtactgcctccctgcaagcgagatgcatgcatgttgcacacgctcgccgtttcttcgcaagatggcgacaattttgccgcaatatgtaatgtaatggttccac

SEQ ID NO: 1630 - DNA, 585 bp, Zea mays
attttttttttcacattccgaaattgcaaaccctggtattaaggtacttagcatgcccacaacaaaagggagatgatggcaattagattagagcatctctaagggactctacatttgtgactctatattttttactttctatttgactctatttatatttttataaagattgcattctatatgtaatatcttattccaacaaactctctaatagataagttagtttgtctagctaagtttagttagagagggtgccaatttgaagagtcggatgtcttggcgagttaaatgactagtttattggaaagttattttacttttaagtagctaaaattcagcttgatgactcatttagctagttttttggagatgcttttacgataaactgcaacttcagaatggcaatggcaaggctgtcgggtcttccctcgtgaaggctctatctctcggcattccctataaatagcctgctcatggcgtcccccatctcatcgccagcctcgagatcgatctctctcaagggaccttgcttgccgccacccccaccgcagttacagttatagctagggatctgaggactagctg

SEQ ID NO: 1631 - DNA, 1278 bp, Zea mays
ccttttagtataaaattcagttttgtttgaaaatttgaaaaaagcgggaaaacttacaccggcggccaaataaagaaaaccaccagtggaaagtgtatttgcactggcggtttccttaataaaaccgtcattggaaagtgtatttacagtggcgttttgcttaataaaaycgtaggtgaaaatatcatttatacgggcgatttgattaataaaactgccaataaaaatatcatttccactccagtggaaatgatagcagtttgctttataaaaccgtggtggttgcaaaacaaccataagtgaaaatgctgatttccgctgcccctagcattgcgacactgaaaaatgctattgcaaatagctctagaacggctattatagagttgtactagtggttatttgtgtgttctaatatcttaaaaattagtcaatatgccattatgaatttgtgagaattataaaatatttgtttttttactagagtttattgttttttaataaccgataactccgatcctgtattttaaccgttttcgtttttgtctggttaagaaatacgaaaaaacaaacggaagaggacattcaggcacgcgtacacgtatgacgtatggtatggtctagttgcttaaccgcgtcgagcgaacgaccaccggcaccagcacgtacggtggcagcacctggatggctgatggccgtcagcccgtcactaatttacgtacatcgacatcagctggtgaactgaattgttttttaatccggccgtgtcgatgaatatatggctgaataagggggtgtttgttcttgccgacccattgcatacttgtcactgttggactgagaaataaaaagtcttgttcagaccgtccgcgggggattgctttgcacgctgccacgtacgtaaatataacagcatacagagtcatggacacgccaacaagctatacttcctggaaatgttcccgtttctctgttggagcctggcaaggattcgttccgaagcaacaaccgtaccagcagcaaaacaaaatctaatacgcgaacacgcgtgaacgaaagtcatgaaaaaatacatctactacgcggcttaaattccaatagcaacaactactgttccatccattccggcccctatataggcacgagctggtttcgtccatttgtatcatcaaatacatccatccatcatcgcacctgcaagcatcatcttcgagcagatcgaacgaaccccaagacacaaccggccgtcgactaccgcatctcgcgttcgcgatccaaaca

SEQ ID NO: 1632 - DNA, 1500 bp, Zea mays
ttgctgagcgctagtctaaaatgcactcggcaaaggctccgaaaccgacacttggcgccgtgacaacgacttttctttgacaagtaccctgacacttggtaaattctttgtcgagtgcccgataaaaagtaatcgacaaataagtcgttgctgatgtacagttcagcaagacctctttgccaagagtcacgctcggcaaagagtttacggattgttttttgtgctttgccacgacaaatgagctgtgtccggtagtgggcaaagaagctctttacctactgttagaaaaaaaaagcacttaacaaagaggtttttgccaagtgctaaaaaaacactcagcaaagagccgaattctaatagtgaatgatggttccagactagacaaacgtacatacaaaaatccaaatctaaatcagctggacggacgcgcgtaatacatgcgcgtgtacctcgacgttgatttcaaaaggacatcgctgagtaggttgacatcaagatcacggcgaaattaatattggcgtcgatatatatgattacatatatacccggaactcacgacgtttgcttgcttgcttgctaactaccaacacaacacacggagctagctagcacccaaccaaaggcacacacatctgtggtacgccacgcacatgcatttttcccgtgacaacaacgtacgtacgtacacggcttttcatgcgtgctactacacacatactatacacatctacgatatactccacgacagtattctgtcatgcatgtagatatataccatatgcggccggggttagttatggctctatcattgcatgcatgcatgcatggttcatatatatacgtaactgtgtacgtactacgtacccatatattgcatgcagggatatgtacacgtacgtacaaaagtgaattgaagcagctagcagcaacgagccacatatccttccttcttcttcctggtggctctggctgtgtagagctgctggttactacatgtcgtctcgtctgtctgatgccatgtcgctgtagtgttcgatggaaagcaccaattaaagtggaaccggcgtggggccctcgccatggaaaccccggccaatgcaacggaaggaacgaagtgtcattgtgaggccttgcatgctgcttgcttgcttaataatctgggggtgggggtgggatcgatccctcaggaagctaagcatcaatcagagagagagagagaaattcacgcgatggtgattattcgattaaacaaccggcgcccccgccgacgaagagtgaaggaggcagaagcccggcgctagctagctactagagaggagaggagccgacggccccggggagggagagagagagagagactgagagagagaggtcgtgttaaaagccctactataaacaccaaccagccatttgcacccagcaacgtacagctagctagcaggcaccaggcagcacatagcctccgattattcagctggaggtcggtctgtgtgtgcgtgc

SEQ ID NO: 1633 - DNA, 138 bp, Zea mays
ggaaccaatccttctgtagaacctcttgatgtcttggctaatttatagatccactgtcggcctggaactattactagccaaatttttgtctaatttatataacctttgattagttggggtcttaataggaaaacatct

SEQ ID NO: 1634 - DNA, 666 bp, Zea mays
ctgcagcaatagaaaaaactaaaacagctagcagttaaagcgaaccaatacaagaaactttaataaaatgcatgtagatacagaccaagcaaggttatttgaaacgctcttgtgtgtagctccaattggaacattataaatattttttcttgttacgatgacttgcaggtcatgttgccatgattcactcacattcttatgatcacattaaaaaaagaatgacagaaaggctaagagcaaatgtcatatttatcttcatttacattcaccgtcaaacagaaaatatacgctttatttcaacctgaatcccatattcagtacacgttcctagttgaataatttcttaagaagcagtttacaaaagaaaagaaaaataaggtgtgcatatgttttttagtgcgtgaggaaagacatatctatgatcttcttgtgaactatatctatgatcttcttgtgaactatgattatggctaaatctagatattttctcatcacaaagactttatactgtacgagaagttgatcattagatgagtattattttctctacaacggtcgaaaaacgaatttcataatgaacgcaacgaacaacaaagttcagaacataaatgagtactattatgaatcaacaacgagctagttggtcataccagtgagttatcgagc

SEQ ID NO: 1635 - DNA, 1422 bp, Zea mays
gaccatctctaacgcacgctaaatgctgttttacttcggctcatcagccacacaggttccatctttgcgccacctgaacttcatcagcccggtccctcgctgaaatcggaacgggaatactagctaaagatttcgtatcatctgttaaagaatatccgaaaagaaggtaagcaaatggcttggtggtctagttaaatcatatgctcaagtcgttgccaccgccgcccacggcccaccaccgatggtactaccaccaccaccattttgtcgcggttttttcaattgctgtactgacgcagacgtaatgcatgggttttactatcctcgcggagccaccgactttcagaacgaaaggcgctcatttggtccgcgtcgccatcgtcgtcgtcccgcgcgaactgtgtagaatggcaggcaaagctgattggacgggcaggcaggcagggcggcaaaagagcgccgccgatgacgatggatacgagctctagctatctcccaccattggatagagagcaataatgctgattgccagccaccacacgacctgctacacaaccaaaaaaaaaaaggcttgggatgcaaaaccatgcatgctcaagtgatgctgaaacttccatctcgatctcccatgttgcgcttgcacaaacggagagagagacggccggcggggctgcatttgagacgaaactccgtccctgcttaacttgttcttccctgattgaccagccgacgacagatcccccaagcattctgcaagaacatgacttctgataggtttcagaagaagaagaagaagaagaaacgcgaggcccaacgtacgatcgactacacatgcacgttgagatagctagctagcatatatatatcctgcaattaaactgcagcccatctgctggcacgtacgtacgtacttgcagccgttcatcaaatgtacagttaaccaaaaaaaatgtttaagcgcgctacactacgcatgtgataacttatcctccaatcagtagtgttgtcatgttgcattatattggtatatatacagtgtaccctcagtccctcacatggacgctctccacaaaaaaaaaaaagttcagactagcgacagacacatctgaacgaagttttggtgcgcgcgcctgctctcggccggacaagctagctatatagtagcaagtagccagtaccaatcatgcatggaataaaatgttttgtgacgattatccccgcaccgtccagagtactctaacccacaagttgaggccgccctgcagcccatcagacgaggacgcgcgcgtgtataaaagctgactggactcccagcgtctgtcagcgaagccgaagcagcagccaattcgctcgagttcagatcgagcgcgcgccaagcaagtcttccggccggccgcgaagagcgcaatcaagcaagacaag

SEQ ID NO: 1636 - DNA, 466 bp, Zea mays
ctgcagacagtcttataaaccattctcatgtatctcttttgttagccccctagagtgaccaaatgttaagtacgttcgtacaaaattattatgtaatcaaatgtcaactcatataagtatattatttatatttattttaccagatgttaaagagaccacaattaagatagttacttgcgatcaaaacgcgaaatgtcctaaccctgataggctgataataagatcaacccaacgctcacagctttcccctttcgggctgttgccttcctcgttgcttccacgagaaagcgacagcctcgtataccaatttgcatatctgcatcaagcttgcggatcaagattctcctctctctctctctctagccagagtggaacaggttgccgccgcatcacctctgggaacagagccgagcagctgcactgtcgcgtcgagaaataatcggagcataagaaaactgcttcagcc

SEQ ID NO: 1637 - DNA, 639 bp, Zea mays
gattaggctcacagagtcacagtgatttgaactaccgtgacttgattgacatatcttcgggtatgtgattcccaaagtagccattgtgtagctgacttgcaactgcagataatcttctcagtcctgattcccgagtgtttggtttctctctgtcccattcgaaaatagttatagaatagttatctcaagacatgtgaaaaatcagtgtcagcatacttgttctataattgtccaactggtccattgtgcactgtctacactctacattcttgcatcgagaatacatgatcttattatcgtagtagcccagaccttcagatttttaatttgttctgcaggaaccaccgtggtctgcgtcactactggggcctccgcgtccgtggccagcacaccaagactactggtaggcgtggaaagaccgttggtgtctccaagaagcgatgagctctatatcaccctgagaaatcttggccgcactaccgtgttggtttgtgtccaaacagtcctgatgaagggtttctgtttaggcagtttcctgaaatggtgttttgctctaggacaatctcgcggttattgaaccttaatatatcgtgtccctgggttgtgtttttttgacactttataagtaatttcatttgg

SEQ ID NO: 1638 - DNA, 918 bp, Zea mays
acaaaagcttcaactgacgcaagtcgtgaagagtggttttggcaatttggccattcatgctgagtttcttcaatctctattggcgacatcaatttctgcatcctgcctatttgtgtttctgctttgtgcccttcaatttgttctttaatttagagcttagaaattagcctctgcctgtgtattttagaaattgtccattccagagtccatttctgtgaaaatatatttattattatcatactctgctaccgagcttttgtacaattaatacaggatatatagactgttctggtgctatgttactcgctagttgtgaagttgtcactaaaatgtaaaagaaatcaaatcattagttgttagatagctaataagttattagctaggttgaactagctaacaactaataactatttgagagatataactaatcattagttggtctattagttgatgtgttataaacctctcggctaattttagacgctaaatattagttttataggtttagaaacaaacaccttaataggtttgttttgtcgttatttctcgtctacataattatttttataattaaactatatttaatatttataataagcaccaaacattaatataacagtgattagattttagttggtgaatctaaagacaccctaaaaatattgtccgacccgttttcagcctacaccgcgccctgcttatccagaaacagacaccgcccttcctatgcgagcggtccacgccgccgaaccctagatccaacgaaccatacggctcaagacctcctcccctcgcgttcaccaaacaccgccgcacacttctaaaaaagttccgcaggaaacgcggcccgcagcacgccctttccccacctcgatctcgcgctaggttttcgccacaccgctctcgtcctccgcgaag

SEQ ID NO: 1639 - DNA, 657 bp, Zea mays
ggtactactcagtagacagactagacagtaggtcacacaggctgacaggcaggcgagtccaaggccaggcggccaggcggactaggtggggcccccacacgcggcactgcggcaggatactggtcggcggccttgtgcctggacagttattctctccctcgtcgacggccgtgtcccgcttgatttcgatcggcagctggagagaatcggttcgattccccgtctgccgcagtgcctcctttcctttcctttggcttaggctcggctcgttccttcgctcgtcgtattttttctccaccacttccttcatttttttttctttctccctccctacacggccactaccagtccaccacaaaccacgtccccgccgtcgtcgtcgcgcttcccctggctacgcgccccgtcgcgtctcggtgctgctgttgggtgcgcccgcgcgttgtcgtgaagggtgaagctgcttccgcgcgccgccgccgccacctgccccgcgtgggttgcaagtcaagcagcaggctgggacggggccggagccggagggagcggacgacgcgggataagggcgaccgcggcacgcgcgtgagcggcacaaccgaagcaggctgcgtttagttggactgcggccggggatcgctcgcgtcgcgtcggaggagg

SEQ ID NO: 1640 - DNA, 634 bp, Zea mays
tgggtggaagaagaggaaagcagcccacatataatgtccctccaaatttggccaaaaccaaggtgcttcatgacatcaataagaaagggccaagagaccgagtcgaaggccttagtgatgtccaacttgaggagaagactagcctttttctgatgatgttatcctgtataaatcctgtaaccatgaggtttgctgaaccaacatgaagttatcctgtataaatctccccttttatgaaagcactttggttgggtgagaccatctcatgaagccttgtagccagccgattggcaagggctttagtgatgagtttagtaacactatgaaccagatttataggcctaaaatccttaacctgggcagcaccctcctttttttggagtcaaagtaatatacactgtattaagcttgccaaagttgttgaatctcctgccccaaactgctgacacaacattcatgaaatccttttttgattatgtgccaacaaactctgtagaatcttccagtaaatccatcgggaccaggtgccttatcagggggcagacttaaaatagtgttccacacctctttttctgaaaaaggtgcatccaactcagagacgtcatgactaggtatactaagagcttctaaatca

SEQ ID NO: 1641 - DNA, 112 bp, Zea mays
ggtttttcccctacccagcttttgttatgggattcattactttgcatggtgttcgatcatgtcacggttatgagctgcttggcgtttgtttgtcgatacaaccaaccaggcc

SEQ ID NO: 1642 - DNA, 714 bp, Zea mays
tggcgcaggcgagggtggttcgtccggtggcgtgggcgaggaaggcgtgagtggggcgtgggggagagcagagcagctgccctgcccggctttggtccctcgcctcgctcgccttttaaaaagggccgccaccccccttgcgcttccctgccttctctcgatcaaggatttcgttgcatatttgcatttcaaatcaaaattttctggctatagtgttgcgtagtgcgtaaatattgaattgcgagcgttagaatgtgtttctgatcatcttcaacatattctaaatcattgtttctaaatcattacgtatttcatatcaaagagtaaggggagagagagagccaataggaaaggctgttgccccttttatgccagaagatgggttggtgagggtggcacttgtcagattaggacctaccacatcctatatgctatactctcaactagggacattctatgcaataacacattaatgcatttattgttctagacctctcggttcgaccaaattaataccgcccctcctctccttattaccaccacctagctagcagcggcagcggcagcaccggcctgttgtgctgctcgctcagacagctctgctagctgcatcctcctaactctccaggtctctctctcctctcccaactcccaagtcccatccggatcgagacgctggaggcggagcgcccccccgggacggcggcggcgacg

SEQ ID NO: 1643 - DNA, 421 bp, Zea mays
tgcagcaaccaatcaagcctgattgttttagtgacgttaatacactcatatctctatttaataggggcaaacagggaaaactctatgataactaatcactccttggtatgcacaatcatatcctaaacgactacctttactacactggagggagtactatatctaggaccaatgtttttttttgcctaaagtaactggcaaagtttgaaccacaaaaaaactttgaataaaaacaggacagatggagatatttttgtacttttattattgtcaattctctgttctccgaacacaccactgtcgtctgtcgacaactcgacatggtgagttggcgacgctgaaaaccgaagcaccgaacacacgcgcacaggggacactcgcgcacactgcagtctgcagctagcccgtatcgccaatcgcc

SEQ ID NO: 1644 - DNA, 521 bp, Zea mays
acaagggaggcctgtatgtactttcgaggtagtcttttccccaaagacctaactgatgatcaaaaggccaagctaatgagcatttttacttgaccaccatcaagttgagatcttgggatagttgcctagaacataggtaaacatgccaatagcagcatgaatgttttgttttcgaagtgctgttgctcagattcaaacctagaaaatgaatgcatcagtaaatctgtaaattgtctggcaattttacttccaaatatctcctccaccagtaattttcatgaattgtcctattcaaaacaagcaaaaaaaaaacctgtgcatttttacattgcgaatgtgtggaaccagcggacttcttcactgagcagggcatacagacattaacgcagtaactgtcaagaaaatagctaaagtctgtagcggaacagttacaagtcgacgccaacaattgtcagacacatgcagtgcattgtacaactggttacagtaacacgcagattctccgactaggaagacatcat

SEQ ID NO: 1645 - DNA, 1281 bp, Zea mays
gaaagataaagttgttcataagactcaggatctagaaagtgacggattcctagtattacaaaaactcaaccgattatgtgtttatgttcattttagattgtttttaccccatcgaaacaaacagacccatagttgtttctcttgtgctttgctaccgtgacaaaacacaagtgtccaacttactttttatgtcaaaagatttatttagctctacctatatctgtctaaattaatatgtgttatgatagattatgaaaaaaattaagtgtagaaaatcaggagaggttctgatatttgccaccagcgagaaacaggtttgtaaaattgccatcagacccatatttcatagacccaactggacccaaatttcatagacacagtgataattataacaagaagacaacattgtgagtgacaaaaatccaattatctcgaaaatcagtcatttttctatcctaatatatctcaacataatggattataattaagatggatacaagtacaactaaacaaggcttaaatataaaagaattcaagtgtggtgagccataggcttatctggcgtcttacaagcatccaacacttaggtgccgtttggttcagattttggtaacgtaatggacaaacgataatgttaaatgatgtttgtttaagtccaaccgtaattgaataccacactacaaatggataccggcttattcaaacttgttaccgccgttactcaagtgtcaatcattactattaccatttacgttacaaaatttgaaccaaacaacaccttatttcgtctgtaccaaaaataaaattctaatagcacaaatttcgaggtacagcttctatgctcccagctggcctgctgtaaggttaaagagctcaaaccttgtctccggaggaagcttccttgtcaaaatacaccaaatacaaatgcctccgaaaaccttgtcacacgtgcatggccattgtgcatttgtgctgtcaaaaactcaaaatagttgcaaattctcgcaaattttaatgatgagttgtgttgtgtgcctgccctcctgctgtctgtccagctgcagattctctcacgagtctaatcataggccaggggtaaaagcgcaaatgtttctgcgctctcttttctcccctcaccctttctctttctccctcgaccgccccggatctatctcgccgcgccggcgcgcagctgagccgccgaagcgaggaggcaatcgaggcggacgaagcgccgcaccaaattcgacgggggatcgagcaccagaggcgtagcgcaaa

SEQ ID NO: 1646 - DNA, 1500 bp, Zea mays
gacggctgggtttgaaaaaaaatgattctagtcttttttttctacttattaattacttccttttgtttatatactcaacttattcctgaaactaataattagtgctaccacaataaataaaaccattccactgaattttaggagtagacccgtaatgtcctacctcatctaggctggtcgatcaaacaccctataacagtgtgagataattgaaattttggattaagttcgattcactatctatttttttacaagttactttttttgtttcgagggttggaagtttggaactaatacaagtagattttttgctaaacatatatatcgaacacatatattaattaattatttgtatgaatctagtaaaaagatgaaacgaattttagtttatgacgagggagtaagtagcagaagttttgctaatatatatgaggatatataaataatagaaggtagtagtcaaaaataatattttagagatacgtcgcagatctcctttatttgcgactaggactgagtaactgtacactaattttagtcgatgacgcaaacatatatgcacacgatactccaagattaaccttgccgcttaaggcgttggtgtgtaggtagcgatcagaccaacagccatttctttcagattttattcaccttaaaacgatcggtcccgaatgggtaaccccccaccctgcagcctgtagattaataatataagccccatgtaataagatggcgctaaatggcaatggcttaaattagatggcgcaattaagcattaatgggcgatatcttttagctggcgcacaactacagtactgcgtgcgtttgcttgcattgtaccgcgcgcctttattccggcagcccagctaatttttgaaaggttaacggctaagctactagttgtgtcacggaaggctcctctcctctcctctccttgcgttcctccaacgcccgcgcccccttacttttcgaaacgcctccgcctgcattattgcgtagcgaaacccggccgatcgatggcgcaagcgcgactgcgaggacccaaaactgaaagcacccccccgtgttggggttgggttgatctccccgcattcacgccaccgagccgcgctgtaacccgcgatccatccaccgcctaattttaacccatgcgtccgtgtcttcttcgccacgagcaatttttaggcagtcagccgccctcttcccccgtccagttctcgcgtcgtcgtcgttcgctggctggctggacgcgatccgttcccatgtcccgtcccgtgccactctccacacgagcgagcgagcgagcgaggcagcggaggtttttaaaagcgccgcgtgccaagtgggtgcgggactgcgaggagttggactcggctattaaaaccacgagtgggaagttttcttcttcgtgacctcccgctcgctgcgccagccaacccaccacccatccgtttctcgttctccggcccctgcctgactcccctcctcccccccttaaca

SEQ ID NO: 1647 - DNA, 775 bp, Zea mays
gtccataagattggtacacgcaaatcgcaactacaaagaagatctgactatgcaaaagcacgcgagacgaatgaaagatcacttgttaaaaaaacagaggttcgtgttggtatgcttcgtagccgaagatcataaagaaagagaacattttcgtcagactctctcaggaacaagcatcgaagctattacctagaaagcttcagcataacgatatatctcaagacgaagggccgaaccgacttaaagatggattgacttaaagacccatgatattttgtgtcattattgtaatcaattataaaggacttaaatgtaattttacgcagattgcaccatatgcctataaataggtgaacagtacctctgtactgttcacgcaatcttgtaatcactgacacattacgctggaattattgctttctgctaagacgaaggtataaatgtacctaaatattatgttttaatatttaggtccatataataaaatatgtgaataatgttatctgtttttggtatatctttctttgatgttttatattttatatttcatgttgcattgtattataagtctgatcacgaaggtgtgatcttcgtgatatttttctcatggccttcgtccgaagttcattaaatccttcggagataatacttcagcggacgaagggcatcaatatttaacattttttgttgccttgttcttaattcatagtatttgagaacaagtccccaacattggcacccacctccggtgaactcacttccactttttgagctg

SEQ ID NO: 1648 - DNA, 947 bp, Zea mays
gatcctcaattcagtcctaggcgttagcagtcttcattgctgattggacgctaggggctcaggaagaagaaacaaataaagacgccgaagcctggacggtattatgtgacggttcttggggaaccttcgacgcaggagcaactgttgttcgagtagcgccctctaaagtcagaacatgctacacaacaaggcttgacttcagttgtacgaataatattgctgaatacgaagctcttctgttagggcttcgaaagttaaaggcaatggggataagaagggtgttgggggtatgcttcgtcgccgaaggtcctgcaggaagaaacaccttcggcaaaacctgttcatacgtgataccgaagctaccgctcatgaagcttcgatattataacgtatccgaagacgaaggatcgaaccgacttaaagatggaatgactttttagtccataagggtctgagtcataattgtaatcttttgtaaggggtatgattgtaattgcttacaggatgcgtcctatgcctataaatagtgaacagtactcctttactgttcacgcaattttctaattgttgaagcattactctgaaattattgtttcctgccaaagcgaaggtacaaacgtacttaaatattatgttttaatattttagttcacattataaaatgagtgaataatgttacttattcttgatgttttataacgttttatatcttgtatttcatttcacattgttttatctttgatcacgaaggtgtgaccttcgtgatatattattcataaccttcgtccgaagctcattaaatccttggggaaataatgtttcagcggacgaagggctttaacatttaacattctatgttgccttgttcttaattcgaagcatttgagaacaaatcccacggacattggcgcccacctccagtgaactcacttccactttttgagctg

SEQ ID NO: 1649 - DNA, 400 bp, Zea mays
cctacaaagaatgccgaaatcataaattagtggcagttcattactcgccgtgtgattttactaatgaatcctcaatgtttctatgagttattactacatatcattgagatatggattgcagtaatattgtttatgttatgaatcagacaatggggaactttcatgatagggagcaaatgtaccttttccaacaacaagaccaacttgttcccacgtgagactgtggaattgctccagcttggcgaaattcaataccaatgcaacaggaaggaaaaacaacatattaaagagtcccaggaatcccagaaactgagccatgctcacttgtccttgacctttctcatcgggcaacttttttcgaatcaaggtgatatacacagcatataaaccggcagaaaca

SEQ ID NO: 1650 - DNA, 1500 bp, Zea mays
ccagtgactgagaatctagacgagtgaacgctggtgctgtatcatttgttgttcttccgcaaactgatgagattgcagtttgatatagctttttttggcattttcttctcaggtttgttcgtttgggcaagttatagcatgactataacaggtttgtccagctgtggaatgagaatctgagaatcgatacctacagatcaggtggctctggaggtcagtctgtcaatacaaccgatagtgctgttaggataactcatattccaaccggaacagtggttgcaatccaagatgagagatcacagcacatggtaagggtcttggttttacaaactccatgaaataaatttttttatgtgcacattaaatgccatatctttgggtttcccttttaaaacctggaaagcagcagttcctaaagctcaatttcacacattttcactcatgtttcatccatatttactactttactcgcagccttgttgtttttagcacaatcgcattatttgcaggtttcatgttcaatgaactgcgtctgcgcttgggtggaccatttattttagttggcgcatgttgttagcaaattgtaataacaaaatggaaataaaagaaagagaatttatctgctctaagtcatagtacagaatggattccatattatatgttgttattttttccctatattatatccttacatcgattacataaatgtcttttcccctctactttcagatataaccatagttgacctcaatgttcaaaggatggccaggtatttcttttttccagtctctattcaactgttgtcgcataactaatcttgaactacggattgcgacagccattagaatccagttatatatactttgctgcagtgagcagccaattggccatagactgaacaatctcatgttcatgatgaaaaagaaaaaaaatgagggatttagggtttaggaacccaacatgtttttacctttcgagcttggctgcaatgaacaggaagtgacttcaaccctttatagtgcagggttgcaggctgtagtttctttttaattgtttgcatgtatgcagtgatgatgcatgacaaatcaaaggtgctatttgcttttgacctaccttatgtaggaatttatgatgtgtaaacaggctacctaattccctttcatcacataaaattgttacttgtttgtatagcacataactgcattctagaagatcacagatagtcaataacataaatttgctcgttcttggattcggaattttgtaaacccaatgtgcaatgtaataactatggacaccccatccatgcatttaaatatgtatattaaaaatattaatgtggtttatgtccaatgcatttcttaactaactaccttcatctaacacaatatttagggctacatcatcttgttgttgacgggttccgtgtgttcaatcgccgagcagaaagtcaggaacagaactcaggcgttggcgattggcatctccctcccctaagcc

SEQ ID NO: 1651 - DNA, 1500 bp, Zea mays
tcaaaatgttattcatttacctttgactatttgcaaaaagactttgaaaagaatttacaaaagaatttgcaaaaaaacaaaacaagtggtgcaagcgtggtccaaaattttaaatatgaagaaagcatccatgcatatcttatgaaatgtatattggtttaattctaagtaacctttgcacttacattatgcaaactagttcgattatgcacttatatatttgctttggtttgtgttggcatcaatcaccaaaaagggggagattgaaagggaaataggcttacaccttttcctaattgattttggtggttgaattgcccaacacaaataattgaactaaccagtttgctctagattataagttttacaggtgccaaaggttcacaatagaccaataaaatgaccaagaaagggttcaaacaaaaagagcaaaagacaaccgaagcgtgccctggtctggcgcaccggactgtccggtgtaccagggaactcagctccaaactcgtcaccttcgggaaaatcagagggcgcttcgctataattcaccggactatccggtgaggcaccagacagtgtccgatggcgcaccggactgtccggtgtgccagcggagcaacgactacttcagcgccaacggtcgactgcaaccgcattcaatgcgctacagtgcgcgccagagtcagagcagcgtcagaaggcgcaccagacagtctacagtacttgtccggtgcaccaccggacagccagaagaccctacctgtcagagctccaatggtcgaaccctaacagcagggtgacgtggctggcgcaccggacagtgtccggtggcgccattcgacagcagcctccaccaaacggctagtttggtggttggggctataaataccccaaccaccccaccattcattgcatccaagttttccaccttcaacacattacaagagctatagcattcaattctagacacaaccaaagagatcaaatcctctcccaagtccggaatcactccaaatcaaatagtgactagagagagcgacatttgtgttcatttgagctcttgcgcttggattgcttcttttctttctcattctttcttgtgatcaaactcaattgtaaccgaggcaagagacaccaattgtgtggtggtccttgcggggactttgtgtcccgtttgattgagaagagaagctcactcggtctaagtgaccatttgagagagggaaagggttgaaagagacccggtctttgtgaccacctcaacggggagtaggtttgcaagaaccgaacctcggtaaaacaaatcatcgtgtctcactctttatttgcttgtgatttgttttgcgccctctctctcggactcgtttatatttctaacgctaacccggcttgtagttgtgcttaagtttataaatttcagattcgccctattcacccccctctaggcgactttcaattggtatcggagcccggtgcttcattagagcctaaccgctcgaagtg

SEQ ID NO: 1652 - DNA, 258 bp, Zea mays
tcttggccaagtgggtggtatttgttagcaaaaccacacgcacggcggcggtgggcaggactgaaatgaactcgatcgtgtcgtgtcgtgtgtataaatgctggccgcccggcctcacttgtctcgcggctcgcgcactactctcactcactgcactgactgcttagcctctttagcttgcaggacacaggaaagcatgcagcgacattaactgctacttggcctctgtgtatgtcccgcacctaattaatcacgcgc

SEQ ID NO: 1653 - DNA, 254 bp, Zea mays
ttgattaagaagaatagtgaattcttgagcaactgcgtagatttataggattaattactattcttttttgttttgcatagataaaagaagggaaatattgatatatattagagggtattgatatatattatgatctgatgtgatttcttggtatattaaatataagattaatacttcaagttgctgagttgagaaagagatgcttgaatcaaaagaattccttttttgaagttcaatttttatcagaggacaat

SEQ ID NO: 1654 - DNA, 1500 bp, Zea mays
aaccaaccaatcacgtagaaagagaacacggcaacggcaacactgtctgaggttgcaccaaaagttgcagcaaacaacaacgatagagcgtggaagtaggatgggctttttttcccgttccagcaaacagtccagactccagacatgtattgatccggcctttgggccttccctctcgtctcgtcgtccgccagccagatgcttgcctcgcgggctcacggcgtccggcgaggcctgagctcatggtgtcgtcacgccgatcgtcagccgtcagtagtaactcacgagcccggttcacgaacgacacgcttgtccagtgcatcttccgcttgtgtttggccgcccccgtctccggatgaccggggcgcgacgtgtaggatcgctggatcgaccggtcagcgtccgccatcgatcagatcaatactctcgagccgtgtcgtagttgtcctgtgacggaggatacgacaagatagactagaatggactggacactggactccactgagggcttttgtttgggagctgaatgaatggaaacccctacacaagaccatccatatatggccttaggacatttggctgtttgttccgttgtgcggttgtgccaagcgacctgtatgtatgtgtgatgtgtgtatatggactctcaagtactacctgctgcggttgtgaacttcattctatgaacagtgcagatatggagtcagttagtcgtcagtgcctcaccgccgaccacacgtatgcacacacgctaaaagcgttgggagttgggacacccgggtggaaactggaaagcttctgtcccggcgcttatgccgtgtccgtgtgtactttactcgacgtggaaaacgcttcccgcttccggtcgacggcgagaacactccggggtcccgctcgtcgatgggactatggctagacagacgtaggctcgtcgccatgcacatcttatcagctgcggttacgggagcaccccgattcgactcatacggctgcgtacgacacgatcaaggggatcaaaaaaaaatctgggcgagtgcttgggccttggatggcgcttctgcaccacatgtgcagaytcgttcggatgatggagcgagcagccgagcagtagcaaccgccaccgccaggacccaggagtggtcgcgtgccgtggacagtgacccgacccgcgccgtatcaggcagcgcagacgagaacgagaccctggtcaggccaccggacccgaaaggcgaaagcacaagaccacgagaaagtccataaaacccgggcacaccaggycaagccatacgtatcgaaggctggacgcaggggggcatttccgggaacctcgccgcgggcggggctggaaagccgcggagcttttgatttaaccggccggttggtcagccagccagccagccagccactcagtactgcacactgccatcgctctcctacggtactgctgcctaccgcgcgtctcgtcccttcgctgccgctctatctatctcggccggagcc

SEQ ID NO: 1655 - DNA, 990 bp, Zea mays
ggtgagcacccactacccaaaccctaactggatctgtcaagtgtttacatgtattttgcctactaacttcgttttttttaattatcggtgtacgtctatgccgtttactgcattcaactctgctcgtttgtttgattcagttgagcagtgacatcgtgagcttatatgctagtgtagcttattggtgtttcaagcaatgtatgtcaaatatctagattagcaatttataaaccacgtaaaaccgtgacagtatcataatggcataagaggttcttttattttgtttgaacattctagtcagagtaagttatgtgtctgttttctgcatgctgaaggttatactcaaaccacttgtgaaatggctctcaccctatatctttctttagagcatctccaacagagtgccctaaaataatgccctaaaaattaaatttctatctcatttaaaaagtatagggcacaaaaaatagttcacactccaacaataagccctaaagtaaggcaaataaccgtgaatcggtttttttccgtccatttgccgcgaacttttcccgcctgtgagcctttggcgcctattttcccacccgcgttcatcttcccggcgacggcgcgaccccaggttctatcacatcgccatcaatacctctaccacaaatcaacctctctgttttgatagacgtttgcccacacaggtactacatctacagcgccacaggtactacatcttccctgtgttttctattcaagtattcagccatgcgcccatgcctttgtcgtcgttatttagccatgcctgtgtacatctgccgcattgttttattctcccacgcaactgagcagattatttaaacaaatcagtcaaacgcacatgatcagttacataaatccattcacttaagcatgtacatgtactggttattaaactctgataggcttgttattggtgaagccccagaagtttcctatacaattaatggacacaactacgac

SEQ ID NO: 1656 - DNA, 1500 bp, Zea mays
aatacaatccactatgcttatccctaacaaaacccaaaccaaattgataagcatacaccactaagagccacgtatgaccaggaaaccctaagttgctaactaacttaggttttcttcacttagcataatgattactaaatcctgcataatcatggcatacatattcttattcattgcattcgatagattgcaacctcgccgacggagaatatgtcctcgtgccggagcaaggagttgctcaggaggtagccacggatccagcaccagagcctgccccagaggatctgcctgccccagctttggaaggcaagccccggttttatgcataacatgttctatatgatattttactacacttaatgtttgtaggctggtattgtgcacttaagtgtaggagttgattgaaaccctagttgcatgatctcaggaatccttgttgagatggatactagtatgttaggtcgagtagctgctttgctaattagggatctcggtagaagtcgagtgatttttctagcactcgcgcgaggtcaggaattggttgtacccaccttcatatcatattgatgattggtctgtggacacggatccatggggatgcgtggtctacgagatgaaattggaataaggattaacgtgcgaatacctgtgtcaagcgtttgaatgtactaaacatatgccgagaaatatggtaaatcggtaagcctagtacctgattgaacctgcccgcagactttgcccctcacgcgacctgagacgtggtctcccattccggttatggtgggtataagtgcggtcacagcacgacggcagtcggggtcagtgagacattgtacgccaaggcggtgagccctggtctgttgctatggaatcgatggggacggttgatgtgtgtggggacagagtgcctcatcacgtcgtgtgtttaggtttaccttgcaaggataaaaactcgattcgaatcgtttgcttctcgcagctaatgagactgcttgatccattgtactgcattgagtaataagtggaaatgaggtgactgacaaaagatgttgattggttaaaatgtttgatacaatgtatgattagctaggtacacatctagtctaaatgattctactaaaacttgaaaagctaaaacttgattttagactcagctagtgcttttggcaaaccaaacccctcagccaaacagctgcatgtctagaggtagaggagtagactcctcacaccgggtaagtctagttgagtactagtatactcagccttgcttgtggcataatttttgcaggtactccttaggatgattggttgatgggtgacttggccttcatcactgccaccgggatagacggtcgagagggttattgcttccgcaggagaggaccaggaggagtagcgtggccaggcttcgccatgttactcggttttctccgttagttatttccgctgcattaaaaatttatggttatcatttctgaaactccgataatgtaatcacta

SEQ ID NO: 1657 - DNA, 172 bp, Zea mays
tttcttttatttgcagggtaaggtaaatgtgaacacacagttaccagagctctgtacattgacagatcatgatgttcatcgtttcttacttagtggaatttctccatgaatcactgacaaacaattttctcagggggatgttccactgcaaggcgacttctctgctgagcac

SEQ ID NO: 1658 - DNA, 1146 bp, Zea mays
tttcttttatttgcagggtaaggtaaatgtgaacacacagttaccagagctctgtacattgacagatcatgatgttcatcgtttcttacttagtggaatttctccatgaatcactgacaaacaattttctcagggggatgttccactgcaaggcgacttctctgctgagcacatgatttttggaggtattctatcactctaatgcttatgattttggcatatcccatacttgggggttcttattgacagaagatatcatgaatctaacacaatgtttccaagtcgagtcgagttgtgcagctactggctggtacactagttgtgactaggacagactagtcgtgactagtcgaatataagtcgatgaatatagttttatcatctgattgtcccacctattatcaacaatagaaattacttcatccattaatcactctttatgttccgaagcttccttgatgctcttttttgcatggtccatggcagcccacatttcagccattgctggtctctaccatttcagcctaacaagatctctaccatttgtcttggtcctcatcaagtcttaaattcttccatgtccatagataaatctagttatcttcattgctttagcaatgcagccactaaactcttttatcttcccaataacctacatcatgagatccttgtggatagcacacggtgtccaaaataaggtaggaaacttgtccattagcatcctacctactagggttgagatggttgtgtgggctcacatttttatacctaggcccaaataagtcacccgactcaaatgctatgactagtcgatgagtcgaacgactagctgagaaagtcgagtcaccgtcgagtcgctctggtcgactatcacctctacaccgacttctcgactagtcgctcgactttaaaacctaacatactcctatatttgtcctttaacaatcagctctttagagattactttttccctggtcgcattagtttttgcttaaacaaatcctgctttcacatttgcggtttagtttttcctagtttaatcatgcctttagttagaagattggcactaaggccatcatttctgctggtagaaaacctactggcttatcacttgtttcgttctgtaccctgaaatatgagcagttg

SEQ ID NO: 1659 - DNA, 162 bp, Zea mays
  unsure (1)..(162): unsure at all n locations
ctggntgaggacgccatacaattattgatttgaatatccttcccttattgagataacatggttatacctttcacgaaactgcatggtgataataggtagcatccttggttacaatatagttatttttccatttccttttcctaataatttgttttttaatga

SEQ ID NO: 1660 - DNA, 1500 bp, Zea mays
ctatttactgctttacacaatacaaaaaaatactgccttcatcttttttatttgacatcaaatagtacaaaaaataaactatagacgtcaaatataaaaaaatggaggggtacgtgtttaagaaaggaactttacgcatcggaagagacaacacgagatccatgaagattaaacgcggctataaaaaaacatattttatgtactgctcacatacctgtttttgtggcctttaagacctgtgttttattatctcaagaaatttgtatatattcctaattcactgtgttacttcacaaactctctgggaattttttttatcgcacatttattttctgatgactaagaccaatagatcggttggttctcatagatgcaaacacgaccattgtaatataacttccaagctgtttatgatgctaggtttgtagaatgtaagatttcactaccacaaatatatgtatgcttatacaatgctgtaatataattctacagatattgctatacctacctacaacatcatttttcttattatacatacatcgaatcatctttctaaatgcatggttaaaaaacttgcgcgaagcgcgagcaagtcactagttattgtaagctttgaacatatccgcctcctgtgggaaggacggaactgtggcaaaaatgtggaaccaggaatcgtcgctgccagtgacatgatgtccaccgaacagataggggtcaatggccagattcttaaagacgagagagaacgtgataaggagggcattccttattactatcctcttttgctattgtttggttgcagatcaaatacgagagagccattcgtagcctcctctatatataattatttatattagagatatgctttattttaaattttcatacatatatttttatcatacttcaaatattttatatagattttagttttatttaatctattatttatagtattaaatagatagagaaataaatatagaattcctattctatatatatagcgaggatgtaatacgatgctgtcaaggaggatagagaaaaaaaaatgtctcatgtaaggagcttttacatgctcttatttgtttgtgccggattgatgggtcgaaacgatttctaaccgaattgtttatctaatttatataaattttgattagctaaaacgatttcgagtgcaatccgacacaaacgaacaaggtctaaggccttattcgtttataccggattacatccgaaattgtttcagataataaaagtttatataaattagagaagcaatccggttaaaaatcttttcgaaccaccaatcccaaacaaccgaacaacacctgataaaatactccctccgtagaagctttctaaccctccaacgaaacactctccaccggtgcagcctataccttaacgtacatgcactggcaccgcaatactaagctacagtacttggctacttccttttgtagatcgactatcagtcgcattgctcggagcttccgagcgggc

SEQ ID NO: 1661 - DNA, 1500 bp, Zea mays
taaacttagtttagccctagtattagtcttccttgatctattagttcacctctcctcggctcaacattatctagaggcgtcttgggtggcctaccgaccccaagacaacccttggatctctcctccccgacagggtccctcctaggaggcgagattcaattttatgtggtgaagaataccctgtgctatcgtggaccatccgagccttaggcgtggaccgtccgaaagaattcgtgaaatgagtcgcttctgcagcgaggtcgtggactatccggcccaaggccacagaccgtccgtgcccccgcaaagagcactattagatggtttattctagtgtttggttccagatttgtgccaacattatcttattttttaaatctacacattgcaatatgaatcatatctttrcatatctatcccatttttgcatcactatggaagtacaatggtgcttatcccattttagtttgagtttaaagagaaaagacttaaattgatttggttttattggtttgtttatcacttgtttatggcatttcatattgatagggtggccatgtcttgtgtaatatcactttaaatatattagaataatattttaaccaacatcaaactaattactccaataaaaccaaaccatctgaatttttctatttagtataacaatcacatacacactacaaatcacgtgatatgtatgtttcttttgattgtctcagtgagaggtacacaatgctagactctacatcatttagacattatttaaattcatgttgtttggaaactagatagccttgttttttagactatctagtgtaaaaatttggtcaacaacaatgggttaaccatattaaggcagtgtttggttgaggagccaagtagaatgaagccattccatccctgattctaggaacggagctgctctattctatgtttggtaatctggaacggagcggttctattttttgtttggttgcagagtgaacggaacggagtgtgactgtgcgagcgggctaggaacggagcggctccgtccggttgattttttggagcggaatggttccggatctgaggagaatattccctaattggagtcattccgttctagttactttgtaaccaaacaacaacaaaactgggacagaacgactccgttctacttggctcttcaaccaaacactaccttagagaggtgtacacttcacttttcagacagttgcatcagccttatgtgtaaataaaataaatgaataatgtgcagaagtgtaccaaattgaaatgtatgatcaaatttgaagagcatgacatgaacaatggctagttaaatcaagtgctgatgtggcataatgctgctgcttgtttaaataatagaaaaattagaaatacttggttctcaaggatgtaaaggagaatgcttgacctttaaatttaatctctattttccctttatttattgctgatctgagttgttctttgtcagagcactacaagttggttaag

SEQ ID NO: 1662 - DNA, 1500 bp, Zea mays
attaggaaggcattaggattttaatgttgtgggattgtttggctacccagccgtggaagaagaatgtatgtttggggtgtcattaggatgagaaacattacaccatattaaatcacactatatatatatatatatatataaacgaattgttggtcttgctttcttcctatttgtatgtgatttcttttaaaaaacaaaaggcgggtctattggataagggatcatctctatatatagtttcttaactatatttatgacaccaaagcttacatgcaatttttttactatctattgtattcggaaaagccatccggaatatttgggttgaagcttgtatcacgagaaattgggccgaatccttgtgaaaaaaaaaaccaaattggacctcactcatttgtccgttcatcttgcacctgaactggccgaaaggccgagacggcccacggaccacctgcactggttgcggccatgggaggcatcaccatcaccatcaccatcaccatcaccattcaccaacgtgttgggtgtaggttgcgtgtgtggctacgaaggaagagcaagcagcagctgcccaaccaactgacaccaaccaagcatgcatctaccggtcagcaggcccattccattcacctgccaccaaactcgtcttcccttcacttgcaatgcacctcaaaactaaggcctcctttggaaaggagtattactaaaacatagtgatgagaaaaattatagaaatagagttgtatgtcatgaaggattccatagaaaaaatttcaagaggttggacctcatgttaaaggatgtttgacatttctaattttccaaaagaaaataaactaatttcgtttggtaaaatagggttaccaagttagctctaaaaatcctccaaaatctcactacaaggctcgattttataggatttatgacaactcaatcatttgttccaaaagaatatatgaaatttttgcatagagtttttaatctttcaaaattccttcactttttctcttttttccaaagaaggtctaaccattccttccttccttcaccacgaggtcaaagcacgagttattaatacccgcacgtagtgtttgacacattgcacacaatcttgtgcagtactagtatcccaccccaattttctcccctaggaacacagttttggactttcaaaaaagcaaaacaaaaggaagagaggacttgtccatgtacaataatactacttcaacacacataatgttaattaagatggacaattactatttcgtaatatttatttatatctatcactgcactgcagcgctgtgatgcttatgtttttttttaaaaaaaaagggttaaaatccatgtccatttctgtgtaacgaccactacttagatcccatctaacccatgcatttctgaatctctctctacataaacaaaaaccagtcctttgttcttcttcccccggcacgcccagcgccagtcaccaaccttccactccctccctccgtcgcc

SEQ ID NO: 1663 - DNA, 56 bp, Zea mays
ggttaggcgtcaatacgtgtacataccctacactgtaacatgaaattgcaaaggaa

SEQ ID NO: 1664 - DNA, 246 bp, Zea mays
gcgcgtcggagcggaggcggcgtggcgacactagttcgcgttgtgttcttcgatgtgtacagtactcgttcgtttcgtctccattggtaaccgggaaggaccgaaggagggtgaggacgtgtcagttatggcggactttcagaaagacgtttccgcatcctgttggcgtacgccgttaccagcttaaaaggataagctggcctcgtcaccacgctccatggtggctctgaagtcatctgttaaccg

SEQ ID NO: 1665 - DNA, 326 bp, Zea mays
tgcagttgcggcgcaatctcctgctgcaaatagtcctgtagcgccgcatcgcgatcgtttcgctggctctcggtgcgccacgccacgcggcgcgccaggatacgttgaaattccccgctgtcgaaatatgcggtggcctgctgaaccgcctgttgtgctgtcatgtttgccctgcctgttataggtctgctgttttttcatctttgcggaaagccagctttgccacaattatcaatttatcgagtaagatttgcctttaaagcaaagctgcgttgcccgatttcgaggcaggcacagacggaggccatggcatgttaagcacggaa

SEQ ID NO: 1666 - DNA, 295 bp, Zea mays
tgtatggaagttcgcgggggccaaacaccttgcccttattacagctcccattccaggtgtccctcagggatctggtagagggatcagtcgctagctccataaaggaagtttttttgtgtctggggctggactggtgcrttgggtttgtggttgtggtgaccttttaggtagtcatcttgttttgttgtggccggatggccatgattattaatttttcttcttctttctttctttctttcttttcttttttgtgtttgtatttggtctatttttagaccctccttttcttaattca

SEQ ID NO: 1667 - DNA, 877 bp, Zea mays
ttctctttgtttctgttccttagactaatctatgacgattgctaatttatttctgttcacttggatagagacaccctctttgtttctattcacttggacataagatggtaatttataatttgtttcctcctgccttttttgaactaatctgcatgcttccacataaacaaggttgggagtaggcatagttcactctaagtcatgtctcctgctgtttaagttcmatatttttgtgaagtctgaatgttcgaaatctggtgccatcttctatagctatgcttttctttgatcactttggttttagtgcatgcttccaactaagcgctaagcggaccgagggacaaaagcgggagctagtagctatcacaacgtacgggcatttactcacttcttagattttgtacttcttagattttgtttttttatattcgcattgtaatataatttgatttgtgtcaatttagttctgtattgattgtgataaaaaaagtttctaaaatattgaggtcgataatatatgttgttcatttttatgtaatcgttgtgcatttacattttatcgaatatttttgtatgacgttgcaacatacgggcacctaactatcttatatatcttttaaggtatgtaaacatctacttttagtaacgctttagctgtaataaaaaaaagataatatgtgagtccacccaaatctcaaccctagtaggtttgatgctaattgaaaagtttcctaccttattttggacaccttgtgctacccactacttggatctcatgctggaggttattgggaagataaatgagtttagtggctgcattgccaaagcaaagaagataactagatttatctatggatatggaaggatttaagaattg

SEQ ID NO: 1668 - DNA, 81 bp, Zea mays
ggtaggggaagcaagcgagctctctgtcggtgggggagctgctggtggttgtaagtgtagagcgcgcgtttggctgacaga

SEQ ID NO: 1669 - DNA, 226 bp, Zea mays
ggtttgctatctaatatttgcgcatggttttgttgttgcgtgaaaagattggtctttgatgtgattgttgtggttagccatcagaatcaggaaatggataataatcttctgttatgtttgatgattgttagacaatttgatttggagatggggccggaaatgatagagcaggatggatggtaggaaaaggaaggggaaattcaggaattctctcaggcgtatggct

SEQ ID NO: 1670 - DNA, 1500 bp, Zea mays
aaggctctgtcaaagtttacgatactatacatccaagctcctcgagttgttgttatttttggcttgactgaactgctagatggttagattcagatcaactctgaattgattttgatgtatatcaaaaagggctttgttgtatgtatatagaatttttcgaatatgaactagctcaggcatttaagagtcttgttcaaatgtttagatatttcagccattgcacaatctggtagtcttcaggccattacctgtgttgtatagtcataccaaccactgcacactcaaccagacttttgaacatttttgtacgtataaatagagcaggatagtaacacatttgtcttgatgctaacagatagtgatcatcgagtatctaccaaaataatattattggttctttttatgtgagcatagataacaacttttaaaaaatatgtctaatgatgggaaaatatgtctctgacaaaaatgacttctaccctagacaacacayttgggttgttggttttattaatatcttcattttttgcattatattttaagaacacataatttttttatggaatacggagccctttccctgcttctaagaattggtatttttagtggttttgagtccaaccttaaaataattgtgtcttcaaaatatcaatctagcattttgtgaaaggactcactttgttcataatggataaagggtccttaattagtataacaagcattatgatggtagataatagtttcatcatttctggtgaactttgaatggcagtccatccaaatttccccttttttgttgcagatcctaatcttttgtagtcatgatggtagataatagtttcttttttaataacttatggtgaactttgaatggtggttcatccagttttttccctcttttgttgcagatcctaattaatgtgtagatttctccatgaattccggatagtttcctaagtactgtagtcagatttcttaactattgagtactgtaaatattctgaaactgaccatagattttccttttaaaggctgctacaaacatatcaattagacccaaaatcggcacgtataacttcaagcaatttttttagtatgctcacgtagaatccttttgagatctaggatcctttgttattatctctaaattcttcccacacatgcacacgtaggtaataaagtcacacaaaccattttaacgttgataattcagacattccattgttgggtatgaatgtaggatgatatagatgctagcatatcatgcaagctaaratgaaattggcacaagatattatcccaacaattacaattattttgctgtaaccagattgtaagccggctcatcctatccacgcgtcgtgtgtcctcctcgctgtacctyaccttctccacgaagaagacagtcacctccgttacccaaggatagatcgcgggttgaccctgacccctccatcaccaatcggcgctagcggcatctcttccccgatgtaattactg

SEQ ID NO: 1671 - DNA, 167 bp, Zea mays
ggtttgatcaagatgcccacttttaggcatcacttttacttcagcaacttgggtttctcaaatatgaacggtgtttgtgtcggcaacaggagaaggaagaaaaacttgaaggtgatgctgcattgaacaagttcttccgtgatatctacaaggatgctgatgaagat

SEQ ID NO: 1672 - DNA, 247 bp, Zea mays
tgtccaaacacatttgaagtaggcttccagatacattgttggtcataaacttagcacctctgatgcataatggaattgacctaatcattgcaacaactgccatgtagtatctagtacttgttcctgactgagtaggcaattgtttaggcataagattatatcgggatgtaggattctaccaggaaacaccacctggcctgtttgtacatgcaatacgataatatcacttggaaaatgaaactagtag

SEQ ID NO: 1673 - DNA, 207 bp, Zea mays
tgtccaaacacatttgaagtaggcttccagatacattgttggtcataaacttagcacctctgatgcataatggaattgacctaatcattgcaacaactgccatgtagtatctagtacttgttcctgactgagtaggcaattgtttaggcataagattatatcgggatgtaggattctaccaggaaacaccacctggcctgtttgtac

SEQ ID NO: 1674 - DNA, 247 bp, Zea mays; identical to SEQ ID NO: 1672

SEQ ID NO: 1675 - DNA, 597 bp, Zea mays
ggctaggtttctggattggrgatgcaggccgcgtgaacaagaaacggcggcgccagacttttgacggcgtgagcacagagtgaatttaatgttgacaccagagctaaatctctatctgttgtccatatcaggaagagtctgtcggctgcgtctctaaaacgaagaagccaacgccracgcctctatttcgtggaaaccgcttctctcttcttccataatggcaattatctcggtagagagacttccaagcggaacggaagataggaacgcatgaaatttccacgagaaatatgtattcccgtttagggcctgttcggttatatcggaatgagacaggattcattccagctcatcaaaatatatataaattagagaagtaatccggctaggaattaatccggggctccaatccggaacaaccgaacagggccttaaaaaaacctgaaccatatatctgcagttccacaccatttacacagtttcaaatcccattactttctcccttaaaacctcctctcccctcgttctcctccgccwcctcctcccacctccccacacgggcacacctgccctccccgtcgccgcggacccactccc

SEQ ID NO: 1676 - DNA, 342 bp, Zea mays
cgtttcttctcccatccgtgatctgcatttgaactgccaagcagctagctgcgtgcgtgctttgccgttgctgttgctgtccccgctaatgagctcctccgtacacttggccaaagaagcacgctaaactccacgtaccacccacgtgccccggcgaccaccctctgaccctcgtccccgtcgttccccagatctcctctcgcatctcgcatctcggcgtgccaccaccactccgctccaccgctacactgaaaccaaccaccacgccacggcacgggcaccacccaaacccatccctaaatcccgagccccaaaacccccgtacgcgctcgccgcgccgca

SEQ ID NO: 1677 - DNA, 1279 bp, Zea mays
tttgggtcgggtacgggtccccatgggtaattggtacccgttcggggatgggtatgggaagatttttgtacccgaggtcgagttcgggttcggggatgggggcgggtctgtacttatgggtacgggtctggggagttaatccctggtggggaattccccattgacatctctaggccgcatgtcctttcctccgtgccggttagactgaagaagacgggacataggagtgaaggagaaaggaagaagggaggggtagattagtcaagccggcaatgtataaccatgtcgcgctggttagaggagcaatggtaccaaagtggtgactgcacgagctcgacaatgccacaatggtgaggacacgatgcaagatactaggaaggtgtttggtttgggtaatcgctccatccaaaatgtggtggtgcatcatgggttcattcctcaaatttgatggaatgaccccattcctcatattagtactaactaactaactataaggaatgaggtgatgatggatcaactcattctattccacaaaccaaacaaaaaagtgaggaatgagaagatggtggactagcttatttctcaaaccaacacgcaatataaaaacgttaatgagcctttatagtaaaaatatattaacatatgtctatatacacacttttgcatgctacaggagagagacatcatggacattgtcgccacttatgcctacagttacgggcgtctagctcactttgcatttctctcgctggtatggtgctagcacattgccattggtgtcaaaatgtttcacctccatatcagctacgaacgttgggagcatgagtagtgttactgatatacgaggagatatgtctacttttattaaatcctcctgttttttttattgcgctgcatgttccactcttattttatcttaattatacatggtatgtatgtttcacgttatctcagttaaacatgacacatagatatgctagcacgttgctgtacgtagtattgatcacgcatccaccgtgccgaaaggatcccgagcaaccaacggtctgaattctggagcgaggcagcacctcgttctgctcacaccgttggccgccttcctgtgatagcgtcggagcaggctgcttgcgtactcggcttaacagcaaaccacatatctggcttgcggccacatccatcgtagtcaggcattgaattgccggttcggctaaccaccggtgctgcataaatacctggcacgcacagctctgaagtggcagcaccaccggagaaggacacg

SEQ ID NO: 1678 - DNA, 175 bp, Zea mays
cctaaaaaaaaggccaactaattatacccagattaattaaaaatctagctaatctacctttacgggcttgtcaattataccatagctggactgatggagtacatcattattgcccccgcgcactctaccccttccccttcctccagcaccccttctgctccttcacttcaccaca

SEQ ID NO: 1679 - DNA, 339 bp, Zea mays
ccccaccgccttgcgtaacgcggcattcatccgcccctgccagcccgccccatcggcgcgaaagcgctcgatcacgtcgaggtggagccgcagcgccggcgctgcaagcctacctccccgcaatccccttcttcccgctccgcttctgcgctatattccccacatggccaagctctcgcccattgagtccgagttcgagtcggccgaagcggccgaagcgcatgatcgctgggtacgcgagaaggtggcgcaggcgcttgccgacccagcacccagtatcccgcacgatcaggtgatggccgacctccaagccgttctcgacggacacgcgccccgctg

SEQ ID NO: 1680 - DNA, 597 bp, Zea mays
gtgtgttggcagcccggatgaccgctcgcagggatctcgggacgacagagtggcggtcttggaggttttagtaacccaggacaaattatatatatatatactattccttaagagcgtaacgagggcgtccaccgagcatcaccatgccaccttccgtagttttcaacggcggttgggccccatcaaaaatctaatcctactgtcactccaaagccgactttcttgactaatcggcgacggaatctcgcggtcttggtttggccccattgtgtgcttcctcccgatcggtacttgcctggtggttgataccttctattctcttmccttgtttggtgctaaagggcacaatttccacttggttcttggtatgttggaggttgccaccttctttctggtttgattttttcttcggtgggagcgtcgtcaacgcgacgcctcgagcgggtaagcttcgttccatcttttcggcatccatttacttcgttgttatcgccggcgtcgggtgggaatgagcgatattcacggccattctcacatctttacaggtgcttggctggtggatctattggatttcttggcccatcgacatttgtcacc

SEQ ID NO: 1681 - DNA, 52 bp, Zea mays
ggcgaccggcgaggcggtccctgcttcctctttctactcctcacaagtatgt

SEQ ID NO: 1682 - DNA, 112 bp, Zea mays
tcggtacccactggatgtctaacgtcgacctgcagcagatccatccttctcacccgaaacaatcgatcccctcttatagacttcgcctgcctccaacccttaatcttcagct

SEQ ID NO: 1683 - DNA, 558 bp, Zea mays
tgttatcatctaattaacttgaattcaatggtgatgctttttagtttgtcttaggtatcattccgtcaaaacttcaattctattcaaatataccaggatacagttgtgtggtgcttcacatatctggtgttgggtgatttttaattatattcccaacacagttgtcttttgagctccatgacatgtgctagatgatttcactgagtctttcatagaaaatgttttcaattagagtattctgtatggccttcatagctttgccttttagggtattttttgatttcctgaaatgttattgtcttggtcactttctactttaaattggagttttattctcgacttacctcatagtttcccttccttttgaattatggactcatgtgtacgcacttgcctttctcaagggcttacattcatgatctttgatctattgatttattttgtttcatctgtggcaatttccattttttattggttagtggtgtgctggctttctcagtcacccaaaattatttggtcttctcaaatgtggcctggtgtgcttgaacaggtcatgca

SEQ ID NO: 1684 - DNA, 1500 bp, Zea mays
taggcatgtttcagctcacgcacttgagaagctttcggttgacttgaaccttgccatccactggctgtggcctgtggcgcgaagaggaggatgagagatttggtcggctcatcacggatcgcgataccggcctgtgtgactgagctgacgtttcgggaatattcattcatagctacgccggcgggcagccttttgcctagccctcctcctagcagattcttcgtcgtccgtcggcactgatggccatttgtggtcatttctggcggacttttttttttccgagctctgttatgttacgggtggcacgagcacgacagttggcggaggaaaggcgacggaccgggggcccgacacgtcactgcattgcatagcccccattccgtccgggcagccgccatcgagcccaccaaacatatcccactccttcctttcctttcaggctttcactttgggagagtactacgaaaactgctccccaaaggaacaccgctcctggacctcacgtctaaaaggtgagaaaaaaagtgcgcattccagtttcacactccgtgaacgatggcaaagcaaccttactacctggcactggcaggcaacgagaagtaaccgactccaagccagtgtgtaccgaccactacaccctctattgtcagccgagttcgatcagtatatatatagctcagctgtcagctcacttaactacgaatttcagtttaacattgatacggccatacgggcatgtacatttgtattatactactacccgtatgttataatttagtatataattatattttactaagctgcatataatgcgatactaaggttgcgtttggttgagaagtggagtagaatgaatgcataaaacgtctcaattcctaattttttaatgtttggtttcaataaaagagaagcggagcaactgttggagtctgcatatgaaaatttactataaatagttagagtgctcacgctctaccaaaacgacatgatatgaacgctctcctggacacgacacgagcgctctcctactctctgcacttatatagctctctaaccaaacaaagaacggagcggctgcctgtctatcgtgctccaccctacaccgtaccaaatcacccttcacagcacagcgcgccgttccgctgtttagatgataaaaaaaagcgaggaatgactgaaggaagcaaacaagggatggtccaaggagagcttggggctcgctgccacctcgcgcgccagcgcctaaataaatcactcccacgcacacccaccaccgcgccgagcacctcctccttcccttccttctctctcccaccctcctcactagctctatctagctgagtgaactgaacagcccactggctcgtcttagctaagctcagctgtaaagctaaggttcggagtagctagcgtggtggccggagagtgtagcgagcggcgttcagctcaccgggggctgctgggtgagtgagggagccagcgtcgtgagagcgctccaag

SEQ ID NO: 1685 - DNA, 945 bp, Zea mays
ggtaagcgtgactgaataatctgtggccacattcaggcaagttcctctttgactcatactagaaaataaggcaccctgcaaccacatgaagaacaaaaatccgaagcgcaatgtttttgtcagggcctaaggaggcccactgaggggctgcggccgcagcaaccatggaccctctaaggggattagataaggatagttagagataagattagaagattagttgagattatttaggagattagttgagattatctaggaaggttatcagttagtagtttgtagagagtttttaggagagttttaaggtttttaggagagttttaaggagaaaaggatctctagttagataggaatggccagctggcccatttatgtaatcaatggatgagaaataaagaatgcaagaattagaagtgagaaacccttctcttgctcggccgtgggcagaggcccctggccgacgttcctgcccatcgatacccctctccaatccctcaccggtccataacaggttatactccatgtttgcagtattcatttcctgtaggctcctttcattttgtaaatatcaaataccaatatcactcttggaatttgaaagtgattgttagtaacatttacattatttgatttcatgaaacactagctgaatagatttttttccatttgccataagtagcacatgcactgaattgccacattatctgtccatcttgttcaatgcctttgctttatgaattacttcgccttactactattaagagcttatgaaaatctttattcttctgaccaaccttcagaacatgtgtgagggagtgtcaagctacagggattattggggagaacgtgatcagccattgtcagttcaaagaggacaacacttctgttggaggctcttggtataaccaggagcaaatttatatccagtggaaagaactgaactgt

SEQ ID NO: 1686 - DNA, 145 bp, Zea mays
ggtaagacgattgcttccagctttcagcttattaaatctgatatgcttccagctttcatatctccagtgctcacacaacggattcttagaactggcaagtaaatcaactttctgagagtatgctgtgacgatagtggctgggctg

SEQ ID NO: 1687 - DNA, 1500 bp, Zea mays
tccctttcattccctatgtgcgataatgttattgcggtgatagcccacacgagcgttaatttgtaggtcaagctgcagagtgctcgttgtgtccttgctatgaatcagggacacatgtactcagcttttagtaatgtgacacgaaccaaacaacatgatgtaccggcgtgttaattgcctgtacctttcccttctcaatccgatgtgcaatggactttatctcctgagtgccccatgattatgaagtaatgctacttgacaatgggtattagattgtaggttaagctacaacggtgtggttctcagtaatcctttttatgcattatcatccgggatcattttgtttggaactcccactgtttttttcaggaagcaacagaacgtgcccacacacagcagcagaaaagcaaatctagaatacgtagaaggctaaccactaaaacttgcactctaccactaggttacgttagttgatcagtagagtgtgctcgtttctaaaggccgcgaccattttgttcagaggattgaagctcactcttcttctgcacttctcttagatgaccattttccataataataaaaactgaaacctgatcttttctagctgtttcagtttcataaaaggcttcgttgttatctttgacagttttttttcaacaccgaagaataaagtgaagttcattaagcagcttttgaaggtaccggagactgaacgaagcgaagggaacattatcttgctgtggacgcctgcatcaaaagcttgagttttctgtaccaaaccattttaattccaggttaaagttcatctgaaaaaaagtcaaaaagcaacacaaaactatctgatggcatactggcaaattcgagcacaattgccgcgcaaaaagttgagtctggaatccttcaggtttcagttatagaaacttgctcggttcgatgcaatgcaaccacaaaccaaaattcttcaaaccagaaggatacggcacagcaggattaattgcactgcacacacagagattactaaccagcaaagcaagatattcagcgttgatatgatcttctccgtcctgaaatgctcaaaatccactggctggcaaacatgcaatccaaggactgggtcgagactagttgatcaaaacatgcaaactaccaacctagaacttacccacaaacgaagaaatccctaatcagctgcatcttatcccctaacttttctcatccgtgggattgacggagacaggggactcatctatttcgccaggtgtcaacggcggcggagagagccgacggtagtcgggcagacgacaagcgcggcagagctgagcatagcaccagaggatgctttacgattcgagctatttctgagttctgacaggtgggacccgtgttcagcgggagaccgggttaggcttcagaggagaccgagtgactgtctgactgacccactcgcagtctcgcacaactagccatcctgttagcttagccctaaactcttctttcccg

SEQ ID NO: 1688 - DNA, 589 bp, Zea mays
atccaagtttttccacttcccaactataacaagagctctaggcattcagttctagacacattcaaagagatcaaatcctctccaattcctcacaaaaccctagtgactagtgagagtgatttgccgtgttcatttgagctcttgcgcttggattgcttcttttctttctcacttgttcttgtgatcaaaactccattgtaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaacggggagtaggtttgagagaaccgaacctcggtaaaacaaatccgcgtgtctcacttcattatttgcttgcgatttgttttcacgccctctctcggactcgattatatttctaacgctaacccggcttgtagttgtgtttatatttgtaaatttcagtttcgccctattcaccccccctctaggcgactatcaattggtatcagaacccggtgcttcattagagcctaaccgctcgaagtg

SEQ ID NO: 1689 - DNA, 771 bp, Zea mays
tgtaaaataaactaattcatacattaattaatattaatatatgtgaattgagatgaatagtgaagtaaccaaacaaaacctcatgaatatatacgacatgaaattagcatcttgggagcggacatgcgcttattaatcgggatcagtacgtacttgtcttttacaagagcaaatcatgagcaaggagtaaggctgaaggttgcaacagaacgatctggcctgacaggggcctgatgcagtctcacttttttcatggcagctggggtggccttgtcgtcgagatcggttcgattctcttttatttaaaatagaaatatcaaatctcaacttaattgccaacttatttttttctccaggtacaagcaagcaaccactcctgagtgacagaaaaaaaagagcaaaaaggaaatacagtttccgtttcactgcactagaagcaaccaaagacacataataaagctctggttcactgcacatgctgtggcatcatggtggtatggcggcattcgtgcaggaccgacccccacctccacctcgtatgctctctctctctctctctccttcccatggctgatgcctgacacggtgacacccccaacattctccctcactagctagctgtgtcctgcctacctagcggtatcaatacccggctgcagctcaccaccaccaccaaccaaccaacccacagttcccatataggcagccatcggctacacagcctcgcctccgtaagcagagtgtgtcgttggaagagagacgacggcggcc

SEQ ID NO: 1690 - DNA, 1500 bp, Zea mays
tgttagagatggaaaatgttaggtggtgagtctacttagatagtgataggacgcgaatcatcgtgagtccataccgtggagaatattttttagagaaatgctcttgtggagaaggctaagaagtaggggtggatacgacctggctcaactcgttaagtaactgaaccagagaattagctcgatttggctcgtttgcaagcttgagctgactcgtttagctcgcgaggtacaacaaaaaataatatgcatatccatataacaataaaatcatttgctagttaattccaaaccaattaaacaccagaaaagagtaataatgcttaaaattttatataccaagtctttcaataccaaattaataatgttcgtcgcttattagttcatccaacacaagtgtaggttttgttttgccgataaatgctagctcattcgaaccaacgagcttggctcgagctcgactcgagctggctcgtaaataaaccgagctgagatgctagctcagctcatgataaaattgaaacgagtcgagtcaaaccgagctgaccacgagtcgagcgagctaacgagccacgagtattttgtccagccctaccaagaagattggtttagtgatccaatccatgatgctaacaaaataaatagggtagattagaataaggttcaaatgatttcatattttctttggattttgaccgtggcttttgtcccccacaagttcaatcaaagagtcaatccaatcaacaacttttttcaaaaactgacttctcacaatgcaaaattgaaataacatctagacctacttttagtagtttttcggatggaagaactctgtaaatatacatttaaaatttttagtggcttgtaacggctttcaccaaacgacttttagcttttttacagctcataattcacaataaatttttcacaactcataattcataaccacctttttatagtcatagttcaaccaaacagacctcaaacacatcatgaattcctcattaccgtcctaggtgtgacacttctagttttaggccttctaaagccgtgctcagtagcgtgcatatattcatataaaacacaacactgttttatgttgtagtctgtattatttatatagtgaaatttaaaatagagaatgtgataataggtgagagaagaaggttattagagataacctgaacatttaggcccgcattggcctgctgctgagttttgatcgatgagttgtgggcgcacctgggacagaataccctatctcggtctgcccatgtgaaaaaaacagaaaagcaagcagcccaatcagccccaccaagaaaagccgaagcccaagaagcccagtgagcaccttctccactaggttagtctttagtacacggtcagccgcccgagccgggtcggagttgagcacttccccttctcctacccttcacctcccgtttgcccgcagccgccaccgcgtccccaagcactccagcgcccccgtccccgatcgacgcc

SEQ ID NO: 1691 - DNA, 1500 bp, Zea mays
actacgtggtgccgtccgttaggacagggtaccctgttctgttcccctggagcctggtggtgcggtgctgatccaagagaggataacggccttctggtgaaggtaggagtgagatgggacgacgtgtggacgctgtcgtccgctttggtctccttttgatccatccattccttgattggacatgtggtagatgcatagcggcgcatctagaacccatcacgcatgtagtcgacacggacatataaaccgtattagctgctgacagacaggtgttgggctgtgtcctacgagcgcacgaacgggtatgatggcgccgcctcgccacgcgctggtcgaagaaagatgaaaagccagtccagttcgagtggaaaactgactgagcgcgcgcgcgcggagagatagacacatctccggaccgaagctcccttcgtttttttcctttttgacaacgacggcaacgagttcgtcgatgtgacaatgagcttggcacagttatccggcaggcccatcggcagaagaacccaaggcaagcggggcagcaggccggcccagatcagcccaatgctgcaaactgaagcccaccagcagccgcaccaggcaggcggtgggacccgggcggcgttggctcgttgcacgaagaggcgtagctgtcgccggctgcgctgctcctctctctctctccctgtgcgtgggtagcgagtggcaacggcgacccggccgtgggtggagacgacgcccacactgtttgctgccatgattgagggggactggagacgacgtcctcctccgtccccatgctcctctgcccacctgcacggacgcttgagcgatgtatttggatggctcgaggtggaccgtgggcagaggcaggtgcgaggacagcggcgcagccgggcgcgacagtctgcagccgtgtgttagcccccaccagcttgtactcattcgtgcgcgcccttaattttacttcgctgcacctgtaccacttgatgcaacggaggcactggtgagagtagaccgtcatccgagggcatacgataattacagtccaaagtagcggcttatttcttgtaaataccctcgttacaaatctgctcatgcctcagaacattcagactgaagcaagataaggcggtctcaaaacaaaacaaaacaaaacaaaacaaaggtaaggcgacaacatacccacagcgtgcaaatggaaatgggtatgtatatctgaatagaccggcctgcgcatagttgaatcacacccaagtcccatgggccttacggtcctccgtaggccgagcattcttcgtgaatatgggccgaacctttcttttcttacgccgaacccgaccatcttgctagggttttgctccgctgctcccccgccgcccctgacaagtataaccagccgcgtctcggcaaaaagtcctccgcgacagagagcgtgcagccagccaccgaccacccgcgcagcgcaggacttggggagcaagcaaggcgaagcggcctgcc

SEQ ID NO: 1692 - DNA, 699 bp, Zea mays
ctgccactgcttgcccatgtcatccttgcttgacaaactggaagaaggatcaaatcacagcgtacttttcatctactacagctactcctaggagccatcagcactgtagctaggcatgtccatgttcccatccatcagtacccctcttcaatttcgcccctaccatgcaagcaagatccagccctgctcccggcctccccctaccaccctgccttcaccagtcatcatccctccgttttctacgctagctcgcacaattccaagggatctagcaaaacaaaaggaagcaggtgggagtggtgcattaatagcgatacttttaaaaaaaacggagggagtatcgtagtaggtgagaaagccatctataactataagcatgcagccgggaagagaggagaagaagagccatagcgaaatccatagggttatttgtcccctccccgattcccacactgttcctgtgcaggctacaggagcagcggcagctagctgtggggtcgcatcacaccccaaatgccctggccgaccgatcgatcgatctgctctccttgccccctctcaccccatctcaccagcagtgacgcacccatcatcatcgatcgagcacagacgagacgaccaccccagctgtcttgcccaaggcaacaagggaagaaggcagcaacccgtcgataaaagcgcacgtcggagcagcagcat

SEQ ID NO: 1693 - DNA, 1414 bp, Zea mays
tggccttagcaagcaccttttttatctgcacaggcagagtcagtaggttattcatctacatatgctgttaagcagctaattccttaatctccaagagttcaaaaaagttctttagaagagaatattcgcacaatgaagctacattatggctattcttacaggtgcacttggataaataaaaaatgactttttagtttttatggttcgaaatcagtttgcaccgtagcattacaaaggaaatggcagacacagtgccagaggctcccacacgagtggggtctggggaagttaaaaaaccgaggcaaacattcccccgcaaatatggacagactgctattaaccagtaacctggtgagtcagtgagacactctcaccactgcatcaggcctgcccttcaacagtataatcttctaaatgatagaaatctgaaggggaaaatgcaagtgtgaatgtaggggggaaaagaaagaacaaaaaggcctgcaaacatgcttcaaaattagggaaaactgccagaagggtcattcaccaaccttaccactaacataaacaagatccccttctttgtgctttgctgacattaagttaagaaaatgttgggaagaaaaacgtgcgccactgaaaaatctgttgaggtgcaagtgaattctcttttgctctgctccagagtgactactctcaactgaagagctcaattcagactcgattatggaacaaccaacaaccacctcaagaagacctaaagtggacttaaccttgattcccctgagaacagtcatcaacaaagtatttacaagaaagcatagtgaaatatcagcaatggtgtactgctttgtctagaaaatgatggacataatagagatcttgcaaaactatatgattagtgtacactgataactatcttaagaaggaacaaggaatttcagaaaattcaataatagtgaagtggtggtttccattttgtcttgcatactttaaatgcaattgagatcttccaatagctctccatattttcttcagtaatcggcaaaattacaattttttgttyttcaaaagaatatatattaacgtattcttatttgctcgatccacacgcatagtcaaacatgaatttgcttgctgaagaaaacaaatcctttataattcatcattttaaccccttttaaaaatgtgctagagcatgaattgcttcatatcactgtaaatgttttgtctgacttcctcaaggtttgggacctcactacagactgggtcttaacaccaratcaggaggataagcatagctggaggctttcaagctcaggtttatattcggcaaaaatcggcatataccggtttctttcttggagcaacaacttttaaaccttgggaaaggatttggaaatcatgggctcctagtaaatgcaagttcttc

SEQ ID NO: 1694 - DNA, 136 bp, Zea mays
ggtactcatcggttgcgctcccgatctgtcgctatgtttctagttgctgatgtattggcggggctgcttcgctagatttggctgctttttaggtttgtttggggtctaggatttggttggttccgctgtggaggag

SEQ ID NO: 1695 - DNA, 1500 bp, Zea mays
aaacatactttggttccactgcaattggtccttatcgattacgatgtaagctatcgaccatactaccgatcacattatcgatcatcgtcaacccttatctatcgtaacgctctagtgtacaacatttaatgttagactagagccacctcaatgtcgtatcatcttttcttttatagacttttagttataataaaacatgatattttattaagataaatattcattcgagtatgtaattaattgaataaaaaatatataatttctaaaaaataatttaaaattacataactttaaaaatacatggtttataaaaacaaaatctaattgtcatggtacataattggagtgtgggagtacgtgaatgagcccaaacaccccacttctatttaaggtctgatttcgatttttttttggaataaatattttaggcttcaaaactttggctatgcggactaattcgaacatgtcatgtggctataggcagtcggtatcgaccgattcaaaacgataacaactggtttttcagctttcgggtagacactaaccaatctgactctaacatgatgatatcgtttagactaactgattggctaaaccaaccaatctaacattagaatcggtgtggtcagtaccaacgggcgccaagccgcgtcgccagtcggtataaataaagcgtgcgtcgtcacatatttatatgcataggagtgtcaatagactctaaattttacactataaattttaagaatcaaatcaaattagaattaagctatattttatttatttttaaactaaaattaattttaatttaatgctctaataacaaactgtgaaaaaacattttaaatcacgatttgttgccacctctggtcatgcatggagctggtcgaagtcgatagaaccgagtcattccattcatcggtttaccgtctgagacatactcagagccttagttcaagtgcggatagattctcgtggcataaaaagagggcgacaacaagagcttcagcatcacgcttgatatccacgcatcgcatcccatcggccatcgcacgcatgcagctccatcctacctggaccggagtcttatctacatctacgccctctctttctctccgagcccaacttcaaattcctctcttccccgctaagcaattctccgccctagtcgcctatcaccgtctcaaaccgccgccaacggaacggaacaagcacaaaaaataccacgaccacctcgacggatcgtcacccagtccgcgatccacacggtgacagcagcatcagtagtggggagaacgaacaagcgagcgggccgcgaggaactgatacaccgcaaaataaagccgaggcagagcatcgaccgttgcacgcagccctaccccaaccacagagagaatcggaaaagcagggatcgcggccggaaagcgaaaagcttaaaagaggcggcgcgtcacgttgggcgcctctctttgctccccctttttttccttcttggcttgatcg

SEQ ID NO: 1696 - DNA, 1500 bp, Zea mays
acattagctcccttaggtcatatatacatgatctacaaagtttggcgatggtaatgtcgtattttcctattcaagacgtgttgtgcacgccactcgcatcttccttcatctccacaccacgggggcatgcttcgccattccgaggtgcttcgtttaagtcttgacgacgaagctatcgcctatttccctacttcgtcgaggccactgtgatgaaggttgcttcgcttcccctaaaacaaactcgaagatagctaaaattcattagtttgaggacctccaacatctacattgactttgacccgctactttaagcaacacacgctatcgactcttatgaatggaggcatcaatgccttggagcacagatcccttggtataaactaatctaaatttattaaacttaatacattttctgctatagttaatatatttttcatgtatatatattcatcaagtatgtgagtaataataattcatatttatccatatatatcatcacaactatgttatcatttttttctaaattaaattaaatataaaaatatctaaattcataacgatatcaatgctaggatgttatagattttactaaaagttacagtttccacatgaccatatcgtaatcttaattcagattcctaaccaacctaaacggttgttttcctcgtaatttattgcacaaatgaaagcccctatcggttatgtttcaatgctagaacttcgtcgacatgcagggctcatatattatattagtaaaaaaagtttgtgtggtttaagcactgtctctacattttgcatggcttcaaaccgaagatctcatacacttcggcaaaattttgccacgcctctactaaacgaatagttagttcttgtagcgatgagaagttgcgccatcacactctttgaaaagatgatcgaggagcagttccggtgtggttttgttgtaaaaggaaaccaaatctatatccatgagtcttttgataaaaagaagaaaatgaaaagccctttttgcctttgtaatgtctccttctcccatgtagtttcggcgtggctttgttttaaaagggaaccaaatctaccagcgagtcttttaaaaaggagaatgctgcctgcctcgcccatgtagtcttttgaaaaaaggctgcctgcaaaaacttgagattcgcaagctttattgcgtccttccagagacgaaaacgacttggttgtcgctgttctcccctctgcgaggaaccgccagagtagcagacgcggacgtacggtacaagccgccgaacaatcgctgtcgcgcgacgtgtcacgcggcgggcggtccgcctcgccctgctgctaatccagttccctacgcgcgctactgcatacagctatatttctctgatcggagaagaaggcgagcgcgcggtgtccaccactccctcctctcctctcccgtcctatccatccggcacgcccagcatccatccactcctcccctgctccggctccggctccggctccgcc

SEQ ID NO: 1697 - DNA, 1500 bp, Zea mays
gccgctcgtcgggtggctgatgtactagtacgtgccgacacagtggtggtcgacagaagggtagaaacagtagagcagaaagttggacaacaacaacaacaccaacatggctagccgcctagctacctcgctacctctcccacacgcttagggaaagaagctagctgtccctctctgcaaggttcacccttgcatgctcaggaagggtttggttgctccctttgccatgcacgcttgcctgcttaggctttctttacttgcgagctcgagatggcgttgggcgctttaggagccgactgtgaagcataccggccacgaagaagaacatggaagatgaaggaatcgacgatgagaataacaaggaccgacgatgagataacagggaccgcgatcggcgatgaatccattttgatagttatagaagggtaaaaggacaatacaaatgtacagtataagcactatcataggtaattgacacggaccaaattctctaattgaataatagcaaccatcagatatcatgaattataatggtatattagaatactaaatttttataatgatatatatgtgagaaactcaaagagagagagagagagcgcgggttgcgccagatatcatgaattagctagtatattagaatactaattttttataatggtatatatgtttgaaactctaagagagagcgcgagttctggcgtaacgctatcttaactgttgttggtgactagagaggcgtgatacctatttttggtttctataaaagatgtgacatgtgagctttaggctatttttaataataatatgtaaataagagtgtaaaatactgttttatattatagatgtatttattgaagggtgaagtttgtaactgagaggtgaaaccgacggatgagatagggagattgctcgatattatattcgacgcgcgctgccactagggctttcagttcagcaacatcagtctatccacactggacacgcagcacttcctcacgcggccgcggtaggaacgagacttggtcgcagtcgatactggctaccggttccttgctgcactccgtatgctgtcgcccgcaccacaagtcctcgaccagcactcccttcatagaccccccctccggcgtatccctcagcaatccagcgttcacacgtccttcttgcttcagtccactgcaaggtaagccacaaaccataacttatctccgtttccgagtggcattcgatttgggcagctagggttctgtaaagttgttggatatggttagatcaggtggaagatgcccaatttcagccactggctattgaatttgagagacatggttacttgtgctctctactagatattccggccgatttgtcctttttttaaaagcatcaatacggattcgatatttttttgaagcaaattactgatttgagattgttgttgtacttttacaacttgctaacgtgactttgtatgctcaactcacgtatataggttaggtggacaat

SEQ ID NO: 1698 - DNA, 507 bp, Zea mays
tcttattatgaattaaataaatatttattttatcatttgaaatcctataataccaatagatttttttatttgtattaaaaacttgactaagacaaaaagtcaaaccctgatatctaaaagtaaaaaataaaatggggagaaggacacgccgatgaagggggcagtacaactacgtacaagcaagtgggagcagctcaagtgcaggacacgcgggctccaccgccgcaactgcaacggcggcaacagcagcaaccacccaacccaacccaacccaacccgcgcccgtcaaactatcacggaggaaacaccgttccggtcaacacgacagagagatgataggaaaaagaaagagaacaggcagagcagcacagacactgaaacaggaaacagcggccgagcagcgcattagcaaccacgcggcatgtatatataggacccccgagggcgcgcgcctcggcagccgctcgagccgatcagcgagcgggcctctgggagaggtagggagcc

SEQ ID NO: 1699 - DNA, 1500 bp, Zea mays
cgtcgttcttctttcccagccgccaccgccctggttgttggatcgaccacaaactccgggactgggtccgtgctctctagcttacgcggcacggacgccgcggggtcacgcacgtagcctatcctctgcgcttggctcgcctgggtcgtcgctagctgctgcgctggcatcctttctctgcggcatggtctaacagcggactcgcgcgttcatcgttaccggcgaaagtcctggcaactaaccgcgcaacggactccgaattagggatggcaattggacccgtggatatggatatccgcggatttcgtacctagtggatatggatacgggtaaaaaaacttacccgcgggtcctattgggtcggatacccgaaatacatcgggtcaaatatgaataaaatactttacccacggaaatccagcggatacctgaaatatcaatatacctctttaaaggtgctacatccactaaaaatgtgctacattcactagaaaaccccacccgcatgtgttgttgattaatgaatattaatttgtgttgtgttaacagtcaactgtaatgtaatcaagaccaatgagacattgacaatgttataactgtcaactgtcatgaactcattaagcttttattctctgtactcaaatttaaatttattggatgtgataattatgagttgagatattgtatcgacgtgtagccaaatatagtcattctcgtgttgcattggtgcttagatgtaaactaaaatattttatgcatttattataacactgaccgaatgttatttagtctacaataacatatccactggatacccgatacccggtggatacccgatgggcatgggtacgggtacagtttctcgcccgattggcttggtgggtatggatatttgtagaagtctcgggtacaatttcgggtcgggtattattattatacccgaacaaaacccgacccgctgccatcyctaatcgggtgtcataggaacctatacattaccactagttgactcaccacattggtgaaatcctaattggttttatgaggctgcggtgcccgccgacgaaaaccttggttttcctcctacgatttcctcatcatttctaattcctctgagcttcctgcgaccgtatgattccaataaaaaaccgaatataaagactagtttggtaactcgattttttcaaaaaattttcatttttccaaagtaaaaatgaactaatatctcttataaaatagatttttttttagaaaaataaggttgctaaactaggcctaacggtggtggtagatacagagatattgggtagtgcacgtgaaaataaaaacagctccatcgatatttcaaagatctagaagaaaagaaaaggaacagagatatcgtcaacgttttccggccttcaccgagagacacgccgaagtctgcaaatcccctctcagtcaactccaagggccaagaccccaatttcccctagaggttgggattttgtgggttcagtc

SEQ ID NO: 1700 - DNA, 1098 bp, Zea mays
cctagatgggggggggtgaataggtgatcctgtgaaacttgaaaacttaagccacaaaacttggttaatcgttagcacaataattgccaagtggctagataggaatcctcaacaaaacacaataaccaataaggatcaatcacagagatggcacggtggttatcccgtggttcggccaagaccaacgcttgcctactccacgttgtggcgtcccaacggacgagggttgcaatcaacccctctcaagcggtccaaagacccacttgaataccacggtgttttgcttgctttttctcaatcccgtttgcgaggaatctccacaacttggagcctctcgcccttacactttgaattcacaaagaagcacggagcaagggagggattagcaacgcacacaagacacaaaaatcagagtgtcaccacgcacacaagtcgcaacaagagctcgcaacacaactcaatgagttcacaactccactagagctctatatgctatcacaacaaaacaaatgtgcggaatcgaggtcttggtgcttaggaatgttgtaggaatgcttggtgtgctcctccatgcgcctaggggtcccttttatagccccaaggcagctaggagccgttgagagcattctaggaaggctgatcttgccgttggcgcaccggacatgtacggtgcacatcggacagtccgatgcctccttctagccattggctcggccacgtgtcccgcgcagattgcgtggccgaccgttggctcaccggatagtccggtgcacaccggacagtccgatgaattatagtcgtatgtcgccggtgaattcccgagagcggccactttgctcgagccagcctgacgcacctgacactgtccggtgcaccaccggacagtccggtgatcccagactgagcagagtcttggctgctcgagccaagacattttcaattggatttttcctgtttccagcacttagacacaatacattagtccataaaacaatgtactaagtctgagaaacatacctttatccttgatttgtactttgtccacctttttacacttaggtacttgtgttggacactaaatcaccaaaatacttagaa

SEQ ID NO: 1701 - DNA, 276 bp, Zea mays
tctcagagaagaaccatcaccactcaccactctcctgcttcgccgtcaccagcggagagaattggctatttatagaacgtttgaaatggtaaataggcgcttcatccaaccacccggcggctcgtctctcgtctcgctctcaccaactccggctccaggcgcctataagtaccctcgcccccgctctcgttcgtcccaggacaaacaccgcgcacgcaccgccttctccactacttacccgaatcctaacgctattcaactgcattctgctccgaa

SEQ ID NO: 1702 - DNA, 211 bp, Zea mays
ggtataaaatactgttatttccatacaaacaataactaacaactccatctcatcatgagaacaatatactaagctagttcgtcagtgtgatagcatagtgctgttctccaactgattcaatttggtttcttatattttgcacccactcccaggactatgtgaatatttttcccaaacagatgacatccatataaccccaaggattcctgta

SEQ ID NO: 1703 - DNA, 1500 bp, Zea mays
accaccctgctaattccagtctgtacgtacgtacgtacgtgctcagcagcagtgttcatctttcgagaatgtaagttttgaatcttgtgagttgtgatgccttatgcatggagtgtgtcttaaatgctcacaggaaaaaccagactactatcaaactctgcttatatatcttcataaaaaaaaacgaactcatctgcagtacagaggttaactggagcgctcgtgccaggtagatctagaaacctgcctgcgccattaacaagtacactatccactgccacccaccagcatcaaccaccaagattaggcaacctcacatccagtctctcaaaacggaatagataattcataacccttgatgcttttggcctgtttgtcatcgtttggtgcagtgcacaccactcaccactcactcaccaactgctacttgcatgctgaaaatctcttgcacaaaaaggtctggtaggggaacgtgctactttcgatgttttgtcagtagtttggtaacacaaggtttgtggctctattatcaggagctggaggcgttaaaggctttgcactgatatatgctcccataaccatactctcactccaacccacatgtctgtctgatgtctcatgggcacgcatggccccctcaaaactgtcactgtatcagggtttggggggtagagaagcctgattagggcacaaattaccaggctggctgaaaaggtttcccctttccctaccctggtttctctggacgcaaaaaaaagaaagaaagaaaaacatagaaaacccggaggactagagcgaacgagggtttcagacctgacctggggcatgcggaaaaggcgtagtggttaacctattcattcatcatccgtcacagcaaggaacgaacggaaccccaggacaggggaaaagttgcgtgtggcgtttttcacaagatgtcacagtcaacggcctttttgcaggctcgccactagcgttggcgctcgcttgtgctgtatatatgcacatacacacgcagacgcagtgctcagtgggggtggatgcagagcagttggatcggggacacacccagagagagagagggctttgctttccgttttcctctccaaatggctcatttagctcttgaccggaagagtggagggtggtggtgcgggtacagatagagatagatggcactcgtcggtgtggacagtgctgggttccttggagcttagcgtgacttcatcagaagacgccgtttgcctgcctggctgcttggtcttgggtcgacgaccggagccccctccctcgtgctcgccttcttcctccctgtccctgtccctgctaccgagtttccgggcgctgaccactgggcaactacagctgatctctgtgagcccttgtttctcttcttcgtctccgtcgctgtttgctcggtgtcttactggcttgccgcttagactcgtttgcatatttttttttaaatttcagttcttgattgactcttagctctgccgcggc

SEQ ID NO: 1704 - DNA, 1227 bp, Zea mays
cgtttattgcgaatttaatatcgcatctgttccgtttgtcgcgagtgcgacatcatttttacttctattatttgggctcttccaaaaaatttcgtgatgatcggaaacatcgtcattccgaaaatcggtgcgtccgatgattatttaaaattcatcgctcgcgcgaatacgaattcggacgtccgacacactctgatgattttattctgagcagattaatttgaaacttgacgactaaagtgttcggagcaaaataatcccaatcgcgcatcgtccgagaaaaatcatgcgcaagattatgacccaatttattccttcagcacactgttgcggctacaaaatcgggtatacgttcacagatattgcttcggctaatttcggtcgaatcacgccgaacgaattgttagtgccgaaatcagtttatttcggtctgtcgtttcttgcccgatccaaaactttggatataaattacgggtgcaaattcatctgattccaagtattcgctaaatcaaaaccgtgattgcgcgtccgagaattataattgagcctcgattcactcgtaaattatccgtggctgtggaaccagatgtttagaccgcaggtaaatttatcagatttcaaatcgaaccaaactgtgtcgcaagtattatcgaccctttaattatcgctaaaaaacgtgatccgaaatatctaggattctctgtttaaaaaaagaatggaaaaagatctactgcagccgccgctgccctgatattttttccacgtcactggccatcggccttatcttttcacgcgcaggcttcttccccaaacccaccgtcgttcttagcgtcaagctcatcttctcccctctgatttttccgccttcttcctccgatgcttatcagccgccgatgggatatttttttctggccaccctgatctttatctacgcgcgtcgttctcttctccaaccggccagcaatccagttcgttcggtgcctggctctgctcgacgtttctctgctccagcgcccagcctgcaagcagccaagcttcctcgcgtctcctatggtcgagcgccctccccatctccttcctcgccctcagctcggaccgtgtcctgctctcagctcccttgccgtggagttctctgtgtacgttctggttcctgctccctctcctatggtggccgcgagctcccctgccccatgatgccgtcgccctcaagctcgtgccccgctcgcc

SEQ ID NO: 1705 - DNA, 911 bp, Zea mays
tctaacaaaaacgcatgacactagaatgtgttggacagtttaatttctccaacctgatcacatagaaggcagtgctcagggtgatccaacccatgcggtgcaaagcgatatgttgtccaacatctgtcttgagctgctaaccacaaaaaaatatttacatcgtggaggtgcccaagtctaccatacacgaccagccggctttaaggtcactactccaatgaagaaacgagcatatgcagatttggacgggtaggagcgaggctgaagatgacggagacaatatgtgttggtcttggatgttaggtgacaagtggacctcctgtagcatgtcccagagcatgaagaactcggagaaaacctgtggggatatgtctccttaatatcgttaacccacaaagaatttagtaaagcctctcgaactgttcgtgaattacatattctcttgggcacgaacttgatcaaattgggggcccaatcacctatagtccttccttatagccatctatctacctagaatattgttgaggacatatcctgtgcaatcactcattttggtgcaagcgtgcaatcaaactatccagagcatccagtctagatccaacggtttcatatggaagtggttaaatgtaaaatagacactaggtttcaggtggaaggggttaaatgtaaaataacagttaccattagatctagatcggatgcaccagatcgcttgattgcatgcttgcaccaggataagtgattgcataggatattttcccaattcaatcgcataaagcaggaggctggagtcattgtctttgtccgcgtggacgcggctgacttgcgaacccaccggaccaaccaggacttggagcgtgcggcgtcggagttcgccggcggtgaggagcagaagaggaagggaaccaaag

SEQ ID NO: 1706 - DNA, 105 bp, Zea mays
ggtacctcttcagatctgattggcttttggatcccatgaggagctccggggttcgcactaaattatccatatgtagccgtcggctatagatcaactggtagtttg

SEQ ID NO: 1707 - DNA, 441 bp, Zea mays
ggtaaatggtcctccagtcatttctccaattaccatatatgatattcatgctggaattgcgatttwataggattgttatattgaagcaccaaaatagtttttccagtgtcggaaatcggtgtcgtactgtcatcaattgttttcctttcatcaaacaatgacaatacatgcttggctrcctttgacaagagacagcatgttattaggaatgcagttggttggtcgttgaacccagatataggccacatgatattttgcttagatggttgcaaacaatcaccttttggtagactaagtagctggtatctttcttctatgaaactcatggttcaacttatgaaacacttaggcaaatattcggaaaggaatcttggtaaattcacctgtttttttagaattatgcctgagcatcgataacttgatcgcctatgactccactcg

SEQ ID NO: 1708 - DNA, 700 bp, Zea mays
ttgcatgtgctatcacaaggagacagttagcatcgagcgaacctggaattctgaacacagtgtatatgaatattctgctcgcctctcctctcctaaaggccattttaaaggacgcgactgcagtatagtcatgcttcactttaaccttaactatttgaatttatactgcctatagctggctgggaaaaaaggcatgggtatttatttgtgaagttgtgactatctgaccattccaagtagttgtttaactgagaaaatcttggatgaggacaattgtgttttatgtactaataatagccagcaaactctgttatcgttaaagtcactatctactgcaccaaatcatgtcagcttgcccccacccccattacctgctaaccagcagagtgttgctcaactttctgccccgtttccatctggcttgtctaatgtgggatcgaccatggaccctcctactattttagcaaatctaccacaatcaacacaagcaaaaggataccttatccatcagatgccttcatcagctcctcagccatctcaacatccaaatatggccctacctcatgctcctctacagtattccaatgttccatcacatatacctatagttcatagttagtcacaacaacctttgcaaagtcctgcaataaataatcaacagttgcaaccacctttgccccaattgtcaaggccaccatct

SEQ ID NO: 1709 - DNA, 653 bp, Zea mays
gcacggagatataagctagttatcttatctagatgacaagtcttcttagataaacaatgcacttatttatatatgtattttttttaaattttatatgtggagatcacatcattgtgattattatgcatacaaacaacatatcaagccttaggggtattatagataatttatattcaatccataatttttcacaacaagttcaaccaaacagcttttagctttttcatggctgtaactcacatcaaattttccacagttaacaggtcatagtggctttttcacggttcccaacaaaacgcatcctaagggctgatttggtgaccagggatcccaaagggatccatgggggagaaatctccttgcaattcatttttgaataacaagagaattactctcatgaatcatctcgagatccttgaccaccaaatcagctctaaagtttctactaacccaagcacatccgttacactgctgccccgccaaaattgcaggcaggcaggcaccaggcagccgccagcgtctctctctgtttctgaaaccatccctgcaggtccctgctccctggttatattaagcagctcccaatctttggcatttgcaggcacacaacacaacacagttctccctttccactccagtccaaccaaccgtcc

SEQ ID NO: 1710 - DNA, 91 bp, Zea mays
tgttccactttcatttatcctgcatatcgctgttcatgacattaaactcacatacattacagttctggtttctacttcctagtgctgaagt

SEQ ID NO: 1711 - DNA, 419 bp, Zea mays
ttcttagcgaatagccacctcttatatttttttcacttagtctcttataaactcctcaagagactcaatactaaatgaggttgtacatgccctaacgcctgatcatcaaaacgaaatagtctcaaacctaactaaggcagaaaatccaaaaaaaaactcattaacgaatgcaaaattacaggcggttcctcttttgctaaatacaccctccctctggccacctttctcycactgcctcgtattctattcccctccctcgccatctccgccgtcgttgccttctccaatccactagtcgacaacgcacgcgcgcaccttctcccgcggcggcgacccccgcggcgtcgtcctagggttaggattcaggcgacttccctcccttccgtgtcgcggcgaacgcgtgggagataatacgccct

SEQ ID NO: 1712 - DNA, 1189 bp, Zea mays
aagagcttcctagaagtgtctcctaaatcatgttttgtaggaaaaacacaaaaagtgtctccagcaatttacctaaagtgcttccaaattttttatagcccttaaaactactttatttataatgacaaatgaggtttttttggctccccagaaataatctaccgctttaaaaagtctgttggagaaaaaattaaaatctaccgccactaaacttggattttcagaagtcatttccctcttggtcgcttggagacccttaccgtatccgtgtatgcgggggtcacccattaattgccggcgacattttggcggtaacgtggcgccgcgaaccagatgatcgccctgccgccttggctggcgcagacgatcggggttcaggcagagcagagcacacgcgagaggagcctgcggcggttcgcggttagcggcggagaccggaacggaacacgcaaagagccggccaccctggccttgctattgcctcggcgcgtgatgtggacacgagatcggcgagccggccgggctctctccgccgcgaaacgtgccgtatccttcgtacaaagcgtgagggggccgttacggcaagtagcagggtccgggcaggcgcctcacgtactgcgccgcatccatgcccaacgcaacagacggccaggaatggcggagcttgggccggacgccgcctctggcgtttgacatgtcacgggggcgttacgacgaacggaagcagcagctagcagggcaagctgcctgagccaccacaccagccaatgcaacgtgtacgcgcaagcacaaaccaaaaacgagatggcctccagcaaaataataataataataataataataataataccagctagcagctgggcttacgtgctgcgcgacaagtcattgtgtaatcatatagacctaacgggcccaccctcacttgttgagctctcttgctcttccacacctctccccgtctcctccctatatataggacgcccctgctgtctccaaggtccccaagagcccaagaaggcagctagctgagagcctccagctcaggtagtgagcgagctcctctctgcccctggcctcttcttcgttcattcttgtccactcgaggactgcccgtttgacgactgctcgatcagtgtgctagctagctagagcaagagaagggctgtaagcgaggagatcgatcgag

SEQ ID NO: 1713 - DNA, 271 bp, Zea mays
aagtgagctctgatacgatgcatttggatggagagtttcagctcgagggagtagtagcagagtcacgtagttcatttggtgccgtgaaagggctgttgtcttgtttccttcatgcatggcaatttatgttttagagatgtcatactctggaaacagttccctttttttgatggtacgaaagctcgatttgtcaagctaccatggccttcaacattgaagcaggtctggactgttgttgcatcgatccacgggtcggaaaatttcaaatgta

SEQ ID NO: 1714 - DNA, 1500 bp, Zea mays
tataaataccctcaaccagcccattcatggcatccaagtatttcattcactctcattcaatacaagagctagataaaatatttatatattctttgcaataactccaagccatccaaagccacacaagtgccatattcaagagatttgagctagagaaaaggtagtgccatgtgtgtgtaatcgtgttgagttggttgttgtgttctgttgctcttgtgcttgtgttttcattcttgcattttttgtaaaggccagcaagaggctctgtgttgtgtggagatccttgtagagacttaggtcctttgattgagaagaaagagagggcctgacttttatctttggaatcgctcaagagggttgaaagagaccctaatcatttgtgacacctcaacaaagatatatgttttatttggaaaccaaacttcggtaaataaatcgctcgtgtattttgtgttgtattgcttgtgatttatttctcccttccctctattaagttctattgcttgtacttgattctaaatcatttgggttgctcccaagttattccgcaatcataaaaggggcaacactagcaagaaggactcatctcccttactccaatttgttttacctctctttttaatgcctaatcgaggatcaaagtttttgtattaaatgataaatttcagattttgcctattcaccccctctaggtgactttcaggtcgccatttgggttacaccggactggtctggtgacctttcacgtcagctagttgttgctgctctggcatattctttacttcacgctagaggtccaatgtgtatctagactagtccgccacgtcagatagccattggcgatcgttgagccttttgtccatcctrccaccgatgcctcactgggctagtctgatgcgccaagcttagtatgccgaagaatacactctctgcgtactcagtctgtcatgccacatgtgccgctctagactggtctggtgtgctagcatgcatagggtgccgaatttgcgctctctgcgcacttggtccggtccccagtccagtgcacccaaaaatagcacaatcttcattttttcaagtatcttcacttagtcttttcttgtcttctatcttggactttgtttgatattggtaagtcttcaatgagtcttctaatgttttctttgaggtgttactcattaaatgccatagcccaaaaccactttgcatcatgtgaactataaacataaacactagcaaacacattagtccatatgttatgttgatcataaaacaccgagatcccaaaatcaaattggttaaggtccattttccttataaactttaccaaagtaaattccatcgacatacattaaatgacgtacaactctcatgcacgttcaaaaaacagtttaactccaacccttttaacctttaaaaaggttaactaatctaaagaaaaacaaaaaaggaattctattgaattgtatttttattgatcaattagaattaccttctaga

SEQ ID NO: 1715 - DNA, 107 bp, Zea mays
ggtataacaaatccattccttgaatcttttacacttctatactcctccactgagttaaaaaacacaagtacaattgacgttgaaatcacaggggtgcagctctgccc

SEQ ID NO: 1716 - DNA, 281 bp, Zea mays
gtctacaagattcaccgtgaaccttagcagcacaaagggcaacggccgcctgccgctccaaagcagcccgtggttacgtcagcgcccgcgtactgctcccttcttcctcgttgctccgcccccttttgtcgtcgcgtcctcctctcgaggcctcggcagtcggcacgaggacgcgcgatcccgtcaccgctcacctccttctccaaacactgactccgcttcccgtccccatcccgctgcgcaagatcgggaggggacgaagagaggtcgaccgggaggag

SEQ ID NO: 1717 - DNA, 975 bp, Zea mays
gattattcaaatggtaaaaaytaaaactatacatgaatggatattcaaatcatggttgttgtttccaaactcaaactcataccaatctagccaacaaaacttatataggattatgtttgtattttataatcagtattaagcataaatgaaaacgtaataatgtactgacactttgctagtttatagtaattgttgatgccaatgaactgcgggtgaaaacgttgtgcttgctctgtcgcgtccgagatagaatgacgacagatagaatgacaacgtgaaattctctgtcggtaatagctctctatcttcatcctcgtgacgaaaatgtttaccagcgatgatcccacgaacacttgcgagaatatttctttctcatactcgttcctcgcggggataaatatccgacgaagatcctcgttcgtgattaaatcataattaaaatgtacatcatttgttattaacacaaaacattgtcacctatacatattatcagatgtaaggaagcgttatatctatatcaaaataaacgcagttatataattagtgatcttttaataagataattatttattttgaccattaatattacacgaaaacatcgtcacgtgcaaatttaacgaacgaggatcggaaatgtttcgccgttttcatctccatttacttgtagtagaatttttttctattttcatacacataggaaggaaacttctacattcacaattttcaatggaagattttcccacgaaaaatcagggatcggatcccttctcatttctagtccgagatcacccctcttcataaaaatgctggagatatttttctccgcctcctcattcrctttccaagttgtccgaaaagaccagactaccctgttcccccgaagtcagagggggagaggaggctagggatagcgcatcgtcatcgcacctccacgcgccggcgagccagaccaccagaggcagcgagcaggcagcg

SEQ ID NO: 1718 - DNA, 1500 bp, Zea mays
ccatgtagacaacaagatcatcatgccctaaaaatatttaaaatttaaacaaagaccattctccaacaactctttgacgagctctgaaaaagaagttgaacttccatggcgcatgcaaccacatttggctcagtcaacaacctgaaatagcgtgcagcagctgcaacaattcgcaaggtgaaatgacacacaacatctactatactgacctggttaataaagaagaaaacattttttgaaagcaatagtgtatatcaacaaagatgtcaagtaacgcacttcagaatcatagtactactataccgagctggattctgaagggaccgaatatgacaaatcaaacatgtgtctagcctaccaaaatggctagacaaacaaaaggtatagcaggccaaagattatgtgaactaacggtgcgaaccgatgtgagtgtctctggattggaggcgggatggcatcggggtcaggtgtctgcacctggggccaggagaccaatggtgaaatggcgcctctatggatcggaggcggggcggggacggtgtcgggcatctgcaccgggcccggaagattggcaactgctcgtgtcaagagtgggttgtgtcgtcagccgtcgggagcgagtgcaggaggccgaccacgacggcagcgaccaagaggttggaggtggcgcgcacaactttttttgtcgcgggaaacaaaaatacgcagatagggacgacggtgggtcggccccaaacctgtatgagaatgctctggttttggggcaccgaacactttgggaggacaaatcagtaacttagattgagttttctcaccttcatcttaaaaaactattgttttgaaaatagcagttgaggcctgttggagatgctctaacaatccatagcagcttgagcactgatcaagtgaccaaaattagatcatgctaccgttttgttgggccatttgggctagttcgtggtccacgatgtggctagacattcctcatgtgtttaactacctgccgattaggcccaaaaatcaatatcccgactgttctcgtatggttcagcttttgtgattggccgcaaagctgcgagccttttcaccccttttcggtgcaaaaggcagcgtgggcacagcgtgacccgactcgaggaaaaactgatctcaagttccgtccatgcggttggtgggcgaaaaggacaagcgcatcgttcaccaactctgtactgtaaacccagtccacccgccaaaccaaccaaaagaggcggccgtgcccacatgtcacggaaataatgtagcatcaccatgcgtacgtccaccaaccaccgtcgaacacgaggagggtgacaggtgggccatccgaggtttgggcgagcccaacaaaaacccctcttcaccggtcaccacttcatctcgcccacacgaactcgagacctcgcccgcccaaatacaaaagcctcagatctcagtgaccagcgccgccgcttcgttcgtgtcgaatagagaagagaggaa

SEQ ID NO: 1719 - DNA, 539 bp, Zea mays
tcttcgtcctctagtactccctttcccataaaatcatataaatcagccttgttcttacctatattaatctctaatttttttaactggccaatagaggaagcaactgaactaggattagaacccgctaaaatatcaatatttttaaaagaatcaaaaatataattatcaggtaaaccaataaaaaacattattacctttagtcggctgaactagtatgaattggcatcggtaggaaatgcagttcacacgactaggaaggataaaatcgcagccctaaactgtaaattctctttgtgtaaactggaaaacgagaagtttctgaagtaaattagcttcaatgcccgactcttcgtgcgaactggaaagacgcttttgtcgtttcgttttctgatctgtgacctgtcagactccagggcgattcagcgcatgctgcacgcaccagccaccaggtattttaaggggtcacacttgcttgtttcatgtactagcacaagaagaaaccgtaccacttcatcaggccaaatcgccagcaatccacc

SEQ ID NO: 1720 - DNA, 1216 bp, Zea mays
cattccttttctctcctccacacttttatggctctataaccaaataatgaacagagcggatccgttctattctactcttcaaccaaacaaaaaaaatgaaacgacttcgttctaattgccaaacacaaaattgaatggctccattctcataaactgaaatggagtcgttccattccagttgactctcgaaacaaacgcacgagtcccacgagttgaccttgtgcctttgctctatgtgtgtgcattttttgacgcaatttgaatggtagagttatatttgttttgaacgggggagtaacacatacattccgtcacctacattccatcacctaatctagctgtaaaatcaattaggccttattagatactctcgtattcacctcaatccatatgtttgaagtagattggagtatatataatatgcaattattttaataatattttgtatcatcaatattaatttttatatgatcttgcccagcatttaaaccattttatctttttgaggtttttaaaattttaaaatttttatttattatagtcttctgaattgtttaagatctgaattcaaaataagctttgccagctaagcctaacaaattaatttaaagtcaaaagtcattaaaaattaaattattttcatttgaaaagaaaacaataggtccaatcatatttataccactatataattcaacagtttaaacttacaaaacctactcaaccaaattatttccacacatataacctttactaaatccaccaaaaaattcatctagacttaacacaccatcaaaattaatgatttacatcgctgaataactttatttccctctcaaatttaataaataatattattttgattgtccatcatcctctcatttcctcagcctaccccttccccgcgtcctcgctgccctctcctcacgtgtgtcatcgccgccgtcgttaatctctcctttcgcatcgtcaacattgtcatcggcctctctgtctcttttcttgcgttgtcatcgtcattgttttttatgagattatagcattagcatagaatatatattagttcttgtgaaattagccaccagttagctcaagcaaccttttgtcagcctagtcaaatagtttttttttttctcgcacggtcgcacggagggagtatcagtctaccacgctaaacaggaagccggagcaagcgtgtacagtaccggaatccagcacc

SEQ ID NO: 1721 - DNA, 267 bp, Zea mays
ggtatgtctttctataatgtctcatgttttatattttatttcatattgtctcttaagactgatcacgaaggtatgaccttcgtgatatttttgctcatggccttcgtccgaagctcattaaatcctttgggagataatacttcaacggacgaaggacattaatatttaacattttatgttgccttgttcttaattcatagcatttgagagcaagtccccaacgttggcgcccacctccggtgaactcacttccacttttttgagctg

SEQ ID NO: 1722 - DNA, 208 bp, Zea mays
atgcatagaaaacgacagcacccgctaatgcttactttggggagagttgctttgaagagtttcttggacaaccgcctttttttggagccaggaccagtcttgtttcagctgccgcttgtttaatgatgccgtgcagaatctgcaagacggccccatctccagctaggcattcggatgtagtagtaaccgttagctgaccatacttgac

SEQ ID NO: 1723 - DNA, 647 bp, Zea mays
gcgcgagtgcctgccttctggctgctggtgtagcagcagtaggcgagcaatgcatcaccccccgcggcccgccgtatattaagacgtcaaaaggacaccggtaaaaccccatagatcccgcgctgcttacggaggaggttgaaattcgtattgagtcaagaaattaagtatttgtaaaactataaaataaaaccatatgttgagatcgtcgtttatttcatttaaattttataagattttatttgatatgataacaaggctaccaaaaattgccaatgagctcaccttgtcgtcaagatcagtccaaaccgcgcctccgtcaagttgtcgagcttgttcgcttggctttaatttatactagtttctacagtgttttgtctttatgaattgcagctgcaacattctgaataggtagctttaatccaaaacgaacaataactctcatcccttcaagattttggcagcttgtttggtactatactcatgctgcgtgagtccagcaatccgtatggattggaagccacatgtgggatgcgagtgtagacatttctcaagacaagttccacggctagccatatatgccgtccattagagccgggtcggcctaggccagcaagttgcattagtttaatttggagctaccaaca

SEQ ID NO: 1724 - DNA, 200 bp, Zea mays
ctttgcttgcctcctcagttttcaccctcgcagtcacggacatctggctgtttttacattgggactctgctttttcctgcctgcaacagcgactcctctttccccgcctcttcctcctcccgcttcggattcccaacccccccgctcaggcctcttcccttcacagcaccaacccaaaaccctagccgcaacgcctacgc

SEQ ID NO: 1725 - DNA, 312 bp, Zea mays
gtgagcataaaacacacttgctgatgtttagtccctgtttggatcccttggtctaaagtttagccactaaactttagatcactttaggtcttgatgctccaaacattcggtataaaatgttctctaaagtttagccaacctgacaaaatggacattagttcattagaccttacaaatgtgctaaagtggtttaaagtttggcccttaactttagccaactaaactttaggccatgggatccaaacagggccttaataatgtattcttttccattgcctctgtttatactatggattcttttctctgactgaa

SEQ ID NO: 1726 - DNA, 1500 bp, Zea mays
cggggatgggtcactcgtccacacccacccgattcctggtactagtggtagcttgggattgggggagaaatcattgtgcaaacacagttctggtgtgggagaatacaatataaatgaaacattattctcataactagtggaagcggtggttaaattattgacaactcctagtctagattggctttgaggtatttcagagcaacaaaacaggtactctaaaaatttgtactacaaatccaaaaattccatggagttaacaactctcgagttgaggtatttggcaagattttatacaactccccttagtttggctttagagccatacaaaaacacgcccttagttccagtttaagctaagaattgatacttaagggtgacagtttagtatctgttcaagctaagaactagtttgaaaggttgacattttagtacctgttgttctctcacttttgattcctttaggatatcaaaaacaaggcaacaaagttaagtcaaggttcatcttcatcccttaatctatttttcccgaaggtgggacagattaaaaggtgaagacacaaagaattgaaaaaagagcaagcaatggacattaaaggtaaatggtgcatgataaaaagacgaagcatataattcaatcttattggacattacttcttatcttcttttattacttaacaaaatattacaaatataccttcggcttcttggaattacaagatgaaaggtaagagaaatacaacttttgtaggtagagcaattcaattttctctagtcaaaaaaggcgcacccgacgcatgacattgttcctctatttatagacgtgatgtacaacttcggtagaactacaaatatgtccttaagcctatacatttatactaatgagtaagctaaggataatactatctttctatccttgcccaacaagtcatgtgaccttgtcttgctccagccagcttctttttctttttcatcatgtgcaagtgacaataatccaaagctctgaacttagtttctgcagcagctatgacagctgctcatcaccgtccctcgacgacgaaggtgttcttcgatggtaccctacaattgaaacaggttgaaaaataattggaagaaaggcgctcgtgcggagatcggctatctcacatgcatgcacggatggacatggatggagaaattagagccgccttgctgctgcaggcactactctcctgctacgccactcactgttcctcgtccaacaccaaacaaaccacggcgttcgcatgcaagtgtgcagccacaacacggcgttcacgacaccggcacacagccggtctatcgtatgcgcgccgccgccggtcaaagagaagggtgcacgtacgtgagccagaccagaaataaagtagcagacggctcggcaagtcggcaggttagcattaccattacactaacccctctaggcttccctccctccctcagtccctccgcccggccggccggcgcaaactaattaagcgagcc

SEQ ID NO: 1727 - DNA, 533 bp, Zea mays
gctaagtattcatttcagttgatcatatatatgtatgtgcgagtgtgaattgtgcaccaaaactaattaattaaactactaaccgtgggaagttgttgttcttgacggccttctggccgtacttcctccagcggtagccgtcgtcgaggatgtcgacctggctgcgcgtctggaaggcgaaccgcgggcggcgctccttcttctcccccttcctcctggccgccgccggcctgtcgtccgcctcggcctccttctctccactgccagctgcggctggacctggaccgccaccaccgtccttgctggagtcgtcgttgtgggacagccgctccgcgacgaagaaggaggacggcgacgaggatccgccggcggcgtgcacgtgcccgctgtgctggcctcggtcgtggtcgcgccgcaagccgctagcgctgctggtgctggtggcaatgaagttgtaggagcttggggttccggcagctgaagagggctgcgcatgcgtcgccgtcgtcccaaacagcatgtgataattctcc

SEQ ID NO: 1728 - DNA, 419 bp, Zea mays
tctgtggtaagagagagaaagaggaaaaggaaaagggtacgaaatcgaatgacgtggcacaccttttttgacgcggtcattatggcggaagcgaagcgtcacctgcttcgcttgccaaaggtgccgcctgtcctgccgcagagttaatgcgacaggacgagtggctcgcggggcagccgttgcgcgtgcgcgagccgttcgaggaacgggcgtctcgctttgagttttgaatctgcggcgggttcgggcgaagtgttgaacgggtcttgcctgggccttcatatattcgagagagggaccgatggcggttttctactctgctgctcacctcccacttaggttttcacaacccgagggaatagccagagaaaggaaaccgcgcacctcgtcctctccgccgccacctcttctgcttagtg

SEQ ID NO: 1729 - DNA, 156 bp, Zea mays
ggtgctcttaaattgtaaggaagacacaattgaacaaagggtggacaactatttacagtctgacatggttgacctaaaactcatctcatttttaatatatgtaatatgtaatatattggtgcacaatacttacaaattaatgttaatgtatgttct

SEQ ID NO: 1730 - DNA, 643 bp, Zea mays
cccctggtaatagatttttacgcattataccgaattgcataattatctacacagtgtagcatatttagtatcagtatatatcataaaatgatcattacgagtctagctgcatggttgttgcagtgatcctaaatttatggaggaaataaaacatttaaatataaaaaccgctacacatatcttttctaaatttacgcgcatgcaaaggaacgtttttcacttatgcatgcattcttttttgcgcgtaccgacgtgggacgggtggcgcacccgacagtttggtcgagtcggcgcgctgagttgaaccaggttgaagaggtggtcggcctagactttctttaactattggaagctcagggctctcattatatctaccatctagacagttttttaactctatctgtctctctgtctattctctttcacatgcctacgccttatgtgcatggtcggacacatctgatcgtaggccacactcctcatgtactcctgtgtgtgtctctctcttgtagtctcgtacagatcgacacacactgctctcagtgccaggacctagagaggggagatgagggcatcaggggccttggagtcctatcagtaaagcatatgtttagtttctgtagttcctcgagcgtcaagcccc

SEQ ID NO: 1731 - DNA, 1500 bp, Zea mays
tatttattgtcttcatgttccatttgtcggaaaaaagcactttaaaactaaaattattgaaaacctatttgagatcaacaattatgtgtccataagtttctatatataagtatatacacacatagacatatatatgaatatgaagtaggccttcatatttagctgttgctgagggcccaaaatactaggaccggccccgaatacgatcgatcgacacgcagttggtgaggctgcagcctagctcgaacacttccgtacggcaacatgcatttagctagcacccacgtacaggatcgatcggatggaggcagcgcaggtgtgccacatacacatgcatgagcacgtaagagtaggatggaatcatagtttggcttcatgtacatgttatgtgtgtgtaggaccaatcttgttgcaacactataggttgttgtacaacggtcagatgttgcaaccaaattgatcttgcttagacaaagtataataagagattataagtttgctaaatgtgctgaggcggtgaagaagtaagaagagagaatagaggagaagcggggtacgtataaacttacagtcggcttatatacacaagaaccaagaagctttgagacatgtgaggctctatgttaatagtgaagagttaaccactaaacgagtaagctaaatagcatgctgcaaggatttttacagccagcattcgattatattattaaacttgctcttatatatagtatgggtgcagagagctcagcacggtagccaagtgaatgttgcatatccaatcgaccggcaccctgccccctatcgatcgcgctaggtattggtggttgctaaatgcaatagtgacaataagtatgtgtacgtctgtccggcctgttaggtacgtactactagctatctctatagagctctagcatggtcctcctcgatgcatgttaattttaacccctcacgattttctactcctacagccctagtacacggatcggagaagttaggggaaactaaaggcacgcgcatgccatgcttttctttgctattctagactctagtaaaatgagctgcagcagagcagaagagagaaccagattcggctgctttggcgtggcgggaatttaatcggccactgtccgcgtggccagtggctggctaccccagcccggcccgcatgtcaacttccttcctccccatccacatcgatatcgccgtccgttggttcctgcagtctgcagagccaggcccgtccctcccctcccctctcccctatttaagccccatgagtgcaacccctcctcctacacaagtacacaacccgcccattgcattgcatcttcctcctctcccttgctcttccacttcgttgcgcccatccgtctctcgtctcgtgctcccatcgtcgacccatcacacatccacacacaagctaccctacgacgtatacagagagaggaaaaagactagtggtacggccgtcgctagctcgactagtgatccgatccatcg

SEQ ID NO: 1732 - DNA, 639 bp, Zea mays
cgcgggtacccgttgtcatccctatataaaatgccactgccgtagtccttgttattgttgggcctaaagatggacagtgtagggttctattgggcctgcagagaggggcgtgcactgggccctgcgtgtgagcagctagttgtaggaagcgaggggggaggaggcgctgggcggtgtgcctgcccgggcggtagataggagaggtcaagaactacggcacgaccgccgacgtagcagagggatctgttcgcctcccgtaccgagacccccctaccctttcgtcgacgactaggcttgcggcgaccgcccttggcttcgccgtcggcgagcatcaccaggtccggccaccgcttcccttgcatttttatccggatctgcctccttcactgcacgcatgtattacgcccactggctcggattcgattcggcatctagggtttgggtacggcaccctggggtctgcttctgtcagaacctcgatgctctatgcctctatccgattgacagaatggatgtgtagggactgacgattggcgggggagcgaatgcggagatgggctgatcagaactgcgacaaggtccggttttctctctaaaccgcggtctctggaggtgggtttgctttttccgtagtcacag

SEQ ID NO: 1733 - DNA, 1348 bp, Zea mays
gagagagactgttcgcgtgtamccagaagcagcatcacctcctatgtatttgtataggtgcagagggaggcgaacggacagtaacagtcgccatcagagctaccgttacagtcaatcagaaactaacgccattatagacgtccgttactagacgacaaccagtcattacagcccatccgttactggccataacacaggaaacaaccagtaacgtacttcgaaccaaggtccaatctaccacgaccacgtcccggctggtgtcgcgcgcgcgcgcgcatgtggcaggctttcatcatttttctcaacttctcaatagatgtgtcaatgatccacctatttaagttgatttgattgatttgttcctcgaacttatgatactaaagtattagtataccgtatatttaacgtgggccttagcattgaatattaatttgggcagacccacgttaatccaacagtaaatagactggaatctaatataaaaataaatttgaatttagattctattcccataaataaaaatggacccgaaagagacgcagaatctagagccatatagatgcaaagaagccaactcttttgcccccacggcatcggattcgcatcgtctcctttcctttccccgtcgctgccgagcgcccaaagcgcgaggtggcgtgtcccgtgcgccaattgccagctgaatcaggctcgcatctgcgttccaacgcagatggctgtgcagcgcagttgcaaatgggcctcgtcaacacaagtgcactccggcatcacagttcacaggctaacagcagcgaatgatccaaccgtgaatcctgttatttgcagccaggccaatgggcatttgccctgttttctcggacacgcacgcttactctcttgacccggcggcgtgccgtgccgtgccgacgcaccaagtcaggctcagcttcctgagcatttatcgccgtagatatccgcacccatgcggcacatacgtggaacccacaccccatcgcattccccatccaccgtcctccgcccagcaccaccaacgcgcgccccggcgcctatttcaagccacgtcccaacaacttgccaattcgcaccgcgggaccggcgccgtcttgttgctccgctccggccgtgacacgagcgcaccagccaccgccagcccctcccccgtcgactcgagccacaggacaaggcatcccaaccgccgcccatctcctatcgtcatctgccgatccctcctcggttcctcacagtcacagagcctcacgtcacgtgtacctcccccaacccaacccagcccaacccagcccaaaacctagcgggcgaggggccggggaaccgaccgccggacgcggag

SEQ ID NO: 1734 - DNA, 1500 bp, Zea mays
tccaattaatgaaacgcttgccaaggcatgttgccgagacatgttcatggaaaaagagaaaactatcatccctatgtgttggtctatgtgagatgtcgtgatttctgcactacacatgagaaagaatatgttagtttggaaggtaaatagtgtctacaaagtacaccctttgagtatttagaatcaatgctatagagagacgagaatattgatgaagatgttagccatagaatcaaagtatgatggatgaaatggtgtcaaacatctagtactctatatgataaaagagtaccacaaaagccaatgcaaaggacaagttttatataatggtgattagacatgctatgatgtatgatgcagaatgttggcgacaagacatgtttagctgataagtatacatgttgcgttggatttatggctatataataagacatcgagtccgtaataatgatatacatgataggatatgrtagcaccaattaaaaaaaagattgtctagcaccgtttaaratagttttggacatattcaacraagaccttcaggggcgcttttgcgtagtggggtcctaaaacgcgatagcaataagaagagagacagaaaaaaaaaccgaagttaacataaaaagagacagtaaaagaaaacttgaaaggataaggtacaccctaagatttagttttaaatagaagtgcatgraaaattgctagacatgtgatcgaacattaacttatggtgattatgttgggtttttaactctagccttcctaaacttgattaagactaaaaggtgttgttgttttagttctttgttgttctatggacaatatgaaattagatgatgccatttttacgaactttcgagaatcagtgttgcaaggctatgttcaggcaaaagtatgctctacttattctacgaggaaaaaaaacaaaaaataattctctcattaaactatggctagaaacttatgcgtagtccttttttagttttttaacttttttttgttcttgaacactctactctatttggagactttaaattttaattttaacaaaattccagtaaaaaggtcacaccccttctgtgtcaataaatcgcaccgagttcaggttcagtgtaaaaatggtgattggtccctcactctctggcttttaagaaattttcacaccaactattgagcaagctaggccatacaatggtgcgcagtgatgaactacgtacggtgcgtgtggacaattaacggcgagtacgaggatagctggaggagtagacttgaaggaaatgacgatcacactgcacgcggccatgcatattaactggcgatcgatctacaaaggcggcgcccaattttagctggccatggttgccttcagtatagtttcacttcacttcagccgatcgaccgccgcgcctatttaaacgcctgcgcttccactcctcagtcctcacccatccacatcttctccttcctcaacaacaactccggtccgaacaagtggtagag

SEQ ID NO: 1735 - DNA, 669 bp, Zea mays
tatttgtctctccatagatattaaactatacatatataacatctcattctaacatactcttcaacataaagttagcttgactagcaagagagttaatttagagagccgaatatcttaacaagttaaataactagtctcttgaagagctattatagtattattaagtagctaaaatttagattgataagatgctctaagacttagatttggaaagttaaacagtcgctcgtttataaacatccccgtcaattcataaaatcattgattatatgctgcacaagagcttaatttaagcaccgccagcataactacgattcctttcatcccgcaccgttaacagactgattgctcctgctcgtattcgtagatccacccacccatcgctcgaacacacagaaccctacagtacagcaagagatcgagcagccacgcccacgcttctctcctctcctctgaaactatcctactatcgtactttcctttttttgttcccttctctttctctctctcccgtcgtcgccatttatcactccttcctcgtcgaaaatcttctgtcgtaataaaggggtcatccgtccaccgtccacgtgggcggcggttgcggctacggcggcggcggcggcggcgtcagcgggcgccggagatgtgagagcctccgtgccgttggag

SEQ ID NO: 1736 - DNA, 1227 bp, Zea mays
gggagtggctcaggaggccattcctcccgcccatcttcatcttggtcaacaacattgttattcacaagggattgtttaggtcaaaccctgcatttaaagtcggttgccctagacctataaaatgaaaagacaactcatgtccattcacatgatggggagggatcagatcctcatctttagggagtgcacccaatagctcttgttcaattacttcacattggattgtctaagagaatccctgaaaacccctccgaaacacagaagactatgaattgcaggacctcttctagagaaataaccctggcacgcactagcagtatcgtgagattagcattatccacttcccacatgataagtccccaaattatccaatagcattctttatctatgtgattggttggttggccggctgcctccaggcccgcgacgtctcgttgaccttgcgcagcgtctgtttgattaactggagaggagggtggcagcctgcacgcagcataggcattttttcgcttgattgcctgcatgcgcagaaacacacctatcatgcgtacccagcggtccaggttagctggagaccggcgctcgacgccaatcaaccaatcacgcagcatgtgttcttgcaaatcccacaatcatcagccaatactccctgttgaaattcactgcccgaaagtttcatgcttcattgtgtctgattacaatgaaagtgaaaccatgtgctgcccagccggagatgcccgatcagcagcagctagagcagcaacaacgtaagtcttcagccgggggaaatttttttttgcctgcagcagcgatgtaaacccacggccggttgcagacttgaccaccactcyaccacctgccacagctaagtcccagttcccacgggacgatccatccgtctcgcccgcgcgctccgcagccacaagcgcaaaggcagagcacacagttctgtgtgcttggcagtgcccaccacccgacgacgtccccgtcgtccaccgggccaggacgcggacggctcgcggtctcgcccggccggcccggcccttccgatccctcgcgccacgcccatctataaatacatagctgcgcgctgcggagctgagagcaggcaaacaccgagcgcagctagcatcatatcatcgtccagagctgcttgcattgcatctcccagcggccgatcgagctgtgatcaagctaagctaataatatatagcctatccatcatat

SEQ ID NO: 1737 - DNA, 1500 bp, Zea mays
ttgacttaaagatagtaaaatgattttgatttgcaaaaacaaaccaagtggtggcaaagaatgatccaaatatgccaaatttgagtcaaaaacaatttggtcttcaatttgaattaatgttgcatgttttgcattgcttttggatgtgttggcataaatgaccaaaaagggggagattgaaagggaaatgtgcccttgggccatttctataatgttttggtgattaagtgtccaacacatagtgagtaagatattatttgccaaacaagcaaaaggtgcaaatcatgtaacaaaggtacgtttctagacttagtacattgttttgagtactaacatattttgtctaagtgctataaacagagaaaagaaaagaagaaaaggattgcaagtgacttggctatgtacaaccgaagtccagctcagcctggcacaccggactgtccggtggtgcaccggacagtgtccggtgcgccaggctggcatccggtgaacaggccgctctcgagaaagtttggtggcgtacgactataattcaccggactgtccggtggtgcaccggactgtccggtgagccaacggccgccagcgcaacggttggccgcgtaatccgcgggcgacgcgtggcccgcgccaacgatcgccagggggcaccggactgtctggtgtgcaccggacagtgtccggtgccccaactgccacgaatctgcaacggtcgtctgcaccagaataggaaggagatcgtgcaccggacatgaacagtggttgtccggtggtgcaccggactgtccggtgcgccacccgacagaaggcaaggatagcctttcttgttggcctccaacggctcctagctgccttggggctataaaagggacccctaggcgcatggaggagccacccaagcattcaagaaacattctaagacttctagactccaacttcacgcattcgattctttgtgatagtgacttgagctccatttgagttgagaactccgtgcgttgtgttttgagctcaagttgtgacttgtgtgcatgattgtgctgtgatttgagtcttgtgtgtgttgctctcccctcccttacttccgttcttcttttgtgatcatcattgtaagggcgagagactccaagttgtggagattcctcgcaaacgggagaaagtcaaagaaaggaaaaaccgtggtattcaagttgatcattggatcacttgaaaggggttgagtgcaaccctcgtccattgggacgccacaacatggaagtaggcaagtattacttggccgaaccacgggataaaaattgcgtgtctcttgtgtgctttacctttgattatctgtggtcacaagaactcgcttcaagctacttagccattctaacttacataacaaagtgttgtggctattagtgttgaattttataggatcacctattcatcccccctctaggtgctctcaattggtatcagagtcgttctcttcatctaagggactaatcgcccgaagag

SEQ ID NO: 1738 - DNA, 745 bp, Zea mays
ggtaccctcggcccccgagggtgaggcactgcgcgtcgaggaggagcgaagcggggtcgcgcctaatcgaaactggcagaccctgtacctacaatatctccaccgaggagagctacccctcgaccgagccgaagctcggcggttggcgcggcgcgccaagtcattcatcttgctgggagatgggaaggagctctaccaccgcagcacctcaggcatcctccagcgatgcatctccatcgccgaaggccaggagctcctacaagagatacactcgggggcttgcggccagcacgcagcatctcgagcccttgtcggaaacgccttccgacaaggtttctactggccgacggcggtggccgacgccactagaattgtccgcacctgcgaagggtgtcagttctatgcgaggcagacccacctgcccgctcaggctctgcagacgatacccatcacctagccttttgctgtgtggggtctggacctcgtcggccccttgcagaargcacccgggggctacacgcacctgttggtcgccatcgacaaattctccaagtggatcgaggtccgacccctaaacagcatcaggtccgaacaggcggtggcgttcttcaccaacatcatccaccgttttggggtcccgaactccatcatcaccgacaacggcactcagttcatcgacagaaagttcctggacttctgcgaggatcaccacatccgggtggactgggccgccgtggatcacccc

SEQ ID NO: 1739 - DNA, 187 bp, Zea mays
ataacatatactactataatttatgattatatttatcataaatctatattaaatcacgtatcagggagttatagtaatctcttgaactagtatatatacacatgacgctgcgcgttacttgtgtctccattcccacctctcgtagaagcaaagctcgacagtagctaccacaccacttgacttcacc

SEQ ID NO: 1740 - DNA, 133 bp, Zea mays
agatcgcaggtttatggttacgaaagccattgtgtttgagtgcgataaatcatgtgtatgttcgtcttgcgataaatcgttggttctgttaacagtgagacagtagctgaaattgtatgcaactaagattcag

SEQ ID NO: 1741 - DNA, 1263 bp, Zea mays
gagatattattgtacattcagaccactctcaaaagttctaacacgttcgtgtcgaaccggcccatccatccgtaattcatgtaaaagcccaggaatcaaatttgcagcaccaaattctaatgaagcaaaagaaagtcaactaatagaaaagagaagcaatcaacagaaacatgagcaatagaaacttaacatttctagtaaattagtgagttattcttaggtggctgtcttatcataaacttttgattagtagggggatactggcctctgggtgcgagcaatctggtctcgagagctagcgaaggcagaccatgcggtggaatgttttagaattgtagaacgtcttgaattatggaatgtgtcaaatatacacaacttctagaattgtgagcacggagggagtacatgtatcgggatggaaccctagtctatgtcaagacaacacacagcgaaagtagatagtagaagagatgaaaagcggacgcagtcgtcgtggcccccggggcactccaccccccactaaacacccgacgtcgtcactgcgtccacgcctttgccgcgggaaaatcccccggaaacccgcacaaaaccgatctcacccagcaacgaaacggcagcagtttcgaaaaaccgaagcgagatgtgcgggggctgtactgtaccgcgctgtgcctgtgcggagcacggggccgggccacccacccgcgccccgcaccgcgctgcctgccctgccccttgccgcgctgcgctgtccgtcgcttctccgttcgcgctactactgccactgcgggctgcggctagtaaaaaaaagcagcgccgcgcctccacctcgactccaggccaaggcagccagcctacccagacaaccaaacgaacccgcccggagcagcaaagcataggcgctcgagcgctccctcctgagctcctccgcctcacggtcacgcctcgtgtccccccaccccctcctcgtcctccaccggccgcctcacgccgtcacctccgctcggcgagtctcggctccgaccccagccgccacgtgcgacctcccctactcctgactcctgagaggtaagatcttctacctccccgctctccggctcctccgctaccctgaattccgcgggttcaggaggggtctaacggctacctcgctgctaccgcgcgcgcagatctgcggggctcggcatggggtgaccagatcgggccgctgctcggtgctttccagctgaattctgcccgcagctcgtgtcggaggcagcggag

SEQ ID NO: 1742 - DNA, 382 bp, Zea mays
tcgctgccgcgccgagataacctagggtttggggattggggattggggattggggatttgggggtatgctttgcttgttgcgtatggccacctcttcctcttgcgcttcgggtggagccggcgcacggggtcgattagttgccgactccgggagagttcccaccgacatgtggcccttacttctcaagcggggcccatatgtcggcgtcgagtctcgaagcttcgttttggcgcaataaggcgacctgagtcctgaaccgcctcgagccgctctcgggctctcggcttcgaatcccgacaacctccctccccaagctgcttagccgccggctgggcctcagacctgcgtcaagcttccggcggcagcccatcgagcaccaca

SEQ ID NO: 1743 - DNA, 463 bp, Zea mays
gctcccgcgcgtccatttttgcccgcatctgcacagccgcgagcacgcgacgagcctggctcccgaggaacggtcgtttttggcgtatgagtagagcctggctcccgaaggaatcttgcatcggtggagcctggcccaagtgaccatccaagcatccaaacatgggcaggctgcatctgtggagacaggcccaaccaaatacagccatccaaacacgcctttagatccagggtaacccgaatcccgacgcaaagatccaccaccaccaccacgcgccgtcgcytataaaagcagccccccggcagcgcaggcttgcagcagcaagcatcgttcgagccccgatcgagccgacgaggccccatccccaacccctcatccatcgcttgctctctgccctctgggagctcgagcctcctcggttgaattgtgagtcgagctgctgagaaagacaagtgcgcgcgag

SEQ ID NO: 1744 - DNA, 1500 bp, Zea mays
agctgctaaagtttatctcgcgagattggaacagggccttaatacagtaagaaccactttattactgttgcatcaatgaaaaaacttcctttaggctcgcgtgcccaacgtgcacctgcgcggccggctcaaagctcaatcgatcggtggcagtttttttttttcactcgggatgcgacggagagaacagagcatggatgattgggaatcccgtagcgggcccacgcacgagcacatgtgttttgttcgtggtccagtgggacagacggacagtgtacccgattgggcagattctccacagaatcgaatagcgatcggaacgggatgcgaaaccgccggtggccggtgaagagagcggcaagatgaggatggtccctccccggccacgctccacgttcttctcgtcgtgtttcggacgaaacgttgccttcgacagtgtgaattgctagtgtccagacgtccgatgcagaggggctagcatagggccggttggttgaccttttagagaaaccaatcctaaagaagtgcctttttctctgagcagcacttttttgcaaggggaccagcctttctcagttgcgttttgttccagtgggtgcacgcaagcgcacccgccgggtgtagcccccgaggcctcggaggagtggtttgactcctccgaggtcttaatgcctcgcgcaatgcttcggctagtctggtcgttccctcatgcgagctggccgtagcccgggtgcacggtcgggtcccaagttctcgggctggtatgttgacgctgtcaacggtttggccggagccgggtttgcgagagcagcccccgagcctctgcacagggcaagaggacggtcagggattgtcggcgtttcgagaccggggggtccctaggccgacgagtgaaatgtcgccgcgtgccccagcccagatgggttggcgcgaggccgagcgcgaagggggagaaaggtggccggagacaggcgtgagagaggtggaaatcccgcgaccttcgtgtttgtcccgcgcccaggtcgggtgcgcttgcagtaggggattacaagcgtccacgcaggagagggagcgagcggcctcacgcgagcacctgtcccgtcctcgtccccgcgcggccaaccctctgtaagagggccctggtccttccttttatatgcgtaaggagaggatccaggtgtacaatggggggtgtagcagagtgctacgtgtctagcggaggagagctagcgccctaagtacatgccatcatggcagccggagaggttttggcacccggttcgtgtgatgtcatggccatcggaggagcgccggagcctagcggaaggacagctgtcggggctgtcgagtacttgctgacgtcctcttgcttccgtaagggggctgagagtcgtcgtcgtcatagagcgtgaggggcgccatcattactcatatagcggagcgagccagatgggacgccggtcttgttccccgtagcatgagtcagcttggggtagggta

SEQ ID NO: 1745 - DNA, 67 bp, Zea mays
gattttttcttcttattagagagagtaggaaaccccattctttggtttatatgtttaggaacttacc

SEQ ID NO: 1746 - DNA, 182 bp, Zea mays
tcgcttcaaagcacaaaccaaaccgcctcctcccggccgggccaaccggctcgcagactactgctcgcggggacgtggcgtggggctctacaccgccacccgcctacggattatacgatggctgccgataggagtgcggggagaggaagcggcggcaggttttggaggggagcagagccgac

SEQ ID NO: 1747 - DNA, 719 bp, Zea mays
aatgaactaatttttccttgggaaaatgaaaataccataaggaaaatatagttcccaaactagccctaaatagcaagagaatttcttctcccaataattcttgatcaccaaatcagtctagttagtttgagaactccattttctttatagatttttattttttaagggaaattattttattttcacttataaaaataggaatctcttaaaaaatggagtttgaagataaaaatgtattgaaaaatgagattgtcaaactaaccttcggctttgtattttaaagcgagggaccgaggcccagccaagatggctaaaaaggcccacggttccaactaggcgggcccatcaccgccgccgcccgccggcaccgccaacgaaccctccacgctaacacgtctcttaattcaaacacccagctggttccgttactcctccttgtacgcttcctcccgcggccacgagagagacgagtcaaaacaagacacgagccgcacccgcacctcaaacgctccacctccacagctccactacctcccatgtcggctctgctcccctccaaaacctgccgccgcttcctctccccgcactcctatcggcagccatcgtataatccgtaggcgggtggcggtgtagagccccacgccacgtccccgcgagcagtagtctgcgagccggttggcccggccgggaggaggcggtttggtttgtgctttgaagcg

SEQ ID NO: 1748 - DNA, 182 bp, Zea mays; identical to SEQ ID NO: 1746

SEQ ID NO: 1749 - DNA, 475 bp, Zea mays
caccactggcgcagcacgtgtccccgactatcccgtccggccattcccgtcgtcctgccatgtcctaccactcgtcttgtccggacgaccacacaaaacatcctcggccatcacccacgcgtcgcgctcccccttgctcacgccgtcgctctcgtcaccagtcaccaccacccctctcctgtcgtctcccttcccgccgcacccgtctcctatttaaacagcagcacctgcgacgtctctcttcatcgacctcgatccattgaataattttactaatcaaattcttgttgggatatattcctccaattcccctcctcctcccaacaaggcaacaacaatctgttccggccgccaaacaaaacccaaaaaaaaaacacactgaacccaataatccgatcccacagaaacttttctctcggtccgttcgatcgatcgctgccgtgtcgtttgccagacaccatcagcacccaaaacc

SEQ ID NO: 1750 - DNA, 1074 bp, Zea mays
agcggtgacctgcctggctgcctcatcagcatatccctaacccatgaataataaatcagtgccattgacgtgcccctttctaggtctcctgcataggagacatgtctggtgtccccttgtacagtaattaggctatgtactagaagagtttcgccgtcatgttgtttgttatcatagtggtcagatgttgtggctcttcgggctttagatgttaacaggtctgaagtagaagggtgttgggtgggtgccaagatgcttgtctaaccactggtctacaatttgacaatgtaaggtattgagatacagatgcttgggttggataccaaatttctttactgctggatcattttttctgcggttgccaaaaggcatgtttcaggttgttcaaccttgaaacatggacctttcgaggcacgattaggtgagtaagttggatgtgcatgtgcttgactggcgttggaattagatgaaaaattgaaacgctcggttttgttggtcaaacaaaaataagtaggtaggttggatgtgctgactggagttggaattatatgaaaattgaaatgcttttgaataaactattaatctacccataaatgaataaactatttcacacgaatgagataaaaactcaccggcttttgaatacgggtagtcaggtacccatatgctttcccacactgagggtttggtgaccagagatcagggaatggttcacggtggagaaatcctctcctcatggatcctcttgtaatccctgatcaccaaacctgtcgcgctagcagtcggagtcaggattcaggccataaaaatatccaacttttgaagacagaagtgaaatagtaaatgggcttattttaggagttaacacaaacctgtcagtactaagcccactcaaaccagcccaacaccagaaccccgtcgagcctcaatccctcccaaggycccaatccattcccacgccacctataaaaagtcgtaagcacaccgaaaccacagcaaaccctagcgccacccacccacccacccactcgcttcagccgcctccgccgcgcgtagcaagcaggtggagacagg

SEQ ID NO: 1751 - DNA, 367 bp, Zea mays
ggcgttctggaacctggtcaactgggcattcgttgccgaacagttcgaaggcaagaccttcaaggcctgagtcattcagccctgaacgaaaaacccggcccggtgccgggtttttttatgcctgaaccggcctctttgcgggtgaacccgctcccacaggtacggcgccgcttgtggacttgatgctatccctgtgggagcgggtttaaccgcgaaaagccggcacggttttgcttgctcagcccgcatagcacgctaacatcaaacctctggatatcgttacggcgcattcaagttgcggggtcaggcaaccgatacactactgaaggtcggccgatagtgtatcgtcatcgttgatggcaaaatg

SEQ ID NO: 1752 - DNA, 1500 bp, Zea mays
agctacccggcgccttatgtagggtcgtgtctgcgaaccgatctgcacgttatccacgaactgatagactcgtgctccgataatgtctcagatccttatcaagatcagatagggctctagacttaacagctaaacaaccaaaaaataaaacgacaaaaaagaagccgcgcccctgcaagacgaggggccagattttggyggatcaatcatgtgcatgttgtgtgccctcgccctatgcctcgcccaggcgaggcgagtgagtgtggttctctacactctctcacatcatccatgacttggtgagtgagtgtgacctctatatttaaactagtttcactacacttagactattaatatggtattatttgtttcaccgttctctagccatactcatatatggacatttaggatttattttaggatttaattgaatttataattggacctagctcataaatccaatagagaagagtcttatttgagccatttgttatctagagaagagtctaaggaaggctaagcgtagagagagcttcatatatagcggcgaamcctaccttgccccattttatgtctgctaataagacaatgttagtatgttgtaatctttttctttctaacacgtaagtacagtcgcggaaaaaaactatgagacaagtttaagtctagtttttcttttgaacggggagaggggagtagagtaccacgtccacgttacggtgttcccatcatccctcagattatgacccttgttcagcttcaacacgactgaaaacggggtcattattttggagtttcttgtacacctccctatgtttcttggatgtattattgcacataattaggcttttataatggcatcaaagaaacaattgctattttgtcactcccaatttaggctctctgctattatgtcactccgtgtctatgagttgtgagaccatctgtgactatatatgatttatgagtccgatgataaactagagaagatcacacctcagagtgaccaaatagcaaatggctctctgctattatttcccggagcttattgcatttactgatcattctcgatgctcgctcgatcggttggctacttgttggctagctgtgaacatgtttatgcaacaactttcgcgcctcatcgacaaattttaacagtttaagcaacttccacatctttcatgatcaaaaagacagatctacccgtccgtaccgcgtggtgttcaaaacttcatacaatatatcatgcggtgttgtgtacactgtcgtacaagcaactccttggcatcattgtcatcgtccctggctcactctccgccatcgatgatcaccgcgaccaaccctcccgctcagcgtgcatgtccaccttttaatccttacaaaaaggtgatcggccgatgacgaggcgagcaccccaagaaaacatcgagcaatccatgcattattgacacccaggccagtttccatcgcaacgaccaccggaggtcgatcgagcgagcc

SEQ ID NO: 1753 - DNA, 644 bp, Zea mays
cgatcgcgcgtgaaattgtagtttataatacaaatttaaataggtttaaaagttatttgtaatctatatgagaaataaaatgatttatctaagagttcgtaacttgaatttcacgattttctaaagcttttaaatagatttaaaaaatatttgtaatctatatgagaaataaaataatttatctaaaagttcgtaacttgaatttcaccattttcgaaagcttctaataatctgtttcaccaacttaactagattttgtgaagccccatcagcatagtggaccgcgaaatattcctcagcatctttccgtacccccttggcaccttggaccattgcggttgtagccctgcaacatatagcacatatctcaaaagccaaggtaaaggagaccctgttggtggtggtggtcgtcgtaggtgactcaggtgggatagattccctggtgtgtgtggtggccgtgcaaattattgatcgctcacggtcccaaacacaatcatgcaaagagagatgtgatcctctccaagaaatgccatgcatgcccaccatctcactgctgatggcacacacatatatatcgtcgtcgatctgcaaccttagcttcaaccaaaggtacggtagtagtttccctgctgcaacagcttggc

SEQ ID NO: 1754 - DNA, 1500 bp, Zea mays
catataacccctctcctctcttataccataagatcatgtttgaaagctcaatgttttttgcagttttgaaccaacactagatgatacaatggtattcaaagtcaaacagtgccgccacggtgctcctgttcccgttccggatcgagaggccgtggcggtcgcgacggcggcactgcagagacgacccaatccaaccaacggtccccgtcccgtatgaatgtctccgatccagtcgcctccgcgacacgaaaaaatatatatataaaaaagcgcaggactgcaagtccactttgccgtgccgaacttctctccgacgacgccttcctcccgctgccgcggttgcgtcgcggattcgggggacgcgacggtaaccgaccaaccagccggctcgccgtccaggtgacgcaacgcaacgcaacgccggtccacggaaaacgaccggcgccgcgccgctgtaggaatccaatccaccactgctgcagaaacggaaagcacgagaacggtcggtcctgctactagctagtactggacactgcgtagtgcgtactctattctagtagtactgctactggcacacgtactgtagtagacatatccgtcgctttcgtgttcagcttcaaagatgctcatcggccagtgacgcactgatgcgactcatctcatctatgctgccgccgcgtacgtattctcggacggatacggaactcactagcctttccaactggaagaggaggaaccgtaactacattacatgctcattaacaaatcatgccgttgttcttacgctggccgaggaccctttcttcagccaccggcggcctaattgccgccgactcacccccaacgttcacctctgctttagggcgacgtgtagtaatcacggtcattagggcccccccagtaacgcgaattttactatagctcaaaagcgcatcttctgtcattcggtcattccctccctattagtccatccgctgccgaccgaaacggcctctttccccttccgcctcctctccctctccctctccctctcccctcttctgctgcttgttcttgtcaatagcgctcccaatcctgtcaccatcatcactagtccctcccgccccagctcctctgcctgtaaagatttcgttcgttcctctttcgaatctctgatcccgttctcggtcctcgattccgcctgcgaaagaaactcgtctttgctgcaatctatagaagtagcagggaggactttgtgcagagtttattttccttttcttcttcttcttttggtccggaggaacctagttcgccagtggttgcttgccactgacgaatcacgttcgggttgcgttctccgatccgtcccagcctaattctgggggcgcaggggaaggattcgggacggaaggaactagtttctgtgcttccttggattccacggcaaagcccggctgcgacgtcggcgtcgtctccaccgcattccggctacggttcccaagcaaccttgctgtggtgggg

SEQ ID NO: 1755 - DNA, 1500 bp, Zea mays
tgtccatccacctagtgatattcgttcaaaggggaagtgcaagaaaataatatggcatctgacaaaaacaaaaagaagcatagtccatgtacaagcaaatgcacaatatgcaaacatcttggacaggatcgacaaaattgttcgaagaaaggatcagcaacaccataagtttttagtagcatcggtttaaactttttgtcttatatacaaatctgtcatatattttctatggatttttagataaagcggttgtttttgtataatatggttacataagtttagcagcaccatatgtttgttcaacatacgctaatggtcagattacaaaagtactacattaattttccatgtataaaattgtacataaattacaaatggcacaatacaaacatagtgataagttacaacaatttagtacaaagcgctgagttttgatttttgaaatggcacattgccaatctctgatgaaaaaagttgtgcattgacatctattggaattacaaagcacatctgagagaggagaactaactcatggtggatcatcttgtcatatttgttaacaactaatgtgaacctataacactctgatgatcgcaataactcaacgcttcgctgatacttccagttagctttactgccaccagaagtagggatacataataagcaagcaaccataacttcaggttcttgtattgacacctgcaaaaaagatttcttagattggggcctggagtgcccagcaacaattgggtgatgccgagagtgccagttgcagcaatgaacaaaggcgttgatgatgtaggggaggcggggtcttggatgacatcggtcaggggaggcgatgtctcgtccatgagtgattggggcgagcacgtcatcgtcgtggaccggctgcaggcgacaagggggcgcacggagatctcagtgaggtaacgatggaccatggcgcgtgacgcagctcgccccgacgactcacgctaggtctccctggcgcccggcatggggcactccatgaatgaataaccggagtgtcgcttccggtggaactgccatggacgcccgcggagctgacgactctgttcgatctgttcaagggatgatgcttgtggaagagcttatgtactaaaattcaatccaccgtaagctatcaaaccaaaaaatgaaaatgctcgtttgcacgcttgcaaataagagccccttgcaccacagtcgacgatcaggaccgaacacggagaaaagccacactctgcgactgctcacgccaccacctttgtttgtttgaggaaattctaagcaccacctggccaggctgaaactctagcgcgactggctttttccacggcccggcccggcccggcaaatccatgtactgtactcgttgtcgcggagaacgcgcccctgccaccgcgccgcgcgggcacggcaacgtcgtagtaaaaccctagaaaaacagtagccctgtcaccgcgccggcgagccgaagcgagcgcggagctaagg

SEQ ID NO: 1756 - DNA, 1128 bp, Zea mays
aattaaaacacgtaaatacaagaaatatgtaaataaggtaatgtaaagtaattttgagaataagaaataggcacatgaagaacaagattgtacgtacaattcaacttatctacaattcaacttatcgtctagttccaagctaaaagtgcagatgtcatcttatgtttacacttgcacagaggtgggaggagctgtcgtgctgcatctcaccttacacactagaatgagacataccagaagaaataataaccaccgagcaagcaattaattaagtagaacattgagtcatcaacttcattcattcgctgtccaaaaataggcttcaagaatttcttccaggattataacggatgttttcacgaattcatacgatcaatggaaccagttgttgttaagccggtgcttatagcaaatagcagaaccaatagaattagccagtttgagggaagaatcactgcaaaaaaaaatatagtctaagtattttctgacaatattcagatgattttattagacccaaatatgagaaaaagaacttccagatgacactcccattgcgcctgcaagtcacaatctgcaatgcatggattttgatactatgatatgcacataagtagattactactgcaagtatttgggaacatttttatagttcaatagtaatcatagaagctcagtaaaatggtgctctgttttcatgtatggctgaacagtaagttcagtagattgggagcatcgtccaacagttcacaactgggttgtccaacgttaaccgtcaacttcatatcaaaagaatacacatgacctttctgaacataaagttccatcggtttgatgaaaaagtaatagggatcttcaggaaacaaatgacgatacaggcatgattttattcaggtcatgactgaaaactaggatcagaaagacaatgtctgaaaaaccaggtgtgttaggattcataagaaaatatatatagagtaatctgacttactacgcctagcaatctgccatctcttcgaacttcaaaagttggaataccccgggccctcctcgttcggtgcagaaaagcaacgaacacctgcgcgcgagaaacccgcccccgtcgccgtcgtcggcctccagccgccgcgggcg

SEQ ID NO: 1757 - DNA, 221 bp, Zea mays
tgcagaaatccatagattcttcgccacttcgattgtccgctgcatgaatccggctccgcgcgcccaattccctgcaaagccccagtctctggcgatttttttcttggaagatttcttcattctttagtggcgcccaattctgctgggaggggcttcttgggagggagatccaccatttcgtttcggcttgagcagccggggagctgagcagcgcggcgccc

SEQ ID NO: 1758 - DNA, 1230 bp, Zea mays
tgcagcagctgccactgtagaaactagcagccgaacaagccctgtataaaccttgagaccacggaatacgccttgaaatttcccgtcacctcttcaaactttgggcggcctctctcgctccctctagccagatttcccgctcgaagtttcaccccaaacaatcagcttccctcgtctccccgcctcgtcgctgcctctcctcccattttcccgaccccgagctcgtcgaccccgcgtctacgcttctcggcctgctggtctcccttatcgactgggcacagccgccgccgcagccaccagatcgctttagggccttaggggggaggggagagggtgtgtctgtgcaccgccggtagctggggtaactgccccacccgccgtaggagcttcagcgagcgatggaaccgaggcggcgccagcagcagcagtcgatcctctcatttctccagaagcagccgccgtcatggagggatccctccggggagggcacgcctcccgagaagccgccgcggccccctatggggtccgtcgccgggatcatggagaggctagtgcgccctcctcctcctccgcaggccagtcacggatggacgcggtaatcactcgctctgttagtgtgacgggaggctagggttttgcggtttggttgggcgtcggttaggccgtccggttgggtcgccgcgaggcacggattgctgggctgggaggagtttcgggttcgagtgatagtgcggatctaacccattagtgctgcgtttaaggacgtgcattattcgagttagcgactgtctagagattttaccgtattattgctcatctgtttctactgcagctctgcctgtgattaatcagtctggcttccattttgtggttattagatatttcctccatctcagtatataaggcgtactatgtatttgtattgcacatatgcaattaggtaactctgtctcagtgttgattagcctcaaagtatattaggttttttatttttgaattcactgccgtgccctgctgagctacatgcccataattttttagagtagagcttgtaactccgtcccagtgatgattagcctcgaagtatattatatctttttttgaattcactgatgtgctctgctgagctactagcccatagtgtttagagtagaacttgcactgtcatctcatgtgattttttttcttggttagatatagctttgctttctagtattttgcatttcagac

SEQ ID NO: 1759 - DNA, 208 bp, Zea mays
tgcagctgcagccttcttgccatccttgtcaaagatcttgttgaggccaggcagaaccttggtcttccacacgctggtcatctcgatctcttcttcagaatatatacgtgtagcaacctctgctcccggccaacagacacagcagaaaaagttcagagacgcaggaagatcgatgatgaatggaaaaccaccagcagggcgatgatga

SEQ ID NO: 1760 - DNA, 480 bp, Zea mays
ctaaaataagtagcccgccgttgccggccgctcgccggctactcgtagtcgcagtagaggacggagacgagtcgcgtgatcgcgtctgcgtctcgccaggtcgcacggagtaattattatccatggctggtgatgacaattgtggacacgtctgaaactatggacacacgccatgggtgaggaagaaagcttctgatcaagctaaaaaaaagtttgggttggttagttatgcggtgggcaatcgccgatgaggcagacgttctcactggatttgcgtcgctgctgcagctcacctgccaggccgcagaggccagtgccactgctggcaggcgctgaggcgcccgagggccctcaagtggcgcgcgagccgcacgccaacgcccgcgacgcgacgaattatctttatcccctttccctctgccgtcctcgttcccggccgtccgtgccgaaggaagtatctgctgagtgctgacccagccc

SEQ ID NO: 1761 - DNA, 1359 bp, Zea mays
ctttatagtcgacctgcagataagttatcggcctctgttgtcaaaacgtatgggcgagcgatagacgaccaccccgacaccccgcccgcacagcgtattgccataggcatttccgaaataaactagtagtgcttccgtttgagaaggacaagcttggttcgcagactcgcagccgcaatgcaatacggcagcagcggcggcggcggcggcccatagaatttagagagagagaaaaaatatatcacctagaaactccactgctacacacgcacacacccacgtcagatcgaagaaaatcacggccgccacgccatccctgtcgctcagtcaccgccgccgacgtcgcgttgcagtcgggttttacttttcccgtagagagcagccggattttacttttttccccgtagggaaaaggacaagacgattacgattaaagtattgttggcgacatgcttagctattccagacccacaagacaacacactaccgtgcacaaggaagaaccgcattagcgctactgaccccgactaattatcctaccgcaatcagacgctgtgagcgccgacgcgatgatcacccccgttctggaagtcggcaggagcggccaaagcgggcgggcgtctcgaaccctcctgcgcgggtggaaagataggggtctcaccgacgtcgctgacctcaccggcgacggcgacggcgacacgacaccacgtccaacttggccgttaactgagcactatcagcggcgtcgcaaatggcgattagcgatgacagaagggcaaaactttatcgggtccggatagattttacacatgacgatgcgttacaccggggcggggcggggcggggcggcgagactctcatttacacaggtctgctggaagaactgatctcggatcggagcactgcttaagctagctactactcactgataattttaactaaagacaccgctaatccaggacaagcccatggttcttggtctcacacggaggaagggggtgccaaggcgcggcggcggcggcaaaccggcgaagcgagcgagttcacatgacggagcaggcgttggggttctcgtcgctgaaggcggcggtgtagcggacctcggtggaggaggccctggcgagcggcgcggcggtggggtcggcgacgacgttgcggacgtagccggcgggggccttcttgtcgtaggcgcccggcgcgtaggggtgctgcaccatctcgtagggcacgtagggccagggctccacccgcttgcctgtcttgtaggcgacgcggcgcatgaccttggcggcgtccacgtagcccgtgaccgtcaccttgttctgcttggccgccacctccacggagctcacgcccttc

SEQ ID NO: 1762 - DNA, 256 bp, Zea mays
agctacatgcatatgcatatcctcgatctcctccagcatgcaaaatgcaatgcaatcaggatgtggtagcgagcaatagccacaaggtccatagataaataagcttcattagccgaagtgacgcatagttttgcattttaattaaatcgactgtgtagtacgttatttccaaatttccaggatgagggtatcactttgaattttcagaaggaatttatttgtaataaattccaaattaaaaacgttgcaatcagtg

SEQ ID NO: 1763 - DNA, 566 bp, Zea mays
aagaaaaatcaaaacaaaaaagacagatcagcccagagtatcgttcgacgaggagaagccgagaagagccccccgggaaagccctcgctcatacggtcatacctgtttgctgtacgtttttcttttcccgttcgcgtcgcttgcgcgacacctagggcgaccgccgccggcctatgcccagctgcccaaagtactcgtcggaccctttgccggcgacgagcaccgaccacaccagccaccaggtatctctcctcttctcttcgcttcctgcaaagggcacctgagccctaacacttaagctattttcctatctgtattcggatctgatctaatcacaagtgtatatatacatgtactaatatgcctatatttttatgggctgtcggctgtatatacatatgtacacccatgcactttattgggtccacgccctgattgaacatagacaccttttaggtcttggacgacgcacctgcgtcgccgacggcggcggtatcatcggtgagcggacgcgcggccggccaggcgagcgtgatcctcgatccaagaggtcggtagggatcgag

SEQ ID NO: 1764 - DNA, 913 bp, Zea mays
cccaaatttgagtttttcgtgcatcatatgatgacacacaggttaattgggaagcttttttttcccaaaacattttgcctggattgagcacttggtggacttgccagcacgcaaaagatgaacagttgtgtgatgcaagtccaatccctccactctcttctgaaaaaacaaagaacagagaaatgcttttcaagctagaaaagtcagcatctgtgtacttaagaaaagtgccgtaccttaaaccaagcttacgtgtccccgatccgccatcaggggcaacttagatcccaaaacagcatcatgttccgaattaaaaaattccctaatcccccaatcaggaggcaacatcacatcctaaccgagagggcattttcgtcaacagacccctcccgcttcctataaagtcccgccattccgagctctctcaactttagccacaaatttcacccaaaaccaaaaaaaatcccaaattaaagaaaacgaggagaagaaaaacaactttcatcgccgtccgccaccggagctcacttcgtcggccttccctcagtgtcaacccccttctcaaaacttgtatttgcacctcagtccctggccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagc

SEQ ID NO: 1765 - DNA, 463 bp, Zea mays
gtgatgcaaaaaagttgactgatttttctaactttaaattcttaaattctagattcgccactgatactgatcaatgcactgcagctactgtgggaaaatcggagcacagctcatgaattactgtttatttacctgaggagaagttgctgcctcgattaatctcatctatttcagtttatttatgtaaacctgaggcgtcccgagcatatcggaacaggccacacgtgttaggctagaaccataccctccccgcgaatccaacggcccgcgaaatgcctcttcccacaagcacgaatcatgaggtgagaaatgcgccacggggtaaacacgtaccgaattcaaacggccgcgggcaatcccccaatttccaattccagggagggtcgcgaaccctccattggccattgctcgatctctgtccctctcgtcgcaccttcgcagccgtcgttcaccgaggccgcgg

SEQ ID NO: 1766 - DNA, 120 bp, Zea mays
ggtacaccctacttgcatccgatctttcctcttgcatgccatggaaatcaatgcttgatctgtgtgatatgattcaaagcagtcgaaacagacaccaaggagttgtgggtaggagaatgg

SEQ ID NO: 1767 - DNA, 911 bp, Zea mays
ggggagaatagggacaactttttagttagatgacttttctgatgacaccgataggggctttgtgcataggatccaagaatttaaagttagaaagacactgaaaaagatgaaagggggtaaggtgatgggtcctaaaggtatctcaattaagacatagatgcctcaggaacataactatagtatggttaaccaagttgttcaaccatatctttcggtcaaacaagatgcatgtcgagtgaagaagtatattgatatcgatctataagaatatgggagatattcaaagtcatactaattactaaggaattaaattgatgatccatactataaagctatggaagagagttatcgagcatattctaagaggaataacgatttggtttgatgcttagaaggttaaacatgaaagccattttcttaataagacaagtgatggagcagtattgggattagaataagacctacacatggttttcattgacttagagaaagcttacgataaaataccaaagaatgttatgtaagcttacgataaaaataaaataccaaagaatattatgtggtggactttacaaacataaagttaagtatgttgaactcattaaggacatgtacaacaatgtggtgaccaatgttcgaacaagtgatgaagacatagatgacttcctgattagaataggactacatcaagaattagctttgagcctttaccttttgggctagtgcacaggggatgtacaaggataaatcccttggtgtatgttttttatggacaatgcagtgctagctaatgaaagtcgagcactgatgaatcccctaatgatttttatcaaaatcattaagttaaggtagatacacatcttgtcatatgatcaaatggtttcgccaaaaatcaataatcagacaacaaa

SEQ ID NO: 1768 - DNA, 267 bp, Zea mays
aaaaaaagaaaatcaggcctaaaactatacaagcattatttacagcctaggctccactctgtaaaaaaccatgacaagcattattcaccaagtccataaactactgccacataaaccgaacacaacttcgagtcatcagttctcgttgtcaagctcatcgatactcgacgcgacagatctgactttccgtagattaagacaagtctccaatggaatttcacacacggccgggcggccggccggcagtcaattagtcgaaggcttttg

SEQ ID NO: 1769 - DNA, 721 bp, Zea mays
gtcgacctgcagcgtcgtcctgccgcatctgtgtcttttaattttttttggggtcgccgggtggtgctcgggggcacggttcccgcgcgatcggccggtcattcgcgggaaacatcgatccgatgaggcgcgcgcccctcggcgcgtccgccgcgggcgggtccagttcgtcaaggctcggtcgcggagtggatttggggtgagaggtgcggttttcgctgggtttcgggtcgggatttggggttagttgcgggcgtgtggcgatctgttctctgaccggccgtaatctggtgcgcaaaaccaatatttttttccccgtcggttgggaatcggcatggtgcatccagtgatggggatgggatgctcccctcccttttccttttgagtgctgattgacgttttcgattcctcggcaaagggtgtggtggtagggaagctgaccgtttcttgatggcgatgaggatccagctccgctgattctcccctctttttacctctattggtcgccgaccctggccatgcccagtgttagttagtttgtccttttggcgatgttggtagatggctagatggataggttgctagagtgagattgatgtgtattctttgccatgttcgttgttgttctttatactgatgaacgattgtaactgtgtctgcatgtggagattggaaggagctcggagggctggggcgctgacctgagttttatggagagagg

SEQ ID NO: 1770 - DNA, 511 bp, Zea mays
cgtgtctagatttatcattatctatttgaatatagacataaaaatcaagagctataactactaatattacgggatggagggagtagaagatagtgagtttcttttgtaatagcgatgatatatgatatattctaaatcaagtacacgctactatttcaaatcgtgttcatatcttcataaaaatgcataaatgcatacatacataaaaacgatatcttcataaaaaaacaaaacaggtttaaaagccaaacaaaccctagcttgttctttgaacattcggatctagatattcctaaaaaagaaagaaataaagaaaataaaatggagatagactgatagaggcccaatggccaccgctaataatggcgcctcctccctttaaatacgtctctcacctcctttcttctacctgcagtcattcattccaagagcacgccattcctgaaagacaaggccaagattgtcgccggcagttgccaagacgagaggggggaaaaacagggcgagatcg

SEQ ID NO: 1771 - DNA, 295 bp, Zea mays
tttctaataatgccatgtatatgatgcatgactacacggcattcctatrtatatagtatatacatatacttcacccactccccgtgcccccggcccgcgcgctcccaagacaggctacacgatcgacctcgtcgttgccgttgtcgtcgtcttgtcaattggctccatccattagctagtagctaccttgtatagttggacccaaaaaaaaaagctttggtagctagcgagctagctagctctcatctcctgttgctagctcgtcgcgcgcgcgcgtcgacgaccagagctagcc

SEQ ID NO: 1772 - DNA, 514 bp, Zea mays
ttagcggcggccggcggacgggaaaggctggcgagggttttgttagtcgccggcgggtgtgtctcttcagcaaaacggcccagtaatacaatacaagacaacgaaacgaggtcagacaagtgggcctcggacagatacggctcagcccaataattcccacctgaatggtctggcccacacacgcgtcgcgtcgcgtggccgttgcccagccacccagcccgcccggaaaagtgcagcctcgtcagagtggtgggccagacagcttggccgcccaatccagcgtcgccatcccatcgtcgtcgtcttccatagctgagcttgtggtgtctccgcagtccgcacttggcaattccgtggccattatctactcctcggctcctctcctcgcagaagaattcgttcccccaatttggagttggaaaagcgtcgaccccagaaaacgggaggcctcgacctcgctagtctccgttccattcgaaaagccatcgcctggtgagcgagaaggggaaggtcg

SEQ ID NO: 1773 - DNA, 1073 bp, Zea mays
gttaaaatttgaatgcattttagtgctaagatttcttttgggctcaactggcttgaccagctgaactttctagttcagctggaggaggccagttgaacttagcagctgaacttcagctcagctgcttttaaccagtttttaccaggaccatcctggttaaaaccggttgaaccggcatagtggaccgtttgaaccggtctctgaccggcctgtccgcgcaggtctgtcacctgcactttttcagtcgcacaacacctttttgaccggtcgcaggtctgtcacctgcacttttttcagtcgcgctgcaccttttcttttggtctcgcagcactttttcttgaccggtcgcttcctcgtgcattttttttattcggttgcatcctgcatgaccagtcatttcatctgcgtccggtcacttcccctgcggcgcacgcagtgttttgtttttacttgctgccgctctgcagacagcagcgtctgtcagcgcccctgtccggtcacttcacgcgcgcgcagagttttttttttggctgtgcatgcagaggcttttccacttttccctgtccggtccttcacgcgagtggagaatcttttatttggtcacctggttgtctcagcttgcatgcaaatgtcagggcgtcaatgcgcgcaatgtacttttttttgcatgcatacacctttgccttgtccgatcacttcccctggcgcgcagataaagtttttttttgcttgctgccgctcagcgcgccactttttctgtccggtcgcttcttgtctgcgtgcacagtcctttttttgtggagttcggtcagcaggggtgtgcatgcagaatcttttttctgggtgtgcatgctgtgtccggtcacttctcctctgctgagcgcgcgcagatttttcttggacatttctgctctgcccgcgcactagccatgcatgcgtgtcaggggcgcaaatttttttcgtgtccagtcgcttccagcagctgcgcgcaaatttgaatttttttttttgcatcttccctctgctgtttctggctctctgaccacactggtcagaaccagctgaactggccc

SEQ ID NO: 1774 - DNA, 1500 bp, Zea mays
tgcaactcaaacatcgtccacacttctaatattgtacccacagggactaggggtgataaccttgtaatatcaccgtctgtctagaatgaggaatagaaagccatttgtgtttctagtccaccatcatgggactaaactgctcaagccaatccatacccaggataatgtcataattgaaagggaaatgtgcccttgggccatttctatgtattttggtgattgagtgccaacacatgtgcttaattgggaatttatgtacatggatgaacaaggtgaaaatcatgaagtaaaggtatgtttctaagccttagtacattggttttaagtactaatatatttgtctaagtgttagaaacagaaagaagaagaatagagaaaaggagaagggacttggctgtgtgctgccaagatccagctcggtctggagcaccggactgtccggtgtgcaccggacagtgtccggtgcgccaggctggcgcgactcgaactggccgctctcgggaaattgrccggcggcgtacggctaaaattcaccggactgtccggtgtgcaccggactgtccggtgagccaacggtcggccagggccaacggtcggccgcgcaatccgcgcgggacacgtggccgagccaacggtcggaagacggcaccggactgtccggtgtgcaccggacatgtccggtgcgccaacagcgccagatctgccaacggtctgcaacggtcgtcttcgccgtttaaggaaacaaatcgggcaccggacagtgtccggtgtgcaccggactgtccggtgcccccgacgacaaaggcaaggatggccttccggatttgctctcaacggctcctagctgccttggggctataaaaggagcccctaggcgcatggaggacatacacaagcaacctttgagcattcttgatcatccacactaagtctctgcgcattcgtttgtgtttctaagtgattcgagctctgttctaagtgagaactctgagatagtcttgtgagctcgattcttggccgtgtgtgtgcgcttttgctgtggatttgtgtgtgttgcttccctcccttactctgtgtttcatttgtgatcatatacttgtaagggcaagagactccaatttgtggagattccttgcaaacgggatagtgaaaggaaaacaaaacaccgtggtattcaagtgggtctttggaccgcttgagaggggttgattgcaaccctcgtccgttgggacgccacaacgtggagtaggcaagcgttggtcttggccgaaccacgggataaaaccactgtgtcactctgtgcttgattggattcttgtggttattgtgttttgactcctctctagccacttggcataaactgtgctaacacctaatcaagttttgtggctataagtttgaagttttttacaggatcacctattcaacccccccccctctaggtgctctcaattggtatcagagccgttctcttcacaaagggactaaccgcccgaagag

SEQ ID NO: 1775 - DNA, 469 bp, Zea mays
ctgcctccgaccatcgagcatcgcccccgagcagtaaaggagtcgtcgcgccaagcaggaaggtaggaagcttcactccgcaccctgtccagtccgccctccgcctctgatgattcactcccacgacggcatgatctaacctgggctgaggtgactgcgtatcctgtatcccccgactagagggtttgacgttttgtgggttaggaagcacggatggatcgcccggatggtggattgttctacgaatgagcttttgactaaccagcaatcgaatctagatcagtattcttgggacgattactccagtccatccatccatccatgctgttagctatactaggtcattgaaattgcttagttatgcctgaatttgattgaccttgacccygtctattacttgtttcttttggtcatcatagttaggtacatgtgaacagcagggcctatcttctgcttttgcttcttagca

SEQ ID NO: 1776 - DNA, 216 bp, Zea mays
ctacaaaagcatcatcttcatgtcagcttacaactaatcacataaggcccggttgaatgtgggacctgaatcagatttcaaacaaataataacaacccccagaaaatgcatccctgcccccacccaacatccaggcatagtttagctgctcaagctttattaatatcaatcatgtagtttgacaagtgcacagtctcaacatgtatgcaaaactaa

SEQ ID NO: 1777 - DNA, 1500 bp, Zea mays
aacaactctctttatgtctcaacaagtgtgtttgacttagagataggaaattgaggttgatttgcaaaaacaaaccaagtggtggcaaagaatgatccaaatatgccaaatttgaatcaaaacaaatttgagttttcatttgcattgatgttgcacttcttttagttgctttttattgtgttggcataaatcaccaaaaagggggagattgaaagggaaatgtgcccttgggccatttctaagtattttggtgattaagtgtccaacacaagtgcctaagtgttaaattgtgccaaggactcaagaagtgcaaatcaagattaaaggtatgtttctagacttagtacattgttttgaagactaatgtattgtgtctaagtgctagaaacaggagaaacaattttggagaagttggctgtgtacagccaaaaggctgctcggtctgggtgcaccggactgtccggtggtgcaccggacagtgtccggtgcgccaggctggcgtctatcaactggctgctctccggacttcgacggcgatggacggctataaatcactggactgtccggtggtgcaccggactgtccggtgagccaacagtcggccgggccaacggtcggctgcgtaatccgcgcgcgacgcgtggcagagccaatggtcagaagggggcaccggactgtccggtgtgcaccggacagtgtccggtgcgccaatggctctgaatctccaacggtcggctgtgccaaaataggaaagaaatccgcaccggacagtgtccggtgcgcccggcgatagaaggcaagaattgccttcctggaatgctctcaacggctcctagctaccttggggctataaaagggacccctaggcgcatggaggaggaaaccaagcattatctaagcattcctaagcaccaagactccaattccgcgcattcgattctttgtgatagcaactagagctccatttgagtagagaactctttgggttgtgttgtgagctcgagttgtgacttgtgtgcgtgttgtgctctgattttgtgtcttgtgtgcgttgctcaccccagccttacttccgtgcttctttgtgaacatcaaattgtaagggcgagaggctccaagttgtggagattcctcgcaagcgggatatagtaaacaaagcaaaacaccgtggtattcaagtgggtctttggaccgcttgagaggggttgattgcaaccctcgtccattgggacgccacaacgtggagtaggcaagtgttgaacttggccgaaccacgggataaaccactgtgcctatctgtgttgatcttcttgtggttatcgtgtcttacaagaactcctctctagccacttggctttattgtgctaactcgtaatcaagttttgtggcattaagtttcaagtttttataggatcacctattcacccccccccccctctaggtgctctcaattggtattggagtcgttctcttcaagaaagggactaatcgcccgaagag

SEQ ID NO: 1778 - DNA, 910 bp, Zea mays
ggtgtttaaatagtgtttactagatgactgctaaacgatcaaaacataccacacattaaacacaagaccatgtttgtgttgtttgtggatggtaacagcaagcgtagagcaaatggactattagattataataatttgacacgatgtatagcaccacaaagaaaattccataaaacgcatgttacggaaaatatctacgcgttaaagcaacagataataatggtttaaaattgtaaagaatttttatcatgataccgtcgtcttttaaaatgtccatcactcaatctcttgcaacaaaaatgacgtcacacggtcagacaaacaagttaatgagcacaccatcactactcactagtctattatccttgcatgcagcacccacatggcaacatgggtgtacagtgaagtccagcacaagaagtaaaacacttgaaacacacacacaaaaaaaacacatcatacacactagtgcactttatgaggggaaaaaaagccctgtgttgtatagtttgccgaatgcagattacaatttgaaagtttggggcaagcaggtcgtttggcagtaagaatccagcatgtggattgttagttgttacaatttatgagttgtctgctgaaatataaaataaaattggacccaaagaaaatagaaaagaaaagaaaaaactgtgggacagtacaaggggccgcctagcaactagcatatatatacccacacatgttctcgatttcccgcaaggcacaagtaactttttgttgcatcccaccctcatttgacgctgatgataaaaaggccctcgcggtcgcaccacatacaggcaaccagcctcttgatcacttgatcctcctgcacaccagagtaccagacaccactgcgcatcagtgcaaagaggtagctaccctatctgcc

SEQ ID NO: 1779 - DNA, 330 bp, Zea mays
aagacgaccctgtcgccaggtcgcggaccgtccggccctagggcgcggaccgtccggccgtcaggcaggaaaccctagcctcgtgccaggtcgcggaccgtccggccctgcgtcgcggaccgtccgcgcctgaccagagagcaccgccgccggttcttttgagtgattggcgccccaaaaaggtgccaacaccaggactttgttccaggtttctttgtctctaatctctatgaagcagtacatgtttttggctgtgccttgttggctttcactgctctgctgctcatctcctcctaactacgcctgcctgtttcctcccccgcaggattg

SEQ ID NO: 1780 - DNA, 338 bp, Zea mays
ttgacccgggcgctgtgcgggtgggcaacctgtccctgctccccgggggcggtcacgcgttgcacgggcgttgaattctttatgccgctcatgcctccttcgcccgtgcgcgccgcgcccgcccctccgggcgcatgccgccggcagcagcaaacagcagcagccaggacgagccgcggatcgcacgagcgggtgccgccgcgcgcctatttatgcgcccggcgcgcaatgtgagcgccgcaatagctggggcactgctcgctcgctcgctacgcggacctgtggcgtacgcgtaccactccgagacagcaggcgcgtgcgagagcagcccggcgagg

SEQ ID NO: 1781 - DNA, 1500 bp, Zea mays
ggctgctggccagcttgcagatctttttcccaacaagaacacagttccgttatcccgtgtagcccgcctttgcgctctgctgatgccggcgatctgagagcaaagggccagggaacagtttactactccatcatccaacgtccgaacagacaagccagagtttaatgcgtgtcttgcatagccacgcaaaagaatgtctcgtttcttcagaaccgggagcaaggaaaatccagaagtcatgtatgacaaggagtgaaaactaaagccggatgcttagaagagaacttcatctgggtttaaaaaaaaatgcatcatcctgacggccggcatccctgatgagaaatatctctccacgagtggaccctatagactagtttgccccccaggattcaggcgccggcatggcttcaaggtggtgctcgctgacgctgctcgatcggttgcttggaaggagctgagcaggcaggaagcaaccagctgctctgccttgcagcctgcggctagcgcgccaagcaagacgttcaggagacctgcaagaaagcgccatggtgtgtgttgccgcatgtttttattattacaatcagatgcaacgaaaaaatcgctaatgattccttgtaatccagattaaaggagtacataaagtggactcgtaatcatacaacacgtacaacacatatatatgatcagattagctctcatctgggagaaaaaacagctggcgctgttgattaacaacgaaggtatccatatgttagatcactttatatattaaaaaaaagatatgcgttggatagcatttccaactaccaaaacgttggttcaacccttctttcttttagcaatcatttacaagaggccacatcaatcaggcttggccttctccacccgatttgccacgtcagggtccatgctatgccctgctgctgacggcacatctggataacattgtctttgtatgaaaaaaaaataatcaagaagaaaattttcgtttccaggaaagcgaagcgagcgtatacgaaggagaactcccagaacgagttgggttcgtttgcggctaaatttaagacagagattaggttgtttgagttaaattatgactctttcttgttctttttgttttttcctctctctctctctctctagtttgcaattaccagtactccatcttgaaactgacagcaatggggggaagagatttaggcaagatttgtttcggactgggacggggtcatgtcgaatcggagaaggaatcacactgtttaagcaaaagagtagacgcgggatggagtccgctccacgccacacgggatcctataaattgcccgccttttcttctccaatccactcatcataaatctctctcgctcgctcgctcgctctccaggctccagctagactgtcctgctctgcttcggtgctactcactgtgcagtgtgcacagccagccagcttcagcagagtccggctcggctgtcggctgcgagtcctgctcctgcagga

SEQ ID NO: 1782 - DNA, 736 bp, Zea mays
ggtacaaatattatctgttcagaaccctactatacaagagatggtgttactatgctaaagcgtaccattggatgggatagttcatcagcgtcttccattgatcaagggtctacaaggcaatctggacatttggaacaccttaaaagtagtaatcgtcatgactttgagaagtctcaaataagtagtaccatgagttgtaaaagcattgcatccatgtcagacatgtcaagtagcaattgttcagtttcagtttgtcctcgggatgatgcaattgcagatactggcttcctaaccgacaattcagaaagcagtgctcctcgatccataatttgtactgaagaacttaatgagtcgtgtaagtacacactctcaagtgctatagagtgctggtctgctgcacaggctattgttaatgttggcattggttcaactgaagatgtagtgattcagaaactatgtacaggtaggatggttcacaaagattacacaagtgataactcatgttcatcagatactgaaacatgtagcaatatctcactctctctggctcctgaggaacgatgcatacagaaaattgaagaaggtacctcagttggcactccagaacacccagatggtgattgtggcatcagtaattatcaaatgcagcatgaaacaattcctgaggcagataggttggatgatggttgtgcgtctgttatctctgaggaggccaacataatggggcttcctggta

SEQ ID NO: 1783 - DNA, 1500 bp, Zea mays
gactatagtaccaactaccaaacagtagtagctcgggtgaacaatgacacgctaggaatgaagggagagagaagcggtccgctcgctgggagggcctcgtagggacaagcgatgcgtgcgtggggatctcctgcagccgacatgcatggggaggggaagctcgcgcggcaacccgtgtggacagtctaacagtctctcaaaaaaatgactcaaaatagtgtcacaaatattaaaatactatattattcaaaatgtttagagcactaaaaataagttgtgcttcaatagttaagccctaaattatttagttttaaaagtgaattacattattagaaaaaatgttgagaatgactaggaaaaaagataggacactagactcgggtgtagtatatttaggccactttataaagtgctatatattatttttataaaaaatggttgagcaccatttgcgacacagggcacgaccggacggtccgcaaatagatcgaatcaggcgcaactaatcccttttccggatgagtttatccctctaaactcgcggttgctgttgggagacgtctatgaacgagaccagaccttccctttatattttaaggggtacgaccgtttgcagaatcgatcaaacaattaatatatcttccattctttacattttgccctagaagtagacattaacatagttttcttcctctaatcttcacctctatacgattctatgtcgtataragacgtcatgtatggcctggtgatcccaagacaaacttatgatctcttcttcctgacgggatctatctcggaagtgagatccacgtgctattggcgaacttcgtcgcctcggcgtacacttggatgtccgacaactagacgcagaccgtccgtctcatcggcagaaactctagcctttgcgttaggtcgcggaccatccgatccttgcccgttgattgacggcgagatcgacgccaacaaaattataaaataaaacactattagagttattttttatggatcgagtcctatatattttaaaatagcttcaaacaaactcccaaatttcaacgtccaagggtggcgcgagcacacagacatagaggcacggaaagcagagcgcgaggaagagagagacagagagaaaaacccaaaccctaacaatcatttccaggcccccgccccccggcgtctccagaacgttccagaaccttcaaggaaccatccacaggcgaggcctcgttccccgcccgtatctccccatttccacccggccggcgcggcgggatcctgactctggcgctgtctgctggggtttcgtgtaggagcaggcgcgagcgcgggtgtttggatcgtgggaggcaacgctggcggctcgcagcggcagcaggtgatggcggattcgcctagcggtggaggatctagggcttgtgtctgctgggtgagacaggtcgaggaggcagcgtcggggctggtgctcgggagaaacgaacaggggaggagggagggagg

SEQ ID NO: 1784 - DNA, 786 bp, Zea mays
actatcccatccaatggtacgctttagcatagtaacaccatctcttgtatagtagggttctgaacagataatatttgtaccatgctaagggtcgcccttctataacaggccatttgttactgcttgacttctgcagcagtactgaaatcccagcaccctccgtattttcaacctttagatttgaatgcccagccgatccctgtttacaacaactgtcataggtaagtgtattagaggcaaattcaatgctttgatacactgaccctggcaggcgttggaacacctcattctggtggttggcagtttgatctcttaaattatcacactcaactacagatgctagttccgattgttgataattatttatgttacattgatgggatgaaatatcgaggctacttccttgggaagagttgccaacatcatctggccttaaattttcattaacattctctccatgcagcattaaaagcattctgtcggttgtatatattgttgactgagactgaggacacttttgcagacaatcagctggaggttcatcattcaacagctgactatcaagaaatgacttcttggtatcttcaccatgatcgggagtaatgtgaggagcttccaaggcaacacaaggtttagaaattctagttttgtggtctttttgatgttcttccaaagtctctatcttggggttcacaaaaagaacctcatctactaaaccacattcttcacacaaatcaatttctccatcatcttttatcgcattaaataacttttcacacctagtgc

SEQ ID NO: 1785 - DNA, 1446 bp, Zea mays
tagaaaatttggatttatacccttaaaaagattacaactttagatatatattgttgtcatctcacttacatatagatttcatgagtctatgatgtgtgaaatcaatggtatatatataaagttgcaattttttaatggtatagatccaattattcataatcttattatattttctttcgtgttaacatccagtacacggagaatcaatttttgaaatattttagactagcatttttttctttaggtgtcggtctatgtggattcaggcatccatgatagcacatatgccatgtaaagcattgtttatcgagtaaagtttgaaataagagattaataagaataagtaactattggagatagtatcagaacatgtttgcttcatatttaggctctatccaaatctctaaaatgagttagcatctaaaattaaccgagaagtttagaacgggttagataacataccaactaattattagtcatcatacatcttaatagttattagtcgttagctattttaacctatccaataatttattaattgactgataattagctttagagatttggaatatggccttaaggtctgtttatttacgattataatctgctcaaattatataatctaacttgttttgaataaaatagtttagattatatgatgtgattggattataatctcaaacaatactcagatttgctttgaaagtgcattattcttttgtctgagctcctagcatcctacacataggatgaccttacaattttcgctctagcaatgtgactaggtgggacaaggtaaatagatgcgaataggcgattagcccagattaaaccaaacgtgcctacttatctattgtctatcgtatagttgtcagctactcttctttgtgccataaacgtcttacataatagatctgtagtttttgtattgcgtttctttttttcaatagaaggctttcgtatcatgaactattctattagctggaagaggtacggttttttttttgttgcacgggatgagagaggtttgattgattaagattaaatcattttttaattttaaccgccagaagaagctcggtaccagaaatgttagggcgattttgtatcaccaactaccaattcacttaatttcactatccaccaaattagtccggctggactagtggacccgagtccacatctgacctccgcctgctcgccctctctctctcgatggtcgtcttctccacgagaccacgaccgatcaaccccaatcgtagggaactgggaacccggacccagatctctaaaaaatccccaatcccaatctgccgtacgccgttgcgatcatacctccaaatccgcccccaagtctgttcgatgcgaatagcacctgcgatttagcgaaccgtgcgctcgctaggtttagggtttcgagggtttgcgttagggtttgggcgcacg

SEQ ID NO: 1786 - DNA, 1282 bp, Zea mays
ggatgccttataggcaagaaattctgcagctgagcggttctagctccgtaagaaaaacaaaagaaggaccagtcatgtgattcgcgacttttctaagctccagaaggaacgagggtttgacgattgacgccgtcgtgaaaggaggagggcctcccgttcccgtccttccagtctggcccacctaccagtcacccagccagcctgtgatcgcgtaataataaccagatccaactaaacctccccaactgacttttcgaaaatggaggagtcgtcggtgacggtacctgtgcttttcccagctccagctcgtttttaacaaccccggacagaattttaatccaagcgagaaggtacaaaaaaaaggaaacactccaccgtcgttacctaatcaccgtagattaattattctgtactcccgctaaccgtccgattaattattattcgttcgcgcagcaagcattcccactcgcggggtggggtgcctggaaagaaagcacgcacaattcctctttccctcactgctcgccaacccagcgcacggcacaacccattcgcaccgcagcgcgtcgcggcgagcgggcgggcgggcgacaccgacagctcaggaagacaaggaggggagcgagggaggcggaagaaaaaggcacgaaagccaagggaagcgggcgcgaccaccgccacgccctacccccccccctcccccgccgcctagtccgagttgtggaatccccgtggactcccgccccccgtccatcccccgcgcgtcgccgcggcgcgccgggccgatctgctccgccgccccgcccgcctcctcaggtgcgcttctggctgccttcacgccgtctccgtcgctgccgcgtctcctcccccggtcggtccgagaatggctcggccaccggacctccttcggggacgcggcggtgtcggtggctgctagatctggggcgcgcggcacggccacggccgcggccgcgaggttgccgccggcgtggcccgcgtagatctagccgtcccgcattcttttttccggtttctggggctgcttcgaattttagagctgcggggtttcgtgtcgccgtccaaattcgtgctctgagcttccagccgaggccgaaacgggagcgcgagcgggaatgcttgcgacgggatctcgatcgcagctggatcttacgtacgcggtgtgaatgaattgtctcacccctgactgttgcaggtgtccagccgaggaggacgtagagctgggcatataacgagctagatttcaaaaaaaaaaaagggaacc

SEQ ID NO: 1787 - DNA, 81 bp, Zea mays
ttctgcatcaattggcggagttccagccacaagttcagatgcttcagctgacgaatcttgcacgtggggattgctttcaga

SEQ ID NO: 1788 - DNA, 290 bp, Zea mays
ggccgcagcgatgcgtttttttagtttgttatcctgtgcccgcaaccattcccggaaggtgtcggtaaaaatgatttcccacatagcgcaatctccatataagtgattgcttatagcaatttataagcaatcacttatatgatcaagcgagtcagcagaagtaaaacaccaaatgctcaaactggataatgctgcacaaagcatgacaggcgttatctgccgattaactggtcaatgtgagctgaatcgcgctagcattaaagccagaccctgaattaaccgaggacgtt

SEQ ID NO: 1789 - DNA, 1081 bp, Zea mays
gtaaagttcgcaaccgtattatgctcatgtacgttattttcacacgcattcgggatggagattttattctttaagatattttgctttgcgcaccagtttagctagcctttccattttcctcgtccttttatcgaacaacaggttttctcaaagattaaacataaaacatagcctttccgcttgaaatcccacaacccaaaaagaaagtaaactggtttggaaggcacgtaaaattttcagtaaacttcgttgtgctatattccatattccgatagctcacgtgycagcagatcctctattttattctctaacttattctctattttaaactttaatttacaaataatattatgtttgtttctaattttatctggtttacgaagatagtctgacacactcctatgctaatgcataccatttcttcataaggcagcagttagtaaagctgcaacccgcgctttactaactgctgcgtgtaaaaaaatctttccagctaaagttcggctgtcatacgaatagacgatgctacggagcagtgagccacaaggttctaaaagactaaaactacgagagtaacaattttatccttgaagaaggatctaaacataaaacaccccccgtgcagtaaacttttttcgacgccacgccacggatgaccggccgtgcgcggcatttacctcggcatccctgttaaaatcccggcaactccctatataacccacccgccgccgccaggccacaggccagagaccgccaccgcgctgttccgagcccgctaaccgcgacggttaaaaacgcgtacggcatcgtcgcgttccctcctcccagtccccccatctctgtccctgtcccccctcctcctcgccttttaccccgcatcgcctcgccgcctcctgcccgtctcgctgaaaccctcttggtcaccgccgtggtcgatccgacccggcagtagccgcagtatcctccgagggtcgttggcgggggagtcgtcgtcgtcgtatttggctgccggaattcgatgcgccacggagcgggcgagaggacctagttgagttgaatacggcagcgacgggaggacgtg

SEQ ID NO: 1790 - DNA, 328 bp, Zea mays
tcgctgcaaccgccgccgcggtggctcgcctcgcctctcggtctcgctcgccggcgtcggagcaaaagccgaaggtgcggagaaaagggctgaggcagcaagcctacaagtagaagcaggctgcaggctagtgtgatttcggcgcgatggactgggccgtaggcccgcgagtcggtccaggacggcccatttaacaaaggagaagtggccccgtcttccacccagtgtcagtgctctctctccgtcgtcgtcttcctccgttccttgtctcgtcgcgtgtgatcgcatcacggaccgcgacatttatcggtcggagagggagggacac

SEQ ID NO: 1791 - DNA, 1370 bp, Zea mays
gctaactataatacattttactacttttaaagtatatatacacttatacttagtgagtgtttraatgcaatagaactaagagttagttaactaaaaatatactagtagaattagctagctaacaaatagttagctaactagtagctaatttactaaaaatagctaataactgaactattagctaggatgtttaaaaattaaatgtctttagccattttttaccactacctattatttttagtgcacccctttacttttctttcttttttataaaataatgaacgcaaccccaatctaacacatgttggagtgaaatttcactctccctctctcctcgcccgccgcctgaaaattttcgcctcgttgtctctatttcttttcagaccgcaccttttcagtgtccgccaccacttctcccttcacaaccccaacctcgaaaacgaaggcgccaaaccattccccaaacgctctcgcgtccgcccgacagctcgcctgcctgcctctccgtcgtcgccgagtccctcgccggctctaccaggcggtggcgaaggcacttcggcggggacgctcaaccgccccgcgggcggcgtcgacggtcggttcccggcggcctcgcggaggttgcatcccgtgtcgaatcgaggtatttgtcggtgagatccgcgaaccctagcgcgtttcttatttcttcgttctgtttgttgcgggtgggtcgtactgcggcaaggggcatcgctgcacgtgggggatggcgcggtcggtgcctccgcggatgtggcgtgggctacctggyccagataggaaccgggcattggattatgggtggcacggatgctgcggcgtaatacgccgctgctgggatccagtggtgtgggaaatgagagagttcgggattgttggggtttctgggttgttagatttcgagctgctttgcccattttgtgaggttagggtccagggttgyttttggactcgttcaccttgcgcttgttcattttgcacaagtgctgggcggcttagtgtgactcgtgatagtgttgcattgatgcactgcgcttgatgtgggtaacaaaagagcaagtttcaagatgctgctctgatgtggtgtgttttccattttctgatggaatcatttctagccagattttacattagattgcctttctcattggtccaagaacaaggtgctcgtactatcactatgtacactcttgtaattgttccttattactcatttgtgcctggagctgttggcagattgcattacaaatcaacttatttgcactgttgtagattattccatgcaagagctttacgggagaaatgaaagttgtgctttattttcaagtgcaggcaggatcctacgccaa

SEQ ID NO: 1792 - DNA, 1500 bp, Zea mays
agccaaaacaaaaaagacagctaaatggtcaaacggctgtcgtatttgcctggctcctgttagagctagcctagggcatcgaaatggaataaagatgatgtcaagagaatatccccccatctgtgacagttgaggggcgtcaacgcgtgggcacgaccggttcagacggtgcccacctctgctctgcttgcctgaattggtgaggttggtgaagcaaagctaaccactggccaccatttccatggttgtcaatctgataagcatctcgtcagtttttcattcttcaacaactcatgccgtcatgcggaactcgtgcggtgaagacgtaaatccgcagaagcgaaagcgtctagtcggatcaagccgcattgtactaaaaaaattcagagtgatttgacctcacctcttctttcggagtgattagtagggtgatagagacaggctatgtgtcattggcggttcttgggagcgccaagagctgtttcgtccagctaagaaatcgctttggcgacaatgggaagggcagagaggttgaacaataacagaaggtgcgtctattgctagctgcagagaagccagctgcaggctgcacctgcgcatggtttgaacaacctgccaattgttaacattgaattagtttcactcgaattaccttaaaatatgtatagcacatttacctttttcactgtgggtgtttatttattttatttttttataaattttgtggagatttgcaaaactatacttgaagcaacagcaggaaactctttgtcgcctctaattttcctgaaaatttcagaggggatagcccggtttcatgaaacggcggcagacaccctccctgttcccacagcggcaccaacccatgcgcaagcgcaatgcaccaaccaaaccaacaactccggtcgctctcccggtcgcagccaccgtttataaaaaaaaaacccgaccgagcagcgccgcaccagaagtcgggagcacgacccactggagccagcaaacaacaacgagtcccttttcgcctcttgcccgttgcccctcggtttcgtcgccgctacccggcgatctccgcgacagcgacccggtgccgccgccgcagatctcgccgagaagacaggtatcggtgccgccgccagatcaactggacctgtaaaacgagggcctgcgctacctgtggctgtggagttcccgaggcgctgttctgccaggattcggcatcctttgttgcccacgtatgtgatcttcgtgctttgcttaggttctggggtgttagtgctaattgttgatgggttaactagattccggtgctgctagcatgaggtggtcgtcctaatgatctttttttcccatttggttttatctctaggctgctcaatgttaggataagaaagttttaatgattacactctctcttgcaaaatcaccgcattcaattggggctttaagcccttagctgcctatataagaattcagctaattttgttgtgtgtattggaacag

SEQ ID NO: 1793 - DNA, 305 bp, Zea mays
ggttggccctaattcatgtatatttccacaagtagatttgtattttttatttttaagtaattagtatctattcgtgattggatacttgtgaagtacaagtaccttgtggcattactaggggatatggctatgagtatggccatataacatataagtcaatgtttgctactcttagataacattgtactgtactagtttatgaagttctcccatgtccatgtacatctatgcattcaggatttatgttcgatttagtttgcagcatgttactgatggccccattgttgtagtgtttggagctgaaa

SEQ ID NO: 1794 - DNA, 222 bp, Zea mays
ctgggagcagcacaccagagtatggactatgaactctatttgcagcacttttgatatataaggatttaccccattgaagatacagttgttgcaacggttctaaattttccatgccacaagaataatgaaataataagccctttcttgacctttggggaccaccttcattaccttgcaccaccaacttgagaatctgctggtggaagattgtggtgtgatggc

SEQ ID NO: 1795 - DNA, 533 bp, Zea mays
ggtagaggagaaaccgattcaccgcccaccgaaagtaaatctgaatgaaatatctacagttctatgaagtacttattgcttcactttgttttgctatttttgcacatggtttcaggtgaaataatgtttgtctttggagcatatgacttatgggagtttagttattgcaatacttccactccctacccctaactaaatgatttgatagaagagaaatgattgtatcgtaacatttaatatgggcacagatagtcggttcctgtataatgacccgctcatgccataagaaatttactgaaatgccttcttcctgttcattcttggtttatgccaaccaagaactacaagggaatctcgtgtattggatcacacacactgtttgctagctgtttgctttttttaggcgtacctgccactaaattgtgtttccatcgtcgttggtagatgccgggagaagcagcgcaaggagtcctctcgtctacaaatcgtgaaccgaaagctgagtgcgatgaacmagttgttgatggaggaga

SEQ ID NO: 1796 - DNA, 1099 bp, Zea mays
agtatcaaactttattctacaaataatattaaacaatgtaatctacggttctgtgtacctattttacattattcgttggagtagactgtcttcggtggatcctataaaataagaaatgcgacactgtaaaatttaaaatataagataagataaatgatatgtaaggagagctgttgaagataaacttagtttatattttggaagcacatagtttttaataaaccggtttatataaattgaggtagtttcaaacattatgtctatatcatcgaggagagataagtttaccctccacctactgtatccaacatgggatgtatccctattcctgattgcacgaaggcagatatcaacatctaatctatcatcgacttgatttaccgagaggattaggcacaagacacagcacaaagcacctatcaaaatccgttgcttttccaccacccactctcgcatctccgctctctccttctccacaagaaacaattccatcacacaaagttttgcaaatattttcttctctgccttctccttcctgccatgcattcgtaggtccactcatgtcactaaaagaaaaaaaaagttgagggactagtgactaccaccagacagacctcgagtgctccattgctcccgtcccccttctctcccgcctcccccccttctctcgtcgctagacctgccgcccggccggcctatatgttctctccttttgagagaagggaggaatagccgcaagcctgcagcgcaaaggaaagcacagcagcggcggtttgcaaaagagcccgccacctctgtctctctgccctgcgctgcgccgtccacaccactcatccggcaacctctctctgtctccactcgtacagtattaatttcctcgcgcctcctccgtcctccattttttttgttgggtgccgtgcgagctccaagtacccctgtctccctcccgtcttgcgggcttgcctttgcctgttccatttccggctcctccagttggtagtgtcgtttcaatgcgagacgccgtccttcacgagcttgattgcccttgaaagcgaagttggtgttggtgtcgttgccggtgaggaggaagaggggatat

SEQ ID NO: 1797 - DNA, 674 bp, Zea mays
atctacaatccaacgccataaatattggcgtcttctatataccccactctataaacaaagtgcaggcggtgctcgtaaaaatctgtatctaacgttagacatcgcatggacgcagtagatttttctattttattttattttattttattagaaggggatatctgctcgcggagctggtcatgcgtggaaccgggtcacggctggtggcggcaatcgtcacaccaaaacccatggccgcgtcacgtggatcactcggcgagcgcgaccttgagccggcggctgggctgccacctgcccgagaccaagcacgataatcaagtggacgggcgcccacgtgtgcctcggcggaccagtgcccagccccgtgtggcacgggtgcgttgggcccacgctgcaggtcgcgaggatctcttccgccttggttgccaaggaaagccaccgccgccccgcttctcacggaaattttactccttgactctctcgccggccgcccaacccaaccgcctcaactcaccccggcgcctctctataaaaccctccgccttgtcgacccttcttccttctattcccaattcgcaacagcccaaacagatagacccggtccgggtggcggccgtttcaattcgaggcttgtggccggccgccgctgaagcaggaaggagcgtgcgtcggac

SEQ ID NO: 1798 - DNA, 446 bp, Zea mays
acccacaactatattttcgattattgactctgtagagctcatcatataaacatcacatccgtcaactaaatttgtcgacatgcttgttaaaaatcacgcaggttgggcagacgtaacgtaagacgaaatctggataatttctgtgagcttagttaaaaacaataataaaatttaacccacaaaagtttcgttttttcatgttgcgatacaacgaatacgttcggtcagcaaaacaagtgcgcggacgcagagaaaacgctcgggcgcagatagcttttatttatttttatttttttctttctgagagggcagggagggacctaaaaatcaagcccaaaggcccaagcttcttttcttccccgcaaagaaagaagggaagagttctcggcttctcgcgagtcgcgacagagagaggcggagttgcggagaatatgcagagcagcagc

SEQ ID NO: 1799 - DNA, 266 bp, Zea mays
tgcaggctaacttacgagtggttttaaatttgaaatttgattgaaccattgtttatgttgacttgtaagcagatgttgattgctgcatctccacgtctacttaatgtgggggatccttcctttggcaaatccttggtggcaagcaagaaaaggctggttggagatgtggaagaacaacttgagccagataaaaacgatgatggggtgcaagcaacgcagcagcagctagagctcacaaaagagaacactgaagcaagagcttcaac

SEQ ID NO: 1800 - DNA, 306 bp, Zea mays
ggtaagtcatctggtcttatagtcgcccctaagttatacttgggtgcagtggagcattttgtgtgaagtggtacttgttgcagtatattgtgtaatactaactgctagtgttgtcacaatttgcagtatcgttccttgataaagggaaaatttatgagctgcaaaatgctgcaaatttgattcaatctgaagatacagtacttgatagttactgtagtgatggcttggaaaatacaattctagctaagaaaggactggcaactggtataactgagtttgcaaaaggtggtaacctttcctagtttg

SEQ ID NO: 1801 - DNA, 726 bp, Zea mays
tcgcgccctcctccccctctgctccatgatccccgtcatccgagccgccatcaacgcccccacgccatccgatagccatcacctaggtcaagtcgggctcgtcgggcttgctttccacctccagccatggccgccctgcagctcccccatcacgttctgctcaagtcagcacccagtgccatgtttgttctgttgggaaacattacaagttcatgaccaatacttaatctaagttttgcggaccgaagcaaggaggaagaagatgtacaatacaagcaggtacaaacccattcttttttctctaaacctgacttcagtcagcaaattggttaatccagtgccacgttactaataaaatccatttttgcttcatggtgactatcatccctggtatgtttgttcctttggtcttgcacgttttagtatatatatacatatgtttttgttttgctttttttgacccaattaacaagaacagaacctgtgttgactttcagttctatctttttatagataaatatagataaaagtgtcacatcttattaccgtaattgaattcatttttatatgcttctgccttttttagcttagtacaaacaaagaatatgcaacataaagtaggcctcagtttaaatttgagcttgaattacctgtatgattcgcatgtggaataatgggtcaccaatgcacaagtttgctggttgacgtcatgtccagttctacagc

SEQ ID NO: 1802 - DNA, 366 bp, Zea mays
ccatccccccaccccaatgggtgttttccaaatgggtgtgaccaagtgacgtcttggtacgcaaagcatttagcacattgtcctggagtagtaacttgacgcgaccgctgggcgtaatcatatcgtccaagcagttgagtttagtccaaatggtgccgtgttacgcgaagcggcgtctgctgcctaacttgtttccaggcgatttgaattgcttattgaatacttgcgattgctcggtgatcgtggtaggagatgagcagttgcctccagcctctataaatagactgcttgccccgttgttgtcttcgcacatcctctgatcatctgttgcttctttctcaaccccttcttcttctccctttagct

SEQ ID NO: 1803 - DNA, 1500 bp, Zea mays
aaagaagaagacaccaaagcaaacattttttaaccgaaccaataaaaatgcctctctccgactctccctctcctctccagagaactctttaacacatcaaaaagaaaactcttacacagatataagggggcaacagtttaggacctagtcttagtagatcatgaaaatatttccaaattcaaataccatatgtgcatttttttatcaaagaaagattgacattgagagaacagtccgatgtagcagaaagattcatatgtaatatatttccaaattcaaataccatatatagctcagatcattgagcaaatgaattcagaaacgttgttccaactgaataaaaaatgtagtgctttgaatttccaagttgattggtatatatattgtagaacgatgataggaatatcatgatagatagaatataaacagtgcatgagcatgtgtttggctgactgtaaagcatggttattaaaacactgtttaaacgctaaaacatgattataatctagaatgtccggactccggacgttttaacaaattcatgtcctttaaacgttttggaacgttttagccatgacgttttatgctattgggcctctcaaaggcccgaaaaaacacaggtcaccgtcctctcctctagcgccgcccatccatccagccgtccaacgcctactaccgccgccacccgcctcccgcctctcctctagccccagccgttcagcgccgcccgcctccctcctctcctcctctcctccctcctccagtgccgccacgacgctcgccactagcgccgttcgcctcctccaacgcccgagcaccgcctccctcctccctcctccagcgccgactgcccctaacaccgccctctagctcctctagcagccagcgtcgcttacagccatcaagttccagggcaggagtcaagacagtgaatcacccagctgctctattcggtaagtgatctggccatctgagattctgagtcaaggccgtcgtcatcctgcttagctgctcatgctcttaatattgatgagttggatgatggttactgatcctagatgcaagttctaatctgcatgttgcatagacttctatggttgaactcgatccatttccttttatgctacttgttttgtgaactcaagtaaattaagagtatgaacatattgtatcctgttkktttatgtcatgtctgaaaagacggttcaacattaacgtttaaatgttggaaaggtggctcctaacgttttatcgtttacctctttaataaccatggctataagctttgccttgaagtatggtagaaaaaaatactctttggtagagatgaagggaagatagcaacaagctcactgctgagatgtaggattttttttgtcctcgactaccctaggttcaaatcctgtgtcggccactgcccatatggtttcaggccggctgtgctcgtttcgtcccttgtgcgggagctttgtttgagatttgagtcgttgcagctaaatc

SEQ ID NO: 1804 - DNA, 160 bp, Zea mays
ctgtgacgtgagtgacttgagctgatccgactccgagcgagaggcgggtaccaaccgcatccctagtacagatcgagtgtcccgtagccactccacgtctccacgctccacggtcacactcggaacctcagctcagaggatcggaagaacggacggcgag

SEQ ID NO: 1805 - DNA, 849 bp, Zea mays
cgacagccagccattcaccaacacaaaaaaagcttcctttgtccattccgatccttgctagggcacgagagctaagtacgcagctgaagaaaagtttggctccaatccagagctagctaggtagcttcatttatggtttgcatgcatgcagcgtttcttccgtatctcggtcgggccattggacctttcagaacgacacgtatgtctctctcttccaaacgacagcgcacatatcttkatccaacatgcatcggatcggccacactgctaaaacatgatgcccgctgtatatgcggctggcctgcaccacccaccgaacgtacgtatcgtatacgcggccagcctatatatatagtatcggacctgaggctgctggtgtgctagttgagcttgagcaaagagtcattgagtggagagagtgacacacgcacacgacgcactacgttggcccgcgtacgagctgcaactggatcatggcagcagttggcagatcgtcgctgtcgctcgtgctggtgatggcggcggtgatcatctctggcgccggtagcgagcgggtgcctcctgccgcaaaaggagccctggccgccggctccgcatgctgtggtcgtacagcaggcgcggctggaggagtgccgccgagtggctccggcgtgctacaccagcatcggacaagctctggctgaagctggcaagcttgtccccaaggtgaagcaccgttttgttgtactcatcaagaccggagagtacatagaacaggtgaacatcacgagacggaacgtcgtcctgctcggcgagggcagaggcaacacagtaatttctggcaacctaagcaacctaacggggacggcg

SEQ ID NO: 1806 - DNA, 582 bp, Zea mays
ggtgtttgtccaggcagacacagggctagggcggtggcggcgttgatcgcgagctctggggcgttgacgggggctgggggatgaggaaggaggctagaggtgggtgagggatgaggggatgatccaaaaaacactcacggttggatgcgattgattaagagagaggagggtaaatgaagcgatttggatcgttggttttaatggtgggatttagctgagggtaatttattgtgtgcactcagtgatgttttaactgatggattatatagaggtataaataagacatgttgacctcatttgaaaattggaactatcaatcaaagtttcatgtctgatttcgtggtttctttatgtttgttgttggttggtattatagtttagttgcgacatctgatgtcaggactctacttattgtgaaatactgaaattcattttcttgcatcggtggtttgcagaaattccttgactaacttgtttatattctcttattatcaatttcagctggagttctcgatgaaacttgttctacagtgttcttctgttgcatgactcagttgttttgagttatacttcataataaca

SEQ ID NO: 1807 - DNA, 967 bp, Zea mays
cgccaaagcaacgttttttgtacgcctcgttcgcaaggcaggcgccatagtgccatacacatctaaacagagtgaatgaactttactttttctaatgattgaactcatgcccaccaattttgtccagccytaagattaccaatatgcctaatttattgtttttagaacaaaactatagtaggagatcacttcgtagttcgttgccccatggtctgtagtgagtttatgtaactatgaaattgatcgattacggtcatgttctgatatcctcacgcctctatcaattgggcagtctcatctttaaggtttgatcttgagggacagaaacattaactggatttcattttgctgatttactatgagcagatcggtgcagtaatattttgtaattctctatatttctataagtataacctatgttcaaaatcccgatcagaagttgagttattgggtgtattatgtcagtattcatagcataggctcgtggaaatattacagttgtggtgctagaaccctggtccttatatttatgtatagcctctggtcgttagataagaggagacaagagacagtatgtgcatgtatttctaattagcaggagcattcagatttttaagtttcactgaacacttctgcagagcaatcacatcgtttgcatttctcaaactgtaaataagcagaggataaagaaaagctcttatcattggaacttagaacactggttttccatagcactagcagcgtcaataatttgaaaaataccattgctcagccttacaaaaataaaactcattgccacatggaatgatggaaaagtaaatatttgcttacctgtgggagatgatttattccctgtttttctttcatttctctctagacctttcattgttaatcatgtttctctatacctgtacgaatcctctgacttgttctaatcctatgcaattgagcggttcaagcagagctg

SEQ ID NO: 1808 - DNA, 522 bp, Zea mays
taactctattttccatatggctccgcattggcaaagtacactgtcttagctactatccatcctcctagcagactctgcatcacacacaccacgcaaaccggagccaggtgtcggggctccctattcttccgtgttctacctcttccccttgatcaacagtagccatggtttccgtgtgggacacggtattggcctcagtcgacacgaacggagtatggtagtagcacggatgcgcgtccgtttgcggagtccgctggaactctgaaagactggaacacgacacgccgttcggactcgacacgcatctacgcgccgtcagatacggatacggagcagagctttgctgctggagtggtctcacgtctcacgtgacgctcgcatatatacacggccagggcagcaacgcaaaccaaagcaagcaaaccccctctgctccgaatcgcgcgcgtcacagcaatagcacgctgcactgcacgctgcggagtctacctgaccacaccttatccggacggcgcgggcgcc

SEQ ID NO: 1809 - DNA, 566 bp, Zea mays
tgtatgttggataatgctggatgaaattgtatgctggataagtactcgtgaagatacaagttcaatttttcagtttaatctatgttataactttcagtttttatgtatgttggataaaaatgcaacctttttggtgtggtgagtgaaagcagattgagcgtcgcttgatgacatgcttcttcaaaacaaacaaaaaatggattcacctgcttcctcaaaacaaacaaaaaatggattcacctcatttctctaaccaaacataaagaaagaaccatccaatcctgtgaggaatgaatccattccggaccggctgattccggatggagccaatcccctaaccaaacacgccataagtccatacctactgtctatatatttagtgcatatagactggtcattttacgattagggattattttggccgccgtcgytgcccttcctagtcgctgtcgcgacctcatctgcttccagagtccggcctcgtctgcttgcagcgtcgccgaccagatccacccgcacgcggccgtccgcgcctcgtccatcgcagcggccgcccgcacgcgtcc

SEQ ID NO: 1810 - DNA, 1500 bp, Zea mays
tgttaagaaacatgctaagggttatgtaggtaaacaacaagtttaccttagagggatttcatttatctctatataaagaacatgtatactaccttacaagagatataaaggaaatagtggttagagatccaactctacatcatgtgtctcttgtgtgttactttttacgtgtgtggattgctgggatggaaacggtcttctacgactcctcacatctaatctgctgctggcaggagggaatgaagttaatctgatcatccatagttattcaacaccaactgccaagtcggatggacagccgtgcatcatctgctggctggctgactcctagtcctagatgcaagtagcctagctagaccagcaccacaatgcagcacatggtcggtcccgtatctgtttgttgaacatctaatctattaccaccgaatagtatgaagagagagttagcccggacagtccgaaagtttggttcaaagacttgatttcttgtgagattctctgcatatctcgccagattttactaggcttcgcttagacctcctctctatagagcatctccaagagatttttcatattttgctctttaatagttagttagttagctaaaatttgttagtggaattagctaactaacaaatagttacctaactatcaactaatttatcaaaaatagctaatagctgaaatattagctaggatatttgaatgtatcaactaattttagtcactaattattagctttattgcattcaaacaatccctaagtcatacctaattatacctaccacttagtagtgccattctcgtaccactaccatgctagagtatggtatcaactcaaatctgacactgaaccttgtatcgtaataatacatggatcttgccgtgcaaacactaacactacgtgaacccgtgtcgtatcgtgccgcacgaaaacactatcatacgagtgttcagtgccaatctatttagcacggcctattttagtcatctatagcggcggtgcgaccacgatcgcctctcctccgacccggttgtgcgtgccgacgcgggcaagatcttgtcgaatgatcgatcatatatgcatgtgcgcttgtctcggtcggcctgctagactcgcgtggatcatgcatggcgactagtggcttgacttgggtttgtagagaggtgtacgtcgtccgccaccatctcgacacgcacgcacgacaccatgcaccccactgaaacgatgctttatttactgctactacggtgggtcttaaccctgcctgcttttattgctcgcttttgcaccgggacgacgatgccgaccaacgctgcagctagcagcctcgtcgatggatcaacaagctttaatttgtgtgcaatgcacctacgtcgtacattaattgtgttcttctataaaactaacccatgcatcgatcatcagcaagcatcgtcatcagcaattcagcatagcgaaggtccgacgacacgacgacgacgatatagcaaatatcg

SEQ ID NO: 1811 - DNA, 516 bp, Zea mays
ataagaatttaaattatgattgttggctccaaaccctcattcacaactcatataatcaacagaacacatatatctttatatttatattaaccataaatgaaaactatagtaacatacggatatagtgagttcgaccatacatgatatactccaatgagatacgaccgcaagcaatcgccggttggcttagtttctatgatgtgaaatgaaaggattgagcttgaatcattgatatatagcgaatgattatccttatgtaagaaattattattattattagtttttgctgctgtgcagatattgtgaattttaatttgtaggtggcaatcagaggacccaccgaatgctcctcaaagatgcttgtttcatcactgcttgctgtgttttccggcacataaatagcacaacctctaaccgccaattgttttctatactcttttgctaaaccgagccatacccgcccgctccttttctcatagtcatccgggaaacattctctctctggcgacgacggcc

SEQ ID NO: 1812 - DNA, 73 bp, Zea mays
ttctgtcagctaagctaccccgtccccgtggcgactgggggaatcgtttccgtctccgggctcggcagccgca

SEQ ID NO: 1813 - DNA, 440 bp, Zea mays
aatcaacaacggtacaatctttcaatgcaatttttctatagatggatcttttaatggtatttttctaaagtgtgaatttttcaatggtatgatccaattttcctttttttttactcccactccttccggtagaacgcgggagacctaccaaatagcgcagctgtagcctctactctctagagggtggcgaaggcggagctgacctgaccggctgacccgcccaacccaacaacctctccgctggccatcttcctcccgggatccctctccctccttcgatccagctcagctctcttcctcccgccccgtactcttcttgatccgttcactcatacttctcgagagaaaaggaagaggattcgatctgttgctaccgctagctgcggtactaacagcagcagcagcaacaggaggtaccgtagaagaagggaagggaatcc

SEQ ID NO: 1814 - DNA, 173 bp, Zea mays
ctggtgggctggtgcggcaaccatgacttcctcctcttgttttgactctcatttcctcacaggctctggcgctggcaatggcgtaccagtccgtcactgatcacaacaaacagcggccgccgatcgatgatctggggccgaatgatgtcatacaaagatagttcaacctgctc

SEQ ID NO: 1815 - DNA, 439 bp, Zea mays
aaacatatgtaatgtaaaataaaaaaaaacctccaatgttatgacgggtttggctttgatttacctagcactttttttttaaaaaaaaaaacatctcggtccaaccgtccacacctcgggaccatttccttcgttcggtcgtttccctactatcctcctcgcgttcatctcgcccgtacgccgacgctgccgcctggctcgcaccgcccgccggcagtgcctcagtccagatcaagcccctcttcccagatcgggtcctagttgggctaccgcagccctacgccaggtgccgagtccctcgccgatttcttcggcggcgaagagtgcccaccaggtattcccccttctcttccctgtctgcagtgcgaaacggagttcccagactctaactctaacctcaagctatttggctattttatgcctactagatccgcccctg

SEQ ID NO: 1816 - DNA, 167 bp, Zea mays
ggtatttcgctcgagccaacaatgtgtttgcgccttcagtgcgacttcatgtcgataatgaatcaccccaaagcacccttcaaatttttgcgaatccgggtaaagcagttggaaaagggagtgtacgtcacattgaagcatcagatttgaacacgctaatgctatat

SEQ ID NO: 1817 - DNA, 436 bp, Zea mays
gtccatctatggtgccataatgtgcttaaaggccaatcaatttcatcgtatcaattacatgtttaaaaaagaatcacccgggccgatccagctctggcgagcccaactgcccgcgttcccgtgcccgtactaaaaataaataacggactgccatctcctcgtgcactccgccaaccgccgccgccactcgccactctcacgtctcgcccatcccgccactgctgctctccagagtccaggcgacccaggctgcgcggtgagctcatctcctcctctcgccctctgctcttctcttggcggcctaccctactcggtcgggcgcctgcgtgatctctctttctattgggacggattgatcacggatcgctgctccattgttgttgcgtttctggattcgcaggtcgctcggtgttgttagtcccgaccgccgccggcc

SEQ ID NO: 1818 - DNA, 86 bp, Zea mays
aaccgccgttcagcatccccattaagcgggagggaacgcatcgtcaggtagcgtccgccgtcggtcgttaccgcgacggggattcc

SEQ ID NO: 1819 - DNA, 540 bp, Zea mays
tgcatgcctgcagatgctgttaaagaaggcatccattttagattccaggcctgagcctaattccggaggggagatctggacggtggggttcggggcattcatcagtggagcatgatccagcatcccttcagcatcaatctctgcaatatcaccgcagcgaccatccttctgtggctgagaaaggccttgctggcactgtcttttcagttgccttctgtgataaaccttcagcaactgtggggtaaagctatttcccaggtaaggctggaggggcgagcttggacaagacaactccagcgtcccaggttgctggggcgaagtatccctgttcaagccccgcgacccatccatcccagatgtgtcttggaggggtgggctcagtcctgccaaaatcaacatcccagcattaagggactgttggggtgaaggcggcaagggtgagtccagcaaccctacgcagccctcatgcgtattcgagaaaaaaaagaatcagctcccttgtaagggcttgttcggttattcctatgacatgtggattgg

SEQ ID NO: 1820 - DNA, 1500 bp, Zea mays
tatgagctggtgtttacgctgctgtgcacaaggtacacgcttcttcattagtgtacgcttgctatactccgactaaaacaactcttgcatgccaacggccacacgtatagaacgtacgtaatacaataataacatcttagaagtaatcatgatgtgagtcatcacatatataaacaaaatatatacacgtgcaaacaaatgttaacaaaaaaaagtttagcgtggatctaacagaaattaggtggcatttcgattggtgtattagcaaggctagctatacgaaaacatggccacgcacgcacctggatgcatatgtttgccacccacaaacatctaaaaaaccaaaacagcactgtgaaaacgcatgcttgcgacccatataaacatctaaaagagccaagacaacaccagcgaaaggcttttgctggtgtgcgagcgtgtgatggcgagagggcaagccccacgcagtgggtagtggacccaatcctcagacgctacacgacaccgttttgcctgcgtctgcgtgcgtgagcttgcccccgctcccatccgctgctgtagctgtactctctctctctctcctctctctcctgctccgagctgtgtatatagaaaaatccagtgtattttccccggtgtgcatatataggctttggaagggggcgcaggggtggaatttcgggaatcgatttgtagtggggcatgtaagcttgtgggagaggaaagcagcaggagacgaaggtagtagacaaggaaaagtatgccaaagaaaatgagagaacaaccttcttagcttctcctccagtctctctccaccaccgctctatctcctcggtaggaagaagagcaagcaagagaggagcaagctagctagcggtacaagggagagtgaggtacagagaaagaaacaaactcgctcgattgtttttcctattaaatatgtatacgagtatgtgggagtgggtgtttgcgagcttttgttgtcttgcttttttctacttgtttcgagtgcaactgcttgtttggatttccctgtccactttgttcttttgtttaatctcggaagagtcccaaactcctaagttcttctcggctccctgtcgatttgttgcttgtttcagatcaatcccaagcacgtacgtatgagaaggtatagccaacccatatcaggaattttgggggctctcctttcggtctgctttatctccttggctctgtcgggctcctccccgtttgtctccggatcggactcggaggaacagcaaaatctttctagtcacgccccccatatggtctcccgctcgcatgctgtgtgtgtcttgtgtttttttggagatactcgtcgactcgtgctcttgttgccgttgttgattgccatgccggccggactcacttggaaagtattgttgcttgtttcagcggcgaaggggacggacgaattgaagaacacctgccagtccgatcgagctggtggtgccgccaggataaatcgggaggtat

SEQ ID NO: 1821 - DNA, 239 bp, Zea mays
ctgcccgtgaaccattttgtattggcgggcccgtgaacattatgctcgctccttacgacaataataaatttacacaaagcgaccaggtttttgcacgtggcttatgtaccaaccggataagttataataatttgatgtttatttttttcccaccgaggagggccaggcaatgcaattgaatctgtgggtttgctccaaagttcgcgaacccggctaggcgtcctcctatctcggttgca

SEQ ID NO: 1822 - DNA, 1335 bp, Zea mays
gagaactatcatttgtctctctctgaactctctttgccactgagtagattacaacagtccgcgcgacgcttttgccatcgtcgcgcgccgatgcggggtgcggggggcagggcactgctgtgcctgtgcctgtgctgtgctgcccgttggttggcgccagtgcgctgcgcggtttgccgccatctctccagttcggaccgtgcctctaccgcccgccccactcgcgttcctgggtttcggggtccgtgcagctgggggacgaaaccgaacgggtctgtgtgtgtagcaagcagggtatgtatgaggaatattggatggtatggtagctactgttgcccaataatcaaagttcaaagcttttagcaagtaggatctgtactacttgcgtcaggaatatttaatttagcacacatctccagttgtagattgaacgcgtctttgtgttcagggagagttgccaggcatcgtgtcctactattgtgcttcgcgggcctaaaaatggggagagctaccactaccagtagatgatatgcatttagacataccaaattctggaaacccacggcgctgacaggaaatcacagaaacagttaaatacatcggaaaaaagaaaaacttcgatcgcgcagtatagctgtcgaaatccgccgtgtggcagtttccaaccgtgccactcctttctactgctagtaccaaacgcgaaccctttcccttttgcgaaccgtgtagtaataaaaaaacaaaagccagagcatcatcatcatcatcatcggatcgaaatgcgcgacctttttctttttgaaaaaaaaaacttcggcagcttccgtccgtcggccaagttcgtgaacgtgaagcaggagcacagtgtagtggatgagtttatcgagcaatcaggcacggaggctcgtcgtggtcgtgggtgctgttcgtctctctcttcccgacgtcccacccccgacccttttgatcttttcctttgactggccacctgcgctctcacgtcaaacggtttcccccctcctctcctctcctctcctctctcctccctccgctttatcttttcctcggccctgcctggcgcctgctttcaccgtttccgcccgtcgccttccacctctcgcattccctccctcccgccctccctctcactacagctcaagcgcagcgcggcacggcaccctacgtccccgactccctccttcttccactccactactcgccgcgctccccatgccctccccgtgacgccgaaaccaaatcctttttgctcttccatattactagtcctcctctccttggtcgcggcggcggtgtaggtcggcggcattgcgagat

SEQ ID NO: 1823 - DNA, 82 bp, Zea mays
ggtcgcgcccgattccgccctatgaaagttgggtcgaattgtagacagcagagctgggcgagcgctccttcctggaattctg

SEQ ID NO: 1824 - DNA, 1341 bp, Zea mays
ggaatgaactggttcttattcacttctgccatgtgttaccactgggtcaccagctgtgatgtctcctttttattcttcttcttaactttcagctttggagattcttacaagcacagctgttcagttgtcaccctgcaatggttgtaattacagtgctggccatactcgttgtttacccccaccatgactttaagcaatagctatacttgatatggcactaaacatgcattcggactttcaaagcattatgaaaactatcagcagaactgttttcagacgcattcacatttacaagtacaattataaagcatgttctaacatgaatgaaaatcgcctgtacctgcctccttgttcagctgtttcagcaaattttactgacgctattctgaaccataatttctaaagtttgtcgatgtgctcaagatatattgtacgaaacgaatgggggaaaaaaagaaactttgatgaccctgaccgatgtatccttttactccatctccatttatttcaagtttcagctctcgcggtctcgccattcttctgttcttgagcttcgattgcaacgtgcaaagctcaaaagtgcaaccaagtccttgcttgttgtcaaaaaaaatgctgctctaactgcatgttaatttaacttatcccccgtgacacacaggctttccatgaagttactcagctgtctgcctgatctgatgccaccaatgtggctctgaggaggtgaggcacactatcttttcctctgagcatcaaagctgttgcagccattaaaaaactccccccgcgaagcaattagtcgttggtgtgatccctccctacccaagtttttttctttcctttccttcaaaacttaaccttccaatcctaacagtaacctagcacttagcaccagtaattacactgcactagagtccacagagatggacagaggtgtatgcggtgtgcagcgcactgacattggatccggagattccgcaggcacaagcacaagcacagcctccattgctccatgacctcatcaaactctaaactctttaacctcctcctaccctctcaagcatagcctatttagaccctcacttttcttgttcttactgctatctttgtcctccctcttcccctgcaactacttcgaggcaagcatataaaaaaccttgcaccatctccatggcctctctttctctgtcttcttcctctgtttgtactagtcttgagacataagcaagaccaagatttagggggcgacaattagaagtagtacattacaattctacgggattatcgtgttcttggacacagtacttacaattcagtacaagtgctatgagtcttggcgtt

SEQ ID NO: 1825 - DNA, 1105 bp, Zea mays
gcagcgagagagatgtgcaatttgagatgacacaagggaagggacaggcggacagcgctacaggttggcgacggcagagatttcacctacgaatgtgttgaataattagacaaattctagattaaattccgaatataaatcatgacaaaatcagaagaactgacaaaatcagaagaactgaagtaaaaagccaaatcagatgatgcgtactgattagactttttatttcagttcgtctgatttggtcatgatttatattcggaatttaatttggaatttgtctaattattcaacaggtgcaatctccggcctctactcactccagatctattcttcgcttcgcctgcaggcagcagtagcaccgttcaagttcaaccaacgcggccaacgcacctgttgaagttgaaccatgcatgaacccgcgacgtgtttatcctccattatccacggtgagctctgaaatccacgttgactcacatacatacacggtacgcgcgtcagggatttcactcggaggcaagaatcgaaaaagaaaaaggaagccacgcgtacgacgtgcaacggggacacacatccacacggacgccgcgacgggactgcacagtggcaatggcaacgcaggtgcagtggtggtggtgttggagtgtttattattgcctcaccgtgtgcttctttttttatgttccagagcaagcacgtaatgtagtaggggcgtagaatctagactatcaaatcgcgaggggcgacgacggtgctcggtgcagtgcagctttgtacaggaacaggactagtcgttttcacgtcgtaacagagcacgctcccgcgtcgatagatcgctacgagcagtcgacagacacggcagcataaatgcgcgcgcaaaagctagtagtaggactaggcctacagtgcagtgcgtccccgagattcattcgtcaagttcaggtcgaccggccggccttgcccttgcattggaaaacagttaccgctatataacaaacagccgcggcgcacggcgagccaagcccgtcaaggcacgaggactgcaggagcagaaagttggcaaccctttgagttcctcactcacacgcgcgcgagccgagagagc

SEQ ID NO: 1826 - DNA, 1337 bp, Zea mays
ggtatggcgccagaggccgccctcccgcgcccttgtgtcgagctgtgagagtcgtggttttggtagggatgggtgacttgcacggcgaaccggtgcccttggtgttccttttccgttcgaattgcctggaacgaaacgaaagcctccgccgcctgtgggcccatgactcttgcttgactctgctctgagaagaactcccgatgttgttgctgtggcggcccatttcgatctgaaaataactttatgaaacatttgtgttgagcaccatatttggcacctggcatggccggcctctacggtccgcaccctcgcgaccagatgagaacgggcgagaatatttatcttcatgcgtggttatcctaatctatcaatggaatccgttagatctcgcctatgaacagttacagacctactcccccataaatataaacgggtacgaccgattaagaacacccgaacatattcaatcgaactaatctgctttatctacctttctttatcagttctgccatatgagtagatgtaacatatttttagttgtagctttctatatatctacatgcacccctattcgactctacgtcgactagatccgacttagttggcctgccgatcccaagacgacccttggatctcaccctaacaaacctggtcatctgctaggagggtgaatgtctttaggtctcttcctcgagctgattttttaatccttaggcaacattacaccatctggggacgccccggatggcctgctgacccgaagcacctaggatctctccctagggggcgagatatacattcccgcgaggaggaagacgacactgcgccattgtggaccgtcccgcacagagcgcggatcgtccggagcgacgcagggaaggagccgctcctacagtgaaatcgcggaccgtccgactcagggccgcggaccgtccgcgctgctgcagagggcaccgccaggcggtacatctctagtgactggcgcccagatcggtgccaacaatttggttcaaacaatgcatcattttttttaaaaaaccgctttcggttgcacaccatgaagttgtttatagtattctagatgcatgtgttgctttaagttcgatgctagtaaactaaactttaaacgccaactttacagctttgttatgttgatctggttcactattttgcttagctagttagggtagtattttttttcttatatattgaggacagcggtggggttcagcaatgctactgtaacataattctcttccaggtgtgtggcccttaaggcaaaggaagctgaggacaagtatatagcttctgttcacagcaagaggcatataaagctg

SEQ ID NO: 1827 - DNA, 429 bp, Zea mays
actatttatatcagatttaacaccatcaaaaccaacgattaagtttgctggataactttctcccacttaatcaaatctaattgacgatattatctgagtcgtttctcatcctttctctctccctacgaccttgcctctccaaaatggtagtgttaacaccggcaatatttttttttaaaaaaaaatcgggagtctagctaacgaattcatttttgagcggttaaaggaactgataactcgaaggggacgattgagaaatttgtccgctcaccatctcggtcggcgacagcgggaaaccactgggcctcctgcacctgcagccagcagccccgccgcgacacgctcccccgagatctccagcgcccgacttggcgagatccagcaagctgcacccaccgcaggcgtgatctcctctcttggatcccgaag

SEQ ID NO: 1828 - DNA, 465 bp, Zea mays
tctgtggacataaattagctaccatatatatttattactcagattactgttgtgtatagtataatattgctatttatttaattatcttgggttgtcggtaagggtattttttgatcacttcttatatactgaatgttacataggaatgcgcgctacagtagacgacgagggggccttcattttcattttccatggcaagaccaagacaaaagaaaaacaacaccgctctccagtccccactctcgtagcaagatcaggcggggtcaggccaagcgcgcagagggccccacaaaacagtgacacgcgcacgactccaaccgagcaggcgcggccggttcgtcatatcaggtggagacatacttctctcccctcgtgcagttcacacactctcctctgacctctcctctcctctcctctcgacctctcccttctatctagccaccgaagccaagaccaaggaacggc

SEQ ID NO: 1829 - DNA, 796 bp, Zea mays
agaacatagaatcggtactcctaaattattcgttgaaaatacatttacattgtgggagggttatgtggctggtcacaggagacatgttctattgctgctcgcctgctccatgaggttgtgagttcggttccagcaggtagcaacataacgacttctcaaaaagccagggctctctacactcctgttttttttttaaaaaaaaatatatatagtatagattttttatttgaaactatatgtgttctttttttttctcgaacgacgcaggagagctgcgtgtcatttcatttaaraagaaaaagatacacactcgagggggtggaaagaagcccccccctcaacacatcaccaaaaggataaaaacgcgccacacactaaacctaaaatcaacaaccacacagggctgctcaggcttccagccttggcttcctgccgagcagctcatggagggccgtgtttccggccatacaccagagctcactcttcctctgctacttcctgacaaaccaatgaaacactaggactaagaccctaaacaacgcacgcgttcctatgtttccaaattgtccaagcaacaagaatgacgagagaattaaatccttttcgcttctactttggcactttgttgactgcacttccccaccatcaagcaaaatttctctcagtttgcggggcagtggccatgcagcccaacataacataggattttggtccaagtctcccaggagaagacacaagacactagaatgtgttgagctgactcatcttcctggtcacaaaggaggcagacactagg

SEQ ID NO: 1830 - DNA, 1500 bp, Zea mays
gtaggagctttaatagtgtgaccaacaccaccattatcatcaatcttatcaagtgaacttgtggtagatacatcattatcatcacttgacctttaacttgaggtggatcacttattgatgacctccttgttatcaatgttctcatcatcatcttgtacatccatgcacttatcatcaacaaatatgatccttccatttttactataaagatacgacaatatgtcatgggcggtctcctttgtgcatgatctccttgaacaccttatcacttagtcattgatatagattgttagtagtttagtgttcaagatgtaaatagttatttttcgattaggtgagatctttccttttctaatcaaagggtatgagaaaattctacgctcacgacacactagaattttgcatcaacaacaaagaaacaataactcacaaaacctttccactatgcaaagtgtgtgccacaaaaaatgtgtggagcacaagtaacctctagcccttttagctgccagcctacttactctcggatcaattaagaccactaaataagaaatcagagcctgataccatttatagggtcaagatgccagactagaggtagactagacgaggtgaacagtactttcaaaaactaattacgttgactaattaaaataaatatagaattaatacaatttggtctagcgaatactacacacctctgtctatcacaaccatcttacaaaagatcctaatcgaagcaactaaggtgtcgagctagtgagacatcatctacgcaagtctagttagcaagattacacaaacctacgtagctagcaatctaaatattccatgactatatgttctaaatacacgagcgtgccccttacaagagacctgtagagacaggtgtggccacgtgacaagagcgcatctttcaagcgcgctgttggagcacggtcagtgagaacacaacaacttagctctaggcacgtccatgaatataccacttcaggcaagcaaggcatgaagatgatgggtatgaccagctaggacgatggtaaacaccatcgactagataaggggcgagtgtaatcaattagcgtggtcgaccggtgagcagggtggtgcaaggcacaaccgatggctatggctagataagcgtgagaagaaataagagatagaatgacaaaaagtaagaataaaccaatatgctagatttgttaatttgagttgatgcaatttaatcgaagtaaagctgacaattttactatcttcactaaatttgagttgatgtaatttaatcgaacgtctagatttattaatttaataaatttagatttttatgtgtaatctgacaatttttagtgaagtaaagctgtttttaccgaatctgaatttgaatctggagctggttagcttctgccgagtcgctcccccttccagggtctcaaacgcaaaccccaatctcggcgtcaccgccccaaatctagcaaacggaaatcccatctcgccgccgccgcg

SEQ ID NO: 1831 - DNA, 1500 bp, Zea mays
aaatagtatacaatatcatgtcaacagctattaaaaatcaatgaaaccatgacatatgtttaccataaagacagtgtttgatagtagtaaaccaagtacttgtgtttgtaccatcatccttagcatcatacagaataatagcatcaatgaagaagtaacgattgtacttgtttggttcagctttttttctgacgatcttttcggagaatctggttgtgggaacaatttgagtatcgtgggaattacgtgtggagtaagatgaacatgtccatagggtttagcatctagaaagtgacagattcctattatcgcggcgactcggccgattttgtgttcacgttgattttgaacggttttcaccaaagcaattctcatagaagcggactaaaaagttggacgtttgatagtccacaacagcttatgtcggcaagaagctaggaaaaaaaagccgaaacaaacaacaactttgttccataatttaaagatgtactttcttatgctttgactttgatatacactcttttttctgacaacatgtctagacaatgatatttgatctttgttaacatagacctttgagaccttcactccaaagcgatggaagaaatcagaatttgaagatgcaaggaaaaaaatgtaaatcaacccgaagaatgtccacgttctggcggtgttctacagggccctgctaggtagtagggagtacatgtgcttccagaagtagatacaacaagtggagacataaaaatggaaaaaacgtttctggtcggtagcctgtacccgaatacagtaagcatcagccctggctatcagagaaacgcattacgacttcgcgagtagcatcgcattcgcatcagagatgacgaaccggtctgcagcctgagctggcggggcgaagtttgacctatcactatcgagcaatgataatacggttattaataaacctaacggaacgggaatatttttaattttctagactgtagtcgttaaccatcggaatccgttgccttgtacacccccttccccaagccatcgtgtctgcctgcctgcctgcctaccaatccacaatcagcacgccaactcgcttccgagaccagaatcttccaagcaaaagcagctaatactagctacttacctgacccagttgaccaaggcccagtttgactttgaatcgtcaagcccctctctctctatatatctctcgtgatttgtgagtattttttgtgcccggtccccaactccgtccatggactacctggggggaggaaacccgagcgaaagaacgcgccacggcgagggtggcggcaacgtcaaactccgcgaaccgcgtggcgtcgcaggataaaaggctcgggcgacgagagccggagaccgtgcgatttatttccgagacagctcaaggcaaggcaaaggcaaataaaggcagcgcacgtacgtgttgaggtggcacttggcagcagcttgagttcttgagacccgacctgatcgttttgcgttgtg

SEQ ID NO: 1832 - DNA, 1500 bp, Zea mays
taaggattttttttacccttttaacttcaaatcttttaacttgtgataacatttgggtcatcttttgtttaaattttatgacctcaatatactttatttgccaaatgtcaagtggttcggtttcttcgcacgtgctaccgatttatcaatccaataatcaatttatcggtcttatcagccaattaatcagtttcgtatcgtttcaattcaaaaatcagtttggatgtgagcacaacataaatgaggtatttggtttgatgaatcactatattcaaaatgaagtggtgcatcatgggttcatttctcaaatttggtgggatgcctccattccacatattagtactaaacaattaactatgaggaatgaactggtgatggattaactcactccattccacaaaccaaacaaaaaaaataaggagtgagaagatgatgaactatataattcctcaaaccaaacactccaaaagtgtctcgcatagcagcctccagactttttgacgagtattaccaggttaaaaatgtagagatccctgaaccccataccacctttattcttcagaatacataattttcaccaagcttgccactgaatagtttgtgttcctccgcgttgctccatcarwgctgagatatggcatctgtgatctatttaccgatatttatttagaatttaaaaatcatcatcacatataccaatatggtttgagctatagattttattaacgagcacatatccagtgcacatgaaagctttgtgcacatgatgcacatattaaatcgccactattcatctcagatttaacgtctctggttgatcattgtaatttacaaataacactttccaccactacaacccaccacgtcagaagatgtctttaacaaatataccaaacaactacagacgttagatctaaaatgagtggtgatgatttaatatgtacatcatgtgcactaaaatttcatgtgcattagatacgttctttttattaacacctccttttcctcacatgctaagaaacttctccttgcatccccttgttcttgccaaaactctaccaattaaatgattaaaacagccactcattgattaaaagtcactcataccttatccaacattaacctgctctgtctagtctctattcggtaattagaaagaaatcacatcgctaatccccgttctttagcatcacaaattccaggtcaagtgaatgttcagaacaagggtctaagccatgtctacgaacatatagaaccaccttttattctgattcaaattcggagtaaactggatacaatagttgggtccatcagttagacaagtcattacagaacaacctctggtttgaatagccaaacacccaaaaattacttgtccacgaagagaaatggtgccactgcatatggggcaaaagacaccctatcaaccgccgcggcaaccagagaaccttttcagcttcagctacatctctgcatcaggttgacttgtcaagcttcccg

SEQ ID NO: 1833 - DNA, 57 bp, Zea mays
ggttgtctctcaggctctattatttgtgtttcagtacctctctaaatttgttgttat

SEQ ID NO: 1834 - DNA, 1500 bp, Zea mays
atccatcggtcaaccaagaatcaccaaccgaggagcgaaaggtaagcccggatctgggcttgaggtccagatcgaatccaccactgatacgggaaggacaaygacgacgagggggaagcggcggcagaaaccgctcactcaccagcgaggagtccgagggcgcgccacgcgcctccgccttcgcctccggtggagctcggcgtctccaatcccctccctacgtggtgggacctggaagcaaccgtgggagagagaagagatgctgttaagtgagaggaactcttccactggctgccacaggggcccagaatcctagctgcggatagggacccacatgtcagtgaaatgaagccgctcgagcccgactgatcgagtgaaggtgattaggtgaaggatcgggtccagtgaccagtccaacccggaggtgggactgggaggcaccgtgtcgtcgtcgtcccctttcccttctctactccgccgcygctcgctcgccggtgaagagcaaatgctgctgctgttacggcagcggctctgttggcgccgcgtatctccgacttacctcgcgcctttgtaggatctgtggagactcgtgagtacgtgacccccacggtggatgaggataggcgggcctcgtccggcagcctgtgctctctgggacgggaggcagagctggcaccaggttggttcttctcttcttgcccctgttcgtaactggaccataggcgctgtcgttgagtcgattgaccctggcatcgaagctgctagttgctttgcttctagctgctgctggccctcagtatggttgcgtctattcgatttgttaattaattgggcgatattcagttaggcataattrgagcttggtccttgtataaggtgggatgtgccacagcgaacaggttaggcataattgggcttctcgagctaggttaacgttacatgaatctgggtgtagatcagcgtgttcatagttgatgtgctgattgtgattaacatgactcctgatccctagaagtattagctcaccttatatttggtctggatgcttgctatgctgctacatgaatctgagtgtagatcagcatgtttttatccttgctattccttcagtagctccagctagttgttttccgtccccaaaagtcccgggcatagccgcatagcaaagcatatagtttgtgcctctccaaactcagcgaagcagctgcaccttgtgttaaggggtttattggaatatgctacacatatatgcatagagccatttctggttttttctcactcctgtgtttatctattaactatttacgctgttgctatgctagttacttacttacttctcttctctgcaacaattttggcaagggttatgtccactgtccaccttcgtatgttgacattacattacatgtctacactttcaaatttaagagagagcacgaattgaggccggcccaggtgaacgctgctgaagctgctgctcaattaaaactaggggaacag

SEQ ID NO: 1835 - DNA, 145 bp, Zea mays
gcgaggaggagcagcagctgccagcaggggaggacacggatagtagccggcctcccgccgcccgaggcccaaccgcccccgcaattactgttgttgctgcgtgcagagcggttttgaattgccgtctcctacccaggaataatcc

SEQ ID NO: 1836 - DNA, 1500 bp, Zea mays
aaccctgtccgaacggcgagcagatccacgcctcggaaagatccaaatatgtggcggagcggaacactaccatccaaccatgtcaaactcaaaccgtatgggtgtcgaggcgcttctcctcagatccggaaacaagtcgagcgctcggctcgacctcatgtcactccattcgtgtcgtcacgcatactcagcctcgtccggtgatgttgcagttgtagatgagcctcgtgtcagcgggcggagagcgtctaaaaatttagatacggctgccgtatctaaaaaaaattagacacgacggagcgtctaatataaaggttcaaaaataagaatatggtcgagatttacattaaagaaaggaggacaatcctaaagaacccgatatatacggctgccgtatcttagtttagtttggtagaacgcgggtttctaaaacccgatgtcgtaggctcaaattctatggagcgtgattccatatatcttatgtcgaaactaaaataacttaaaaaaacaaagtagaattacaactccaatttgaccttctccagacaagagaggaggccaatcaaaaaagaaatattaatcaatcaaagatctaactgatccccacgcctgtattgcaaatacacagtcacgaataatacctgggccacatgtgggcctgtgccggggcgcctgtttggccatctatatgcggatgtgtggtttaggacgtgttgtctgcacggaggggccagacgtgcgatggcttaatttaaaatagatgtgagaggttatttgtaaaaatatgatgtgggacgaccgttaaaactgttgttttaatatagtagatagatacatagatagagaaataaaacaggtgcaagtcacaataccttacacgtgggagaataaatatttaaaccattatctatactactccctccgtttcgttttagttgtcgctggatagtgtaaaattgaactatccagcaacaactaaaaagaaacggaggaagtatattacaaagggaatcaatatatagttgttctaaccaaatatattttagcttcttcacaacaataagctcgaaacaattttctcacgattcaccgctagaatcagatttacagaagaaaaaaaatagctaaaccaaacagacaaacaatcaaacaaaatctcagttcatttatctgctcgatcgtgttacctcaccaaacactacttcatattttctaaagtatagttccacgtcgtctgcctccacttgatcatgataaacaatgttaagatatcagcacacattacacacgtgcccagcacagcgaatcactcaaagaagatatcaagggaagaccacgccggatcggagctatatataaaaggcacccgcgcggaactgacatgcatatccttccagtgcagccttgtgttttcatcctccttgaagcgaaaacgatcgagcttgtatcgcaggcatttcggtacactacgttctccggctgtgtagagcttctgcggag

SEQ ID NO: 1837 - DNA, 175 bp, Zea mays
aaggtgttgctagttcaataagtcaatactatatacttatgcttgtctctatatagtctataggtcctagttcaaataacagatgctgcttgcagccttggatatttgtggagtgaacgcattgttgatagcatatggataagaaagtaatgtaatcatctggagatgtgtaatt

SEQ ID NO: 1838 - DNA, 1159 bp, Zea mays
ttgacccgtcacatataattatttatgggccgtgggctcagtctatatgcgggcacaacccgacctacaattaaggccgtgctttagtggacatgggaccgtctcaattgtacatgtatagtcgacaaccagggcgaggccgccgtgagcggaggcggagagtgaacagggtgctgggaggaatagtggggaggaagccggaggggaaattcatggaaacctgcaacacatatataaacctgcacatcctatcaagaaattattgtggccaagcatgccatacatacatctcactagttgtcagcaaaaaaaaaaaaaagattgctgcttgtccaatagtctatggcactttggcatcgattcccaaatgataagaaaatgcccttgttttagtcagaataaatatcaaagctacaacttaagatgctcacgcaatagatattctgcagatattgtcagtgcacaagggaagcagcatcttccaaacaagagacactacgatatactccatagacctgcttttctgttaccaatcaacatcaggcctggccaaacctatctatctatccaccaagacccatgttttctgcttgcttctctgcctcccacccaattattcactataaaagagacaaaaaaaaagataaaagagaatcattttcaaccgaacgagaacaacaaatgttttccctgcaacacgaagccaagtcccagatcattcaaatattagacactacaaaacaaataaaaacactacaccatgtatgtttttcttgctattcatatttgagcatacacacacacaaaaaaaactataatatttgacctatagcataacttgacgtttctcttaatggagaagagaagagaagaaacctaactgggaactaaccttacaatcaaaaagtaaaatactagccgtcaaaatcagctgaactactgctagcagtagtaaaagagatgagacatgtgacgcctaacaaatttgaatgaagaaagggaacaaggcaattcttcaaaagagaatcggatgcttgattacctagtagaaaaatagatgtcacgttgggcctataaaagaaggtggcaccaaaacatcccagctgcataccgaccttccttgcattttctcaataccttgaacaactaagcaagtcca

SEQ ID NO: 1839 - DNA, 878 bp, Zea mays
cggcggagagaagaaggagaagagggtttttgccggcgggtgggattctgcaccgcaacaaaatggagtgggaatcatcgtccgtcgcaaccgtagcggaatgaaatctaggtgggcccttcatgggcctccatttcctagtccatgggctacctcttgcgtcatctgagcagcacgggcacccgacgaaccctggcttggtcggctcgggtcgtttccgttttggccgctcgggggcaattctgtctatccatccacaaatagaagtttgtctcagaaaacaaaaataagaaggatgggaattggattctgatttgttgttcttcttcctaaataataaattctagggtttgcctcttccctctcggctctcgctcccaccaccaccaccaggcagacgcagatcggcggcgggataggctagcaatgatccccaattccgacttcctctagactgcctggcggtcgaattccgattcgattggagtagggaacgagaagggaacaaatacaccggcaccaccaccagaccagacagcacgtgcctccatactatggtttacgccccgtgccgctcatcgacgccgccgtcttcctcgccgatgctccacaagaacctccgcgccctcggacccggcttgaatcccttggctcccttcggcatgggcaactactcccgctagccgtttcctcctatccctctttctccgattccgatctctgagtgcttccgcctccgcccccggccgcttcctccatcggaaccgatccccgctattttactcccgttcgtttcattgttccgttgctttggatctgagtctcgagatcctcccctgtcctgctgctcgaggagccgccaaggataccaaaatacc

SEQ ID NO: 1840 - DNA, 667 bp, Zea mays
tcgatggatcggatcgggtgaatgaatgtctgtgatcgatggagtaattataccttatatgtgtatatatacactcaatcaaaccagcccgaggaagacgcgagatcgatctggccggattataagcggttgaggagatcgaggacgcggatcggatgaaaggcagccccggaagcgttcgtataactgatttcgcaagagatcgatatcttgttggccggccagttatcagccagcctgatctccggctcccgtgcggtgagaggaccccaaccccgcggcccacacgtcatccactctagccacagcatctcacgtgccgccccccacctccacccttacctcccggcatttgggttactgacgtgtgggaccagatctaggatggacccacacgtcagtgacccaactgcagaggaaatagctgcaaaggatctcatccccccacctagcacatcaactcggagtcggagattcccctcccagccgtcgaaagtcgaaaccctagccccgcctcaccgccggcggtggtggcagcctcagcaccggcacacagcccgccgtacctctcctcgtacgctcccttccggtgtgccgtcgccccctcgaccggtccatcgttcgtcggctcggtagccgccggatcggatcgggatcggccggcgcc

SEQ ID NO: 1841 - DNA, 132 bp, Zea mays
ggtaattaagcacaaacatgtgcgtacacctcgcccattctgttctacttctacgtatcaaattaacttggcttggtggtcattaatttggcagacaacaccaagagcctcctcggtgagtccctggtggtg

SEQ ID NO: 1842 - DNA, 337 bp, Zea mays
ggtaattaagcacaaacatgtgcgtacacctcgcccattctgttctacttctacgtatcaaattaacttggcttggtggtcattaatttggcagacaacaccaagagcctcctcggtgagtccctggtggtgatgggcgagatcggcggcaacgactacaacttctggttcttcgcgcgcaactcgcgtgacacgccgagccagtacatgccggaagtcgtcggccgcatcggcgccgccgtccaggaggtggtcgacctcggcgccaagaccgtgctcgtcccggggaacttccccatcggctgcgtgccgcagtacctgtccgcgttccagagca

SEQ ID NO: 1843 - DNA, 57 bp, Zea mays
aggcatgacggcgactgatctcagggggagaattgacagtgagatgcagacgccagt

SEQ ID NO: 1844 - DNA, 58 bp, Zea mays
tgaatattgtaattttaatttcgtgttacctaaattatatattatttatgtaaatatt

SEQ ID NO: 1845 - DNA, 244 bp, Zea mays
tgttggacatttaactaccaaaattaattgtaggaaaaagttaaccatatttccctttcaacaacgagttgtcttccacgcctaggtgcggatttttctatcccctgtgtagtattggactcaaatctacttcaacaccagatttgtcaaatataaatttggaccatacaggaacatgctcctgtcgtgaacttgattacacgtgargcttttacacccgttctaaacgaggctttaatgggca

SEQ ID NO: 1846 - DNA, 1500 bp, Zea mays
ttgtctgacactgacagaagttccatattgcacgggcggacgtctcgaaaccagccgagcctcgtggatttcgttgaggcccgacccccgctcgcgcagcgctggcgcacgttcacccgacccgattcaccttggccgttgcgcggagggcggcggggaacgggggtgatctcacatcggcgatgacgaagacgacggtgcagtgcggtcaggtgtcagcttgtcgctgtcagttggaactctggactcatcagagtttactcctagtactgacgcattcgtcaggcaccgtcggttaaagttcgttacaacaacgccgtcgtcagtcgcggaattagttaccgcaccatgaccgtgcaactcctgctctaccggcgcggccgcccgctgtgacgaagaaggcgcgtcgtcgatgccaattgccatggcatcaatgcggaaggcaggcgaggccgtggagcgcgccattaatttctgcatcctccttttgcagtcacagcctctcacaggaggaagcagagcgcatttacttgcggcgcggtgctgctgctccgcaacaacgccgacgcgacgccgaccacagcgaggagagtaacgcgcgcatgacgccatctgcagcccccgaactctgaaaagaatccaaacggaaccgaaaagatggcgcgtctgggctcccattttccgccggagccggcggccgggggcgggcgagaagccgagaaagacaggggcgaaacgacaaattctgcgggcgtcaccgcgagagagagagaaaaaaaggaaccttcagtttctagtgaacaatggaagccaagaaggctacaactaccctacaggaggaccccagcaagaaacagagcgaagggacaaggccaagttatggaccggaaccggaacgaagacgaagcacgagcctatacatggcacacgtatctactctctaccagtatctctgttattgtcatgcacgcccaggcgtcgatcggtcctccattgtaagtcctttccggcgccgtggcgcgtgcccggccggaaagcaggaacaagagaggccgaggagcggtgcttgcatgcgctggcccatcaggacctcggcgtccaagaaacggtgaactgaccgccgccgcgccgtggcgtgcggcacgcgtgcgcctcagttgtgcagcgggttcggccccgtcggcacgagccgcttggagacgccgaagcgcacgtcgatctcctcctccccgccgccgtcgcggcccggaggcggcatcggcacgggccggtggtggcggcggtgccccgcggccccaacgtgttgcctggggtgcactgtgtggcaccaggtgggcggcgccgggtgcgcgccgcgagggtcgcacatgcggccgaagagcgcgtcggcggcgaacggctcggccggaggctggttccccacgcgtcgcgagggcggcagcgctgcggcggagaggacgagcagggacgccacgagcaggaggcgaaggccccggcacc

SEQ ID NO: 1847 - DNA, 1156 bp, Zea mays
cggcatgctatcgtaatgctgatgtcttgtagcttttgtaaacgggctggagtataaaggcgggtagcgtgagctgaatgggctgatgggcatcgaacgtaacaagtctgaactcgtattctacgccgctgtcgttctgttcccatcatcagacgcctatccccttgctctctagtctgatcgcacttggaatcgtgacagttaattcggaattcaaaggctctggccacgcataaaggccagcacatgcttcggctacgtcttctctctccctccctctctctctctctctctctctctctctctctctctctctctctctctctctctctctctcttctcttgattgtttactgctcgttccgtggcaatcgagtcagtatcatttatgtgcctgcgcccgccatwcacgggtgtgataatccgctcagcagagtagggattagtaggaacttgagtcgccgttcagtggggccgttggcacgtcaggttcaggtacatgcacggtgccgctgtgcttccgtgtttagtaccagtcgggggacgtggttcttcggtgcgtaggaacactgtgcaaacagtggctgggagagtggtgtgaggtgtcatgatcctgtcagtcagtcgttgtagagccccgtgtgctacagatcagctgcgcatctagctggcatgcatttttcgttcatcatcaagacgatcgaaacatcttgtggttgctttgagctgcaagcgagctcgtgttctgattcagacagaaacagaggagcggcctatggcctgtgtgacatctagtcggaggccctgagctagacttggagggaatcgggcatagtttaaatgtggctgtgcctttgtattaaaggaaaccagctcctcctccctcctatcatcctcttcctcaacgctccctcgtcattatataacacgaggatcagttcagagctgcttgacaaacactcacacctagcgaacagctatacacccaaccaggtgggagagctccaagccaccaagaccaaggtaatgcctagtgcatggtgcgcgctccgtccaaacgcagcacgagacgtgtgagccgcgacgctaactaacgtcgtgtgaactgtgcgcctcagtgatcggaacctgtgcggcggcggcggcggcggcgacg

SEQ ID NO: 1848 - DNA, 457 bp, Zea mays
gttgatgacgttgtgtgagtgtcctcgaacaagatttatgtagaggagtagcacatcttgtggtgcaacggctaggtgtactacctcgctgatgagcccggggtgcacttcgtttgacagtccagccaagagtcatcggtactcgacatgtcgtgcgcgttcgacattatatacacattttgtatataagttattatattattatatgttcccgttgcaacgcacgggtactcacctagttattacagaaagccatatcactccaaagcccatccatatctctcccggcttttcacacatccgagcagcccacagagcccgactgaggcccagaccagtccgctccaaagcccattctactcgaccccaccacatcgatcggtccataccaagacacagctgacgccgctacccgttcccgtcctctttccgccgcctgcccagacaccacagagca

SEQ ID NO: 1849 - DNA, 108 bp, Zea mays
tgcatgcctgcagcttccattcctggctaaccaccaccaacccaaaagcagctgcccgctgctgctgcggcactttggtcacgtgcccactgcacacctgacaccaac

SEQ ID NO: 1850 - DNA, 714 bp, Zea mays
atttcatgtctaccaaatcagtccttagtgtgtgatatgtgatgatattagctaaaattttttgtgtcatcttagtggtagtatgtatgtctatatgttttatttatactcaccttttgttataattatacttgtattcaattattcattgcatattttaataaaagacactagtctctctatcatttagtctattcagaactaaatagacacaatatagattgtcaggctattcagttcgatttttaatattgtttttaaaaatagtctttatttttagagccggaatttcaaaaaatccaaacataccaaaccaaatcaaccgaatagacggaatgaccacctctagtcatctctacccgcgcacctcagccggccccacaaaatctgacgctgaccatcaacagcccctgcaacgtgggcccgcgcattgcccgtcctcacacgtcatccctgggcacgcgcgctttatgtacccgcccaaccgcaacttcctttcccgcgcccgagcagagagagcctgactctgcagctatacgagctcagactccctctcctccctcctttctcttaccttcctcgtgagacatcaccgccgtctcggtacgtggcagcaaccaaccgttcgcttctctctcctggagcgtcgcgcggggcccggcgggggaccgtacgtacctgtgcgcgaagacggggacggtggcggagttcgag

SEQ ID NO: 1851 - DNA, 566 bp, Zea mays
catgatctgatggtcaaaggctaacattcgggtacatgtaaaaaagatggggagaagtgattttttttacgagtagagatttcttcgggacagatggtagataccgttgttgggcccagcaaaggttgagtttattctcctccaaaacagcgccagagattgggccgtaagacaagagcgggccacgaaaggaaaccacggcccacgggtggtaaccacgtccacgcctttccgccaaaagcaaaacccagagcgcatgcgcatccagattcctgtcttcttcaacagagagcaaccgcggccgctacctccgccacagcccacagctccctcgcactgtatctgcatgcaacaacacgctctgcagcacgtctaccccgtgaccctctcggcatctccagtgtccagagctacaacagatggccgtcagttatgtccgcggtgatgttgtgcacgaaacaccgaagcaaaagaaaaaagagaacgacgacgtcgtcgccgacccagacgccgcataaaggaaagctttctccgcacaagaaaccaaaccgtgacgcagcgcagcc

SEQ ID NO: 1852 - DNA, 656 bp, Zea mays
gaatatgttcacttgtttgatagccttttatggctgtttatatattgatctacttaagatctctctattttttcttaatacaatgatgcatagttcttctacatgttcaagagatactgcattggacaagaaccaacctgattccattatgaaaactgcaattataatgaagcctcgtcacccattgtgtttttaagaatcgtgagatatttgaagttgagcataggtgaatgatcatggaagttttttgttttcatgacatgtttggcagcttattttagtcaaacttttttttttgaaaaatagtcaaacccagcttgcattcctgaccaagcttagtccgatgcgaagcccggtataggtactttccagccagcccagcccagcccattcattcctttttgattgaagccaacttattcatttaactgtgggccgcacgagataaggcaaatcagcccagcgcatggaacactgactcctgcacgatccagccgtcagattctcaagcccctagatccaacagtccatgtcgtctttctcctctatataggcgcacacaaccgcgaacacagaaaccctagactacacccccatcccgcagcagccaaaacctacctagccgccgccgcaggcggccccccatcgccgccaag

SEQ ID NO: 1853 - DNA, 591 bp, Zea mays
tgcagttcagctccagaaattgacctcctcctcctcttctttaatctttaataaaagaaaagtgccacttcaatttgtgcttccaaaactggtcttgtgttgaataaagtagacggcctcgagaatgcccttttcaatctggtttatttttgtcgccatcaagcatggcatggatgtcttcaaatgagaccatagcagcctccgatttgttgacgtgtatggtatccgtaatccgtgtactgggccaaagccaaaccccatgccgccacgttgactcgggggccgcggtcaacgcctctgaccagaggccagaacgcaagcaggcaacaggcaaggcaaacgagtggcccggtcgccccgccggcgcccgccgccgacacgtcgaggtgcgctgcacgacggcggctgagcgaaagatgggagtgtccgtcagggtcagagcgagcgtggagagagttcaaatccgcacgcaacttctcctctccgggactgttagttaaatactactccctgtcggacgaatccaccgtgaacggcaacgcctgtcggacggtcgttggctagctagctcgcctctgcagtgcagagtcg

SEQ ID NO: 1854 - DNA, 1243 bp, Zea mays
tagcagcggaaaaaagcatgcagatggatctatctttctcaaagttgcagcaaaaaaacaagaaggcgcagcgtcatcagcaatacatgccccagaattgtgaaggaatgaggctgtcatgcatgatctaacaacgatttgcaggcacaaagcgagacacagaccagacgagagcgcgcgaggccactctagtctagctgtgcgtggacgcctgctaatatggtgccaaccaaatcagagctagatcatgctggcagcttcactcattcgcaagagcatttgtgttttcatccaggatgaatcaaactagctaacatctctctctctctctctctctatctgtccatcccttcgtcttctccatactcctctcaagaaaattaacctcaggtagccttcacttgatttcaaaatcctagcatctactggaaattaaagacaccagtgcaaaaaaaacaaagattcttgcaatgtggtagaagtgagatatatcgagctggaagaagaacagcaaattaacacacaagaccaagaagaaagatgggacaaggaaaagaaaaaaaggcaagatgaagcgatatatttgaactctccccttgcaggaccttagctttgccttggacgatggacatgggactgtatttatagaggaaagaggacgcatccacggcaggctaaacttggcgcactagccccgtggcggtgcatgccctaagagcaagtattataagtacacctcagcaggctgtaaggtgttccacgtcatcagattcttacgtggaggggtgagaaaccaagaaagagaaagaaacatgctcttgtttcgcagcccgtccgcagcgtcgtcctcgagggaaaaaagaccgcttgcagcccacaacgagaagatgtgccggctctttctcgctctttcgactccatcctgatcccgtgcgtcttcctcggccctcacgacctcgctcgtcgctgcccccgcacacccgcgcttcttccgtccctcccgctaaatccttccgtccctcccgccaaatcgcgccatttagtctccaaatccattcgctgcgcgccaaatccaagccaccatcctaaatcgcccccaaatcccaaaccctagaagcaaaacgcgttgaggcgtcaatccaagaggacctctgcaccaacgcctctggagatcccgccgcaaggggctccgcccgttcaaccaccaagggctcagcccatcctcccgcctggcttcccgtcc

SEQ ID NO: 1855 - DNA, 1380 bp, Zea mays
tagcagcggaaaaaagcatgcagatggatctatctttctcaaagttgcagcaaaaaaacaagaaggcgcagcgtcatcagcaatacatgccccagaattgtgaaggaatgaggctgtcatgcatgatctaacaacgatttgcaggcacaaagcgagacacagaccagacgagagcgcgcgaggccactctagtctagctgtgcgtggacgcctgctaatatggtgccaaccaaatcagagctagatcatgctggcagcttcactcattcgcaagagcatttgtgttttcatccaggatgaatcaaactagctaacatctctctctctctctctctctatctgtccatcccttcgtcttctccatactcctctcaagaaaattaacctcaggtagccttcacttgatttcaaaatcctagcatctactggaaattaaagacaccagtgcaaaaaaaacaaagattcttgcaatgtggtagaagtgagatatatcgagctggaagaagaacagcaaattaacacacaagaccaagaagaaagatgggacaaggaaaagaaaaaaaggcaagatgaagcgatatatttgaactctccccttgcaggaccttagctttgccttggacgatggacatgggactgtatttatagaggaaagaggacgcatccacggcaggctaaacttggcgcactagccccgtggcggtgcatgccctaagagcaagtattataagtacacctcagcaggctgtaaggtgttccacgtcatcagattcttacgtggaggggtgagaaaccaagaaagagaaagaaacatgctcttgtttcgcagcccgtccgcagcgtcgtcctcgagggaaaaaagaccgcttgcagcccacaacgagaagatgtgccggctctttctcgctctttcgactccatcctgatcccgtgcgtcttcctcggccctcacgacctcgctcgtcgctgcccccgcacacccgcgcttcttccgtccctcccgctaaatccttccgtccctcccgccaaatcgcgccatttagtctccaaatccattcgctgcgcgccaaatccaagccaccatcctaaatcgcccccaaatcccaaaccctagaagcaaaacgcgttgaggcgtcaatccaagaggacctctgcaccaacgcctctggagatcccgccgcaaggggctccgcccgttcaaccaccaagggctcagcccatcctcccgcctggcttcccgtccatggttggacccggcacttggtttgccccacgtccaccgcagtccatggtgagctcttctgtaccatcaggcagcaatggaggctctgcagttcctcgttctttggctgagaatgttgctgacactgatgtacaagc

SEQ ID NO: 1856 - DNA, 969 bp, Zea mays
tttttcttgctaaacttcgatataacatttttttttcttcttctagccaaccaaatatgctccgcaccgcataccttcctacctactccagcagaccagcacctctcccagccgctgccgttgtggccccagctagcgccgtccacgtcgtttcaacgggcaaatgaatttctcgttgtgctgcagcgccgacacgtatgcccaggcccagccgcccccaggcttgccagttgccagcgctacccgacgaacgaaacgacgtggaaaagcgtgaaaatgtgcagaaagccgtacgggcgcggcagggctcacgccggaacagggataccaaaaaaaaaaaaacgccggtcccggcggcgcgcgcgcggctctcgttttgcacgcgcgcgtgcccgcagcggccagtactactgttccttatcaggaagggggcaaaaaacctcggtctgccccgggctgggctgggctggccgcactgcactgcactgcacgaggcacgtgtactagcgcctccacgccacggggccccgcatgtcatccggaagcaggccgatatttatgggccataaacaaggaccggcggtcaagtgagtgccccccaacccccccgccgcatcttgatccaattgtttgaaaataataatcgtcttgtactactgtgctgaggggcgtgcaaataggaaacaggaaaggagacccgcgcgcgccccatcggccatcgcctcgcctcgcctcgcctcgctttcatttgccgtcgcttcgggtctgtccctgctcctccccaattggtggggtcgctttcgtactactactactgctagttgtgtcttgtgtgcccatgagcctagcgttttggggatgttttcttgcccctgatggtggatccactggccgccggttttctccagctggagagccattcgtgggcgtaggacgagagagaggatcggcggcggcggcgtgtgggag

SEQ ID NO: 1857 - DNA, 250 bp, Zea mays
cttcggaacccacgcggtggcaacagctcgttcgtcgcatgcgtggaggagctctgcagaggctatttgttgcgcccgcacggcgcacgcacaggaatcgtaggccgcactgttttgtcggcctccgagttttccagctgtggtgatgtagacgagttcacgagtctgctggtagtggggtccggtgccgttggtcgccctcatactgtgtggaccgtggtcgtctgtgttggctacagaacataaaaag

SEQ ID NO: 1858 - DNA, 321 bp, Zea mays
tgctaagttgtaccggtacggtcggaccataggtcacgacaaaacttcagatgcaagtgaatcatgcaatgtatatggcatgctgcatttatcaatatacttcacttccttcaaatacaatacaaaccttaaacaatacttcgtttaccttcagatacaatacaaacctcaaataatacttcattcaccttcaggagtgtgaattaatctcgtgggtcatactcgaatcatcatcatcatcatcatcaatatatatgattaagcatcaatataatacaatcaagtaaagcatcccatagagttcaattacgaaagagttcg

SEQ ID NO: 1859 - DNA, 1454 bp, Zea mays
gcagaggtgaacaaaacgctgccctttctccacagattgcctcagtcgaagcaccaccctattgtagggtcttattctgtacctgacatgttctgggctacaaaccaaatggttcagaagatgttgtattcaaagggtgagattgcgaaggatggccaagacggatcacttacatcaagatggaactttgcacagagaccacactcaaatagtccagtcatgagcagggttcaaggttccgatgcctattcaagtactaaaaccgaggtgatcacattctgcagcataataaacactgattttactaccctgggtcaccataatcacctgttttctatgtcttaataagattatgctaactatgccactttgacttgaagttactactttcactattttcaggaatctggaggcgcaccttcctctgcattagcgaagctgactacccgactcaactttttgaaagaaagaagggccttgcttgccagtgagatgcaaaacttagatctgggccgctcccaggcccagaggcatacagctcctccgaaagctgagactccaactgagaagtagaatcgttttactgcatcgttgttaggccacaagctcaggtaggattgcaggcagtaacagaaaacttcgattcgacaatgcacagagactatctagctatagagtaacttgatttgtacatcgcacaggcattcatgtcttcaccctgatgattcatatgtcaagttttttagcgacaccgacgaacaacctggtttgtactattttatctccaaataaacaatactcctactctgggacaaagccaaagtgcgtttgcaaattatttgtcggtctgtctggtactctggtttgtacatcaacttcacttacgatcaagctaagtaaaaataccgtaccatgtgtatctatgccttcagtgtaacctaatagcaattccagtaaaacttggcagtcccagtgccaaaaagagcgaccagtatacctgcttgaacatcgtgctccgttaagttggcagttccagtgccaaaaagagcgaccggtatacctgcgtctgcgtgagcatcgtgctccattttgtttcgtccatttgcagaaaatttcgaaaatcatgttagattctgttgtttgattgtttcatgctttctcaaaaacagattcttctttctgctggaaatcattactccggctaggccattgaggcccaacgtctatttattccgttatctaaaagcggcctaccgggcccgcaagaaaaggcccgctagggcgccgagacagcggaacgttctctgagtttgagcacgatctccccgggccccggcgccgccgtacgtcccccttcggcgtcgccagccgcctcctggctccggctccttcatcgcctgctccagcgtgcctgcgtgacataagcgtcgattgattggcgagaaaggggacga

SEQ ID NO: 1860 - DNA, 790 bp, Zea mays
tttggtgcatttgatctattactgtttatcagaaaacttgttttttttaactgctagagtaagatgaatttgaccatgaaattttgtgcatatatgagggaagatcagatgtacattcatgttttttcagaattttttgaaacttttttagtaggtttgcacggggtttgtatcaaaacgtggtttgcattcgatatattccctatatagaaatcgtagtaatgcacgagcatatacctatatctagaataaaataacaaaatttatgtatggctaggatcacaaatggattatgaaaccttttcttataacagtataacacacatttatacataagttatcgtggtattatatgtttccgttgcaacgtacggacatttacctagtataaacataaattgagaataaagtgttgtggagaaggagcttcaaattcaaatactcggtttatcgatgctgttgcgaggactttacaagccttccactataattatctcttcgtcttttgtgtaccgccgtaacgcacgagcattatactgccataaatttcttagagctgataaaatacatactgcgcgttgcaagctcccacttcctgaggaacaggaactccatgagatccgcggcatccgccgtcccgttcatctgcacaaaaagaccgtaatccttctttttcctctcctccccatccgcggagtgtaaatcgtctctcgctagcgcgttcagtagaaaccctaaaccccgcctcctcccctcgccggggtaggggctacgggtgtcaacgcccgcc

SEQ ID NO: 1861 - DNA, 75 bp, Zea mays
ttttatcaaccagaaactttgttcacaaaggatttgatatgaaccttgctttctgcaatcaagagaagcagagaa

SEQ ID NO: 1862 - DNA, 219 bp, Zea mays
ggtcttattttctgctgaaacttataatatttaattgcctgtttcgaataacttgttgttgttatgttgatttgataactgtgatgaacaatgactgatccatggcttaccatttgatgtatagatgagtatgttgctaacttgtactctggctgacatcatatcttgcaggaattcagcaaatatgaccgacaaattgccaaatccataagtaaactt

SEQ ID NO: 1863 - DNA, 277 bp, Zea mays
ctggcaagctttagtgagtggtttttgtcgcagtccgggttcacaaagtgggtcgggttttttcctcgtgctacctttctcaccgtttctctcctagtctcctctcgtttcccgtcctcctcccgttggggaggtataaaatttcctaatccgcaaacgaaggcttccagaagggcttcttcttgagtaccttccacttccacccaacgcgactcgctctttcccggcatctggaaggtcgccggctcagatccagccgggctgcggcgctggccgg

SEQ ID NO: 1864 - DNA, 959 bp, Zea mays
cggcatacggctataattcaccagactgtccggtgtgcaccggactatccggtgagccaactgtcagccgagccaacggtcggccgcggaatccgcgtgcgacgcgtggcaagtgccaacggtcggatggggcaccggactgtccggtgtgcaccagacagtgtccggtgcgccaacggctccaagactgcaacggtcggcttcgccaaataaggaaagagatccgcaccggactgtccggtgcgccaggcgacagaaggcaagaattgccttcctggaatgcactcaacggctcctagctgccttggggctataaaagggacccctaggcgcatggagtagtataccaagcattctcaaagaattcctaagcaccaagacctcgattccgcgcatttgattctttgtgatagcaattagagctctaattgagttgtgaactcgtcgagttatgttgtaagctcttgttgcgacttgtgtgcgtgttgtcgttttgatttcgtgtcttgtgtgtgttgctcatccctcccttactctgtgcttctttgtgaacatcaaagtgtaagggcgagaggctccaagttgtggagattccttgcaagtgggatatagtaaagtgaaagcaaaacaccgtggtattcaagtgggtcttttgaccgcttgagaggggttgattgcaaccctcgtccgttgggacgccacaacgtggagtaggcaagtgttggacttggccgaaccacgggataaaccactgtgccatctctgtgttgatctctttgtggttatcgtgttgtgcaagttctcctatctagtcacttggctttattgtgctaactcctaatcaagttttgtggattaagtttcaagtttttacaggatcacctattcacccccctctaggtgctctcaattggtatcagagccgttctcttcaagaaagggactaatcgcccgaagag

SEQ ID NO: 1865 - DNA, 79 bp, Zea mays
agattctagaatgtgattgtattagaatgtagaatgcatagagtgtggtttaagttgaagtatatatggtcataatcca

SEQ ID NO: 1866 - DNA, 1500 bp, Zea mays
actctggctaatccacttattacaacccagtatggcgacaatacgaccctataatagctcaagcaactattacagactcaatcacttagaacatcacagattacagactaatacctcatacctgctactaaaaactcggccggggagggaaataccgccctcccggtattccgtataagaagagaccgaaacaatggtcccgcccgagaaaatccccgaaccctggccccccatcactaacgggccggcgtcaactgtgcactctgcaacggcccaaccggagggtggcgcacaggacatcgcagcccgagagcggatggggcacttcgaggggtttttttaaccaagcctgaaaattcgctcccgataggaatcgaacccagccacccaggacttggaggtggtactcggaagtccttcaccgctagtctagaggccctttcgctcatacctgctactaggatcctccatacttgctctaggcatcatcttgggccatcacagatacatgcgtgttgtaagctgtgtacttggtgcttcagacatggcgaaaatggatccttgtctctctctctctatacacacacttcatatatatgtttcctggatccattgcccattggtgcgaggttctggatacttgtacctgtttcataagggctttgcatcttatctgatgtggtgctcaacctgtcctttgttgttctagcatttcaatttcggtcggacatatatgttgctctcagtactgttagtctggaacatcaaagtagactactgtttcaggttattatattacatcaaaatcaaggctttatctaccaaagaaaggaacaatgaaatttgaaccttgagatagtgtattgtctgtattctcttatcttgtcaattatggatgtgggttttttttcgagtcgatgctgaattgctgattcatacttttcctgttgaatgatttaatcacaccagcatgatttgcttctgctaatatatgtggcttattgcttatttagatttaccttcacctatttaggttcaagattatccggtttaaagacatcagaagaggctgcggtagtgccaatatgtacttttagtattttaaacttgatttactcgtttccttcgatacatcatcctactaagtgcaaccagctcttagtgattctgtccttgtttagatatttattatggtttccaggaaaattctaaatctcggttgactcattcctacatacaatgtgccgaattttgtaactttcttctcttcactctttgttcatcaaagagacatgcatgttgttttgagcagtgtctgtacctttcatctttaacttggttgtaggtacggcttgatttcatggccttttaagttttaacttgttttcgatatgagttcttccatgtattatttctgcttgctctagggctctcttcaaaaatttacccgttaatggtccatttaatatattgtattgagattttcaacgacttttaggc

SEQ ID NO: 1867 - DNA, 1500 bp, Zea mays
cgaggaacggattggacttggagagatgatgatcgaggctggctggttgtgtctcgaatcgatcgatctcccccaaccactgctactcgcacaagaatatgcttggcggccagaaaaggccaggraaaagccaacatactagctccgagctgtgtgccctgtgtgtctgtgtgaggcgccgcacgctcccccaccgcaccgctagctacgacgagtatactagtagctaattaatcgcctgatgctaaactaatcgtagccccgaggtagacagcatcattacgctgtctgaccgtctctgatacagtatgcacgccgaattgctggttaaaggcagaagagaagagtctggagcaagagcgggatcaaggataaaagtccattaacagctttggcacggtaaccaaagtgtctccaagtcartggcagtggacagcggctggtacgttgcttgtgggcgagactgttcagatgaggcggatgcgttgcgtacgtccactgtggcgggcgagggctgccggccgtgctgtgctggactgtttcccgttccgtgctcgcgacagtctgcgtgcaggtgcgccgtcaccgtgctcgctgatacctgactcgccgtcctgggcaagcacggcgcggrcccagacccttgtgcgcattcctccctgttgtccgtccgtccgtggacgtctgcacgacgatgacggtacgacgagacagcagcttctgggaaggcgattgatgattgatgaaacatgtccttgtcccgttgtctctgtacagtatacaaacgtttcatgagtttcagaacactcacggcgcactgcagaaaaccgaaccccacgaaaccaaccaacactcgcgggaaaatagcgatgagaagatgcaggcccagtactactccgactctgctacagtttcccaagccctcagcctcacagcccggcccacaaacataaatgcaggcccatcgacgcgaccagaccacccgcataataataaatggccaaatgcaggagtggcgcccacgagtcggtgatacaacgtcactggtactggtagtacgccggcgcttccagttccagcacgtgggatccgcccggtacaggctacagaggcggacccgtctgccagcgggagagcggcgtggtcgatccacaccgatccgtgcgggccactggacgaggggccagtaaaggctttcgggcccacgccgcgatttcgaattttaggggtcccgtcaccgtcggtccgtcaaaccacgctacccgtccgtccgcggttcctctccccattccccaacgttcctcgctccagagcgtttcaaacggtaaggaagccacccccgctgtgaggttacttaaggcacggtgacccgacgcgagcaaagctccaagacccgcacgcgaacgccctccctgccgctccgccgtttcgcgtgggagtcgtttcgaaaaagtctgtttcgcgagcggtgaggactgaggagtgtggaggcctaaaacc

SEQ ID NO: 1868 - DNA, 379 bp, Zea mays
acactcctccccgaccaaaccaaccttccggacccgacgacagacacccgtgcaggctcagcgaccgaggccgaaaacgaggctcgacgcccggcgcacacggcatactgcatcataccgcaccggcagtggcggagaaaagagatgagccagccggggccgggagccatcgccgcctcatgcctyccgactccgtgacggcccgcagccacaggccaccsgataacgcacacagcggaaccatccaaaaacgcgggagctttcccccgtcaaagcccccaccctaatcccccgtctcgcgcgccaatcaaccagcaccgggagcaggagcaagagcaactcaccctcccctccggcttccgcggaactaggagctgcc

SEQ ID NO: 1869 - DNA, 257 bp, Zea mays
tcgacctgcagcagcagttaatcgtcacgcccccatccttccccagcaaacacaacacaagcagacggggagagattcagatccactcgtcacacatccgcgttaccccctctcccttggtttcctctcccacccaccaacccccagatcgcagcgatctccgccgccgccctctcagggattccgcgcgacaaagtcaggcgtagaggctccagccggacgaggaggaaagaggagcagcagggcgggtgggggag

SEQ ID NO: 1870 - DNA, 1500 bp, Zea mays
tgttccctggtgcaccggacagtcctgtgatctcagtcggacagtccgccagtggcaacacttttcttcatttcttggactttgcttgatacttgttgatcttcacttatggtcttcataatgtcttcttttgatgtgttgctttcctcaatgccttagtccaagtcactttagcatcctgtgaactataaacataaacactagcaaacacattagtccacatgttatgttgatcatcaaacaccaaaattctttggccaaatgacccggggtccattttccttacaccggctgtcggtgttttgggttcgaccgcacacccggggttgcccctcaaggtgtttttaggagtaggacggtgtcgacgactgtagcaaaatggttcgtgccattcgcacgagggacagtggacaagatttacaggttcgggccgcttagagatgcgtaacaccctacgtcctggtgagtatgcttggtgaacgtggttacaagagagctctctggattgagaataccgagagttaacgtgggtggctaagtatagggtcgatcgttctgaaggggtgccccctaggccttatatactcgaccgtggggcaatacatgtggatatgataacaatgtgtagctaaaatatagtgaactgcttgagtttatctccttgtagttctgccgacttatcctcgcatggctccgttgcatgggggctccagcgcgggaaagtcggatctctgttgtggtcactcgctcgacgttgtgggtcgcccgggtttgcaccgatccggcctcatgtcgatctgctttgctggttgtctccccctaggcccacgaaagaatgaccttacgatttattgggcccttgggcctttcgtgaggtcttttactcttttagtggacccgggggatatctatcccccacagtgacattccaccactttacaaagttatcatataagtctatctcaaattaatggagtgagagatggaaattgattctatatatttacatactatttttctgatgtacaacttatagcacacttttctactttcttcgttataacatgaatatagtatataactatctctctcatatgatttaagataatatacaaatatattacatatataaatatatgaacttaattagttttgtctaaattttaaggaacaattggatctataccattaaaagatccaaactttagatatataccatggaccccacatgtcattgactcatgtggacccacatgtaagtgagatagtaatggtatggatccaaagtggtgatcttttaatggtatggatccaaatttccctatctatcgttcgcgcacctcgcactacatactagcctgaggacctgaaaattcagctgaaattgttacaaggggtactcgaataatagccgcaaaaccctaaccttggcaccgtataaacgagccaacctgtccaccccgcgccgccgccactccgccgctcctctccgcttccaag

SEQ ID NO: 1871 - DNA, 1483 bp, Zea mays
gcctttctggctattcttgccctaacctaaccatctcttatatcctacctaatcagtagctggatacctatgctctcctaatcacccactattgacaaaaatacatatgagaccctggatttttgaaccgattatagactaagaattgaattacaaaccaatccttctgtattcccttttcttacaaatctcgaggacgagatttctgttaagggaggtaggatttgtaaagcccaaaaacttggtagaaaaaaatatcatgaaataataaaagaaagagataatatatatatatacacatatatctaatcctgagatctaaataagagtattttctcgtaaaagtaattatatactagaaggtatttcttcataaaatagaataagtaataaataatgaagctttggaatgaaccactaatggactaaacattcgaaatactttcgtaaaatgaatattttgtgttgcatattgaaaacattgcctaaataaataaggtaataaacaaatgaataaacttaatacatgaaccttgcatttatgttgaaatatatttttggtgtgcaaattagaactttgtttgaatttaaaatctaattggaatttgaaaataggaaaaaaaggaaaacactttcctgcgtttgggcctaatgccacatcctcggcccatcttccttgtttctctcacgcaccagccagcccacctcggccctcggtgctccagccaatgacatcgggtcccactcctcagtctccgttgtggctccacacggtctcccggatatccgacctatgactccacgtgactgtgcgcctattatcgctgacaagtggccccaccctcattggtggctgacttgtgggccttgtcgccaggagccatcttccccctgatggctacaactgaaccgcgaaacggagatctcgccgtggccatcgctatcggtgattcgctagcgtagcagtcgctcctgtaatgggggattcggttaacccttgccctccgtagaattcgcgcatgctcttctataaatagcaagagcctcggccatgagcgccagcaccaggtgattcgcgccagggtgatgtggggcgcgctgccattgggaaaatcgcaccgagcttcatcgaagagagagaaagagagaggggtcgcgttgtgtgctagccgtggagtattgacgcgggccgtgcgtggcgcctgttgctgtggaaacggcacgtatggccaaccatggcgccgtggcgagccggatcggctgcggccggtcttcacaaggaggaagaatcgcttggcttcgccgtatccaccatgcaccagacccccgcgtgcgtcggcgtgcaggccagagcttcgccctgccaaatcgcgctgatgaccatcccctccggcgagcttgtaaaggtcagtgagcctatacttgaatacaacgtactgctccgtctggttcccgcgaagaagatcgtggtcaaccgggggag

SEQ ID NO: 1872 - DNA, 54 bp, Zea mays
cgaggcgaggggagggaaaacaagtgagtgagagagagagagagaggagggaaa

SEQ ID NO: 1873 - DNA, 1500 bp, Zea mays
aaagaaacaatccatgcatatcttaagcatttatattggctcaatttcaagcaacctttgcacttacattatgcaaactagttcaattatgcacttccatatttgctttggtttgtgttggcatcaatcaccaaaaagggggagattgaaagggaattaggcttacacctagttcctaaattattttggtggttgaattgcccaacacaaacaattggactaactagtttgttctagtgtatagactatataggtgctaaaggttcacacttagccaataaaaagaccaagagttgggttcaccaaaagagcaaagggccaaccaaaggcacctctggtctggcgcaccggactgtccggtgtgccaccggacagtgtccggtgcaccaccggacatgtccggtgcaccagaggactccaacgcaaactcgccaccttcgggaatttccagaggcactcgcgctataattcaacggactgtccggtgtacaccggacagtgtccggtgcgccaaggaggagcggcctcaggaactcgccagcttcgggaatctccaacggctagtccactataattcaccggacatgtccggtgcaactccagagcaacggctatctccgcgccaacggctacctgcggcgcattaacagcgcgcgcagaagtcaggcgtgcccatactggcacaccggacagtaaacagtgcatgtccggtgtgcaccggacatccaggcgggcccacaagtcagaagcttcaacggtcagaatccaacggaactggtgacgtggcgggggcaccggacatgtccggtgtgcaccggactgtccggtgcgccatcgaacagacagcctctcaacggccacttttggtggttgaggctataaataccccaaccaccccaccattcattgcatccaagttttccacttctcaaccacttacaagagctaggcattcaattctagacacaccaaaagagatcaaatcctctcccaactccacaaaagcattagtgactagtgagagtgatttgtcgtgttcttttgagctcttgcgcttggattgcttcttttctttctcacttgttcttgagatcataactccatgtgtaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaacggggagtaggtttgaaagaaccgaacctcggtaaaacaaatctccgtgtctcacttgcttattcgcttgggatttgtttttcaccctctctcgcggactcgtttctttattactaacgctaacccggcttgtagttgtgtttatatttgtaaatttcagtttcgccctattcacccccctctaggcgactttcaattggtatcaaagcccggtgcttcattagagcctaaccgctcgaagtg

SEQ ID NO: 1874 - DNA, 450 bp, Zea mays
aatcgaaggatttttgaaagcgttgcccttcccccggtccaagtcgccttaagaattaaagaagatgtttcacaatttaggcaggctttgcttcccatgtaattttcatattgctgcttcctgctagcctggaggatttagggtgtggggcttagcctccctttgagtgtgctcgggtgtggcttgtccagtctcagaccgttgtttgtactctccaaactctttccccttaaatgatgggcagagctcctgccgttttcgttaaaaaatacaatccattcctttaagcagaaatcatccatcactcccaactcactccatcctataaaagccacgaccagctacccccacaattctcctcctactccgtcctcagcaggacagcaagacaccctccctcactgaagaaccaagagcaagaatacccaagaatagtagctctcaccccca

SEQ ID NO: 1875 - DNA, 55 bp, Zea mays
ggtcatcaccgtcggatccatgtaccgacacgcgtaggaatgcaacgtggagtgc

SEQ ID NO: 1876 - DNA, 609 bp, Zea mays
ggggaccgttacgcgtgacgtaagcaatgacgaaactgacgggtacttttcgagagtcgcttcaaggtgctcgaacgtttcttggccacagacgaggcggagtagtaacgatcagataaacgctttcgttctcatctgaacttctggagcataccttacgaaagcacactgcagcgtattgctcactcgtggtcgtggaatacatcgaaatcacagctggtcagctctaggtttacgaaagcactgtgtacaattaagcacttgcagaggctgttcaaaatttgcgaatgaagctacacacttggagcacacaccaagtaactggaccattggagccttggaggcttgctgggatagagatcaccaagtcatacaagtctacctgcattcttcctcgatggttctgttctgtcaaggcatcaggcagaggtagtacaatagaaaactgcaaatataagtctctccagtcatcatgcatcctacaaatacacgaccatcttccgccaaaagtttcaaatctcttgctactccgctttctagctacacccttcctcttccttataaaatatgcaagagtgcagctgcgcagccgccgtcgcgcagccagcc

SEQ ID NO: 1877 - DNA, 1108 bp, Zea mays
actatatatatatatatatatatatatatacacaacgtgatcacctagaacacaccttataatattattattatgtagtggtggatctagagggtggacagggtgaatccggcccaccctctctaattttgatcctgctaaaatatatggatgatttaaatttatttgtttcttttgattctcatatattgtaagatttgaaatgtaaactcatatatttattttgatttttataagattggaccaccttaattttaaatcctatattccccactgatattaagactgtttattagggctgattgtctctattctcaaagtaactttattagtgggtctttgcgatttaagtgtgtttaggcatcraatttttttggatggggtttcttccatctgtactctttargaagctccggctgattttagtcakgtatagatgccgttggaattctgtttgaaaaaaaaagggggtaaaaaaggtttgtttgtgtctttcaattakgtgttgttttattcagacattgttaagggaatartaatgakatctcttaccggcggtaatggttactagttataattggattggatagtagtacctagtattactagaaagagctcaaccaaacaaaagtatcggtatcattaccctatgtaatctatttacattatatttcggtgaaccaaacatcatcttagtctcgacagcgttagaccttatatatggaggaggaggaggacatgcaagcgaaaacatgaatatatattcgttgtttacattcatagtatatatattcacctctatgaaagattcaacgaaaactcaccatgacatcccccattgccaagagaatatttcaccgcccatgaaagccaaggctttagtatacaaagactacatacacacagcccagggttttcgtcaaaatattccaacagcgattgttttcttgtggcctactatagcttgacccttcgtcgtcagccaatcactctataaatgtcacaccaccctttgcagcatgctttgcaacttgtactaacaagaggcacacaataccctttgttcatcccctgcacacatagctcaagcaattaatactggacacac

SEQ ID NO: 1878 - DNA, 228 bp, Zea mays
ccctaatgcaatgttacgaacaatatctagtaatcgaacaagtcaatggtcacggggacactagttttgtttacctgctatagcgcagccccttatatccacaaaaaattcaatgggttgttcacattccatggctataaaaaccactagttgctcataaggggagtgagacagaaaaaccaagagacgtttggtcatcacttgaagttctgagcactagctggaggc

SEQ ID NO: 1879 - DNA, 171 bp, Zea mays
tgtgagatgggtggtgtgctctctcttttagcttggtgatcatctgaaaaaaggaagtgctgtttatttctgtaagatagaaagcaaaccattggttcatgaatggtttagtcatgctaagaaaaacaaagttctaagaacacatatacagtgcacgtgcttgctggcaat

SEQ ID NO: 1880 - DNA, 1500 bp, Zea mays
ctgtcaggttgaattccaccctgacctgagaatctggtgctttcagcttttcttcgaagtggtttctttcttctctccgaagcttgacaagcacacgcgcgtttatgggggatataaataaccatcagtccttcttatgagaaacttatttacagtttagatttaacgtaaccagttaaaaccactttgaaggataaaaaccatcgccgattatgagaaatttccaagatggtgcagtgtgtccaatcaccgatcttatgctgttcctacttgcgagaatacacgtcatcaaataactacaatcgaactgttttttcttcagcaccgctccgaccagccatcaaaccttccacgcatcctattttttgacgatcataattcttgtggttgatttgttttgcgtgaagtgttgttagtagattacctagtactaagctcgtatatttaaaccaaaccagactagcatactgtataggcttattcctcgtgatgaagtctaaaatttaatcagcgtcgcaacttggatttacctaacctgctggcttaagcaaacgtagccgtccttgccacacacacacaaaaaaaaggtaactagactgaagctgtgagccacagccacttgggtgttagcggaaggacttccggagtaacaaacatactttggttgtttgtaacggcccaggagaaggcccaaactctcgcagcttataacctgtacctgtaggctcgaccaccaacagggcgtaaaaacaaatgaaactgaaaacctttcctaaagaaagaataacaactaaagaggcaatgcacaaagaataacaactaagtgagccatttggttgtcaccctagcgtggcaccctggtcgatggcgctcttggaatttgagacagaggatccgcgacctggcgacgtggccagccgtgaggggcaagtggcacgtgaagagggcgaggtgcatgtccagctggcggcttccgcgccgcgaggggcggagggcccgcccgcatagaccacgcgccgtcttggggggagggggaaagatatctatccacgtcggccggcccacgtcgctttcgaatctcccctcctccaatcggctgcccgcgcccacgtgaacggccggcccgccggcccccgctttttcctcccgcgggccgctccgtgcgcccggtccagcagaggaagccccggcggcgagcgggcgtcgccgcgacgagccgtggacctctcccagcgaggcgccgggcggcaggcggtgtcctcatccgtggcgcatgtatatataggatcctcctctgtcgactctgcacgccttatcgccacacagacacagcacaacgcacggagtcagattgcgggcagcgctcgctaatcgccatagcctatagctgtagagaaactgctccgggaggaagtagacaaggagagagagagagaggtcaacagggcactgccggagccggatccggatccggagccaaaaaaaaacccagaaggatcc

SEQ ID NO: 1881 - DNA, 143 bp, Zea mays
cgttttgttttgtttttgcaaatctgatgcattttttaataataataataataataaccatgttctattttttgtttatgtagctgaagtaccgtggcactggatctgacagtttctgttgtccaaaggatggttagtggaac

SEQ ID NO: 1882 - DNA, 112 bp, Zea mays
aagacagctgcgagcggggcggccatttctaggcggaagcgcgggcggctgggctagcagattgattggtttgagtggttgggtcggctctaggaaacgccccgccgcggcg

SEQ ID NO: 1883 - DNA, 212 bp, Zea mays
cctaagtgtttaatttcatagaaattaatgaaattacgaaaaggaggtgtccaacggagaaggggttcggactcactgatctctaggtcatagcctctggtagtccctggtcagcctgtgtggactgtcctcaggacaatcgccaaaaccccccgagccaacacctactacgccgccgcgccgccgcgtcaaacaacggcgagaggacgcct

SEQ ID NO: 1884 - DNA, 1500 bp, Zea mays
aaactatactgccgtgtcagtaatttgcatatcaagccctttgaaattggattatttagcgatgatttargaatcgaatcgaattacgacaagactctattcgtattcaattagttaagagcctcaatttattatgagaaaaacatttagattgtgaatcattacgcttggactatcgtaggcattccattcaatgcgtcgataattatgtacataactacttcggtgatttgtgcggtgatatttgtatacaacgtgatggctatgaatttataacacataggattaacaaaatacataaaaagaaaatcataggtttaaaatttccataatatcttaattatacatgaatttataacacatgaaagccataaaaatggatttcggctgctcttctttgtggctggctgtagctacaattttattatagatgagcttggctggctgctttttgcaagctgctggtagccggaggagccgaccacattgaaaaacacatagaaatacaaaacacaaaaggaataaaaacataagattcaaccttatacttatttttctccaaaattacatagaggataccactctatagaaaattttaagtaatcgatacgatttgatcttttatctaaaggttctcataaatactttaaatcttttacgctccgtttggattattaaaattgaatttcattataataatagtaatttagacatataccaattaagttaattcggttttatacaaaatatatttatatactataataagtaagatgtcagagatatttatgtgctacatttttactatatatgagtgagagtagaaacaaattattacaatacataaaatcattttccatcctccgtcttatagttttaagatagatttatatttaaactttaaaaagtggtagaatatcaaattccaaattaaatagattactttattaaataaattttaattcatcttaaaagaaggtattcaaacgttcacgtagaaattgaatcctctgatttttctccatttcaatggagtcctaggaactatatatgtttcctaggcacgcgcgagtatttttggtagtttaataaaaaaaatctgtctccatacaagtagtacgatggagcgttgaacacgaggattggtccgcggtgggcgtgaaaccgcgggaagggaggctggttctgcgataccggggtcgtacaggggcctgggcgcaaaacgcgcggcacatgggacctcaccgtggacgggcacggagcggacacgggcagataaaattaaggcgaggccgcgagggcggcagaaaaatcctcgaagcaacccaccctgtcgtccgcgtcctccacgccctcgtcggctcgtcctcgccgtcctcctccacaccgcgcgcgcggcggtgttgacccacccacccgttcctcccccaccccatcagcgctggaggcggcggtgcgtaagtcccccggacccttcggcggcggcggcggcgcgcggtt

SEQ ID NO: 1885 - DNA, 380 bp, Zea mays
ggtatgcttatattatcatgtgatgctcaccaataattctccttcctatatctgtacctacctttttgtcctatttcagaatgtcacctttgcaatttcattgtattcaagccgcttttagattgcttttcttctaactaggcatgtttatgggttttcagagtaatgtcccaattttttgtcctctagtgggttgctatgacagttgctaagttagcatgtgtgtaaggcatttcaagctgcatttgatgtttagtttaggtggttttgtagctgcatgatacacatattgacacagctgtgcgaatgtctaggaactagtcgttctctttgtggtctattatagtgaagacacaggcagtgtgaagtagtgcaggctt

SEQ ID NO: 1886 - DNA, 1500 bp, Zea mays
ttcggagatcctgctctctcaactccaatggcacgtcgacagcgggatggagaagacgaaggcagtgcaacgttctggtgtgaggaggagagagtatgtattgaggacgacgtctcgccctcaatttgtacacacgacgcgacaaaacagacaagtaatcaaccacataatcacaacactaacgtgacaatcaatcataattaatacgagaataattgcttaccaaaatagaccagcgcaattttctccatgcatgcaaaaataccaagtagcaaatggaagtcgtgcacccgcaagagcgatgcacccgcgcccacttccacgcctcacttggcgaggcgagcgagcaagcgcgtgagttctcccttttcctctccacaatagcttcaatcaagtggagacaagtcaactatttaagttagcctcacatcaacttgagtagtaagatggtactaaagttttcactgtaccatgcatatgcgagtcggcctttagaatttataggaatttttatttgggtcaagcccaaaatctctaacacagcaatcatacacagtaaaatagttaaatctatggtctcaattattattctacactcagactacccttcagcgggcaccaaagcattacagccaaaaaacattcatatcactgccatcatgaacagcagggaacgacgaagacctgtgcggtagggagcggcgtcgcccatccgccggagatctacgacgctaatggaaatcggacgagaggctggaggaagcgcagtcgcgatcgagtgctggcctcctgggcgagacgctgggctaaggctgactccaacaatatctggtaaaccgatctatacgctaaatttagcgtttggtacatgcgctatccgctccaacaacgtccgctaagaggttcgctaatttagaggagctccctgacagccgctaaaggtagagaatcgctgttcatccgctatctgtccttcgcatcgtccaaggagaattgcgacacactgtgacgcacaaccagccactgagaaaataaatattgtacgattagatactgagaaaataaaattaattacgtctttgtacgattaattctagtgaaataaaagaaaaacattgaataaatattgtagtttatggattatgttaatactgtagatatagaggacgaaatttagagaacgttgctggagatgaagaaaatttagagggtgaaattttttagagtgttctgtaaaggacagataatatattcttttagaggatgaaatttagaggacgctgttggagaccgtcttatacttgtaccgttccggtcccttcgacacttcgtctatttgcggttctcggcgcaatacatttcccaacacagcgccgtacgcacagcacagtcacggtactccaccgctaaaaccttcggaaagaatccccaaatctcgcacacctcgaagccttcgaggcccgaaaccctagctcctcggcctccccgccgcttccaccc

SEQ ID NO: 1887 - DNA, 1307 bp, Zea mays
ctgcagtttatatggcagatgttgaaattgtctgccccaggaggctgcaaagagctctaacattcagcaacgcagaggctgaggatcacctgttgtctaggaaggaagcacaccttgaacctaagaccaattaaccatgagccaggcaatttcctagctcgacgcaatgcaatgctgatccttgatttctgaatctgttagaaagattcaattgcacagcatagattagtagtagtagtaggatgtgcatttccatccttgcaacaaccttatttgatcaagggtatagtatttgtgagttgtgagaccatgattacagactccttttgagtcattgtatctgtatccttgccattaccgtattacgatgccattggtttgagtaaacaatcattaaattctttgaagattgatcgaagtcatacgacaggctgatcagcgtctagttttattttcaaaaataaaaacaacaactcattgctactttgtatgaggctaaatatgtcctttaataataactataagatwaaaacaaacttttcaaacagcatgattttttattttaaattaaatatattttagaaatctttagagattaatgacgacatctttatatattaaaggcttggccctaatttgacaggctatccacgtcgtctattaaagttatgcttgcttgcaataacagaacgagtttggatgagataatcctttagaaaatattgtttaatttggagtcaagtgttgtgacagaaccattcctgttgtctgttagagtggatgtgtcgtcgtcgagtgcctcgttaccgaccatggctggcttatggatgccgtcgagcttaaggatgatatgctcgactttagattaggtcttctttataacaaaggaaaattttctgaatcctacgtgaaataaattctgttaaatttttatgacatttctgtgttctaaaggacccctcattgggccacatcccaaaatcgacgataaggtttggggtcgagagctacgatgagatggttgatgtacttcagcagaatgagaagttagaggatgcacttaagctgttcgatagaatgatgtaggagcacgaccctccacctccactgcgtccgcgcgcgccagcgcaaagaactttcgaacagcagagacgccaaccgagccccaccacggttcttgaagatagactggtcggtctatttcttggctttctagactagaaaagggaatccaactagccaaggtccaagtgaccatcacgtttcagtttcattctctgggtaggggagctgctgcagccgtgtgt

SEQ ID NO: 1888 - DNA, 80 bp, Zea mays
gcttaggttggggaatgatgggacagaacaatatgaatatgccttaggtagcatcagctcaaggtgcttcgggctacaac

SEQ ID NO: 1889 - DNA, 735 bp, Zea mays
ctactagtgcagaataagctggcgtttgctgtttggtcactttggtttttttttaaagtgaaatggtgtttggtcagttagtttaataaaaacgtctggttcttgaaaccttacttcgcttgattctctctgcacatgattggatggttgtttgtctaccggcctacgtgcaggttcgcatatatgtgggtgcagctaaatgatcttaaaacaatttactttgtaagaacagacagtacaggtaatcaatcacatggtctatgtaggagtatagagcatggcaagtttggatttggacaccgtctgcgtctcagcgtctgtagtcgaatgaataaccgccatagagtttttttcacttggctttatgcgacggtgccaccatcaaataaacattccgcaagatggcctggaatgttaagcttattttctggcccacgcgtactggcccaacctaatctaacatcggcccatataaaacctcattatggtaaagcaaaaagaagcccaaatgaggcggtcaacgcactgcccactaacatgtccacatgcctctgcgccgcgcgatgacgcggatccgaatccataaagataatgcgagtgcgccagtagacaaacagcgaggaccttggatttcacctcactcttcctcttcagttcatccacacaaccacctagatccaaagccaatcgtgagctcgtgacgatcaccaccaaccaaccaaccaaccaaccaac

SEQ ID NO: 1890 - DNA, 1500 bp, Zea mays
cacgcaactgcaattgcaatctgagtcgacgtgcgcggtatgctgattcttgattcgtgttctgttatgctgcggtagggcgtttcaagaaagggcggcggcgcttttcctgacgcaagttgccccggtgtcctggcttgctgcgcgcttgggggttgggctcaggaatggggggagagcaggcgctgcgtcgactggtcctgttcccatctctctgaaacttagatggatgcatctgtacgtctctgtgcctctggttgcttttgcctctctgaccattcttctcacgcgtgttccgttctcttgtgttgtgctgctgcgtaggtgaacgccaagaagaaggttagtttctgtgggaacaccggccacagccgctgcggtgaagttcatttagctgcggtgtgctccggtcgtatgcgaagcaaccccttctcacttcaggttattgtgttctctgtccgcctacctgtcttgctcaagagtacaacactctacgctctgactctaaacgatgccgttcttgattgggaggctaccagtttccttcttttctttagttgtagttggatcttgtcgaactctctactcagtcatattgaaataggggttgggatgaggaacgctgctggagatagatttagccccaagtactactgagtttagaaccggtttatccaattttgataagaactaagagggtaggtttctactacactcgttctcgaatatttgtcgtccattagttcattttttaattaaaacgtgacaaataaaaaagaacggagggaatacaattcaaggtggaggctgtgcctgatggcgtttgattcctcgtataaaagtttgtggtgtgggaacagatgaatattacaacctgcacaagtcaaacttgagttttcttattttatcaatgcaaacagtgttggcacctaatatgtaatttttgcgctcttaaatcttggtggaaaaataatcaaacgaacctccttcctctgtcctagaaagaatggcgttctagttttcttatcaatcgattcatctcaattttagcaaaatttatataaaatatattaatatttatgatgccaaattattaacactagatacatcatgaaatatattttcatattatatctatctgaagtaatagatgttgatactatttgctgtaaacttagtagagaccggttcaaacctaaacttacattcttttaggtagtgtttggttgaagaggcaagtataacggagtcgttctgttctagttttgttgctgtttggttacaaaggaactagaacaaaatcgctccaattagggaatattctcctcagatccggaaccattccgctccaaaaaatcaacaggacggagccgctccgttcccatcccgctctcacagtcacgctccattccgttcactctgcaaccaaacaaaaaacagagccgctccgttccaaattaccaaacacagaacagagcggctccgttcctagaatcaggg

SEQ ID NO: 1891 - DNA, 547 bp, Zea mays
tggttccgattaaaaaaaatgtgtcgtttcctccaagctacttgcttactactgtgacagctctatctacttctgggtgaaaagatactggagatcccggcctgctactgtgcctaactctgcctttcaatctctgttattcacgaaagaacaaatgaatcaggtagtaacacaacatgggttggggctgatgtgagcgctaaacacaggaacatgtttgttgcataccatcactgagctattttgtctgatactccaatactacccgtgaatttcttcagggagaaaaaacaaccagcagcactttcaagaagacctgtttttcatccatagttccttttttttttgggatggatttgagaggagtttatttgagattactctttactgccatgtaaagcaaagttgtgctctcttagtctcttgtatatataaggcagtatttccttaccccgtagtccattccacatttccactccaccgtttcagcagcaacacagccaaagcccaaagaggcggcagcagcacagcagctcggcctgttccc

SEQ ID NO: 1892 - DNA, 499 bp, Zea mays
atcctttcttcagatgaagctcaaaggaagtgacttatcaaaggaagctcaaaggaagtgacttatcaaattatcaaattcatcctgcgccttcagctctcttttgagtttttgcttgttcttgtctagtagtttgtaagctggggtcacagcagctaacttgctattgttttcaatatgggtatagggtcatgcctttggtataatatgcctagtttattgttttcaatatgggtagggtcaacgctgcatgcagccatgcacaccgtcgccaaacgcccaccttaattcgctctcgtctcctgacgagcttggtgcgcgggtcaaaaaggctagctgggacgtagcgcacccgctcaaatctctgaatctctcgaccagtgatcctttccgatctatccgccttcccttcccgtacgtcgtcgaggccacgccacaagcgaccgcgctagcctcctcatcctcgcgcccgctcctctctgcgccgttgactgccacg

SEQ ID NO: 1893 - DNA, 631 bp, Zea mays
cccacccaacccacctgaagcttctgattctgaagtcgactacagaagatctgaatcccctttatcaccccttgtttagttttacgcccgcagatcgacggtgtgttccttgatttcccagtggtgcatctgttcacgatctgggagcaatattaaataattatttcaagacgacacgcatgtccttcatcacgtgtacgttgccgggtgggatgacatgacacccgtcgaaatcatatatatgcttgatgggtgtggtggcctcgtgccatcgtgtgtgcctgtctactgcgctagctagctgtcgtcttctccatcaagtagaaccagtagaggaagcaggagaatacaagctactgcccttagaaaaaaaaaaccctacgctagctagcatcctctttccattagccatcctagccttcgccccctcgacgagaagaaccacctcaaaaccgaacagccgcaaaagaaagctgctagctactctatacatgataactaggtagatatatataagcttccggggctttaatttggttgggagttccggccatgagcgagaagagattcatgcatggcgcaaatttcatgtgtgttttgcagaacaggaccgtgaagtaatatatatata

SEQ ID NO: 1894 - DNA, 513 bp, Zea mays
tgtattttttacttggagtaccgtgcagcagtatctgggttgtacatgccctaacgcatactccgtccgacccatcccatactacacatttttttaaattatatatagggttgaattgaaaaagaaaaaaaaagctagttagaggagaagctatattggccgtaacgtgagacatacaggactgggagtctggaagtaggagtggacagtgacgggtgacgactgtgcctctgaatggatcctatcctacacaagtcatgggggccgccgccagctcacacacactgccgacgctgccgtgccactgccatcctcgagcacaagggaccgaccagacccgatccacagctcatcacacacacacacagtggcgagctcgtcaattgcaggcaagacagcaagcgcatttacacagcacgctgaaagccgggacgcagagcagcttttgcgccttgtcccctcctgctcgtcgcttccctcactctcacagccacgccacgccacgagagaaga

SEQ ID NO: 1895 - DNA, 1140 bp, Zea mays
gaccatatatagatcagaacatcatggcttcatggaaagaaatgagtgaaggatgggggaaaagctgcgcgcaaagctcgtggatttggatacagagggttctttgaagcaagttttaggattgttttttttataaaattgtgaaccatgtaaactagtgctttagtatagtatttaaagactgcccagcgtacaacttttgagagtcgtctagttctcaaccgacggtcaaaataatttacatcgtttaattttaaatagagaaaacgctgaaataccggccgttagcctagtttggaatctttgagttatataaattccattcaaataattgtaatttagagatagatgaactaagctaatttagttttatgtgaaatatattatgtatattgctattgaccatatggtttatatgttatattcctactatatgagagcaagccaaagatcctattataagatagagagtacgaacataaatttacagatatgtaaaattaattttcatttttcaccgtattaattttttggagatagatttatatctaaaaatttgaaaaatggtggaatgtcaaattccaagttaaataacccactctattaagtacattccaattccttcaaaataaatggatccaaacggacggatccttagcgaaaatcaattctgcagtaaccataacaaggagggttcgaaaaaaaggaagtgtagctcgagcatagtttttttttgtcacgcctctaaacataacatggagtgtgtaaggcaatgttagagttgctctagtcacacatgcatgctcttggttttagcctattttattctctactcccctaatattttagaaattgtgtgaccaggatcagacaagtgctatttccattgacaaccctctccacttgcctcctggatctctataaataccacaaatgtggctcccctctcaccaccaccgtttggaaagaagatcatctcagatcgctcctctcccctcgtgcccctctcccctcgtgctcctcttcaaatagcactcgggtacaaaagggaagtacaacgaaggcacttggctgccttctgaggctgagagaggatcactcttcttacaagttgcagcgtaggggcggccaccacaccac

SEQ ID NO: 1896 - DNA, 1500 bp, Zea mays
ttggactgtgatccgtcaccgccgtacaacctagcattaatttgcaggaattccctctatggatacagacatgcacacagatgcagcgcacgcggcatggcgtggcccagacagaacgatgagtttcctgcctctcgagactctggttcaatccaatctctctctctctctctctgaagagtgaagacagagcacgttccggtttcaggacacaatcagcgcttctcaccatataaaaatcagggaagtacgtgcatgcaagcgactctggaacaggactgctgatatataagctacaagggtctccaggcactcattagagaagtgcgtatgtgatcgacacgaggacacgtacggtgcaatatactctcactgattgcgtttttgtttttgtttttgtttttcttttatgacagtgcaacgggggaccaacagcccccacctgacgggatcgattctagatttcagagaaataaggttcagttcagttacatgtatgttggggatggggggagatatgagcagagaggaaaaaaagatattacatgatcagggtgatgattacatgctactaaagatattttaacggtggacagtggactggcacgccaaacttcgcatatagcgcagcggctagttcatttttcgcgtggcccgcccaccggcccacccaccgcgtcgagctgccctgggttgacaaaataacgaccgagatccaacaaatctactgtcggcccaagtatcatgtgagcttttagttatacatcatatctttcgtaatcaaaattagctgggcccagaacgtcgaacggcccattcaccgaagactcccaggacaagcagcgcaactagcgcgagtcgatgtttctaaaaagaaaaaaaaaataacgagtcgatgactccccccataatttcctttttctcgtccccgtcgaatccgcatcgtggagcaaatccaccggaatccggactggattggattgcggcatccattccattcgcattcgcattcgcgttatgcattccaatcgcggccgccgtcgctatcctcgtagcactcggccgtgctttgctcggcccacccaaccccgtccctatcgccccccatcgtctccctcaccaccagtcaccaccgccagctccccgcctctgcctcctccaggcgaccaggcccccagctttggcgtcgacggacagatacagcggcgccatttccaaagagagacacagatcgcgctgcccaaggaaaagaagccgcgccttctcccctctcccttctttcttcccttttattgacgggatcgtccgccggttccattccaacactaattcctcacgggggttccatttggattcggcctggatccgcgagatcaagaaaaacgcctgcaattaaactgccaagattaacaagaaaaatataaccaaccttgattggctgcaataatctttcttcaaaaaaaaggagagagccttcggcggcggccgatcttggctcgg

SEQ ID NO: 1897 - DNA, 1500 bp, Zea mays
cttccttgaagagtttgaaatcctcagagtcgcacaagacacaagcgtacgaagatctactaggccttattcggttatctctcaatccatgtggattgagttggattgggtgggtttaaatcccaaacaagtcaaagttcttctaaattttttccaatcccgtccaatccatatataatgggaataaccgaacaagaccctacagagaagaaaatacagatacaaccggctgaagtttgaccttctagattggaagggatcaaaaccaattgcaaggtgagacaaatctaacttcgatttgttctagactagttaaagtgataaacaaaccacgaccgttttacaagacctgtccgtgcctgtcgccgaacacgaaaacagccagccaccgcccaccacagagcaaatcgtttttgactcgtcggagccggctcgccgcccgccgagcgctgccctgccgaccgctgcggcttctgtcggtgtgcaaatactccgagactccgggtgccccgccgcaaaaacgtccccacgcagctgcgtcgcacytaacccgccccgccccgcccgcctataaaagccggctcgccccctcccgctcctctcttctcccccatctccatttttctcctcccactgattttgcattttagcccctcaggaagctcggatttcggccccgctccggcggaccgcttccgttcgtgctctgctccgaccgagcgcgccgcgccgtggggggcagctgcgaggactctcgttcggcggctctggttctcggcttggtcccgtttcttccccaacaaatctcgtaatttttcgtccagatttggcttctcgccgcccgtctgggtctttctcgtgcgtttcgcctttggtttcgccgatttggtgccggattcggtgggttgcggccgagtagcctggatctcgggcgcgggtctagcgctaggagccctcacactggggatttcctgccggaggaagcttttcaagggagctagcagctagtagctagctgcctttgggagcagtagctcttctagtctctgaaggtttcaccatacgcggtggagagcgctattagcttgaggagtagatttcgtgtagcggtgagcaaagtttgggtgtcaagtctggtggtggaagccttcaggcttgagattttctccaaggagcacgccgtctctggaaggaatttcctgccatcccagaggtatgcacttcctccttttggcaaagctagagtttccttgctaattgacttgccttgtacagttgtactgactagtattgattgctgattgagcctttgtcgtgaaatgtcaggctgccgatttcctccctcccgggaagcaagcaagggctttcttctagacgagctcttctggttccttaagtttgtgggccgtggctatttaatctccaactgcatccccagatattcaccaaattctgtgagactgggaactccgggattggtttggataaggtgttctggga

SEQ ID NO: 1898 - DNA, 196 bp, Zea mays
atcgagggaggactggactggaggagtggtgttgtgttcgtcagaagtaaggggaaaaaaagagagagtagaaacagtagaggaggaggatgtgtacaatctgaggcttgcttaatgtgaaattctttttgcccaaacgacgaagccttggactctttgccgcatcgagttccacgctgtttatgtgtttgcaaat

SEQ ID NO: 1899 - DNA, 828 bp, Zea mays
cttagctgtgtctactgtctaaagccctccacggtgcaataggttcttggggacccttcttttgtgtttttttctaacctgacgtcgaccaaagatttcgccgatacttttgggctttggcgtcgctagcaacagtgaaaggaatagttttgaccccgtacaggttttagtaaaaaatgtaaacgcagaagtgtttgtttgttgttttttcattcggttgccagtttagcaagccagacgggcggtgaaaaccgcgcaattctctccctgctgtgaaagggatgccacaatggcgaactactgcgacgcatcagatcaatctgcctgtcgctgcattctgcagacgacccgagactccgagagcagcagcaggaggaggccgggggccgttctcctgggctcctctcctccggctccggttctccctccgcacggcgtcgctgtcgccacgggcactgtcctacagtcccactcggccactcctcactcactcccctcccgacccacgtctagtcccactacccaacaaggcaacaaccaccgcggggacccccgaccccgagctcgaaccaccccaggatatgagaagaatacatttccctgtccctcccctactcctcccactgcctttcgtcacatgcgcacaagaaaccgcgccgcccccgaggcctgtgacccccacctctcctccagcgccccgccaagccgtcgctgcgccgcttccatgaccctcgttcccctcgcgacgagcggcatcgtcccgttcccgtccgtggctggtgcctttttgttgttgaccacccgctgagctgctgcgtgcccgcgcgc

SEQ ID NO: 1900 - DNA, 627 bp, Zea mays
gtatatataaatactagggttttaaaactaaataacaaatagttatttatagttaaaattttataaatttaatttaaactttgtctaaaacgaatactggaggggtacctgaggagtccataaacccaaaaaaaatcaccgaaaatgctaggtcgtaaaactcctgctcgggccaggcccatcgcttgttcttggttcttcgtgcctttccctccaagaattgaacccacagcagcccccgtccgccgttacttcctgcttcgcgccacttacccgcctggccggctggccgactccaccacctcctgcccggcaagcaacacgcgctttggcgccacgcacaagtcaccgtcgccgaacacagcacgccccctgcaaactcacctcatctcacacctcgccgcagaatcgctttcttcctcccgcaaagccatcctttcccacccgtgcgtcaatttccgcgtcccaaacgatcaaaccctcatttgctttaaaaccagcgtcgtctcaatctcatgcaaaattccgaaggcggtcttccgagagcaacagctgctcaggcaggcaggcaggcaggcaccaacagccaacccgacgcaaggaaccaattaaccaccgtcccggctg

SEQ ID NO: 1901 - DNA, 557 bp, Zea mays
ggtcattggtggccactcacgcctcctcagacctcaccctcacttcgtcgttagcgcaggatcggacaacggcctcctcacggcgaggcacaggtgagcaaattatcgtaaatttgattgagcacttatcatattaggccctatctagaagactagaaattcaatgcatactgcagttggtttgtattcttgttattcagcagtgtaggactatgttagctggacctacaaaagccaagactgataaaccactgaatgtcttcttgatatacgattgaatgaatgcaaatagatgcacacgtgcttaattgctaaaaaagaaacgtacaaattaagaagtgcaaacaacaacatctgctgcccttcattacagtttagtgcagtattgtgttatactgttatatcaaacttctgttgtacacattgtgttcacttttatgcgtttcatttcgagaaacatcagcaattatcatatcttaacattctgaacgatttcctgaaaacttctgacagttatagcaaaagaaagaaaaaacaccttcctagcagaactgaag

SEQ ID NO: 1902 - DNA, 610 bp, Zea mays
acccgcggcccggcaagcttggtccgttttgacatgtatatctaacgggaagaagagatgagaaatgcaggagacgttttggtgatgaaaaatgtgtggcatgacttgtcgatgcatgtcgccatcaccaacttgctctctctcccttcagaatcctgctttcatttccatgggtgtttagtttcatatctgcagtgaatcttgcaaagtagtggcacgtgttttagtttttagtgcggaaggaaaaaggtaaaaaaaaaagaagaggaagcaaaggtgaggttggattggtgaactgggcagggcatggcaggacaggagggagggcacggggcaccagccaagccaaccatagcaacttctctaccctaggcgtctctgtcagcccactccgatttgggccgccaccactagtgatggcccatcaccgccgccgcctcctccactctccctccatccatttaccaccccaccccgccgccgccctcctcttctctcccctgagcctgactggaaccttcccgagagaggatacaaaggcacccggatcgaggaaaccaatccattccattccattccacacaaggctaggcacaagcgaaccaaaccc

SEQ ID NO: 1903 - DNA, 1157 bp, Zea mays
gcttttaagaaatacttgtatcaccagaaattaaaacagggctgagttcttcagagtacttaccgttcatcaaacttgtgcgtgaggatgtccttactgttcatcaaacttcaaagtacttcagatgccgtccttgatcttcctggtgagctggatgacctgcttgtgtgtgaggaggcccttgctgacaatgcctcttcctggtgagctggatgacctacttgtgtgtgaggaggtccttgctgtggcacgatgccacagaggtagatgcggttccgtctctgcatcagctccgggctaatggtgacgctcttccgcgcagcgccctgccggtggccgttcatccttcgctgccgcactgagacgctcgatcgcgccaccaccaccatggccttgctaagcctctcgtccaccttgtctgctgcctccacacccaaaaaaaaccgttggcaacagatccaaagcaaagcgaatcttaaataaacagaaaagggagaatagagaaaggtatatgaaatcaaagcatggaccaatcaaacgaacamgcaaaccaaaatagggtgcaagacctcgtgatctgacctggggcacgaacatccgcggcgagagcgagtggccagggcggggatggcggcgagatttggagattctccttccgagggaggagcggattcggcgtagacgacgtggacagcagaggctctgctcacgggcgtgggatccgggggcgggggctctgctcgcgggtggctgggagaccggcacagacggcgtgggtagcagagaagagagcgggagcgagggagacgccagacgcgcgcagatggcgggcagggatggcagctggtgttgcatggagggtgtcgcgggtgggagtgggaggcagaaccgtgcgccatcgtgttgtgaacgtctacactacgttcttaagtagtagtagagatagatatagataaggacggagagagattatcccccaatttctatggattaaggataaaagaacaaagcctaaattgagaaagagacgagcatgcccttatgcataattgtctttttttttgtgacggtcggaggcatcggaaccagccttgcgcttccgtcgacgccgatgtgccgccccgccgcacggaacggcacagaacaagcgcagccag

SEQ ID NO: 1904 - DNA, 1500 bp, Zea mays
tcataaaatactccctctattttttgtatttgacgttttgtagttcaattttaccatatttaacgtcaaataaaaaatataaagatagtacaatatttacatgtaaatttaaattgattatattaaattaatataaattgaacaaaaataatttataaaaatkgcaagagacacctactttatagtttaatttgttattttataacaggttgtgtattggatttttagtgtgattttaatgtattagtgaactaatttagctgaagaggagttcacgggcgcgtatgtggagaacggtgacgaggtttagtcccaaaccccgtccccgcaaatccaacgggtacaagactttcctgtttcaatttccatgggactaaattatcctatccatgtttcctaatagaagaattctctgcgtaaactgaggatcgggttcccattaccatctctaaggttagatcaagtcggttgggtccgtatgtcgtagaccacacgattttttccctcctatttctatttaaaaaaacaaattgcagttatagttatttgaagtgtcatttgaattgtgcctttgaattccattaagttaattaggtctacctagataatgtaaaataataccatttttttggtgtgttgaatctggatgatacatgtcttttgttttgcatttatgtttatttcccagaaagaacagttaaacatctcaggtttggtgacatagagtatatatctcaggtttggtgacgacatagagtatatcgctacttaatcatgatttctttatggctagtattgtcctatttaaataaaattctacctatgtgttatataaaaactgtatcaactcacggacatctgactaattatatttgttgggactatgcttcgtcgccgaaggtctggtaggaagaaacagcttcggctgaagctgtccgcatgtgatgaccgaaggttcctcttcatgaagcttcggaattacaaaccgacataaaagtagaatgaccttttagtccataaatgtttgagtcgctgttgtaatcccttatgaggggcataattgtaattcctcacaggctgtgtcccgtgtctataaatagtgaacaatattcctttactgttcacggattcctgtaattgcaaccgcatcattcgggaatcaatctttgtcaaggcaaaggtataattgtattcaatgcttaaatatattaaatcaatttaatatgagaataatgttgttcatttgtaatttatttacctttgaagcttcatattctatattactttattcaatctattacgaagatttaaccttcgtaattgtactacctttaaccttcgtccaaggttcattaatccttaagggaataatgcttcgttggacgaagggcattaacatttaacactttatgttgccttgttcttaattcatagcatttgagaacaagtccccaacattggcgcccacctccggtcaactcacttccactttttgagctg

SEQ ID NO: 1905 - DNA, 1481 bp, Zea mays
tggcagcagaccaaacgctcaagctcgggcctcggcctgcgcagcacggtggccggagacacgggattgtgggtttgtggccgagcaggggggaggggatttggagcaggggagagaagcggccgaggctcctgctcctgcctcggctagtatagcttcgctctgccgtgcgggactgccaatcggtcccaccggtcagcgtcatcctctcgctctccccgagccgctgcctccctccgcggctccgccgcgccggctcggcttgcttccggctcgtgcaccgaaatggtagaccctggagtgagaacctcaacggcgggaccgccgtcggtgcatgagctgggttcaggagatcagtagcagctttcgggctgggagttgttgcctgcgaatggtttatttgttttctgttacagtaaatgacgaatgtgtttcgcttttttatcggcttttgcttttggatggacgggaactcgaacaaaaccaaaaaaacgaatggatttttgtggcttaaaacactttctaatcagagcggctcaaggtaggcccggtggtttgcccacaccacaccagtgacaccacagcccacagggaaggattaggggtggttgcaaccggcaaagcgagcgagcgcaaccagccaacaattacgtcagcgaaaattttaaacgtggcttcttctggaggatttgtcgatgtcagaagcagatagtgacgtaagataggctcatctcaaaacacaccagaaaccattttcttttgcagatgatgggtaataatagactaggtcgtcaaggttagaatttatgtattgcatcaggccctcggagttgaattcgataagcattagaaatcctaactgactctgcgtacgtgtggaccgtccacgttactaccgcagaccgttcggattgcggaccatccggctttgggaccagaccgtccgtgctgcattttctgtgttcaacagattcttttgtaacaatatgtctgttgtccaaacacatgctgcgtttttgatattataataaattagaactatatcagtgaggtactaaaacgaaatattaggatatttttaaataagaggggacaactcatattttaaatagagtactgacccaagcccacattatatcagctcagaagttcagaagttcagagaaacagcccatatttcacacagggcatttcggttcggggcatttcggtccggcgggatcgaaactctcgcacccgagagccctttatatccgctagggtttacgcgcatttttgctcctcactgccgcgccgccaccctctacaggtgaatgtaacgaatccgccgcgggcgtcatctcctcttcccacctcgactcgccttgctcgccggcggcggccttttcttcgccgagcggcgagccgcccatgttgagctcgtggctgatctgatgggcttgttgtgatctcctgcaggtaaggaagaggaggagggcagg

SEQ ID NO: 1906 - DNA, 952 bp, Zea mays
gtgctcccatcttcgtatgttctatttcacactatttctgtcatctaacagatgcaaggatatacttgttttttgtttttttaaagattcaaaataaaaaagtcattttgagaggcaaaatcacataaacacaattgccccaaaactttatcatgcggcggttccggccactgcccagaagagaagaggggtggcgagttggagatggtccactgggccggacgcagacagtttcgtggcttttgtaaatggaccatggcccaataggaatgaacggaggcctggtccgctttagaaccaaaaaccctaatcgccgtgaccattttggggcgcacatataagccaccgccgcctcgcatctcctcctccgccccacgcagctgaggcgttgatcctcaccggcgtcgccatcgtaatcgccttggacagcggcacacagaaccttctgccttcgcaggtgagttcgcctccaaacgcatctccttttccgcttctcgatccgttagggttttaaccggaggctgaggttgttctaccagctatatcgatctgcccttgtaaggctgaagcttcagatgtttaacaattggagcaactattcaacagaattatggaaagcaagtcctactgtattagcaatagttttatcatcacctgtagtagaaagacccttgattgtttggtttgcttgcctgctttcaatataatttttattcgatcttgttgccttgtacctgattatttacatgattacttgtcttttttgtgttacagtagctgtttttatttaatcttgttgccatgtacctagttatttacataatcttatgttttctttcgtcacttgcagggtgcttgctggtatcattacaatctggtagttttagtggttgggcttgacttcctactattcagaaacacagtaccgagaagtctttaggtggggtcaaag

SEQ ID NO: 1907 - DNA, 216 bp, Zea mays
gatgcctgcagcgtgccttccgcgacaactgtagtcgttccaatacatgatcggcgtacaaactccgcaattggctccatccttctcagtgaaattggctctggcaaccgcgctcagtgcaggcataaataagcgtgtttgtcgtgatttgtaaagacgcttatcgctaaggaaaggttatggaaggtaaaaacagccagttgcaacaacgcaaag

SEQ ID NO: 1908 - DNA, 307 bp, Zea mays
tgtaatataaattctgttaatgttcatacatatatcatgaaataaatgtatgcatgtatgtatgtatgtatgtatgaatgaataacatatatcgtctctatgaactcttattctcatgaatgatgaaggtgtgtccttcatgaccttcatccgaagatcgttatattcgaaagaagataatgcttcaaaggacgaatatccttaatctttaacaactgtgttgccttgttttttattcaaagcatttgagaacaagtgaccaacattggcgcccaccttcggtgaactcacttccacgaccatgaca

SEQ ID NO: 1909 - DNA, 1018 bp, Zea mays
tgcagactactcctcctgtccctctactctactacctgatggccgatgccaaaagccgtagtagcatttcataatcaaatcgacggacggattcatccagcagtaatgtaaattcatgtacagtggagtacgcattgtactccatgaccttccctcgcgatcgatccgatcggcagctccagtgccacggcgatatgccataaattcatgattcatccatcagtctctctctctctctctctaccatgtacaacagtccatacaatcatgtgatttgtcaagtattttttcttcaagaacacaacgtcacatatccggtggctaaggtttacgagcaagatctattcagcctaacacaccctctaagcatgcaaaaaaaatttaaaaaaagatgaagaccggaacgtgacgtaagccttgtattgactaacaatgtatgtatacttttccattctcaaatggagcgagtaggttttaaccacacggcaaatatacctcaatggtttcaaataaaacacacacggcatgactcatgagcttgaatgtcaggccacgtggcggcgtccgatgactagatacacccatcacaaccactctgcaatgcatcagggcgacgtttctatacagtagactttcaccgtgaatttgtcgccgataaagaaaaaacagtgcatcttttcgtcaggtttcaagtctagcaaacggcacgaaatttttaaatcagttttttttttcttcttccagttgttccattttgggccgattccgtcgttcatggaactgggaatctgaaacgccgggcccaatggttctcagaagtcaaacgcaggctgcgcctgattgcctgcggccaagcttttctatccaccttctttgaccgccattgctctcgtcaaagagcatttcagcaaccacctccctcctctacaaacgataataaagccctacctctcacatcggcaacaggacgaggccagggcatccacgaccacgacacggacacagggagccgcccgcc

SEQ ID NO: 1910 - DNA, 678 bp, Zea mays
acgtgttagagagagcactggcaacaacagatgttcttagctgtacaaattctgtaggcaggggaggctgatcggcctgatgtttgagtgagcatgatgcatggttatgatgatggtctccttcacggcaaaagctgtcaaaccgggaagaaattgcagggcagtgtgtatttggcatgtaacgtacttctgactgacctttgccttcatgtagcatctgtatctttctttttccgcgtactgtaacacttcttactctaccaggagctggaatttttttggttcgggtgaaaaaacattttgctgctctcagcttttcaccccttgtttccacatgctttaggtcggactcgctacatgaaattcctagcctagttactagtggctcgcaactcgcaaatcatgcgccatccattgcagcattgcgctgcgtggtagcagctcgaccagcaactccagtcggccagtcttacttgcactggcagtgggccacacgttcctaatccccttcccagcgccgcaaaaaatatctcgtttctggcaaatatccgaacagccagcccgaccgcgcgagccgttggatatttaagcccctcctcactccccccagtcctcccgtgctatccccccattcgtcaccagccaggtcctggaaccttatcaccaaatcctcacatc

SEQ ID NO: 1911 - DNA, 64 bp, Zea mays
ggtgactgaaaaggcacaagaattcaaaatatttgttgataaatagaggtataagcaagcattc

SEQ ID NO: 1912 - DNA, 496 bp, Zea mays
cctggacaagcgaacgggcctggattgctacttgactaaggccttgttcgtttgtattcgattgcacctggaatcgttacagctaatcagagtttatataaattagagaagcaatccggttaaaaatcgttccgaccaaccaatccggcacaaacgaaccaggcctaataggttgcctatcgcaccaaaatatggtgacctcgtaaaatagccacttgaatttgtccgcgccaaatcacgtaagcggaagccaacaaaagtgcaatatcaaataatgagaacccaggtagaaaaatctgagctggaagaaatagcagccacaagcaagtggccacctttgagtggatgttggaagaaatagcagccacaagcaagtagtcacctgtgtcatcttattccgatcctagcccctcccatctccaattcctcgcttcctcctcccttctctagttctctgatcctcagcacttagcatcaagcttagcacaccggcgag

SEQ ID NO: 1913 - DNA, 1257 bp, Zea mays
agagcatgtacggttttgcgactaaaatttagtttttagtttagttcgtatcacatcaaatgcttaaataataatgtttgattatcaattatttggttttaataaattcattttatattttattatttagctgtataattaattttataattaaactatatttaatgctagtaaaccactcattttatgttcggttcgctctcaattctcaatctatatatagattgagtgagaacgtttggatttaaatcccaaacaaatcaaaaattttgttattttatttcaatcttatttaatccaaatgtattggcaataaacaaacaaggcaaaccaaacacccttctacactgtacccggacaagtacgtcatgcagatacaaattccgcgaggcacgccggacgcgccattcgagtttgaatgaataggagtagacgatcacgctacgtcggtaacatacactgaggtgtcttggctgcagccgagctagatgtcaacagcgtgctcgtgctcgtcgggaagccgtaggaaacccggttcagatggtcacgcctcctcgcggtccatcagcagtgacctgtcccgtttaggaaacggccggagagcaacgtcacactcacacgcgctaattttggcctctgccaggcaacggaacagagcacgccgagctcactggtatataaaaaaataattaatacataacagaaccggggaaaaggagcccgaggtttcgtcgtatactcttttgtgtaacaacaccgctccctgtatctatctgatctcgtgcggcggtggagaagtcgacaacaagcacgtgctgaatgttcgtcagggtcctgcactggggtgcgtagattattctgtcaggataagtactgcgctctggcctctgcgcaacatgcgacgccggagagcgcagaagatcctctgcaagaagctgctggtaattcacttctgaacaaagatccaaacagaggaagcgtctatccacgcatgctagagacgatgccgatcagtcatcagagcctgaccgaagcgcagcaaactgcggctgcgcgcgtaatttggactggctgtttgttattgatgacgatgaagcccctacccggcaccgcacctgggttttctcgatgcatgcaccaatgttttctgatcaccacgcctggctttcgcatgcaggctataagcacgcgtcgcgttcaacaacgcatcagcagagagtgtcctaaaaggagccagtctcataggtcgactgagag

SEQ ID NO: 1914 - DNA, 189 bp, Zea mays
ctgcaaaagttcaggataacacagatgcatcgtcatgttcactttcaacagacaagtctaatgctgcagcattggagtggcagaggatacagcaaaagatgaagatgacactaccacgttgcaaagggcatagtgaaccatgcattccgaggtctgtgaagaagggccctaatataggccgtttgttct

SEQ ID NO: 1915 - DNA, 1500 bp, Zea mays
gtgattggccgtacagcatcgcggaacagcgaagcgcgggcccgcgattggtgggcgcggccggccgtacttttgcctcccggaaaagcccccagccacggccgcggccgaaacgttgtcgagaaggcgttaaactgttggcgggtccctgcctggtgcggcagcaggctgcttatcgccgagtggtggggaagtggcgtagtgccggggcccacgtaatttaaagccgtctgcgttgaggtggccatccatgcgcgcccatcatgcacccgcgccctgattgagaagggggggctacagaacaagacaccaaccggacgataaacaagtttgctttcgttagcagacaacaatgtctttagcaggttctttccagctcttgcatctataacagctcctcccgcctgggctcctccagtccacccatagccataggtaggatatgcttatccgaggaaatcacaaagctgcgcaacctatctagatatgtttggtcgtttggaagattgaattggggaagtaggaaattccatagcagctgttcagcaaaggtatatactttggtgatatagttggtatgttgtagacaatgagacggagagaacgaaatttagaagaagttgcttgagacggcgataatatagagagttgtaatcttttagaatgcactataaaagatgagaagtgtttgtttagaagatgaaatttaggagacatcgtttagagatggacgagctttttgatgggacgtgaatggattttttcacgcagcacaatgatgtttgcttttttgaattggacggcaccattatatttatttgggaggtccaattattttgccttatccgaacttatgggctgcataatttggtgggtggtagctagtggtttgccaacgcatcagagaaacactgcttttttgcttttttttgtgcacttgtgcctcaacaaattcctcggttttggagcaaactgtgctcgacaccctctctattagtggaagcagccacataatcaaatcaactgctgattgcgacagcaggcgtttggcaatcgagtccctcgtttgttgatttgtttatcgcgtgttttgtctatatagattgcactgcagccgtctgaacagctagttttaatccgacgtctacttgaacttttccattagatcgtacattttattataaaagaaatcatatatagcccagatggctagcatacacgtttgcgcgtaagatttccgtttacacctcggtctgattagtgctaaccggacctgtttggagccatgccaaatactagtagtaggatcgagagacaaaccacgacgtacgagggcatttgaggaaatgagagaaaaaaacactgttcgctcgcggtcccggtcaggcgcggatccgaatattccgcctggccgtagctcccactcatgtctttaaataggccacccggcccctcctccgaacgaggtaacccaaaagaccagagagaaattactgaagc

SEQ ID NO: 1916 - DNA, 768 bp, Zea mays
tcgaactaataatagaaatagcgaatcaactcacatattacaatttgactcgatcatcacacgaacgatgacgaccttcgattgaagtcttcaaccgagcacttgatgagcgatgcacacgggccttgcttttcactaattgacatccttagacttctcccgaactatacccggctcaaatttgcaagaacgtcgatgatttttagttcggggttttcgtcgaacatctcatgagtgacatacggaacatcactgtcttccctatcaatagtcccatcttcaagctcatctctacacacatactgaccactactcaagcaacatcgtttcccttaacagaactacgacgtggagagcaagatggctagtgaacaggaacgaagctggcgatgtagaatggcgaggaaatggaagcgccatgggggatggaatccgacgattcgacggcggtcgcgatggcaagtagggtcccaaactcgacgccgacatcgaggagtgctagcgctgaggtcgggcgagatccgagcagggaccagggacgcgcgcgcacgggagctggaggccgagcgcacggctgcagagagactcgaccggctggaaggagtagagggcgcggcgaccatgggaaggtgctgaaggaaacacgctagagctagagtagaggaaggagcacaggcgagctgggaagaccgacgagctcgcgcgcgcagcagggacagagcagaggccgagctgggcgagcacacggctgggtcaggatcggcagcc

SEQ ID NO: 1917 - DNA, 785 bp, Zea mays
ggtacatacaaattcttggatgtaggcaatgtattattaatattaaccactattaactagatgttttatcaggctccaaaagtatcagaaaatattggatctgaggatgaatcttctgaagacaagagtgataaagacagtgaagagcctcaggcatgccatcatttaacacctcaggcatgccatcatttttgtttcacaactcaaaagtaaaggaaaacagtaaaagtatgcaggcagtatgagggacacacatagtttactgaaactcccttacacagacacatacacaccgtgttcactgaaacattcagatttcactaaactgcaacttctccaaacaaacactatctgcggctcggtcaagtaacgagcctcggctcggctcgcatcctctagcgagtctctaaaaagtcggctcggttcggcgagccaacgagcctgaccataagcatgaaatcagtctccaaaatataatataaagtctcaaaaataatttaagtgacacgtcttaaattagtaaaataaatatatatcatataatatagaaaataagttaattttgtacagtaatctaaaaaatataaattaatcatctatttagtacctataatatatgttaattaaaatttatataacaaaaatgttgttgtttgagccagctcgcgagctgaactggctcgctctggctcgctcttttattgagccagaaaaaactctgctcgagcttgttctaagcacagtttctggatcggaggagcatccccgcctaggtctctgcagcc

SEQ ID NO: 1918 - DNA, 453 bp, Zea mays
ggtacatacaaattcttggatgtaggcaatgtattattaatattaaccactattaactagatgttttatcaggctccaaaagtatcagaaaatattggatctgaggatgaatcttctgaagacaagagtgataaagacagtgaagagcctcaggcatgccatcatttaacacctcaggcatgccatcatttttgtttcacaactcaaaagtaaaggaaaacagtaaaagtatgcaggcagtatgagggacacacatagtttactgaaactcccttacacagacacatacacaccgtgttcactgaaacattcagatttcactaaactgcaacttctccaaacaaacactatctgcggctcggtcaagtaacgagcctcggctcggctcgcatcctctagcgagtctctaaaaagtcggctcggttcggcgagccaacgagcctgaccataagc

SEQ ID NO: 1919 - DNA, 1500 bp, Zea mays
aggaaggatgagagaagaaattaggcgcggcccttggctttcgttttgccatgacaggagcacgctctttgattcttgagtagcaagcacatggaaagaagagtgaatcccttgggagtagggagtgaccaccaccatccagattccggggcggcgctctctctcacactcagtcaggactcaaaaggcacgcggaacaacaagagtcctccaaaatccgtgtggcgactgtgtgagtgtgactggcagccgtagctgcattccattccattgcattccattccaagtagcttagcctcctcctggaaacagtataacagagttgtttatacattgagctataacaaagttgcttttttacgttgagctgctaagaacagagcagcgctagtacaagtagaaggaaagcatctcgagttctccaatccaactcacacactctgctcgccgtacagggatagcgatgcaagatccagcaggctggccggagagggagagaccagtctctcctcgagcccaagtacgaaagcgtatcaaaagaagaaaggaacaaggtgggggaaaaaaactaggggggccgtatcatatatctggtgccgaaaaacgcccttggaacggagaaaagcaaggtcgcggtgaagtgtgagcagcctctcctctagtggttctgctgggacgacaccaccagcactgcagtaccactactagttagtaagtacgctgctgcacacaacaatattcttttttctctccataatactacaaatactgcagtatcaatgtggctgtccctcctcttttccgctgatggagttgagatgttctgcactacttttccaccccgaatccggatggcacccgtaccgtagtgcttgtatgccttctttccctttcttctacttgtacctacatgctactacaggtgtactacgtattttgctccccccacttggttttgcaagcaagaccagcgtaaaagcagaggagactgtcagattcctctttcgctttattctcccgcccagcctcacacacacgtagttagtgttgggctactcacacatgacacaacttcgcctccctccaaatacccagagttttgaagcagggaggaaggaagacagagcagaagcagagcgctctccgtctccggtccagtatctccgctcgccctcctccctcctcctcctccttcgcttcaggttcaggagccagttagaacattggtgttagcgcgcgctctttcctccaagcagaatcaagattttgttcccatcctcaagtacttactcctcctctcccccactctccagccgtcctctctccttctccatcaaatcacaggctttgtttatagggaaaaaaaaacaaacaaacaaacagttgtctctgcgcccgcccgcccgccttggcttcttctacctacatcagctgtccatttcgcagcacgcagcagcagtctctacgctacggctgcatgagtgttagctagcagcaagg

SEQ ID NO: 1920 - DNA, 319 bp, Zea mays
gttgtcattccattccattctgtgctaacaatatactcttatcggttccagaaattgttgaccactataatattcaagtgtcagtgatttctcatccttcatcataagtgcatctatcattaaattttgttaaagacgtcagtggttaagatgcatatttgaaactatactgatgtatgaaatagaactatagcattggtctataaaataaaattcgaagtatcacctgcactttactttgttcagcaaaagttttggattatttatattcatattatacatgattgttctcacaagatgacgcttttggttcctccag

SEQ ID NO: 1921 - DNA, 1228 bp, Zea mays
gaaggttgtttcaattgtaacatcattttggattttacttgaaactactttttaccttatgcaccccactaaatttagaggatagaggagaggagaaagaaactcgatatatagaggattcaacagcgtcctctaaatatagatggatgtttagaggatgctgctgaacacatagaggacgagaatcttctccaaaaattaggatgcaggatcctttagagaacctgttggaactaacggtataaaggagtctttcataaggcgatactattgagctgatcatgaagagtgggttcaccatacattgaaatactattccacaaattaaagtactgtgcaccaaagcgccacatcgcacgttgtgatattcttatactagctagacacgaatttaggaattaggattaaatgaggtattttaatttccagtgatcaatatggaactgatggcgcgcgacaaggacacaagtaccactaccatatgtgtatatgtgtgtgtgtgagtgtgaataccctgtacctaccttgttcacaataataagcatcagatatttgttttgttgcattgttcattgctgctttgtttcggcagaagcagaaccttcaattcggcttcagacttaaacccgatcgacggatgacccaagagaatctgaataacatttgtgtggcggcatacccagccagcatcgatcgatggcacatcttgtcacgtgattcttaacatgcatgttccacattgctgtcctccctactcgtcgcgacgatgctgacgacatgcactacttagccaaagcgaagcaggtccgcgcgcggccagctaagagctaataactcccacaagcgccagagatgcactgcatttttccgggccgggccgggaaaagctgaagtagtagtaggatcgagcagcttctgctttcgccggaagtggaatattaaacaaggggaacaattagctaagccagcactgcgacagacacacaacagccgggtgccggtgactcggatccatcaatggctgcacttgctggcatcgtctcgggatgtacatgtacgtacgtacagcggcgcgcggctatataaatggttgggtgacctcggctgcctcctcactgccatagctagctagctgaggacctcggtcgaggtagtagtatagttagtagccattagcagctggaacttgttggaggagatctagagcttagctttgagagagataaaa

SEQ ID NO: 1922 - DNA, 559 bp, Zea mays
ggtgcgtatggagcagccacgggcacgagagcccacggcacgcacggcggcgtgaccgggatccaggacggcgccgccggcctcaccggtggtggtctgcatggcgcaacaggcatggggacgactaccggtactggcgcgcacggtgccaccggaatgctccacacgggggtcttgggcggcggagggcacgcggccaccggcatgcccgccggccacggcacgcgtcccggcgccacaggcgtagctggaaccggcggcgcgttcccccatgcagaccccccctctgtgggggttgattgaagaagttaactgtacacttaggagaacttgtgtcctactgaaagtttcttggtttcgaggcaagtatgtcagattcaaatgtgaatgtcttactaagagtagggctttggtggcatagatggatgaactgattgtcaacttcaacaagttgttgattacaggtgctcttattggttattggatcgctgtgtgtaatttgtttctttccctttgagagcctttctagtttcttgggcaggctcttgagctaccaagc

SEQ ID NO: 1923 - DNA, 383 bp, Zea mays
ggtgcgctgaaggtgtttggggggtatgattgttgttgcacctgaataactgaggtgggtgtggcgcgaacttgggggtgtcttctctttggcgatcagtgcaatcgaatggtcagttgagttagatagtttttacatcggcgttgatggacttgcataattatgtgcgaatcatgggatcattaacttggtataaggggacgatcagtgatatgtgaagctgtcatgtttaggtgcttgattcagcaaagtggttaggcatccgacgctacgttttggggattgagatgcaaaataaagttcagcacttaactatggatcaagggttgtagagcgcaacccagctcttctgaatccaaactgtaggttgatacgtcggtgcc

SEQ ID NO: 1924 - DNA, 920 bp, Zea mays
agcaagagccaggttccctagatacgagccaagcccacccaaccagacaaccaaacagaccctatatgctgctcacgagccaggtcaatttacacattgttggaatgtgtgtagatgtggtgtatataaaaccaactgggtggagtatgtgatgtgatacataataatttgtctaattcatgtaaaagccctttgtgcggaaatgtgagggcatttaaaggacctattgaaaacagtacatggacggcaaaagaagccaccttttttatatcatgtatatgtcgtccacaaacattctcttcatgtatcatgtatatttgaccttggtcaggggttcatggatgtactttgtttcttggtgtggcttttattagggataaaaagtccactacacaagtcataattgtgatagcttaaattcattactcaggtatttattgtggttgaaaacagtatcaggtgttggttggatatatttttatttaaaaaggatgaagcttgaaaaacatttaatataaccaacacagagagacgatttttcaaatagtaggttgagggatgcagttaatccggctttagaacgtgagaaaaaacaccatacttcattgacaattcaacaggcaaaaacactaatacagtcatacagataataattgacattaaacgttcgtacctgtgtaaccaaacatcctatattttttgcgtctatgaaagcgcacgtcagtccagtccacgttccttctcgccaacgtcaccccacgcaggcacggccgaggaaaaccgaaacccgtcccaaatccgttgctctttcccccttgcccccttcccagtctccactctgagcactctcctccgctctgctcctttgctccccacggcaaaccgtaaaccctagcctgaggggcacccctgtcgcagcc

SEQ ID NO: 1925 - DNA, 546 bp, Zea mays
agtatgtattctgtgaacaatttttgtttgtggcagtaccttaagtatgtattctgtgaacaaagcttatgttgtgtgaacaatctctgtttgtggcagtgaacaatttctgtttgtaccttaagtatgaaaatgcagagcttgtgttgtcagctcagttaagtctctgtttaactgccatttctgtccaaaaagctcttgtgatgccattctttttttgtgatgtacagattttagcagatctgttcagatggacaggaggcatccttacactttctgataattttctataggtttctcgattactatagtcaatttgattgggatgctaagggaatcagcttgtttggtcctgtttccttatcttcactacctgatctarttagtaagtcaatgaactctgaacgacccggtatgttggcttgttgcaacttaaatttgttgataattgacatgggtttttattcaacagctgaccctccagctattcatgatgattgacatgggtttttcttctgcaggaaaagtttctcagagaatgtgcag

SEQ ID NO: 1926 - DNA, 1500 bp, Zea mays
agttacctccggccgcaacgtggcggcccgtccgtagggcggagctggacagctggccgtcagcgcgggggggagtcgtgcagggcagccgtccgatgcgtccgacggaaccggatccgccctgcccgaaaggggtaacgctacgcccagcgacttctctttttggggcgcaagagtgcagtgcagactgcagagcctgagccgtactggtggcgtgggggcagagctggtggtgctagtggcgcgtcacgtgagaggtgggctcccaactgactgcgctttgcccggcccccatcgagtcttgtcttctcttcttaaattaacgagcgactttgcattgcagcaacttcaagctcaagacctcccccgaatgatggcctagcgtctcgccgtgacgggcgggcgggcggtcagccactcggtcacaccacggcgccggcgcgcggcggaggaccgccgccccgtcacgtcggcgctgtacttgccggtgtgggggtgccactgccgcggggactcgtccgtccgtcggtcccgggcaaacgacggcattcagtcacggatcacacctcgcatcgcggtgtggctcgtgtcggcactgttatgggtcggcatgcgtcgtggcgatcggagcccaacccgctgctggctgctggctgctgcctgttgcgggccaaccaaccgtcccagagaggtgacggccgacgagacttgttggagcgggacgcctgtctgcccaccagtgagcgcccacgccgcatccgcatggacgggacgggaacgggagaacaaaaaatctccggtcatgcccattgcttgcccagccagttattacagcgaaatgttcccgttatccgcagcgtgcggattcaaaagcggattcgggcacgaaaggtgtcgcgggaggtgcgcgcatacggcggcttgtgtgcggtgatagtcctcagcattgggggcactgctggtctggtcactgcacactgatcctgctttgtcgtggcacgcgtaaagctggcaaacgttacaactgcagtctcatcgtgaaccggcggcaattgttaacaagcacagggcagcatttggccgcagggctagtggtgtagagagaataatactagtagtactgtatagggaggttgcctgcgagacgcgcgccacgccaaaaatctactactactgtagaggaggttgagtaccattgcccaccacctacccctctgtcaaaaatattaaccacggattaccaccccactccctcaaccgcgagacggccacgtggccgtctgccactggctggctgggtagaccgggcccgcgcgtcagcaaatttaccatgcccggctatataaacgcgctgccctttaccgggctataccgcacgcacctgtccctgtcgcctccttacgtttcatcgcctcgcgaacccacccacccaaacagccaagtacagtgcgctgtctgcaataagcatccgcccttggatgcgcctcgccgcagccggcc

SEQ ID NO: 1927 - DNA, 1500 bp, Zea mays
tatttttatttctcattttgttaggagatacttagatgctttgaaccttgacatcaaagttcatgctattctgaggaagtgtggcagtaaccacacattgtcctctggatttttcaatttgtgccaaatatgatgggtttagatgttaagttgtttcttctcctctctactcttctaatttgatttttagagggattttgagaacatgagttcttgggatcatttgggtttgatagaaacgtgctcggaccttcttggatcacttccaccaagtggtatctgcttattcacctggacgatgaatttccaaccccttaggcaattttcaaataaccctaatttgaattcagattttcatatatgacttgaagtttaaatcttttgcgttcaaattttgtgtacgcttttaaaactcttttgtgaagatgtgtgccaaatttcagttcaattgaagtccatttggattgattttgcattttagaacttcaattcaagatactgaaaatagtctgagtaagcggcacagtttttggtcattttgaacttttcggtctcaattttgtgatctgtttgtttcattggtctcatgtgtgtcctagaaacattggcaaaacataaaatcgctagttggttgatatgtttttggtttaagtaattccttcatctctaatgaaaagttaagcgttcagtttctcgagtttggaatatttctcttggaaagacatttgtagccaacttgagtgctttgttgtgttacctggttatcaccaagaactattagccaccagtgggtgcttaaacatctctagtgtgtcatttggagttttagaggttatatatggtgtaatattggaaagcaagcgaagagtacttcagcatataaaattttattagctctcattcacgctctctgttcgtttttttttccgattcttcaatcagttttggcgtctcatagttacatcttgttcttattcaaaggtgtagctgttgctacagcctaatcctcagctcactcagctcttatatcgtctacgaagactagatgaccatgatctctcaccggccggcatctagctctctcctttatccgtctcccattctctctcttctgacttgtcgaatgggaatcagagaactagaaaaagcaggagtcccaaaccttatcaacatgcatggacgaccatctcggtatcatgtcgctgccgtccatatattccatattctacactaaaccgatcagtggactgtggtggtatcgcaagaaataggcttggtcatcagatctctgcaaaatccctccactgctggcatttccacgrctatataaaccagtctcctcccatcaccaattctaagcaagcaagcaagcacaacaagtagtcaaagcatctagctcgttacaagtggctcttgtcgcctacaattttgccttcttccaagtcttgtttgaagttgctctctgcgaagagccggtagagaagttaatatcgtctagca

SEQ ID NO: 1928 - DNA, 253 bp, Zea mays
ggtgtgtgtgtgtgtgtgaggcatttgctggcctgttctcagctcctctactgttcatcttctcttgcttcttttttcttttctttttgctgccattttcaatcaaggcaggcgggaggcagctttgcttgtgtgctcgcagcatatgttccctctcctgcagtcctgccatgtttgttcttgtcccttgaaatgaaatcccctctgtttctgttgttttccgtgacgttttccttcctcgttgcagacattg

SEQ ID NO: 1929 - DNA, 1500 bp, Zea mays
ccgaatcgaaattgtgagtctattcgggtttgattcctaaaaatattttgaaaattttggttctcatttttcagaacccgaaatttcacaaacccgaatagaccgaaccgaattaccctaatagaccgaatgtccagccgtacatgtcatgacatatgactacactagatacacagacgtggccaagaggggaagtttctggcttggggttgaccgacgaggacgtcagtcttctaaggggtgggtggtgatatcctagccccaatggatggtgatattatgatccaaggtgtaataaaattaatagagtactcatatacacaaggtgcatcttttttcggaagcctatctcgaaagaaactctaggttaagcgtgcttagcttggagcaatttgaggattggtgaccggccaatttttttttcggatacgcatgagtgagaacaaagtgcacacaaaaaactcgtgttgatatgtgtggatggtctacgattctagagggctgtcaggagtaagtaccgccagtacaggagtgaacgggatgttacaacaattttatatccaaacaacatttttttaaaactatgttatttttggagctgccaaaactatggtattattgtagtataatattgtaaaatcatggttccgagaaacgtcgttgccaaactgactcgtaaggtgccaaatttatttgagcccagttcattcgaagcattagttattgttgcatgcatatttcttagaacaagaattaaattttctgagatccaatgtttaactttataaagaattgaaaggacatcttgctttattcagttaaaaaagcagctttgcttaaactgctgttagattaaccaagtctgccggtctacctatacgctgcgagcctgccttgttttccattactctcagcctgctctctctctctctctcatggcgacgactgggtggccgtcgctaccaacggcacacccatgtattcttgggaccctgcgccggcgacgagcaccgcaaggtacgcccgccgcttggtcttcccttcatattgtacgaaactgtgcatccaaaccttaatttactattcgtattcggatctgatctaggagtaattaagcgtatatgcatgtattatgcctactaactttgattgttttacaaaacttatcggttgttctttactgggttcgccacttctgagcctcatagatgagggaagttcttatttttagtagaagacgttccttgtcacggcttctttggctgtagcaaggagttactgctgcaattttaagctagaattacatgttgtttggtggtcgccagctcacttcattgattttatcctgttttagctcatttcattgattttatcttgttttagctcagttcattgattttatcctgttttagagcttgtgagggggcagggaagatgacatttcttgcttgaggatgggaaacttgcaacagctctattattaggattggatcctgagag

SEQ ID NO: 1930 - DNA, 1500 bp, Zea mays
gatgtctaagatagtatgggagatctactgttgatatatttatgtttaagttacttgtagggttaatcttctatttgaatggtctactcagagctattaggcctgtttgtttcacttatttctaacgagcttctatgagaatctgattgtgggaagaatctggttatcgtgaggattatgtgggaagaaagatgaagtagtccatatggtttaggacatagaaagtgatgggttcctactatcacgattgttcggctgattctatattcatgttcattttgaacagttttaacaaaaaaacgattctcacaaaaatgacatgaaaagccagtttgacagtccacaactagcttctgatagccaaaagctgaaacaaacatgaccattgttttgagcatatgcttgttttgggataaatatgaagaacaagcccgacagcgagagcgaatttaggtcatgtttgaaacctctggctagtcattaaccatctaataaaataattgtctggtgcgggttaggttacaattagctacgaattttatttgtggttattttgaaacatccacaaacaaattttagcagctaactattagatctagaggttataaagggccttagtaaaatgttgattaagaccatgcttagaacctttgaagctaatagttaaccactaaaattagttatagagataaaaaacactccaattaattgttagctaacttatcattaataattagttttttagttagctcagcgtaactaacaatttattagctgactatctataactctaggcttctaaacatgacctaattaccagaacacaataaagcttttttattacaatggacaggggtatcgaagaaaatagtactattaataaataccgttaaagaattcaagttcattaattattccatttgaatcacgagagatcttctacccggaccaaacagccaacaggtggggaaaagaggaagaaaagggcagcggcactgcggcagaacagtgaatgaattaactagacacatttgaactgagaatcgatgttggcaggggacacggccgacgactgcaccagcaccgcctgccttgctcgttctccttttccttcctagttccttttcttcgtcctcaccaaccaccaccaccacacccccctgttgtttcctcttgattgttcggtttgttttacaagttccttgcttgcgtcgccagcaagcaatcctctttcctcccccttccatacccgagggggagtaccgctaccgcgccacgctgccgccaccgtcatccgggcggccaccccgccaaacgccatttcgctccgcccgcttcgcatctccctcgccccccaccccaaccactcccctcgttccgcccgcgtcacccgactcaatccgattctatccgcccgcaccgcaacccgccggcgccgcccgagatcccgcccccagggttccgtcccgtgtgatgcgcggatctggctgagggcgagcc

SEQ ID NO: 1931 - DNA, 52 bp, Zea mays
gttgtagcaaaaaccatgcattgtgaaataggccctttgcagggaagcgtca

SEQ ID NO: 1932 - DNA, 269 bp, Zea mays
tgcgaccttaattggttttctcttcccctttttaagctttgatacacacaccgcgccatacccagtcgaaatggacacactccacctcttgctgtgaagatctgttccatttccagtgtagtccctgtcccacatgtgagaggaaccgatctagcaagcgaatgaggaagatgatgaagaaacagtagcagtggcagtaccgctagaactagaactagctagatctcctctcttactagctagaagcttgtacaaacaatgcaccacag

SEQ ID NO: 1933 - DNA, 223 bp, Zea mays
ggtacttctactcttgatttatagagagagggatcgcttctcccttgtccttttgttatgtttttcctgtctgcttgtaagatatgtctaaaaatagccccaaaagaaacagaaacagaaacagaaactttattctattctgatcacattgcattgcaggctgataagatataccgagagatcgaaggtcacaagcggaaaattgctcgcgcggaagtcatat

SEQ ID NO: 1934 - DNA, 57 bp, Zea mays
ggtacttctactcttgatttatagagagagggatcgcttctcccttgtccttttgtt

SEQ ID NO: 1935 - DNA, 1485 bp, Zea mays
tttgtgggaggtactgcagggagctggttatgctacgcctccccaatacgcggtgcagttgttcgaggagcaccaggtaccccactgtagggtaaagatgaccttggagcctcatcccttgtagccaggctggcgttctttggactcggagtctttcggtttcagggccgaggatactattgagtccactgctctgcatgtgctgacgaccttctgcggctttcaccccttagagctatcaacccacccattggcttattccctgctgaaaaggaggatgacccgatgtggaaggatcgggttgagcacgccaaggaacaggctctatacctgggacataccgctcacctgatggttcggtgcatgaatgccctatattgtctgcaggcactgcgaggtaggcaatatcccagctgatggcactcgtggagtctaccaagatcaccctagataacagagaggaccttgttgtcgacttgtccactgagctggtggaaaaggatctccaggtggagtagatggccacccaaatccaagagctcgaggatcaggtggaggcaagggagaacaccatcgatgttctggaagatcagctccagaccacccagcaacagcttgaggaagccaactagcacttggatctgcaccatcaagaaattcaggacatggaggcagaaggggccgatgaggatgtagacatcgagggaggagaggagctggagcctgcatccagtttggacactgctggctcaggaagaccaccttcccccgagtctagcgttgcctcatttgttcattagatcacagagaaagggtagaagtgtgcagcagtagaactcctcaaaactagcttagcttttgcaccttggaggtactaggctagagagagttgagtattttgggcactgctataactgttggaaactcttttggcaagatgaatgatagatggtttctattttaagtttatgaatgaaattatatcatgttggtaccagttgtgaaaagcgaggcaatatttgcaatcctgcaaacttcgttgtttaagttcttttatcatatgcaatcataaattgtaagtataacaacagaacctcctaaatttcagatggcaggaagagcgcgccgtggacagaatgagcgcattcctccaccaccgcgcaacctcctaccatgcaggagttgatggctcagcagaatgaaattctgtggcagctcgctcagcgtcagccaccgcctcagcactatgggggtggtgatcatcaccagcgtgccccggcagcggccacctaccaggagtttcttagtactcagctgtcgttgctcaccagggtgraagatccacttgatgctgatgtttggctcagggtggtggaattcaaattcccactgcttaatgaagattattcagatgcggccaaggtccgtttcaccgcccagtagcttcgtgggcccgctaggacttggtgggaccatttcctctct

SEQ ID NO: 1936 - DNA, 85 bp, Zea mays
tccccttctccctcccgcatgcggggaaaccccatccgccttccgcttctttccggtctccgctgctcgcttcacccgtctcgcc

SEQ ID NO: 1937 - DNA, 558 bp, Zea mays
atttgccggtcatcacctcgggtctgtcgcccatggtggaaacatgcacgaaaacacggtggtagtagtagtagaatgctttctcttgtacatcgatttgtttttgtgaatattgcaaaatcggtttgtagaatccaatgtcatgttgaggcggccgttgatgcgccagagccctgctttggagctccgacgagaccctattgtacttgtacccatgatgaccttcttcccccttggccgtgactcaggcggcgcaagcggagcgaacgccatggccagactgtgaggcctgcagatgaaacgaacgaacggccgagataagctgcgcatgcacacaaacatgcggtcggtcatgctcttcccaacaaggcagcatgcacagttatcaccagactaccagagctccactagcgtctagcggtccccgatccggcgtttgcgtcggcacgcttggcggtggcgcgcaaaagcagtgcggttgggccacgccacgctcactggcaggggcgaggggacacgtaccgtaccgtacgtactgctggatcgggaggaagcgct

SEQ ID NO: 1938 - DNA, 64 bp, Zea mays
gatgttgcttccttctctcttcgggacttttattcattttttaacttaataacttcatctgaac

SEQ ID NO: 1939 - DNA, 793 bp, Zea mays
ttggtggtggtgttgtgtcgcttcgatgggtccagggctgggaagacactcgtagtctctcgcccttctcggactgacgtctggtgtgagtgcctcttggtttggagctgctccggatgagcttctttctccgcgtgcatgctttctcctatatatctaatggtatactacatatgtcgcctccatatgcataggtcttcgtcgtgtccttctccggcaacgaacaggtatgtccgcctcttcccttcccctgatgctctacgaaaccttggaagtaggggaggcgagggatggaggtctctaatttgctgcctatgatacccgtgtgttcataaaaaatattatgcgaagagtggagacaaccaataaaaaattttaagatctttttggtggataatttatgtgggtattgttgtgagccatcgcaacacacgagtaaccgactaatacaataaacagaagtacaaaaatgagtccctcgcggcctcgtcccttaagctaaggccctgttccaatctcgcgagataaactttagcagcttttttttagctacttttagccatttataatctaaacaagagagctaatggtggtaattgaaactaaactttagcacttcaattcatatagctaaagtttagcaggaagctaaagtttatctcgtgagattgaaacggggcctaactttggcgagtgggcgagccgacctaaaatcctccgcctccttcctcgccgtttcgggcctcgcctcgtccccaaatccaacccttcgtactcagtttccatcattggc

SEQ ID NO: 1940 - DNA, 214 bp, Zea mays
ggttatttcatgtgttctcccatacttaattcatctgtttttttagttcttgttactggaaaaaaatgagaacttaacatttgggagcttagggtacttgattttgcccatataattcttggctaatgtactgcatgctctcatgtgaatttcaggtgaggaaagttaccttcatgatgaacctttgtcaccaagcagggctcttcgtgcagca

SEQ ID NO: 1941 - DNA, 844 bp, Zea mays
cctttatcttattatattgccttgtttctagatacctgggaggtcttaataacaagtccataacctatagtcatgtggacttaagggataagctcttcctaacatacactttccatctggtctattacttatccctatcatacacgtctcgggcttgctaaaagcaaggctatcgggatagtggcaccacaagccgcttagtgatctactctcttatcttttttatttgacgtttgctagtgtaaaattgaactatcatgtatcaaataaaaaaatgaaggtagtacaaatctacttgtggacggcacaaaactacgacagtagtcttttagaattgcatgtatgcaaggctatttttgtgttttaattaaagatgaattttatggttgtggcggagattacttttgtgtttaattaattaaagatgagttttactgttgcgtgatatgttcttatgctggttaaaacgttaaataattatttagaacatagagaggggtggatacatgcacgaattggtgcatacatactgatcaagaaacgtattcttgtcgagatttcctgttgtcggctccccaagatcccaagcttgtccgtatcgtaggctctgtgttgccgcccttggaaacatttcctactatcctcagggttcccgttcaagtgctagcttctgcatctcccaacaaaatcgccggccttgtacgcttaaccaattcagacacgaacggtgatcgaaaagaacagccgtctctaacaatgagctagtgaatacacgcatcttgatcttgtataaaaaggacgccatggatgcacacgcaaactacattagagcaagacggcagca

SEQ ID NO: 1942 - DNA, 1500 bp, Zea mays
gttttaagaatatattctagaatagtggtaaaaacatgcactgaagatcgtgcaaaatcaaatgtgtcaagttgtgaccagatggagtgtacatgtttaacataaataacttaattgttgtaactgatttgtggccccgtcgtgcttcctctgtaactatgagttgctcctaccaggaggaattgacgatgctccatgcctgaaccttgcaacttgttgtatctataatgtttgtctctagcagtgtactctatacctattctatgtgttcgttctttatgatcttctctaaaagattcactctatatctttggtagtagtatcrttctatatatctaaatacttaatattagagacatgttttacttttatttattgtacgtatgtatttgtcatacgctcaaatattttgtatatatatatttttgataaattcgttgtttaaattattaaaatggatagggaagagagagagaatatctatgtatggagaatgaaagaatgccctctaaggacgctgattcctgaaagaatctattcttaaaattctacagatttatcaaatctatgtatggtatttgatgagagaatacctgtgtatgtgtgtgctaggttcagacgtagattctgaaaatttgacacactatgagaggaatgacttaaatgttgtttggacgttataatgacttaatattttctgaaatgactaaatcaataacataagaaatgtttgagaaaatcttaaaaagtgactgaaaacaataaataacttaatgttttctgaataaatgacttaatatttactagaatgacttagcgttgattggaatgacttaatgtggctagaaaacaagccatgtggaggcggagccatgcgggggcgcgagttgtgcgggtagaaccgtagaagccacgcggggcatgcgtggtcggcgtgggcgagcgcgtgccgggatggttcgggtggtccatcgccctaggtaatgaatagagtatataataacttgggttaaggctagataactctgtacaactttctcaattctaaattataaggacattttttatatatgtagtttttattgtgtacctaaatatacgctatatttagatacttagtaagaatagtatatttacaaaatattttatggtttagaatgaatgaatgttatattttttaataaaaaagaaaaatccttaaaccacggccgaaaatgagaactgaaataagtttcaagagcaccttccaacaaggaaggcatactcattgcccacacgcttccaacaaggaagccagtagttgccgctccccattccaaacatgaccgttggggcgctgtgccgctgtcgccttcctgagatccccaaaaccccgacgccgcgctctcccacctggcacccgagaatactcgcgctcgcgcactcgacattcctcgcccccacgccggttcaccctgcgcgcacgcgctcagcatctcgcaatcccccgggcggaggcgt

SEQ ID NO: 1943 - DNA, 1500 bp, Zea mays
acgaactcgtcgctctcgggaattcacagagggcgctgcggctataattcaccggactgtccggtgtgcaccagactgtccggtgagccaacggtcagaagcgcgatcaacgggcaacacatggctcgagccaacaatcacttggacgcaccagactgtctggtgtgcaccggacagtgtccagtgcgccaaggggccaagggcgcaacgatcggctttgccagaaaaggaaggagatcgggcaccggacagggacttgaaaggaaaatgtgcccttgggccatttctaagtattttggtgatttagtgtccaacacaagtgcttaagggataaactatgccaaatgatggataaggtgcaaatcaatacaaaggtatgattctagacttagtacattggtttttgtgtactaacatgtttgtctaaagtgttagaatcagagaaaatgcaattgaaaaagagtggctcgaagcaaccaagagtctccacagtctgggtgcaccggactgtccggtggtgcaccggacagtgtccggtgcgccaggctggctctggcgaactggctgctctcgggacttcgacggcggcgtacggctataaatcaccggactgtccggtgagccaacagccggccgggccaacggtcggccgcggaatccgcgtgcgacgcgtggcaagtgccaatggtcggatggggcaccggactgtctggtgtgcaacggacagtgtccggtgcgtcaacggctccaagactgcaacggtcggcttcgccaaataaggaaagagatccgcaccggatagtgtccggtggtgcaccggactgtccggtgcgccaggcgacagaaggcaagaattgccttcctggaatgctctcaacggctcctagctgccttggggctataaaagggacccctaggcgcatggaggaaaaaaccaagcattctctaagcattcctaagcaccaagactttgattccgcgcatttgattctttgtgatagcaactagagctccatttgagttgtgaactcgctgggttgtgttgtgagctcttgttgtgacttgtgtgcgtgctctgatttcgtgtcttgtgtgcgttgttcatccctctcttactccgtgtttctttgtgatcatctttgtaagggcgagagactccaagttgtggagattcctcgcgaacgggataagaaaagaaaagcaaaacaccgtggtattcaagttgatcattgaatcacttgagaggagttgagtgcaactctcgtccgttgggacgccacaacgtggagtaggcaagttttgtacttggccgaaccacgggataaaccactgtgtcatctctgtgttgaactctttgtggttatcatattgtgctaacacttaaccaagttttgtggcttaagttttaagttctacaggatcacctattcacccccctctaggtgctctcaattggtatcagagccgttctcttcacaaagggactaatcgcccaaagag

SEQ ID NO: 1944 - DNA, 968 bp, Zea mays
gacttaatcttaggatcaaaaacaaaactatttttgtaggtatctatacgcttgaatgtttgttcttatgatacttgtttgatttggttctttgattgagtgtgatgagttgtggagtaatgcccacaattgcatctgcatatacacataggcataaaaaacgtgttcgtaaaataactagacaacctagattatttcccattaaaatatatctagtgtcacatatctatcttatctwaatggattctatcttatctttggaaattcatctcataagcatagttatcccaacatatacacaaaacgatagatcaaagctctgcctaagtgttggggtatggttcgtagccgaagatcctaaagaaataaacacyttcggcagatcctctccaaagcagcgccgaagctatcgactataaagcttcggcacagtgatatgtctcaagacgaaggggtgaaccgacttaaagatgaaatgacttaaagacccatgatattctgtgtcattattgtagttcattgtaaagggcataaatgtaattatacacaggctgcgccctgtgcctataaataggtgtactgttcacgctctcctgtaatcacgcattgggcatttgcttttgcttcacgctggtatttttgcttttcttcaagtcgaaggtatatttgtaatttgttatcatttccataataatgaaatagaaatgagttaataataataatgtgtttatattattttttcatactttacaaacccttcttcattatttgttgcgattatgaaggtatgtccttcataaccttcgtctggaatccattatatcccaagggaaataatgtttcggaggacgaargactataacatttaacaatttctgtgttgccttgttcttaatttatagaagttaagaacaagtccccaacattggcgcccacctccggtgaactcacatccacttgctgagctg

SEQ ID NO: 1945 - DNA, 527 bp, Zea mays
gctgcctgttccatcccaagtgcccgtagcattcagcatgacgtacgtacgtagtctgttctggctgacaaggtggaccatagctggtgaactgaactgcaactcatagtcagtccttcttgtgttgggtactgtactctctagctcttagactgttacataaacactctacaacaggtactttaggtgggagggggacttatatatttatcacaggcacagcctttctttctccatgattaagcatgacttgctcttcccttgtctattcaagtcaagcactgtgtcaggccaggatcattcagggacaaagatgcatcaaatggttctcctgtttgcactggcaaccaaaagagcgccagccccagccccagccatggacggcggcggaagcggatacatcccaaatccaagcgacagctaacacacataacggcaggggcaaaaatgtcatatcgcttgcagttgcggcagctggcatcaaaagaaaaaaaactagttccaactagtccctctccccaaccacc

SEQ ID NO: 1946 - DNA, 1491 bp, Zea mays
cttttcgactcaggggtctgtctgtctactaacaaacaagagcacttgcaattaactaaacaaccggaagcgttcatttttagtgcacctggctgcaaacaacaccaatgacactgatgtaaaaatgactagcaactacttactgggctagctgctagctagctggtgctggaccatkgatccttcttggatctgctaagtggcgcgtgcgtctcggtccaattgatgcaaacgcttttcctttttctttgtctttttcttttctttctttcccgagcagagcaacgcggccttgaaatttgaagaaagtgtccggccggcagaaaaatattctagtttcttgaagaatgcacagatcgaccaaccgatgctgtagacaaaattcatgaatattgattaattagttagaattaaacatatatagtagagatcagacgaagaagctaggcacaaattaaagtaataatatatctgtagctgctgttgtgtcgtggtcgttgcattgtactactacaagtaacaaaatagaaagagagcccttggaaatggtgcaaataaagcaaagtagatcgccaaagcagatcccagctagcggctgccataccatctatctatctattctttctatacgcacgaacgcatgctggagactggagtggagtataatactagctagccattgtagtagagtatttgttccttgttggatttattcttcttcttcttcttatttagtactagcaagcaccagaatgatgatgatgcttaaacagctatcagtaataagcaggaaggtgtgggtcgacagcaacattacattaggtaaccctacgctagctagctactagtacgagtcaaataaataaagcaagcatgtggctgcctgtctctgccctgcttggaataataatcgatcatgatgcatcctgtttgttcttgggagtattatcatcaccatcattattatctagcatgcatgcatggttggcttggccacccctggccgggtccatccagctacctagctgcctctagtcttgccatgcctgtgcctgccatatgatcgactcgatcgacacacatgcatcgtcacattcagaagaagatgaaagaaacggaaaccgggcgtgtagacaagacaaatgtttgtgtgtaaaccgagacggtgacgaagcagcagtaaagcaaaagagaaagcgtaaagaaggtggtagcatgcgccagactaaaaaaaaggaaaaggggacagcggctactctctgcgtgtgtccgctctcagctcagctcctgtctgtctctctatagcattagcaatagcatccatggatgatcgatcgatccatccatccatcctagcagactgtcaggcagtgtccctctcgttctcgtccatcttcttcctttcctccattccatgaaggagaagaagacatatatatcatagaatgatagtatgacggaggcttgacagcagcagcagccgcacatcac

SEQ ID NO: 1947 - DNA, 235 bp, Zea mays
gctgcctgttccatcccaagtgcccgtagcattcagcatgacgtacgtacgtagtctgttctggctgacaaggtggaccatagctggtgaactgaactgcaactcatagtcagtccttcttgtgttgggtactgtactctctagctcttagactgttacataaacactctacaacaggtactttaggtgggagggggacttatatatttatcacaggcacagcctttctttctcc

SEQ ID NO: 1948 - DNA, 563 bp, Zea mays
taccctaggcgtttggcaatcgagtccctcgcttgttaatttgtttattattattcatctatttgctctgaaatctaactatttgcttggctataccagcttttactggtgttttatctatatggattgtaactgtaacagccgaaataactgtttttaatccgaagcgaatagatctaatcacttaaacctttccattagatcgtacagtttattataaaagaaatccaatatagcccagatggctcgcatacacgtttgcgcgtaagatttccgtgtacacctcggtcgtttgctctcttgtaaacagtgctctgattagtgctaaccggacctgtttggagccatgccaaatactagtagtaggatcgagagacaaaccacgacgtacgagggcatttgaggaaatgagagaaaaaaaaacactgttcgctcgcggtcccggtcaggcgcggatccgaatattccgcctggccgtagctcccactcatgtctttaaataggccacccggcccctcctccgaacgaggtaacccaaaagaccagagagaaattactgaagc

SEQ ID NO: 1949 - DNA, 729 bp, Zea mays
tttctaaaaaaactactccatctgttccaaactaaaatttgttttagatttttaatggatccatacaatatttgatgtgttttatatatgaatctagattaatctacatccatttaaatatagaaataaaaaattaagaacttaaaacgaatactaatttgggatagagatagtactaaataaccaaataaaatatgttgtgctttgttacctaagccttaacatcaacatagaaaaagagaaaccccgctaaaaaccctaaagaccgaggaaaaacagaaaaaccctaactgaaacaaaaacccatcctgcaactcaaataacccacagaaaaataaaaggagcgctatttttcactttggaccccggaacatccgcagcttctcaaggcagcccctcccacctactatttcttccccttgctcccactattgccctttcttcttccttccttctctcctcctccctgagggctgaggatatccttcaatacatccacctcacgaggaatccgcactcgcgtttgctccgcaatttattgctcagggttcttgctgggtggtggtggcggcgggtggtgcaagcagtactcgttcacaagagcaagctgttcttgtgtgcgtggttctatgcctgcttgcttgccgaggggaggagaaggaggcggagtagtgggagttgaggagtgcaggtaccggcattgctgaggcggcgccgggagatccggcg

SEQ ID NO: 1950 - DNA, 1500 bp, Zea mays
ttttcgaaaacgctttgtctttgtcgcctgagaagggctcgagrcgaggcagatttggcggtcataggacgaggtagccttgggcgaggcggagatagaggacctatggcgtgagaacctcagatgaggcagagacatggttccttgctttcggaggacatggtgggacagagaatcttcctaagcatgctttaagggtataatccgggtacccctaattatcatatctgacataggtgatacataaagtttaccatacggaacacagagttggrtgcagtccggtccggtcagcccgacccaaatcagatttgtcaagattcagtataaatgtataatgcaagaccactgtagagtccaatatgctcggcttgttccccaagcaaaatcgtgccaactcgaatccaaccgtcttgaggccccccaacgcgaaaaagtctagcacagcacgacatacacaggtgtacatctgactcatccgacccaaacctaaaaagcccaacacggttgaattttgggccggtccgacccacagttattacgggccatgccgggttgacccatgggcttagccctcgrtttgtggcccagcacgttactggttaaatgtgccggtcttatttcggacgacctgaaattgtgaaaagcgaaatttaaattctgacccgaaattcgcatagagtcaaaattcacaacaaagcctgaaattcaaaacacatataatttattagatattaacatttcaagctttataataaaaaataaagaacatgaaaccaatgggtggttcacacctcatctccattattaaatatgcgactagctaaattagagttaatgatttttatgattagaaaccgatgaccaaatgaatatgattattttcgtgtctataaataggctatttcgtgcatcgctaaacggttcgtgcgtgtaagctgcaacccgagctcaagcccgatccaatacattatttcaggccagcgatcgtgctttttttccgtcatcggggccagcataccatatccggcccaaatgtacacgtccgccgtggcgccgtagccggtgcagcgggcggaccccggtcctggagaacggcaacatgccatgccaccaccaccaaaggcaccaacggaccaaccagaccagagccagtgctggcgccagctggcgcacgaacgcccagcccactgtgactgccgccgtggcgcgagcaaaaccctaggcgcgagcgcgggcgcgggcgccgctccgtttcctctctctcctcctattaaccactctccacccgctcgcctcgccctctcgttgagagagtcgtcccctccgcgtgctctccgcctgcggcatctgtatcccacaacgaaaaactaccaaaaaaattagaaatccccaaatccgcgagatctatcagtatcgagcgatttaccgatccgattgctagggtttagtttcgaaaaagaaactctgaaaaaaaattctggtcgaggggaggagacg

SEQ ID NO: 1951 - DNA, 904 bp, Zea mays
gagtaaatactcgaacttggcgagctatgtcatttaaacactggacttagaaaactaggtaaatgggttcttgaactttgtcgacccatataaaaatcgtctaaaatcgaatttgctcaaacctgattgtgacctgacatgcgatccagaattttcactagcaagcgtgtagtcgctatagtcatgagtaggaatggtaatgaatcacgatccaaaatatttctcttcataataagttaagacccttaattagttttattttaaaaataaatagaaatatagactaatcatattttgattcgatccttaaattttatattgtaaacatctagatcacattacccccatagtcatgactctcgagtctccatcgatttagtagatatatggagttatggacaccttttcccgagcgtccacctctcccatcccatgtggtgtggcctgtctctggtcctgacgcagcttcttgttccactcgtttcctcgccggctcaagcacgggtggaaatgcgacgaaattgccttttgcatatatacatccccctatgtcttctgcatgcgagcaatgatgtcgtgtgtgtctatccatgcacggaaatttcagaacaaaagtttcagttgggctgggctggtactgcggcaaacataaagccagagagagccggggtgcatcaccgcgtcccccggacgcgctcctccaatcatcgccacagggaaaaagaaggtggcatggcatggctataaacagaaaccagcccgccgtgtcgtgcctactctctccttcccccaaaataaaagaagcgattttgaacggctccgctagctaaagcagggcaaggcggccggaaggcaggaaatccgtacgcacgccgaggtcgaggtcgaggtctcagcagggagg

SEQ ID NO: 1952 - DNA, 1272 bp, Zea mays
atcaacattatatctaattatggattggttcccagtacgtccatggagccgtttgcattttttcctatgccgagccaaatggctagtgtcaatggtagaacaagcagcaagttctttcttgtggaaaatcttacctccacaccattttcagtggtgaaaatcttatctccacaccattttcagtggtgaaaatcatattcatgtcctcccagacatcggatgtgcattttctcttcctacctgtgcttgtcgtagtggaggcagtcacagtagttctagtcccgtagtcgttaggtctagccgcgcataagagatttaggagctcttcttcccttgctcgcccgcttgtaacccctactttgagcattgagcaacatatgtgtcggtagcgcgagccaccgaagaatggatgtagggacattctgcctactcgtataaacctcgggcccactgagcacatcacctggaacctaaaacacgcacaaacaaatttacttgtcggagttaagttcgaaacatcgacaaatatattgtcggaacaaaggtatgttatctttaattgtggtgtcgtgttttagtcccctttagaaaccaaaggtgaccactgaccaacatcagtcatgtattttttaaaagaacccttacaccgtgaatcagcttttaaaacaaccattccatctctcttggtaccttcaacagcacgttggtttacacgttttacaccaagtacttgatttgcatacgatacgttcctaacttttagaagaaaaaaaagttgtacaaaaatatgacagtgagacagcaaacccagccggccctggcctgacgagtacgatgctagctgacatgggtgtgtgacctgccaacacaaagcttgcacgtagccgggctccttctgagccgtccatgcttgcacggaccacatgcaacacgatccctcgttcgtatcgtatccctggcccctgggctctggcctgatratccaacagcagtacagcacagcactccaacgccaaggagagtcgcacgcgccacaygagaggagacgatgacctgtggcccctcgcagcagtggcaaacaaggggtgaataggccgtagcccgtggggattgcagccgatttcgtgtccctgcagccacggccaccgcccaatctccacttctttatcttctccgaggtgagagagcccaggcgatccaattccaccctcgttctcaggcactgtcacacagacacagctgacctgccactgccaggaaagtaggtcgagg

SEQ ID NO: 1953 - DNA, 578 bp, Zea mays
ttgccggagaaggccgagttttttttattttccctgcagagaacagtgagaggctgacagatgagtacagtgatgcgagagcagctgtaggtgccgggtgaagtactactgtcagtgcacaggtgcagtgcaagtgtccaggtgatgcgacatgcaagtcctctcggcgggtagctagctaggcctgcggtgcggtgggaaacggctgacgggcaggcctgcggcctcctcggctactttactcagtggtagcattaaattgcagtgtttaaattttttgtcgtctcctggcttcgcgtatcttcgtcttcactcccactataaattaactcctacgtcgtctgctggcttcgtctctcttcaccatttggcttcgtctctcttcaccgttggtgccaagttcacaagtatcagatctggtaaacacctttccaagttctttctcaagtatatgtacattacacaccatgttctttaaaacacaccatgttctttaaagatgctagtttcttactgcttgatatatattagtcgaatagtcctctctgtttttatttaccttgcgttctaggtgataa

SEQ ID NO: 1954 - DNA, 55 bp, Zea mays
gctgataaagtttgggaaatgagggacagatagtccagtcaggaactagataaaa

SEQ ID NO: 1955 - DNA, 424 bp, Zea mays
cctttgtttgatgtgaatactttttatgtatgtaaaaattcttaacttttaaaatatactaacaaacataaaataacaattatttttttaatttcagtgtaccttaccataatatattcactccgtagcaatacwagtgcgttcacctagtcgaacaattaatcagctccccgaagcaagtgaggccagcaagcaaggcagccacatgcgagaaagcaagggttaagaagacgtggaagcgaagcagagtcgcccagcggcaggaaccaatagcataggcataggacatggacaaagcaacgcacaaaccaagctcttgccgtctatatataatataatataatatgctcgtagatcgtacacaaaccaagctcttgcaaggagaaaaaaaaaggaggggcaaggaacgcgctggctgagagac

SEQ ID NO: 1956 - DNA, 228 bp, Zea mays
agtccgtccacctctgcctctgcgcggcagcctttctctctgtcgtctctccccgtctcccgtcgctgattccatcatcgtcctccccggcttttccccaccaaaagccggaagccatagcaccttctgccagctagtccccagaaggtgcccacacccctccccacccccatcccacgcagcacagcggcagacaccgcaccgcgagtgacgcggcagcaaaaaacc

SEQ ID NO: 1957 - DNA, 1500 bp, Zea mays
tgtacaggttttgtgtctatgcaaggcttgagaagttggcattgtactgataagtgataagtaaacaagttattgtaatgatttaaactagattgttttgaaaggaaatggaatggataaagcaaattgaactttgtattatgttactaattcatgaaaaatggtactaaacttccgtcaacgttttctatttttctcatttcactcgctctatttacagttacaactacactgcatatgctagcatatttgttcatataatactcttgctgatattttcactgtcacaggagcatctctactactatttgtgtttttatataaatgcattttatcatattgatttcgtccatgcaagaggatctctatcgtgtttcacaagataggagccgccaagcacttgttcggtttgtgtagaacttcacgctctttcctatcccggatacttatatcattattcagatgatggtgtctagcaacaacgatagcctattatcgacttggacgaacagccatagatcttcctcaataacttacgtgccgtcgcaacgcacgtgcacctacctagtaaacatataaataagaaacactaggctcaaccgttcgaataggcatctaacgacttactccagatggccgcccgggttcgtcgacaaaatgcgacggaattctctcttttagtgttctacaaaaaaactgtatattttagataaatatttacacatgagaattactcgtaaattttcgggctccgcctgatctttctacgacatagccatcaagacctaacatgacacggattcaaatacttcaaagctagacatatgaaatgaaagcattaatttccgtaaacatgccactcagcatttgcaaaacataacaacctacacaaacaagaaacacgacatcctatctcaccagtaataaaaatttgtgccagagtaatttacaaaaatagggtcattggtttcggatgccgacaaaattgcctactaaacttggcatgccaagacgagacacgcgtgaacacttttctcccagccgagggcaagcgcccacgcaaaaacggatccggacacacgttaaagcgaagcataaaaactcacacaacacacgtggaacattctagaacatcatacacaagcaacaccggcactcatgacacatcagccaacccaactgtgcacatctcatgagctagggaacccacagttggacaaacaaaacattggacccccccaagccaaggtgacacgtccagctcttatacaggacaaccacacttcacaggaaaaaacaaggcgtgaaagaaagaaccgattttgttctgtttaaatggcatttccggagaggtgttgtgctattcatttgcgtcttgtgaagtgattctagttcagagaaagaaagaagttgagaatgagaagcaagtgaggcgcgtttgctgggaagtggttcttgtgaggtttaggagttcacccttcttttcttccccttctagaa

SEQ ID NO: 1958 - DNA, 622 bp, Zea mays
tgtggtgcacggttctgcctcccactcccacccgtgacaccctccgctccgctcaacaccagccgccatccccgacgccatctgcgcacgtctggccatctctctcgcccccgctctcctcgctgctgtccgcgcccacgccatctgcgcgcgtctccatccgcgcccacgtgtgaacccacatccagccacccgcgagcagagcccccgcccccggatcccacgcatggatgactgcaccggatccactcctccctcggaaggagaatctcggctctcggtcctcgcccacgctatggaagcagatcgtctccgctacgccaaatcgaggaatccgcgtccgctatggaaggcgatcggcatcagcgtccgcgtccgctgcgccaaatcgaggaatccgcgccccaaatcgaggaatccgcctccgctatggaaggagatcgcccggtcggcatcatcgtctgcgtccgctgcgcccaggctctcggtccttcgcccacgcgttgccacgaagagatggcagagcctagggtttggtctgcctcccacagccaccgctatgctttggctgcatcactcgctcctcttcggagcctccctttcgctggcggcgtaggaagag

SEQ ID NO: 1959 - DNA, 63 bp, Zea mays
tgtatgtcatgtctatagctacatttcctgacatggaggataattcttcaaggttcatcttat

SEQ ID NO: 1960 - DNA, 277 bp, Zea mays
acacactgcaggttaactgacagccacgcatatacatatatagacacagcaataagaggctcgacatcgatccaggttgctttggacttggaggctgtgaagtagatgaattttctcccgagttagctagggttgtttggattggaggggatatataattagttcaattcccttcaatccttatggagaaatggtttatccagagacaagctacagcgcagggagcttcaaacagggagaaaatttctcagcttcacatccggatttttaggcaacc

SEQ ID NO: 1961 - DNA, 227 bp, Zea mays
tgcaggcctgcacgccatcctcctccagtcctccaccctgtatggcgccccgccaacgagccccgagctaccaaacgggcccaaagtgaagtctgggcctttagctgttcggcccatcaaaggcaccagcttcagcatcaacgcctccgctgccgtcgctccggactcaccgctaggtttttcctcctgccgccgcctcccagaccgtctcctccgccccagccggg

SEQ ID NO: 1962 - DNA, 576 bp, Zea mays
gatcacattcaatacaagagctctagcattcattccaagacacaatacaaaagatcaaatctcttccaagtcctaaattcattccaaacacttagtggcttgtgtgagagagatttttgtgttcatttgcgctcttgtcgtttggattgcctttcttcttttcctattcttattctcaagtgctttgtaagcaatgcaagagacaccaagtgtgtggtggtccttgcggggtcttagtgacccgtgagattaaggaagaaggctcactcggtctaagtgaccgtttgagagagggaaagagttgaaatagacccggtctttgtgacctcctcaacggggactaggttctttggaaccgaacctcggtaaaacaaatcaccatgttcactcgccttatttcttggttgatttgttttccctctctttccgacttgaatttaactctaacgctaaccccagcttgtagtgtgtgttttaagttataaatttcaggtttcgcctattcaccccccctctaggcgactttcaattggtattagagcctggtgattcattagagtctaacaactcgaagtg

SEQ ID NO: 1963 - DNA, 498 bp, Zea mays
gaaagtcgcctagagggggggtgaataggcgaaacctgaaatttataacttaaaacacacactacaagctggggttagcgttagagttaaattcaagtcggaaagagagggaaaacaaatcaaccaagaaataaggcgagtgaacatggtgatttgttttaccgaggttcggttccaaagaacctagtccccgttgaggaggtcacaaagaccgggtctatttcaactctttccctctctcaaacggtcacttagaccgagtgagccttcttccttaatctcacgggtcactaagaccccgcaaggaccaccacacacttggtgtctcttgcattgcttacaaagcacttgagaataagaataggaaaagaagaaaggcaatccaaacgacaagagcgcaaatgaacacaaaaatctctctcacacaagccactaagtgtttggaatgaatttaggacttggaagagatttgatcttttgtattgtgtcttggaatga

SEQ ID NO: 1964 - DNA, 1500 bp, Zea mays
cctggatggcaagttcacggccatgttgagtgagcatggtgctcgaagtttccggtccgctcctgaaatcggtcgtagcttgtgctaattagcatgaatatcatttttgcatgcattgttttccaagtttcgagtgacctgcagttcaaatcttaattttccgaagaaatccaaataaacgaactaaatctactagctattgaaaacatatttataattgtcccaaaatggtacatgtaggtctacatagtgtaggaacataccccaaaaagtttggtggtcaaaataaaaaaatatgctttgccgagtgtccacaaaaggcactcggcaactctttaccgagtgccagttatttgacactcgacaaagaatatgctttgtcgagtgtctgttttcggatctcggcaaagactaatggccgtcagctgcagacggccgctaacggtcctttgccgagagccgtctttgccgagtgtttgacgctcggcaaagggcgctttgccgagtgcttctctgtgccgagggcgcagcactcggtaaactgtctcgttaccgagcgcaggactttgtcgagggcgacactcggcaaagtagtctttgccgagtgcccgataaaaagcattcggtaaaaattacgacactcggcaaagggccggattccggtagtggatcggataatcgtgtcctcttgtcttcggctcaaggctacagactaaactttctctagtgtatatatatggttgtgtaacaaggaagaatatggatatgattttctatttttttgttcagtagctgatcgacctgtgtatgctaatatattaatgatgtgcttgcagattaaatcatatgccataaaataactagatatttaatgatgtatagtagaccggatcatatttagttagacggaacttggtatcctcggatagacaacggcgttactgagttttaaggtgcagcgtgagatagagatatatatacagatagaggacacgtagcatctctcggaagcaactcagcctgatatgatcaactcctcccatgcagtgacgaaaggacgggctacgtggagagacaatcgagctcgtcatgcatggttgcacaagcttcctcgtcgtgtatagctagctcgcgtcaggttctccgcaacgcaagcagtaagccagcgcggtgccgtccggctcggagcacgtcaagcaagcagacaggcagcccagcttgcattgctagctagctagcgtcggtgcagctagctggtgcatgctaccacaggggcaataataatgccgtcgtgtggtgactgtcgaacggcgactgggtaggtagcagatccaagtctctaagagcttatccgatccattttagcatgggccttttgcattcgtatgtactcacgttcatatatggtgccggccgcccagctataaatagacggcaagctaagggcaatgccgcactgggcacataacaatacatgcatgtacaaagatctgaataata

SEQ ID NO: 1965 - DNA, 118 bp, Zea mays
aggcagtgggctaccactaaaaatgcacaggatacctatgcatcttctgttttttcctggtttattatctatgtataacatgtgactgtgacttgtattgtacattccaggtcttgtg

SEQ ID NO: 1966 - DNA, 91 bp, Zea mays
tcgattcggccgcacagttcgtgaagtcgggcggcgcgttcgtcagcgacggcaatctcgtgcagatcgccgcgccggagccggccgcgcc

SEQ ID NO: 1967 - DNA, 85 bp, Zea mays
ggtgatcttcgtcatcgcagttcttggtatggtgtgtcaatagatttccagtgctagtaacgaatgaatatgtgcagagaggacg

SEQ ID NO: 1968 - DNA, 192 bp, Zea mays
cagcttgcgttctctgtccagatgaaccctctagctgctgttcaacaagtgccacaagcccctcgaggaagctggtgattggtgatgttctttatgccttgatctatgtaacattataactcaactgaaattcaacaggcaaccagatttcatgtcgcggaaaatgtggctgtgtaaatactagtgtgctta

SEQ ID NO: 1969 - DNA, 768 bp, Zea mays
ggctgttgcactccggcacagcaaaaaaaagagccaaccggggggcgggggtgcagtgcagtggcttaccagtaaagcgcgcacggaactggagggtttgatcctgtcatgtcggtaggcagcaaccagagatcaaagcaaagcaggggagccccttcctcctctggagggtttggacagattggccgccacgtcgggctctgtctcgatcgctggctagggcctagggcaaaggaacggaggacagggaggcaggcagacagattggccgcctttgggtccccctgaaccccgacaagctgcccttccttggagtcctgcgctgcactccaacgattcctttccactttccacctcgagaaaattcctggtatgccatcagattttatactcatcccttgtgtgccactcagtggcatataggtataatttttggtgtctatgacatgtggggccagtggcatacaagggatgagtatattttccagtggcatacagggccaaacctcgtcgtcgtctcccgcggtcgacgcaccgcacggcgcacacgtctctccaccgtccctatccctatatatgcgaggagcatctgcttatcyctgcccacgaccgccaggcgccagcagccatcgcatccgaatcccaagctttctcccctccgtgcaggtgcaggtgcagcagccagcgcgcgcgtctctacaggaaacagagagcatccgagtccccaagctcgcagctttgccagcaaagcaagaagacagttgcggc

SEQ ID NO: 1970 - DNA, 1500 bp, Zea mays
gcgggtctgttcttggagacccccctgtgtgttgttcctctatttcaaatatgagtctacaaacaacttttctaagctggaatgtcagaggcagtgagaacaaatcttcttcaaattcagccaacagttgtttgtctacaagagaccacaataaatgtttctgcagagtatagcctaaggtgttctaagaattgtgcaagtcttgttctacatctatatacaagtaatcaacgcagacgaaacacctcttgcacgtgtggagtctggcttatagtaaccgaataataggttacgatgcaggacgacaatcagaaccaaaaacccttaggcctttgttacggattgttggtcgaaacaattacgagaggaaaccgccatccccatcctcgcggacggccggacgccattcctaccgccgtcacctcatgcacatgcctgcatggtcatcgaggttgtcatcattacccgcgagccaccatagctgtcatcgttcctggcgtcccccacaagctcaaacaggagcatcccaaccaggttagggttcgagccctctgcgatcatgattaattgattgaatactgctttattattttttagcgttagagcggacaaaccattggttacttactaaacatacagacgattgattgattggttggttgagcgtgcagtttttttttcttcccttgcagttatgtagctggtggcggagtttctggcataaacttgaattactccttggattatttacgtactagtactactaattcaacaccatccatccacccgattccgatccgcgcaatcggcggtccatctcggccgtcgtcgcagccaccgaaccggctggcaccggaaattcaactcgttatcccacgggccccgccgacaggccccttctgcactacaaccagtacacgacgcgctgtgcagcctgcaagctgcaaggcaagttccgtccagctcctcctccatttaagccgcctgcgtagtgcctccactccacccaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcgggcgaggccccggccgtgatccgggcggcgctggccaaggcgctggccttcttctacccgctggcgggccgcatcgtggagggggagcagccggggcgccccgccatccgctgcaccgccgacggcgtctacttcgcgagaggccgaggcggactgcagcctggaggacgtgcgcttcctggagcggcccctgctgctgcccaaggaggacctcgtgccttaccccggcgacgaccgctggcccgtcgagccgcacaacaccatc

SEQ ID NO: 1971 - DNA, 1222 bp, Zea mays
tggcgacccttgtccccaatatgtgtcaagttttcctctgttccagatgattagcgtcttcgttagcaatgttgcggctttagttgtttctcctttattgtcttggcaagaacgttcttcccagtttgttttgccaggcgggtctgttcttggagacccccctgtgtgttgttcctctatttcaaatatgagtctacaaacaacttttctaagctggaatgtcagaggcagtgagaacaaatcttcttcaaattcagccaacagttgtttgtctacaagagaccacaataaatgtttctgcagagtatagcctaaggtgttctaagaattgtgcaagtcttgttctacatctatatacaagtaatcaacgcagacgaaacacctcttgcacgtgtggagtctggcttatagtaaccgaataataggttacgatgcaggacgacaatcagaaccaaaaacccttaggcctttgttacggattgttggtcgaaacaattacgagaggaaaccgccatccccatcctcgcggacggccggacgccattcctaccgccgtcacctcatgcacatgcctgcatggtcatcgaggttgtcatcattacccgcgagccaccatagctgtcatcgttcctggcgtcccccacaagctcaaacaggagcatcccaaccaggttagggttcgagccctctgcgatcatgattaattgattgaatactgctttattattttttagcgttagagcggacaaaccattggttacttactaaacatacagacgattgattgattggttggttgagcgtgcagtttttttttcttcccttgcagttatgtagctggtggcggagtttctggcataaacttgaattactccttggattatttacgtactagtactactaattcaacaccatccatccacccgattccgatccgcgcaatcggcggtccatctcggccgtcgtcgcagccaccgaaccggctggcaccggaaattcaactcgttatcccacgggccccgccgacaggccccttctgcactacaaccagtacacgacgcgctgtgcagcctgcaagctgcaaggcaagttccgtccagctcctcctccatttaagccgcctgcgtagtgcctccactccacccaacaaattcccgagacgccattctcaccatccacacaaagccacagcccaagagcagagtcgtcgtcgtcgtcgggc

SEQ ID NO: 1972 - DNA, 136 bp, Zea mays
aatctgaccacccgcccatcgacctgcagctgctgcgtcgtcgtgttgttacgatcgtccttttttttttgaaaatttattgaaggcccgtgcttcttcttctcttcttcttttccttctccactgttttcctcgc

SEQ ID NO: 1973 - DNA, 1396 bp, Zea mays
gtttgaaataggaggtgggatagagagtctgctgaagatagcctaaaggatagatatagaggatgaatatagacgatgttgctgaagatcgcctaagaactgagaaaacgaaactctcaagctcacacctccaacaaactcacacccaggagactaaggcggaggctaaatgaggttatagtgttgatagggcacctttcagaaaccttgtcagtctgctttatccgcacttcctctagggttagactgtatccagtagatcatgcatatggtcgtataaaacattattctgtactataaataacattgtttccagagtgaagtttaaaacatgatgtgagatttggaatatgataggagagctgatggagatatgagatagccttactctattcttccattcgacagtctcctggaatatcacycacttgagttaacaagcaattatggttttctaaaagaatatagctagcttggaaataatatagctagatgtttcagttgctccatcattaaagtaaacttattctgcttcttctttggtggatagaacaaatttcattcatgaatgtcagatttagtaatagcgccatccctcatgtctgtgcaaactatcgtctaaaaataaaatttgctctttagtgcgtatttgcagctctactataaagtttttgagatgtttgacaagaatattacaatcaacttaaaaatgagtgttttttgtgcgagaaaatatgtttacccttcatttggaccatgaacattgtcatgttcaatcgttctttcatttagggaggtcacaagtaacatcgacatcaagttggggcgttgaaggaaaaatatttgtataaaaaaaggttacgtgatttgatatttttcaagtcaaataatacatcatggagattttatgactactcgaagaaaacttcactggtaagtttgacaatgctctagaatttcaagctaatattttttttgatcgataaaagaacacccaacttatttcggcactgcgaactttaaataaagggtaacctcaactttgattcagactatttaactgcaagctgaaatcaaaagaatagattgaatagtctgaaaagtttgtttttaaactaaatgtttgtgtgattaaaagaacaattctttgaaagctatctacgtcatctctgtcattaacaaaggcccgttcatgaaatctactcaagttttccggtattcggcccaatcgcgcattaaactgccgcccaaacccggctctggccaactctagggttgagataaaagaaatcttcaagtcattggcccgtgtaacgactttccatcgacccgccgcctgtagcccttcccgtctctggagtctggaagcttcttcctcctcgcctccgactccgtc

SEQ ID NO: 1974 - DNA, 909 bp, Zea mays
ctgcagacgttaacatcacaaggtctcgtcactcagctgagctcacacatggttgccaattgccgttgcaattctggaaggcattgttaatccagacgaaatgtcaaactacaagtctacagtatctagttactgaagatgggtaaaatatctagtcgccgtgactcgtgagaaagagggctgatttggtgatgtatccccttcatttcaatggtcatcaaatcagctctaaggaaaaaaaatctagtataacattttttaaaacacatttttatttgatattttctagttcataaataaactatgcagcatcaacatcaaatatttaagaatggaagaagtcgtacttgatacgaccgtgaaaaaaatctgtaaaagatgtgagccgtccgttgtgtctaatcagacggtcaggagattacctggtggtgtcctcagacctcagtcctcaccaccgagtggccgccgcctgtgcagtggccagcaccggcatcgtccagccgggttcgtcgggaagcgaccgaaaccctccttcgcattgcaaccaacgcccgcccccaacctccgttttgaccgtcggcgaccgccgcgccgcgccaccgccatatatacatcgccctctcccttgcccgccacggctgccaacgtcgccagggaaatccaacttcctcctcctccctctgccgccgtagtggagatccgggttggcccgcccggtaaaccgtccccgtccctcgcgcacgtctcgcccgtgattttgcctccttaacccgacagccggaagccggaggcggcggagcgggggcgatggggatcgggacggtgtcggacgagctgatgggcacgttcgtgccgatcgccgtgtactggctctactcggggctataagtcgcgctagacggggtgggg

SEQ ID NO: 1975 - DNA, 791 bp, Zea mays
tggagtccggacgagaagatgccgccagcaagaagccccagtctgtcgtccatcttcgatcggcgcggatggattgggccgggagggggggcagttcccgctaaaaaaaaaaaggcggaggcggaaggcaaggccaggccgcaagaaggtgcctgggtgtcgccgcggctgcgctccagctgtggccatgcggccatgcccgcctgcctccgtgacacgtcgcctgccgcctccgctcacatgcagagcgcttcgggctccgtgaaccgggagggacacgaagcggggtatgtggccggctggccgccttgccgtgtggccgtgtgggagggcggcgagtggaagcggtggcggcaccggcaccggcagtctcgactatcgagtgcctagtcagacactcagacctcacaaggtgtgttatgcgtacgacacatctgattagtagagccacctcttggtcagcatactactcttagagcatctccaacaacaaacactaaaatagagtcctaaaatttgaaataggaccatatttagaatgtttagggtctcaaaagaaatgtttactccaatagtcaggccttaaataatgctatttagaaaataaaccatgatattaggaaataaatggttagagattaagtaaaaatgaggatagggctccagtatatgggtactatatttaggacccgagagaccgagccctataaccatttgatgaaattttataaaatagggccgctgttggaaggatgttttatggttttgagccctatatttaaaataggacc

SEQ ID NO: 1976 - DNA, 106 bp, Zea mays
gcaccttgctgctgctcaatctgccattgtttaaggatcctgatatatgtatcttagatagaatccacaagtctgctcgtgctttgtacaatcaaatgggggttat

SEQ ID NO: 1977 - DNA, 101 bp, Zea mays
ggtcattcttgttcagaaaatagtgaaaaatatatcgtgatcttgttctttactagaccaaatgaacatttgtcttatagatagctttgcgccgtgaaaaa

SEQ ID NO: 1978 - DNA, 1043 bp, Zea mays
tagcgaaggtttatgatcgccgaaggtgttcaaaactcaaagagtggaagtgagttcaccggaggtgggcgccaatgttggggacttgttctcaaatgctatgaattaagaacaaggcaacacaagaaatgttaaacgttaaagcccttcgtccttcgaagcattatttcccttaggacataatgattttcggacgaaggttatgaaggacataccttcataaattcaacatataataatgaagaaggaatcatatgtaatacaagggataacataaacaattatgtataattattgacttatttctatattttcattatagaaaaatagaacaaattacaagcgtaccttcggcttgaaagaaggtaaaagtacaagcgtgacgcagaagtaaatgccaagtcagcgtgaacagtacgggagtactgttcacctatttataggcacgggacacagcccgtgtaaatttacattcatgccctctacacttgataataattctatagtaatccaccgaggtccgaatagccttttcatctttaagttggtttctttttccgctaccacgccgaagctttcccgctcacatcttcggcgctgtatcaaccttcgtattactttgggcttctcctactgtgatatcgacctgagtccgaaaatacctgttcacacattatactccagaaacactgttaaatcctgtttttgaggaccttcggaagccgaaggcccccaacagtagcccctcgcaatattaatttgttaaaataataaatttagattgcgacatgaacgaaggctttaagccgaaggtccgaaaaaacaccttccctttgctagaatagcaacattcactgataggcggggtctttcaatttttaacgcactgggcgtataaataagagtgtaccgcgagctcatttggcacgctctcttgccatctgctcctgcttactcaatttttagctcttgcgcactaaaatttgctgagcgtttagttttaaagcttcggctttgaaaacagttttttagcgtttccgaag

SEQ ID NO: 1979 - DNA, 663 bp, Zea mays
tggatcttaatctgtatatattaaaatgaatttagatgtaaattagtttaagttacacttcaatccatatcattatagattaggatcaataataaaataaccaacgtacatcaccgtgtcggcgaggtgccattacgactacttcgaagcgcttggaaacttcctacgttgtgcccctggtatctctactgtctattgtcatcagttgtggtattatacgagtaaaatctgtgtgcagttgcaggattgcaccctcctcgcagtcccagacgagatccccacagacaaagatgaggaaacaggaattgacagaagcagcaggccgcccccacggcgcctcggaccgctcgcccgcctctgagtcctttccgaggcctacgtgtccccgtccgccccgtgctcgtgcccgcctctccacgtgtaacagacctccccggcatttccgacgtcacctcacctccctccccggccattaatcctcgtcccccccgcagtgcccgcacccacccggttgtcatcgtcagccgctcgctccctcggtcactcactcactcactcactcccctctagtacatcactcaccgcccgccaagcgcgaagctgtcactctgctgaccgcttgacagagcagagcacggcacctagccgccctctcaccgaccc

SEQ ID NO: 1980 - DNA, 1500 bp, Zea mays
gaccgtggggcaatacatgtggatatgataacaacgtgcacctaaaagatagtgaactgtttgagtctatcttcctatgattctgtcgacctatcctcacctggttccgttgcatggggctccagcgcgggaaagtcggatcttctgttgtggtttcttgctcaacactgtggggccgtccgggctttcaccgatccgaccttacgttgatttgctttactgattgtccctccccaggcccatgaaggaatgaccttacgatttattgggcccttgagcctttcgtgaggtcttttacccttccagtggacccgggggatatctgtcccccacaagcccccgatctttaggttgattttgagttaatcagcccaaagatcccaagtccagcttgcaggtaatttgaagaaaacgatttcttactgtctcctcctgctttgatcactcgtaaattgaagctttgtttcatgcttgtgccttaaaggtcggcatttcattttgtaggaccctgaacttcattgggtgcaccggaggtgcacccaatgggtgtagcccccgagcttcgagtagattttagaagataatcttctcgaaggtcttccccaaagattatctccattcgcactcctgcatctcggttgagagttggtcttttcaatcttgctctacgccttagaagtcgacgttatattcggtttagaatgatactccatgggggtgcaccgggaggtgcacccaatgggtgtagcccccgactttcaaatggattttttgaggataatccattcgaaggtcttccttttgcttgaaaaaattggcatgaagctattcgcattatgctttggaagtcagcattatgtcatcaaaactttgctgcagaggtcagcatatattttgtctttagcagccgagtttgtaatccatccatatcttgctaggtggtgcaatttatttgcttctgcgattgattggacgtttgacggacgttctctgtctagtcttcacgtcgcttctgtcggccatatcttgtactttgctggctatatttggctttcctctgatccttactgatatctcatttttgtcttgaggtattcactgcatgtcctgcacggatgtgaccgttttgaaaaatatactgataattcctgggcgtcccccccccaatgggtgtgggcaagggacggcttggtacgctgagtgttttagccgactgcttctgagtagtaatgcgatgggacggctagtgtaatcatatcctttgcactgttgactggagtcccaatgggtgtagtgttgcatgaaacggcgtccgccgtctgacgtgtcttcagatgggtgggagtgcttattgaatgccttgcgactgttcagtgaccgcggttggaagcgagcggttgcttttcccttctataaataacccctttgcttctctggttttttcacatctcttcgctgctctttactgccttcttctcctcccttctgtttgcttccacc

SEQ ID NO: 1981 - DNA, 1064 bp, Zea mays
tttaattatgaacttgtggaactttaatactttcttcctccgaagcaggtttcaaacaggagcttcgttcgattccgacagacaagcttcggcgacggttaaaaattttggcagcaaaacagtgcaaatagcaatgaatgctgtggtaacttcacacctactcgtctgtttatatagtgcggcaggtaagaaggcgaagcgccaggatttttacaccaggcggacacccgctcgcactcgctgcgtggtggaccgcagagaccgaacagtaactctgaaaggtggggccgatacacgctgagaaattgaatcgtttctcgacaacgagctcagggaaggtgttttttagaccttcggcgctccgaagcttaagagacttttttcacggatcaagctcgttacgaaaaacgatctagcaccacgaaaggggctactgttgggcctgtgcttcgtcgccgaaggtcttctaggaagaagcggccttcggctgaagctgtttgtgtaagatggccgaaggtccctcttcatgaagcttcggtattacaaaccgacttaaagatagaatgaccttttagtccataaaggtctgagtcaatgttgtaaactttcataaggggcatacttgtaatccctcacaggctgcgccctgtgcctataaatagtgaacagtattcctttactgttcacggattctagtaattgcaatcgcatattctggaattcaaccttttgtcaaggcagaggtataactgtattcaatgattaaatatactgagtaaatataatgtggttcatttatgattcgtttacctttgatactctatattttatgttatattatacaatctattaaactacaattacgaagatttaatcttggcaatcgtattgtcatcaacgttcgtccaaggtccattaatccccaaaggaataatgcttcgttggacgaaggacattaacaattaaaactttatgttgccttgttcttaattcataacatttgagaacaagtccccaacattggcgcccacctccggtgaactcacttccacttttttgagctg

SEQ ID NO: 1982 - DNA, 388 bp, Zea mays
agaggtatcaaatatactttaattataaaattaattatgcaattgagaactaaacgataagacaaacctattaaacctaattagttcattatccgttcatagatgttacaataaatatttgcttatcataaattaattagatttgataaacttgtcgcgtcgttttgtttctagatgtatagttagttttagttttatgattaaattatatttaatatttataataaatatttaaatattcgatctaacactaaactaaactttagttccaaataggcttctagagtgcaatacggataagaacactagcgccgaacagaaacttccctcttcaccccgcgcgaaactggcaagcccaactccctaaatcattctccacgagaccacg

SEQ ID NO: 1983 - DNA, 356 bp, Zea mays
ctcttcatagaatcgcgcgattttgttcatctgtgtcctttctgaaatcatcgtttgtctccgtgcaattcttaggttccattccgtatccggatcaccgtgcggaaattcttggttggtatggtatgagtaaatgcgatctgcagtgacttgtgagacaggtttctgcacattagattcacgaaaaagttgcgacctttattgcattcaggagtgttggtcggaactgccaggttgcctgccggatttttaccttttggttccgatttgtcccgtgcttttattagatgacgatgacatgataatcacactgctggttggataatgcagagtgatgcgcttaaggattcacgaca

SEQ ID NO: 1984 - DNA, 953 bp, Zea mays
taatcatccgataaatatgagttgagggattgaatattgatccttgttatgttatttggaacgattcagacttgtgaacaacttatgttactcaaagttctattatgaattcataaatatggtgtgcatgattttatgtgatgtgttgtgaattgaattatgtgtgtgtatgagacgtgggcaaatatatgtatttgtgaatgtatggaatatggttgaatatgtatgcgttataattgagctagattgactaatttggttggatatgtatgtgtatgggatatagttgaatatgtgtgtgtatgggatgtggataaatacatgtatttgtgaatttatgtgatgaggattggatatgtatgactggaccacgaaaatcagagcaactaatttccctgggcggagcatagccgacgaaaactagatggactaattcgtttgtcggcaaaaatcagatagtttttgtcatttaatctggtagacccaagtatcgacaaaaatatatattatcaatgacaattacttaatttcataaacaatataatttttataagtgaacatatcatgtgtattcatgctaactaacttgtccaaccatacatccagacatttaaaggcatccgacatttaatgacatccgatttgcatccaacgcacactggcagtggtatgtcttttttggcaaaatttacgttggatcactattcactagatactcatgctaacctgtccaaccatacagtttttatgtaaaatgtactcacctatgatatgtgttgcacatgttttagcacgggggtgtgcatttaaccratgaggtggcatttaataaaaaaccaataccatcaattgtacaggtcatcttcagaggtacccactggttcaggttctggagactcctacaaaagtaggatgtacatcaacaaattatcgatgtgtgtcaagctctagaa

SEQ ID NO: 1985 - DNA, 718 bp, Zea mays
cctacaaagagcaagattacaggaagtgaaaaaaacatggtcatcatgtttaacatcaagaaatctgtggttaattaccattcatgatttatgaggacatgcatttctttattgcccatgagctgcaagcaaaagcagtattttccccaaagaaacatacatcctgaccatccactgtcggccatcggtccaggtgccagagcgccaagaagaacgtggccggttgcgtccacagcgagcacaccggtatcccccgcgcagatccaaccccaatgccccaagccaggaaggtgtcggccacgatggcgtccggcttctgctccagggacaaccagtccaacagccgctcgacgggcgccaccatcttgatatgcacggcctcgaagaagcctgcgaagtcggtgccgcggaccctctcggaggggatgacgttggggatggtggcgaggcggacggcctgaccatccaccggcggccatcggtccaggtgccagagcgccaagaagaacgtggccggttgcgtccacagcgagcacactggtatcccccgcgcaaatccaaccccaatgccccaagctaggaaggtgtcggccacgatggcgttcggcttccgctccaggacagccggtccagcagccgctcgacgggcgccaccatcttgatatgcacggcctcgacgaagcctgagaagtcggcgccgcggaccctctcggagggg

SEQ ID NO: 1986 - DNA, 284 bp, Zea mays
ctctctctcgtctcgaccgaatgtttagtacagtacggaacagccgggtcgttctgataatccgggtgttgggcacggggttacgggcagccgacataccattcacgcgcctcctccagtgtcgctatctccagcccccactccctttccccgtcccgagctcgagcgcggacgcacgcacaggcacagtcgcacactgacacgaacgcggcgaatcccagcgtcggcgaaatctgcggccttttctctcctctgcaggccgtgggcagtggcgccgccgcgcg

SEQ ID NO: 1987 - DNA, 796 bp, Zea mays
ggtaggcctgggcacttttaaaccgaaaccgaattaccgaaccgaaaatttgaaaaccgacccgaagtttcggtttttcggtgtttggtgtcgggttcggttttaatttctgataacttcggtgttcggtgtcggcctcgattttaatcttacaccgaaccgaaacaccgcccaaaccgagcgtgctgcagtcctacgtccgccggcgtcccactcccacgggccacggccccacgattctagtattctaccgtgaccggcccataggccatagcccacttctctctctttctcttctagtcttctctgtgcattgcgcgcctgcgcccaacttggcaaggcaaccctaatccattcgacatcgttagaccgacggcggcggcggcgctccccactccccagttccccgctccaagatgctcggccgctccggcgctccctagtccccacgtgctccccagtccccacttcccagttccccgctcaagtcgatactgtggcacggcaagtcggcaagaggaggcaggagcggtcgccggtcgagctgactgctgagggccacgagcccacgactgacaactgtgggctactatggtagcaagaggaggccggtgggcgacatcagccatcggcgccaagttctctgagcagtacaacgacgcctataactgagccaatgtacgtcacctctactctactctactcatctcaattttctgtgtagtgttgatgtaaactgtggtctttgagctattaatagatttctgattttttattttcaaactttatcttgtag

SEQ ID NO: 1988 - DNA, 127 bp, Zea mays
ggtaattgtggccacttggcatcatattctctgcagattccttttttttcaggcagcttctataatttaattttcagtcaacattcattagttttcccccatctcttatagtttggctttgctggag

SEQ ID NO: 1989 - DNA, 782 bp, Zea mays
ctcctctccttgtaaatttttgatataataagcttctggtaatggacgtatagttcatctgtgcacgggaacactacagagatccttgtgattagaatttagaaaggaacatttggatctagtcgtttaatgaccacgaaaatgtattggtcctgatttggaacttccgaaactatggccttattgttcttattgtttttgtagttccatctggctataatttttttggcaaattttggttcttttgcagagcaggttaggcttataaccaaatgctgattcaagatttcttaaatgtttgaaaatattatatgactcatgtccacaaatcctggagatggaattctttccaccaaaaaggggaagggtcatgaggtwtgtgcattggacattgatgtgcttgtgctcatgtgctrgacttcttgagctgtcgagtgtcagatgcatcgaatgccttctgataakaaaatgacatttcagatcatcagttgtgaggaatcataactggtcgcgataggaagtgctagctgcagcagcactactcagtaaaacctgtagaaattaagcagcatcagccgycgcaactgttttcagttgtcaggaaatcactgtgttgttttcaataactgactatgtgtttgactaaatcttcagggactggtgtcattccttgtgctattgcacaaatcgtttgcatgtattggagttttggtgtcagtcttagtaaatgttgcccatggtaactttttttattcatgcagattgcagatcatttaacataa

SEQ ID NO: 1990 - DNA, 1500 bp, Zea mays
tgagattggaaaaaattaagaagaattttgacttatttgggattcaaaccgatccagtcccactcaattcacacggattaagagctaaccgaaaagccctaaagtgtctatgtttgtaagatcctactttgagttgtatgtatacaccctcgtcttaaaagtattgtgctcatgcttataatttgcaaagtttgttgaaagacaagccatagttttagagaaaaagtctttggggttccgtttggattcttggaattgaatttcattctaataacctaatttaggcataaatcaattaagctaatattttttttatacaaaaattatttgtataatggtgttggtcttatgtgggagttgtttatatgctatatttttactatagagaagcgagtcgggaagcgtgttatgagttgcgcagtagaatcataacctattgatacataaaatcaattttcgcccatcgtcctataaatttaggattgacatatatcaaactaaataacctactctattaagtaaatttccaatttcttcaaaaatgaaaggattacaaagcattacattcataatctcctagagtaatttagtgtctcataatctcctcgcgagctatcttcaatgtgtcccaaatttttttaggcattgtcgaaaccacttactttcttgtactcctccatgcataaagaagctaacaacacaagtgaacagagagagcttgggaagaagcaaaatcgcaagaaattaaaaagacaagtgaaactaaaatatagaagggtgactaagggaaccaaaggttataatatatgaaactaacaacgtgctacaagttcacaaacggtggtacaatattcgttataatatggttccctgtgacagatatcgccgtatgtacagactgtacacacccacccacgacgggacggtggttcgccatgtagtagttgaacccaggagaaaagaaaagaaaaaaaaaactaacgcgagctccagacgtgtcgtcagccatcatccatcaccgcccggccggtggcagacagcaaacgactaacatgcgattggtgaaattatattatgaagtcgtgcgcccaacccaacccaaccaaaccagcgcacgacgacgggccccgacgcggcaggtggcgttccgttccgttccgttccgttccgttggcggaaggttcagggcaggttcagttattcaggcatcaacgggctccatggaatccaactcaattttccgtcccaggggggttaagttggtgagtgcctccggcgcgtaaagtctacggcagtttgctttgctttattaaaaacgaaaaaaaataaataaaagagcaatcaagcaaacgctagtgccgctgtcacctaccctctgctcgtcatatttaaatacagcagcagcagatggccgaacgaacgaagccacaagcagcgccgcgagccacagctagcaccaccaccttgcaccgcacccgcaccgagacgaacagatcgacc

SEQ ID NO: 1991 - DNA, 686 bp, Zea mays
tgtggttctttactcacagtaccgagccgattaaagttggtaaaaaaatcaaacagattataaatcaagacggatgagcaataaaagtttggaccgagaagacgtactttgcggcttgataattgacgaaaagaaatgggcgacaagggatcgacgaattccacaacagtactaacagtgtgctaatgcatcgttgcgcgcgacttgtaggcacgttccaaaaactattattggaaaaataggaagacgtacaaaaggcgcgctgcaggcttgaacctgagccgccgattataaactttgccggccaaatcaatcgggtcgtcggcgaacgaaccagcacactgtcactcgagagtgcaggctgccacagcttttcctggctgagagagatggcracaccccacaccacgaaacaactrgaccagtttgcccccacgcctcctggcaccaagtagttttccttgctcctttttttttttctctctctctataaaaacaaccgaggcgccactcagccggagaccatgtcccactcccctctccctcctccagtcttccaaaatatctccctgcgcttttccgagtccttttccctccaaggaacagaaacaaccggagcttttaccccacccgctttcccctccccgccaggaacaacagggctcctcgcaataattcgtccatcc

SEQ ID NO: 1992 - DNA, 482 bp, Zea mays
cacaaatcattataaatgcttggtacgtgtttgaaaaactatctcgtttaaataagatctacatatgtaaatctgtagcaatacatgacacctcattgatactgacctcgaaagacttaaaaaaaccgaaccacttctctctttaaatacagataaacatggttagtgagtgtcggcctgagtatttaaatccgaacaaaaggctagtatgatttaagaatggcggcggagcgaatgaagtgatagtcaacttcgccgtcgccggctcttctgcttctacgtactctactcccctccccgtctctctccggcctccgaccggctcataaatagacggtgtcaccgcttccaggccggacgaaggaccttagcagagctcaagtacctgcgccggccagctatagacaagargcggcttggagaggcaggcaccatcatccatggcgccctccggtgacaccattgccctcgtccacagcggc

SEQ ID NO: 1993 - DNA, 440 bp, Zea mays
atcagctggcgaagacaattcgacatcttcctgtgtcgtgtcacgttcaacagcgcccatatttacatcctcattcagtttcggcatccgagtagcgatgtgcttctcttctcgttcgtcaccctgtgcctttgacaggtccttctcctcatcgtagagtgaggaggctagttgtggaagaggggtttcgccccccccccccccacacacacacagtatcagtggttggttctactgagccagcgtacttccccacattgtccaaaataatatttattttcactggatttgtgttctgactattactagtgcccaatgttctacatgaccatacattcagagcatagtatttcagagtaccatataatgtgtacacaataaaccactcgcatactcaatggagaatttgaagacattgatgaacaaccatatgcttgctt

SEQ ID NO: 1994 - DNA, 118 bp, Zea mays
agtagggctctgcttgcttccttccaatgcgggtttatgcgccccctatgtttttcaatgcggtagagtggtggtgaagcaaggtagcactcagttgtctagtgggtagtgaaaaccg

SEQ ID NO: 1995 - DNA, 349 bp, Zea mays
tgctacaattacgcgtgatagtctttaactattcgtccgtcatattattttcttgttgttctatagactataggcacacagcacactgatccttgcgactgggcgttcaatccagccatatcaatcggatccccatccgacggcccagcagatctcgaaacccaacacactaggcctcgccctttcgcccgacacggacatcccctggcccctgccgctccccacccatctccgatctgcgattccttccagccgacgcctccgcatccacctccccggagccaccagcggccagccactggccgtccaaccatcgtccccaagcggcgagttgcggggtgtggcgaag

SEQ ID NO: 1996 - DNA, 118 bp, Zea mays; identical to SEQ ID NO: 1994

SEQ ID NO: 1997 - DNA, 259 bp, Zea mays
gcctctccagtcccaaattcattccaaccacctagtaacttgagaaagtgtttgttcgtgttctttgtgctcttgttgcttggatcgctttcttccttcctcattcttattcccaagagacttgtaatcaaagcgagagacaccaagtgtgtggtggtccttgcggggtctaagtggcccatttgattaaggagaaagcgagagacaccaagtgtgtatcggagcccggtgcttcattagagtctaacaactcgaagtg

SEQ ID NO: 1998 - DNA, 218 bp, Zea mays
atggcgccccgcgagacgatggaaacccctgcccgtcgtccactttctattattacaccgagggagagacagccgctcgtcgcgttccaggcgtgtccaaccgctccgcgtctctcggagtcacccagctggctgaccggccgtataagcgtaccctgcccggacgagtgtcctagcatcgcaccgcaccggctacctcccctctccatctctgcgtg

SEQ ID NO: 1999 - DNA, 184 bp, Zea mays
ccactcaccacacaccaaacaaagcaggggccaggggagcccacttcgaggccgcggcgttggctgtctcggtgtcatcgtctcctctcgtctcgttctcttctcctcacctccttcgtttcgcggagcagagcgagcagccgggaccggacctccagggagcgcaccgcggaggctagcgaag

SEQ ID NO: 2000 - DNA, 526 bp, Zea mays
atcttgcagcattaataactcacacttcatatatataacatgtttatagatatgaatagttgccccctcgcagtttatatataccccaaacccccacacttgcaaagttgcaagttagtactccgttttgcctctcaggggcccatcctagatagaggaggggttccttgaccgtaccaatagcttgaagaaaccatgcctatacaaaacaccaacaggagaactggggcctggggtgaggagggcgcttctctaggcacggcagtgccagtgtgccactggtgaggtgagacttgggagttgagaggcatgtgaccctcttcactcgcttgaccctcctcttcactcgcttctcccagaagtcacgcaccaaacaccaccaccaaagaaggcgagaacgtactccgtccctcccctcccctcccctccccttcccctcgaggctccaggaccgtctcctcgcctgctcatccgccgctgcttcccttctctgggctcggagaaccggagagaagcgcgcgcggcc

SEQ ID NO: 2001 - DNA, 88 bp, Zea mays
accacatacgatttttggtacaatacaacgtcagcagtgaattcttgatgccacgttaacggtggcatccatcatgcgtcacctgtag

SEQ ID NO: 2002 - DNA, 284 bp, Zea mays
cgggccgtttcttccgtccttccttggcggctgcgagtccctgcgcagtttgcttccgagcctttcgagattccgcggagatctgctcagttcgtgccgctcttgtctggttctgatgcgcggacggctgctgcctgtgaggcgttgcgaggagctgaggcccgtctgaggtgggagaggaaaggagctcgtggctcgacggaaaaacagtcctttcgttcgttgcccacgcctgcgggccgcggcctgtttctctccattccaggcttcttccagttccagcc

SEQ ID NO: 2003 - DNA, 1500 bp, Zea mays
tagttcattcctccgcactgtccggtagccagctttacttcccgttcggagcaaaatcccatccatcatcctccgactctgactagaggagtctgcggtggattcttcgtagaatgacatgacgattctatcacaaatgaactgttgtgctgactagggctagatatttagccagtttgattcggttcgttcaagtttaggctggctggactctttaaactaatgagtcgcagagtcagcacagttataagctcgaattgactagtttagctcatgagccagactgaaaaaatgcgtgtatagtaataattaatttttaaataattttaaaytaatttaacaatagaaaaatagtaattatactcatagttttacagatttatcaatgtaacaccaaaataacacacatcattactcattagttcacaattcgcgcacatattcgcatagaccaatttaacacatagagataattaatcaattattagtttaactcatagatcatagatcctaaatatttataacatgttcataaattgttatttaaatgatatgcatataattttgttttgctgtaatatgatagcccttttaactcgtgaactgactcgttaacgaaccgaaatatgatatcattttaggtcctaaaataattcaaatgggccaaactaaccataattcaaacgagccgacaagtcagggtcattttattcaccatcagtgcggacgagtcgcgactcgcgagctgcactgcactgcactgcactgcactgcgtcaccacctgctggctgctgccgtctgcacctctgacttcattccaggcaatctacttcggtagatgactgtcctgtggaatcggcgtggtatggtatggtatgtacctgcctgcagacgaccacagcgcccctgctagtaaagtactatcagcttttggctctcagtcagccaagggccaagccagcccagccatccactagtcagtcaagtctcaagtgagtgcccgcctcttttcactcaacaatttcatgccatgccacattatcaaatcccttcaacggatttgcctttctttccctccatttctctcgcccgaacaaaagagagaggaactctcctttactcgatccgattcgtgcacatctttctcctcgacagcgaccacactctccttttcttcccagctcctcctcttgcctgcctgcctgcctgcttctcttaccatgtgtgtgtatatatatgtgtgtaaataaataaacaatataaagacctgagcacaccggccagcccttctcgatcagcctcactagcgctctccaagagcatgaacaatcgtctgctgctctactagacggacggaccaaaccaaaccctcctttttcgtcactagcaaattaaagggaagcgagatcgacctcaccgtccgtgagtccgtcttcttcaactccatcgtcggcgtcgcgcgcgcggagtgtttggttgctcgggagaggagactatat

SEQ ID NO: 2004 - DNA, 926 bp, Zea mays
ttataacttgggtaaaaatattgggcgcaacattggggagtttgtatctctattacacttaagctttcgtatttacactattacattttgttgtgttcttttcttattagcttagttatagactagtggataggtctagaaccaaggttgctacagatagcaacacttatacaaaaaccttagctacacatatgaatgcttggttattctcaaaggttttgattaaataaaaaaattaaggccatagattggtgtgaaacatagttgtcctaattcatccctctcttagacgtcatcattcttttcaccagtgtactataaaatattgtcaagtacaaattgccacaattgttactacctatgttgtgtccaatggtatagacaccattgtccaatgatatgacataacatacctactttcataacaagtatgactgccgctagagaaggacatccctgacaatgtgccatgaccgaaggtatggctttatgtacttattcacaactagcataaggttgtggttgttgggtcaaagtgtctatgttgtcatcaaccgtcaataaactgacgctaggaccatatttcttacaagtattcctctctctctctatatatatacttgtattagccgtccgttttcgagtcaacggtttgagtctgaactctgaaatcagcatgcaagctgacgaaaataacgcgatacagtattccaatctgttaccctgaagacctgaacccaaatctccaatcagatcacagccggcaagccctaaacattaacccagttggcatcggagagcaatataaacaggctgaggtggaacagagaatttgaaccgaatgcggatcatcggatggcggccgtctaagctagagcgctaggctgtcgccactcgccagtcgcgagctacgagtctacgacacg

SEQ ID NO: 2005 - DNA, 88 bp, Zea mays
agtgatgacgcacgcacggctacacaaactgacaaacagcagcagcgatgggtttcttactttcttttgagcttcgcagcgatgggta

SEQ ID NO: 2006 - DNA, 199 bp, Zea mays
aatggtcgaggaggatgaggtgcttgcttgcgttgccgtccacggtccgtccattccgtcaccgtcacgtacgtgcgtgcaaggtggtggtgtgccgtgtactgagggcgtttgcgtagttgcattcgtgcgtactactactgtataataataccgagtcagctcttgccgtgcttggattggccccttcctgttattg

SEQ ID NO: 2007 - DNA, 1500 bp, Zea mays
gcagtccgcaggaccggtcactcggcacgcaggctagcagcacagcagcagccagagccatcccctctcctcgctacgcttcgcttcctcggcgccgattcctcctcctcctcctccaccctcgtccgtccccttccggcgcgcgagctcgcccgagatggtaagcccccccgctcccatccgcttcccctccctgccccccgcgcactctggtccccccccggatcggcgagggcgtgctgattccgggccttttgttctcgcggagcggtagcgtagcgcttcggatctagttggattcagggggtgaggaggatcgccgctgctcggcttgctcgtgggctgattcgtggtttcgtcgggagggagttctgatcgggatcatggggtcgttcatggttccgtgacgcttgggagccacaaacttgcgtgggattccgcgatctgtggtttgggtttcgggcgcttcgtctagcgctagctgcagaccgtggcgtggtgcggggccgcttggatccgttgctgtttgcgccgtgcggtgtggaatcgagctgtttagatctacgtcccgctagatgccgtggcggtggaatctcggttgatctgtgtgtctgagcgcctgtgtagctcttgtggctgtaacatacatctgctgatttggctctcgacggcttaggccgcgggagcttagatggcggagcaccagctgctccctaatcaggttggttctcgtgcggatctgttgacttgactgtaggttgcagacttgcagtaggacgctggcactgccattgaccaggagctgcacaacaggggcgaagctaggttatttttaggaggtgcagataggggtggtaatgacctctagattttgcactataaaatgtaatgatcggatcgaattgggatcagcctctattcctattcatttttgaactaaaaataattaagggccctaacttattgtgaagaaacatttggatcttgatccactaccacggtgtaccacccctaggtgtagatgcacccccaaaaatacaagttctatatatttagtattttagttaaaatttcaccatgtatgcatccctataaaaaatattatgcacattcaattttgttctagctttgcaactgagtaccgagtactagcataggaattttgttctagaatatgtatcggtagtatactctgctagtactcactaggtgtctcccgagaaatgagaaatgtgtttcttgttttgacacttggcactattggtcgagagtcaagactatgagctgaactgctgaaatgtctaatgttagcagtttctgcactggttcaattgcagcctgatttagaaatgctggggacagctggctgtgccatgcaaaataaaatgtgttagtaggtactttgaagggaaactcaaactttgtatttccagttaaccatgatttaacttgtggtcataggcgaacgcgagatcgggtgtcgctgtgaacgatgagtgc

SEQ ID NO: 2008 - DNA, 536 bp, Zea mays
ttgcatgcctgcagcctatggtatccagcatagtcctgagcattccccttgagggccttttggcaacaacattgtaattttataattgtcataacaataattaatcttttctaacaacatattaatatataattaatgtctactaaataattttaatttatttaaaagtggaatatacataaaattataattcgaaacaaacggaacagtattatataatgtgctgtttgcacggtacccaagaaaatgctgcacctacctgattctgggattttatttcacagcgcacataattcgatgctaaaaatgatctatatttgcatgcataacatattttcaaaatctgatactcattatctgccatgaactaaacaaggcaaacaaaaaaaaactcatacaggcaaccagcacctaaatgccgtgccgcgtcctacccgagccgctgcctccaccaaaaagcgtaactgcacaaattccaccgatccccctcgccccggtcaaatcctctggcctccctgtgcccggcggcgagcccc

SEQ ID NO: 2009 - DNA, 239 bp, Zea mays
tttttaatgtaccccccaactcaaactacatggaaatatggagctagagacacccgtatgccgtatcacatgagcggcgccctcagttttggccagaacggaaacggacggagacaaacccgcggctcgcgaccgaattccattttccagcgcgcacggacgactgtacctcccccgcccttcgccactccgctccctcctccacctgtcatctcccgcgcgggagacctgcccgctcc

SEQ ID NO: 2010 - DNA, 921 bp, Zea mays
accggccctataatttctcaaacgtgtggaggcgcctgcaattcgcccccagatatcccccccaaccaatttgatagaatttccaagttttttttcccgcaagtcttccgaatctcgtcaacgtcaaggtcgagcgtttagcacgcaacccattttgtattgtcattatatatataaataaataataaaagcgacatgttgtgcttgtattgtatgtttgctccaatctttcaaattcgctagatgatgctgaccctcccagtctgcttctttatgatgaatccaatccgtcgtggagacatctaagcaggctttactgaatctagttgctatttaaccaggtgccaagtgcagataccttccctgcctcacaaacaacgccaccctgtactagataccatcagggtcttcaaccagggcaggttctcttctcttcctgcaatcttcattctgctctgaccgagcatacgctatttgattgtctttgctctctctctctctctgtctgtggtgtgtatgcaacagtaactgttcttccaagtcctgtcatgtttgcaaatgcttcaaaattatcttgcttagttactttacaataagattttggttcctgaattgaaaatactgccgcatggagatggaattattaggtgctaagtattcagcatctgtgaaagaatttacttgatggaggtgcttagatgtttctttagctgttatcgttttatttttcttagtaattctggtcatcatacaacctttgttttttacttgttgtttagttgctagtactgccagctattaatctcagttgcagtgcttattcacactattaattatcggtagtagtaactggcaactattgggcctataggtttatgttcaggtggcactgccagcagaagtgatccgttgacttcagct

SEQ ID NO: 2011 - DNA, 265 bp, Zea mays
tgtttaggtaatctgtttatatatgtttaggtaatctgtttatatctgtttaggtaatctgtttatatctgtttatatctgtttaggtaatctgtttaggtaatctgtttatatctgtttatatctgtttaggtaatctgtttatatctgtttatatctgtttatatgaactgaatatctgtggttttcacatgtgtgcaaggccgtgaggaaccggtgcgcgccaccttggcgacggaactggtgctccggcctctgagctgtg

SEQ ID NO: 2012 - DNA, 531 bp, Zea mays
gacctgcagcgtgcccagcgcatgcatcgtagatcatcatcggcgactgccaatctctcaagtgtgagtaagaaacacacaatcatcaaatggcatcaaaccttgcttagcaagtgaaaccactcgatgccgatcacttgcatcaacagccattccgcactagcttggttgcctgtgggcgtgtggcctcctctcccctggtctcgtcttcgtccctaacgggcgtccgagccagcgcgcgcgcgagagacagagagagagagaagggaggaaggggaaaaataaccacagaatataggaggaccacttccctcccctccgactccggccaacccgcccctccctcccaccgctcgtccgcccctcgcccgcaccaccggcgccggcaccggcgccggagcgcgacccggaggagcgtccgcacccgcgccgcgccagatctggccccgcccgcagctcccatgcccctccctccccagacccgcctgacctagctacgaccggccggccggacccgccccaccccccgcc

SEQ ID NO: 2013 - DNA, 277 bp, Zea mays
cttttttttacttgctctacctaaagcaaagcaaagcaaaacccaaacccaaacctttctaaaaaaaacagaaattaaaacaccccgacccgcaccaacaaaaacaggtctgtattggatttgaggagcaagtgaggaattgacacacactactactactacacacccacgcactagttataaggatcatcaacgaaacaacaaaccccaagatcgatcaagagtgagctagcaacgccatcgaagcacacacagtgagcactgcagtggggtgggg

SEQ ID NO: 2014 - DNA, 426 bp, Zea mays
ggtcttctggatgcatgagttttaagtttttatgttgtagatcgtttttttcacaggtcttcacgtgaatttggctccaattgtcgttgtcagcatcaactacgattgcaacctactcactccgttcttttttattcgttgaccttgtattttaggacgtgctcacaacctgatcatcagtacgcataaatgaagacataatatatttacagcatattttattgttcagctccacagcatgcatacaaatacactagcggtacaatctctggctcccaaagctcccttcacaaatactggtgcaacctgcagtacgtaggaatacgtacgtctacggtacacgcatgcaagcatcatgccctcgctcacttgccggggacgaagttggtggcgtaagcccaggcgttgttgttgacggggtcggcg

SEQ ID NO: 2015 - DNA, 407 bp, Zea mays
cccgatgacgagaaagatacacatgatccatttcgatgaatcagcaaaaagacttcatgattatgcatttgacaaatagcaagaagcgcggggcaacaaagcccatcctatctcatccatttttttcccacgatggcaagtggcagctcctgattagctacgcccattcctacgtggcacaccccaggattcatgtgtgataggccattggggcccacgaggagccacgtcagatgccaagccaccccggcgagaccaaccggccaatcgcagttcaggaaaaagatgacctgctatccaaacccaactgtataaaatgtagctgctgtgttctgttatgacacagccatcacacgcatactgcatacacaacgcagagcatcagaagcagctgcgatctgatcgac

SEQ ID NO: 2016 - DNA, 1500 bp, Zea mays
ccaatagagataactctctggttttctgcagtgacacttggacaccgatgagataactctccatctgcttctgggacgtcggaaggacgcaaaatttcactcttcactccaagtccaagccttagtttccacttgaatccatgaaagcaacagagagcgcgccgaaacatctgcattattgccggcccagagtcttgtagtaccgagaactccagtgatctccacgcgcttcctcgaggaaaaccgaacccccaattatggcaagctttgacgatttacggcgggttacgtgcggggcatgacgcgcacgccaagttgctgctccggggctcggaggtggaccgagccacacgcacccgagcgagaccgccacctgtttgggatcacggaacgcggtcgccttcagacctggaagatgggtggaagctaaccggatcgatcacacgtacgtacgcatgcatcctcggcagggctagctccgggcggcaggaaccctcaggccggtgttgttgttattggcacaagcagaaagctgtgcctgtgcctgcctggttaggcaaaggcttttcagctgatcgggtcgggtcaggtgtcgttgagctgctccacgacggtcgcattttcgtatgtaatatataccgaggtcgccagactcatggtcggtgttgtcagttgtcactaaacaatgccatctccgtccatcctcggcggctagtagtgcagagcgctactgcaagtagattggaaacgtacaaaatagtgaccaccgaacgttctaattctaatgctggcgagtgacggtgagctgcacttaccgataggaggaagaaaaatacatagatagaacaaaaaatagttatttcaaacaaaccatccacactgcaaatatgctgtgccgttatttcaaacaaaccatccaggcatccacactgcaaatatgctgtgccgttatttcaaacaaaccatctcgatcgagccaggagaacgaggcctgtagccagttagcagcggccgtcttgccatcgccactctcagcccgccgccagatctcctcctcacccgcaccccaccgcgccttatcactggtttgtttgcagttgcaggcgtgacaggacgaccggggagggcaggcaggcaggatcagttcatcggcggactctggcggctggcgcgcgccgtgggcgtacctacctacggcctgagggttgaaacgctgaatgatcttggctgcttgtcgttgtcgctcggcaactcgtgtgcactaaagtctgaaccggtcgactagtctgactgagccgctcttgcccgtccgtgctgcgctgaggtcgtctcactcggaggcgccagcgcgcgcgcgcgcgtcgtgtataaatacgtgcccgcgtctcactgttgcctcgctcgcacggtgtcctcctcccgctaccggcaggccacccccatacgcctcgttcgtctcctcctcaaccgcaggtcagcagcgcccgagctctgcgtgcg

SEQ ID NO: 2017 - DNA, 410 bp, Zea mays
gggatggacagtataaaaagttaatgataagcttctcttttgcaaattccgaacctggtccaccagaagttgtccatcccaactaaaatttactaactgctgcgtggcgtcgcgaccgacacgcgggcccgcagcgctccagtccacgccgcgctaaagcctccaacggccggctccaatccaaactagccgttgccttgctcggtcggcggtcgcccttgtccccgtctcctcctcaaacggtcgaaagtcgaatccaatgccccaagccccatttagacctctccgccacccaccccgttcctcctcgcctcactgcacaccactgccctcctccaatctcgtcgcgccggtaaaagcccccacgcgcgcctcccgtccggctcctcccctctccgcgtcccggctcc

SEQ ID NO: 2018 - DNA, 1211 bp, Zea mays
aacgaaaccctattccacgcaccaaaccacaagcgcagccgctgtcacttctgccccatcgcggccccatcccgccgcccacaatccacatcctcccttctagcgcccacctccaacctcgagctccctcttgctccactagttcgacctccggtgcgtcacctccttgcccagatctgttcgcccctcaccctcttccggactcggcaactcgcggactcgctcagctctgttgctgcggtgcgtgctggtgctcgagcatgcgactgattgcgctcaggcatgcggcgagcagcacttaggaatcaagttgtcaggcacgcgctaggcggcgcttgggactcggatcaaggagaatctgatcaaggaccgcccagagatgttcgttaaagctaatttcgtgtacgtgttattttgctcctctttctcttcattcacttgtgcaaggagtttgattgatttccagtgggtactaaaacaagattctgcgcacaccaaggtcttggtctccttcggttgctgtcgtttctcttatgatgaatagctttttgtcttttcctgatggttaactagtgtggattgatacttagttcctagtgcccgttaactatggcctagactgcaactgactccaagttttgatgaatccaaattatttttaactcccatgtggtttaatttgacaaaagcaaaaaacacaaactaattattctgttgttttggctgagtgcggagtgcagcactgcaagacccatttcgagcagctgttcaaggagattgggagttacaacaagagcttccaatcacaatcatgtactctttcattcagtatcaaaccattagcatgaaaataaaagttttgtgtttctgtgaaactatatagtgacgtgctcgtggtttacttctttcagctgcaaagaatagtctagaaaagttggccctgagttatggatctgtacatgcatcccataaattttttacctacaaatctaacattatgaaattttcaactttatttactatgttaaattctaggataatttgaagcacatggatggtctagctgctttatgtgaaggttttgtagtttcttaaggacttcattatatagcacatagtcgtaccttgtgtttcaaaactttaaatagtactctgggttactttattgctgttaattgggaaaaattgaatcagtctaatttttcactttg

SEQ ID NO: 2019 - DNA, 277 bp, Zea mays
tggcggggcaggcgacggtgagagtggcggagaggagagcgcgcgcggcgcggtcttatcccattctcggattctccatctcattgaagggaaacagaaattcttttctgcggtgacgatttcacgctgcatcaatcgtaaagcctggaccacttatgtagttttctcctttggcaggggcatttttgaaattggtcgtgagccgctgccgcacacggcgagaggaatagggttgctccccccgttgccgactcgccgccgcatcgccgcgagcgtc

SEQ ID NO: 2020 - DNA, 828 bp, Zea mays
tgctctctatggagcgcggacgatccgcggcacgagcccggatggtccgcgaccctactgtaggatcgggtctcctttgctcgctggtaagacggttgacgctctagggctggatagaccatgcacgtagagggtcgaagaaccctagatctcgcctacccgagagggaccccattaggaaggagagttccagaaggtgcacttggatcagcaggccacccgggacgtctctagacgatgtagagtccaagagggatggagatccaaggttaagaaaagctaaactaggtctaaattacacttactcctaatgtgacaaagaatgaagtaaataaattacatttgattttttagtttgattgttggtgcgcgcaatcggccgcaccccttcatatatataggggaagactggatctgttcgaccgctcctagacattttccaatctaatacttctatttatatggataaacacgcccgaccaacggaatcaaaccatgtgatttgatctaatcgcggaccgtccgtgcctagatacggaccgtctacggcccggactgtccggcctcacctggtggtatatacggtgctaatacaattgttatatgaatgtataaagaaactaaaataaattttaatttaggacaaagggagtatattgtttagtcaaaaagttttgacaccaaaaattactttagtcatctatctcgtctataaatagacatcttgtgcaccacacctacacccacacctacacctacacattacagccagtactgctgtcacctcacttagcaaagctaatacgtatgtcatagcagcttgccacc

SEQ ID NO: 2021 - DNA, 1500 bp, Zea mays
attcaaagaaattcaatgtatcagcgtccattttttttggtttgcgatatgttaatatgggttgcgattcacaagtttaactaagggagatgctaatttataggtgcctcaaaagtaatcatctctcatgagaccctttactgacgtcgaagttgattgaatggctggatcatcgcctccaacctttggtgactgttgctcgcatccggcgtcacctgtgcatggtcgcttccatccctcctccggccgtcctagcggcgaggacacgaccagtcatccgcccaycgcctcaaagtctcaaacaatgacaaaatatttggtttgtgctgtcagaaaaaacaataaagatatatatttctatagttacacaaggtcaaaattatggtatatgttcataccaaagaaatcaacaaattttaagtgtttctatagctaggcaaggacaaaactcaactatatgttagcacagaaataattagtatttataattgtttatatagttagataaagacaaagacatgatatattatgacaaaaaaacaattaacatcaaagaggacaacttacaaagtcaaatggtgtcaaatttacccgttagcaattaaaatgacaaaccacaagaggtcaatccgtagttaaaaaatgatatgattatattctacttgtgcaacaacatttagacgcctaatatataggagtaagtgtaaaattaatgaccaagaaaaaaaaggtgagcaggcacggttgtttaacggatagaaactcgaagcagacacaacaactttaacacagattttgattatgcaccaaaagtaaaaacaagatatggtgatacatcgcctggagggactaaaaaaatcaggcaactgatagataagaacagtgtttaacaaaaaaaaactcggtaggttcagaaggatcttgcaccatcgtagcgtttctcagttttaaactggtggccggtgtcaaaccaaaaccacgataaatgtaaacctgacgcctttccctgctcaagtcaaaactgtctcccttccatccacgcggcagtttgctaaacccaccccgcccgccggccgccgccgccgatccactccccgcctcttccccttgacttccccggccggcagaccagtcaacgtcacctccggcagctggctaacggcgtgaccttcccaatcaccgccctcctcgtgcagtctccgtcacccgcgacgtcacagctgcggcagacgccgtcccacataaaaccggcccacccactcacccaccctcacaattcccctcccctgtcgtcgtctcccctccgctcccgtcgtctaccacccgaagccccgattcgaaaccggcggcgttcgatttggggatttcggcgtctcgctccccggaatttcttggatctgagtctgtccgccgtcttcgatttgcggctgcagtgagcctgcgagttttccggctctgatttggtcggggcctcccccgccccggtcttcgatttcgggg

SEQ ID NO: 2022 - DNA, 115 bp, Zea mays
ggtttgaaccttggttgttggctccacattcacacccacctaaccaatagaacacacatatttttgtgtcttattaaaataaagtctactcatatgatatataaaaaccgtagca

SEQ ID NO: 2023 - DNA, 164 bp, Zea mays
tgcagtgatttcatttgcatgcatgtcctcccaacactcgccgtacgttaccattatcatccttgattcatgtccacatcatacatggctcactagaatgtaccagtatctgcttctgctctatagaactgtgagcaagagcaagccacgtcagttgtagtgcc

SEQ ID NO: 2024 - DNA, 1500 bp, Zea mays
ccgcgaactatagctctgtcaaggcactgtacagtcgaccgttgcgttgatagccgttgctccgcttggtgcacccgacagtccggtgacacatcggacagtctggtgaattatagcgaagcggtagtccagaaacccgaaggtgaagagttggagtcgatcgaccctggtgcaccggacaatgtccggtggtgcaccggacagtccggtgcgccagaccagggttctcttcggtttcttttgcttctttcttttgaaccctaactcggatctttttattggtttgtgttaaacctttagcacctgtagaacatataatctagagcaaactagttagtccaattatttgtgttgggcaattcaaccaccaaaatcaattaggaaattggtgtaagcctaattccctttcagttacaacataggctctcctagacaaaacttagacagagactctcagctctcaagcttccacagcaatccaacacagtggagtagggtattacgttccggcggcccgaaccactctaaatcctcgtgtgttcatgtgctcagtgatcacttagcaagacaggcaaaacgcttaagcccctttctcatcttaggatttagggcaggtgcattccaccacccggccggagaattccctctccgacaattggcgcgccaagtagggtctaggcattaggtttttgcttgtttcctcgctcagcatgatggtgcaaattgtggagcaccgctgttgggggccttcggcctccgaaggtcctcaaaaacatgatttgacaatgttttccaagagaaatatgtaaacaggtaccttcgaagttagattgcgggtatacaaaagtacggttgaagacgaagctcgaccgggacgaaaggcgatcacgacgaaggaaaagacgatcacgaagctatgtgcagaaaagctttggtataacggcagaaaaggggaaccgacttaaagatgaaaagccaaattagaccttgaagaattactatagagttattgttgaatgtaatggatattaatgtaattttgcatgggctgtgacccgtgcctataaataggtgaacagtattcccatactgttcacgctgacttggcatttgcttttgcatcacacctgtatttatattccttcaagccgaaggtatatttgtaatttactgttatctacatgagtaatataagtagaaaataaattaataataatatttacagagattatgttatttcttatattctgtgtttaaatactctttatcttttgttatgttcatgaaggtttgtccttcatgaccttcgtccgaaatccattatatccgaagggaaataatgatccaaaggacgaagggttttgatatttaacatcttgtgttgccttgttcttgattcatagcatttgagaacgagtccccaacattggcgcccacctccggtgaactcacttccatttctagagcttttgaacatcttcggcaaacatcaccttcgtc

SEQ ID NO: 2025 - DNA, 59 bp, Zea mays
ccggcgtcccatctggctcgccccggtaaaacaagtaatgatggcaccctgcgtgctcc

SEQ ID NO: 2026 - DNA, 1500 bp, Zea mays
tatcttatgaaatcaatattggtttaattccaagcaatctttgcacctaccgtaggcaaactagttcaattatgctcttatatttttgctttggtttgtgttggcatcaatcaccaaaaagggggagattgaaagggaaataggctttaaaccttttcctaaatgattttggtggttgaatgaccaacataactaattggactaactagtttgctctagatcatatattctacaggtgtcaaagattcaacataaaaccaatagaaagaacaagacaagggtcaagagaaaggagcaaaggggcaaccgaaggcactcctgggtctggcgcaccggactgtccggtgtgccaccggacagtgaacagtacctgtccggtgcaccaggggactaagactcaaactcgccaccttcgggaatttccagggcgactcggctataattcaccggactgtccggtgtacaccggacagtgtccggtgcgccaagggaggtcggcctcaggaacttgccagcctcgggaacgcaccgcagccgctcagctataattcaccggacatgtccggtgtgcaccggattgtccggtgcaccatcggagcaacggctatttcggcaccaacggctacytgcggcacatttaatgcgcgctcygcgcgcgcagaaggcaggcgcgcccattctggcrcaccggacaaggaacartagatgtccggtgtgcaccggacacccaggcgggcccagaagtcagaagctccaacggtcagaatccaacggcattgatgacgtggcgggggcaccggacatgtccggtgtgcacctgactgtccggtgcgccatcgaacagacagccttccaacggccacttttggtggttggagctataaataccccaaccaccccaccattcattgcatccaagttttccacttctcaaccacttacaagagctagacattcaattctagacacaccaaagagatcaaatcctctccaattccacaaaaggctttagtgactagtgagagagatttgccgtgttcttttgagctcttgcgcttggattgcttcttttctttctcacttgttcttgagatcaaaactccattgtaatcaaggcaagaggcaccaattgtgtggtggcccttgcagggaagttttgttcccggctttgatttgagaagagaagctcactcggtcggaaggaccgtttgagagagggaagggttgaaagagacccggcctttgtggcctcctcaacggggagtaggtttgagagaaccgaacctcggtaaaacaaatctgcgtgtctcacttcattattcgcttgcgatttgttttccgctctctctcgtggactcgattatatttctaacgctaacccggcttgtagttgtgtttatatttgtaaatttcagtttcgccctattcaccccctcctctaggcgactatcaattggtatcaaagcccagtgcttcattagagcctaaccgctcgaagtg

SEQ ID NO: 2027 - DNA, 193 bp, Zea mays
ctcccttatcctttgatttataaattggggtaaaatacggtattattattactagacatctcagctctctggaccatcacgtgtacaattgcgaccgctatatatcaacaaatatatgccatgagtgtgcaagtgtaagttgtgcacacaatatacagggcggttttgtcttaagccagcagctccccggccg

SEQ ID NO: 2028 - DNA, 443 bp, Zea mays
gtgatacacagaccggtagtctagacggtcagcagtaataaaacagaatctcgatactaacttgtttcgacaatttccattaactcggcataaatttataagtcgggaccggctgagttggttatcttgtctycatatatttccaaccataacaagcaccaggtcaccaggtcatcaagcaacaaacatatttatctttcaattctttttttatcaacagtaaataagtacagcaaaatcacccccggaaattcctaatcccaacccaaacagcccagtcgaatcgccccggtccgcaagagcggtcgcatcccaaagcccagaaggcccgaaccccagcgagacaagcccagagtcggtcgctgaaccgctagacgtgcccgcgccagcctcggagaagaacagtggccacgacggcggcggcggcggcggcgacgccactg

SEQ ID NO: 2029 - DNA, 974 bp, Zea mays
tgattgtgcatattgtggataataaaaataaaagtatcaatagcaacgtattaatgtgcccacaacatccaaaccctaatttgaaaacaaaaccatgaaaatggagaaggaaagaaaggaatatcatataatacaaaataaatttataaatatataacttcatcacactttggtataaccaagtagaatattcaaactgagtacaaattctgctgtgaaattgaattcaaattctagattgaaaatttggattcaaaatataagaaagaaaagaaaataacagcaaaagaaaagaaaaagggataaaaagcctacctgggctgtgggatccaattcggcccactttactgttttccccgcgcagcccgtcatcctgttccacaccgttttgctggtgtcgccgttgtgtggggctgtccgtgtcagcctcgcggcttactcaggggcgccatttacctctcactgacacaggggtcgactcgtcagatcttccacctcccaacagaactgatgccgaagtcttcggccgcgtgaccggcatccgcgatttggacggcgccccttccaaccgtctaccctaggtacataaaagggtccagccgcatcctcccttggccattggggcttgtaggagtagcttgccatgtgaatgagggcgccattaccgggcacagggaggtgggatgagagtgaaagagtcgtcgcatggatccggccgccgaccccctacgttccttcgccgtcctcgggctggcggcaaccactgccgcagccaactccggcttcgcggactccaacccgatccgtcctgtcaccgtccgcgcggcctctgcgctcttccaccgtcttcgtcgcgctcggccgcacccgcgacgcgcttcgattcgccatcctcgatacacctggtgcaggcctgggtgttgcgacttgccgctggggggttctcgtggattcactagcaaggttaccctcgg

SEQ ID NO: 2030 - DNA, 649 bp, Zea mays
tgattgtgcatattgtggataataaaaataaaagtatcaatagcaacgtattaatgtgcccacaacatccaaaccctaatttgaaaacaaaaccatgaaaatggagaaggaaagaaaggaatatcatataatacaaaataaatttataaatatataacttcatcacactttggtataaccaagtagaatattcaaactgagtacaaattctgctgtgaaattgaattcaaattctagattgaaaatttggattcaaaatataagaaagaaaagaaaataacagcaaaagaaaagaaaaagggataaaaagcctacctgggctgtgggatccaattcggcccactttactgttttccccgcgcagcccgtcatcctgttccacaccgttttgctggtgtcgccgttgtgtggggctgtccgtgtcagcctcgcggcttactcaggggcgccatttacctctcactgacacaggggtcgactcgtcagatcttccacctcccaacagaactgatgccgaagtcttcggccgcgtgaccggcatccgcgatttggacggcgccccttccaaccgtctaccctaggtacataaaagggtccagccgcatcctcccttggccattggggcttgtaggagtagcttgccatgtga

SEQ ID NO: 2031 - DNA, 449 bp, Zea mays
tttaattgttcgattttgtattaacccggacacaaataaaaacaaaaggaatctcactgcaggcatgatagatgtgccatgcatccatccacccacccatacaggcacacacaccatgcatgagtgagcgtgaaaggaccctgaggcatggggtgtgtgtgtgtgactagaatgcgaggccactgccccatcccatcaggccggtaaacggtagtgcagaaggcagacaccatcgatcagttgagtcgaccagcatcatgtgtgtgctgcctgggcctggttgatggggtcccatctagtttggcagatttattagcagcatatggatctattcgcatacagccccgtagagaaaaagaaagaaccaaaaggcattcagcaaatcgccaaactccggggttgcccccctcccgtgcccctagctacctaataattgtgcgctcctattc

SEQ ID NO: 2032 - DNA, 960 bp, Zea mays
agggaccccggggtcgaaacaccgacacccctagattatataatctatcttaaataagggtgtgtttctttgtctcttagattatataagttggattatattggaggatacgagggtaaaatatcactttaggcttaccctcctaccttctcactacaatgtagattatataatctatgagtgaaacaaacaagacctaaggcctaagttaagagacaaacaaacaacataaattactaagataattatataatttatatatctagactatgataattcatgagcagctcattaggtgcttatataatccataagctagattatataatcctaaaagcaaataaatagggccttaatccctttcagggcatgttcggttttatccaaatcgaagaagattgtgaagaattaaatctatttctgttcaattttaactagaaattgatttaattatcttcaatccctttgatccacttagggtgtgtttggcatgactctgctccaccccatagcagctctactctaaaactctgagtggagcagctcttcttgagaatttagaatgtttctcataaacggtggcagtggtgggtaaataactcaaaacaccatgacgaagttgcctttttagagttttcggagtagcaaaagaggtacttaaagaaattgtagtgcatctttaaaaactctaaagagtttacaactctggagctagagtgtttagcgaccagcttttccttgaaattttgctctagtgtcatgccaaacacgcccttataacggaacaagcttttatagtcttcttaagttcacttttaaccgaaggcctaaaggctggttatagttccgaccgccatctgggcccaacgacaaaccctaaacccttttcctccaaattcacgcgagctccaatctgtgtgggtctccgtcgtcgtctctctcctcccggccgccggcgcg

SEQ ID NO: 2033 - DNA, 357 bp, Zea mays
ggtgcgtggcctaccctcaccaagaccaactacgtcgagtgggccacggtgatgagggtacggctccaggttcgccacatgtgggaagcagttcggtacggcgacgtcgactaccacgaggatcgacgggcgctggatgccctcattgctgcagtcccgcccgagatgcagttttctctttcccagaagcggactgccaaggaggcctaggacgccatcgctgcgacccgcatcggcagcgaccgtgctcgcaagaccacactgcaggcactttgcaaggagtgggagaacctggccttcaagccaggtgaggatgttgatgactttgctctccgcctcaacactctgttgtagaag

SEQ ID NO: 2034 - DNA, 1500 bp, Zea mays
cttctactagacaagtatatatgaaacagggcctaaataaaatattgcattggtgtatatatggaactcttctttctttctctgggtatggtttgagggagacgaagggtgagaattggtcggagctagcaagtagggccagatgaaatactcgtcggtttggctcggtacctttgaaattttttacgagctaagctaatataccggctcgatttgttaatgaaccaactttgtttgttaacgagccgactcatgagctaacgtgtatatgaattatgaatttgtaatgaattgatgagtagtgagccgtgttaacttggtgttgaattgatgtggttgtgttaacttggtgttgaattgatgtggtccgtaaaatcgtgagctatagttactatttttgttgttaaactgatttgaaattaactagaaattgatttttatatgcatacggtttgaactcaacaaactgagccgatttaactctctgaatcggtttcttagcaagccaactcaaactcgcaagatccaagccggtctgaatcaatatttagttctactagcaagcatgaccatgcgtgcggccgaagagaaagagagtggaccgaagtggggcaaggacggagtagacgcgagtagggagagctgatgagggcgggtggggcacggctggttgatgcaagcgagcgaagtaaacgatgttaggaagtagagttcgtaaatgaaaaataacgaatcggtatatatctaataagtgttggtagagatatatcggctccattaaacttctttaacaagcttggcgaatctagtcactacatttgtttgtattgggtgaatctagacttggtggatctgaaacgtttaaccaacttttttgtagagtaaaattgttttcgattttagttggtgaagttgtctgaaacataatctaacaactgacaatataaaggaagaaatggtttaggattatagatctatattaaaaatgaattgcctaattttctgtcccttcctttatggcgtaaggatcgttttagatagtaaatagtagtagagttgagtttaaaatagtaaatacgatagagaatgacatagcccatgatacaaatggtagtgacaagggagtgatcgctttcccttttcttttttcttcctctgaatctgaatacgatatcagaaaagcaaacgatgataacattgttgttagtaggtacagtgcgtactagtggttttggtgtttgggcagtttggcagagggtagggttcatttcactcatcacggaccgaccggcgaccgcacccaatgcaagcaatttttgcggacagggggaccttcctcttcttcttcctcgtccccggcccctgcccctctcccctgcggagacggagcgccaccttcctcaccttctagaaagaactagaaccctccctccagaaccttgaagaccagcccagaccagaccagccccgaagctctccgccggccccgcccttgacgac

SEQ ID NO: 2035 - DNA, 1500 bp, Zea mays
acagacccatctaacccttgcttggacctctactatcaaaattatccaaggtagcacaggtctcggggcaccttcaacagtttggtcccttgcttggatctytactatcaaaattatctaagctagcgcatgcctcggggcaccttcaatagtttggtcacttgtttcgtgagatccaccaatttgtatacatgtataaaaagcccgcagcttgatagcccgcacagaagcccactgtcttggcctggcactagcccgaccctgytcgcttcctaccgggctcgagccaacctgttacggaagggtgtgacgtgctcgggcagagaaagcagcccgttgggccagctcgtcatccatctgccatatataaaatcccttacatatatataaacacttttttgacaggtttacgggtccaggctggcatgaccttatttttttyttgtttactgggctgggcctgggccgacctattaaagcccgcagcgtgctaggctcgtacccgcgggccttcgaggtccggtctggtttcgtagctgtgcttggcggaccgtgcttcttagatgtggataagtaagcttgcatagtataactgcgaygtgccctcgagtgtaacagttttgagacgaggtgtacgtcaacgtgcatgtgtagtcaagctaaggaagtgcacgctacgagcacatgctcctgctaattattaacgtcgcgtcacgggggccatgcgtgactccgggaacatatttaagaagggacgaagaaaggacggaatggtcgcctgctgcgcgcgatctccaaacgggcaaccaaaaaccatacgcattaacctgtttccggtggccgccacgctaccagactgtctccctccatcaattaattactcctggacctggtatgatatgataataagatcattctcaatgcacttcaaaatgtcatgtcaatatttgtctaggaaacaatgtatatccagtttcatgatatgatatgatatgatatgatatgatatttgttcttaattttgattatattctgtaagatgtgagaatccaacttgtggagattcatcacaaacgggaatacactataaggaagacaaccgtgatactcaaggttgatctctaaatcatttgataggggtcgagtgcaaccctcgtccattgagacgccacaacgtggaggtaggccttaagccgaaccacgggataaatcaccgtttctcattgtctacttactttcactgtgatcttttcttcctagctctccacttcactttcattattgctctagtttcaattcacatcttgtgagagcaattaattgaagaaatcctccttctattctcaattgaacttggttttagatttcactaaccccatctatagaccaagtttgttgattttagttaagtttttgtaggatcacctattcaccccctctaggtgctctcaattggtattggagtcgttctgttcatcaagggactaaccgcccgaagag

SEQ ID NO: 2036 - DNA, 269 bp, Zea mays
ttgtttctcaacaaaaattatacatctgtcgctacctaacgccagccaagtttatcctgaaacgtttacttagggtttaacaattgaaggaatggttaattagtggatgtcaaagggatcgaaagggacattacccacagtgggcaaataataaaactggcaactctagcccgcgacgcacggcgccttttcttttaaatcgccaaagtccaacaccggcgttgccacccgcagctctcggcttcccaaacggccaaacgtggaccgtc

SEQ ID NO: 2037 - DNA, 147 bp, Zea mays
agagaaatgaaggaaatggaaaccaatccaattatatggaatttcaggtttcggtaggtgaacattgtgtttctccttgtactttccacatccatatcctttgctcatcattccaaaggtgatttcctcgcccattgtgaattatgt

SEQ ID NO: 2038 - DNA, 898 bp, Zea mays
gtaatgtattgcataaaggtaataaataatactgtacaattaccttcaatccatgatccttttatgccatcatcaatgcttcttctaattgtagtttagcccaaaagcatagaccgaaaattacttcttgtaaatttacttcttgtaaattttaaagtattataggccttctttaaaaattacttttcaaatacatatacggatatagtataaggaaattacttcttgtaattttcttttgcactatagagaaaatatagcaaatgtgcaaaggtgatataaattgacgattcaaatgcttaaagcttaaagtgaagaattataataacatgctaaataatatataaatgcataaacaaggaatatatattttttatcctaattatttcatgaaactatttctcattattttcatggttgttcttgaattttatataattcaagaggtagaagaaaaatcaaataattaacagtggattagacatccaattttcggtcaaaaaaaggggccatttaaccattctagggtgtttttagggtttcccatcctgttaccctttttttctttccttcctattttcggttcgtgcaaacttggggcggcggcggtcgtgcctacctacctccgaggctgcggcggcggctggcgcgcctgccagccttcggggcggtggtgcccgcgccagcctgcgtatcttcgaggtcgtgtcgccggtggcggtcggtgcctgcaggctcgtgtgcccatggagtggcagcggcggcagtcggaacgccgcccgcggaatcagccgcgcctacatattcacttgcaacggcgcaggtggcttaacctgtgtgttcgtgctcgtggcgcagtggcttggcttgcgcgcttgccgcgggacggcggcggcgc

SEQ ID NO: 2039 - DNA, 1500 bp, Zea mays
tcatattttttttcttgctgagagcatgtttatctcattaattgtaattagtgatcccatctgtataacatcatcccactaattattgccgagagcaggtttagccaacacacgcttctttgtcgaaatcgtagtatgaaatggatgagggatgcttgttttctgatcgttcacactcgatgaggatgcaatctactagtgcagtactatcttttaggtaggaatactataggaggcggttgctggctgctgctgaagagtcaagaactcaagatgacccctcgcgcagttcatgcatgggcagcgcgcgcagggctattctgaaaccatccacagatgtcgcaatcaaccaaagcagcagaatgtcatccatagtttccacttgccagcagcacaagggcagatgccgcagaagattctaaacacctcgcctttctctctctctctctctctctctctctctctacacatgcacacttagcttttccatctccttttctcctccacccgaaatgattcaatttggcaaattttttctctctctctctcactctaaaaccgcccatttcccggctataaatggcccctcctccaggcttcaattcccttttcccctcttcccgagctcccttgctaggttaccacgttcttctgcccttcaggccctccctcatctgatcatctctctcactctttcagtagcagcgcagttttgttactgacacacgccccctgtcctgcctgtctgtgttgacctgatagtactagcaaagtttggagactccatccaacctcttgtctctgaaacttggacttgttgccgatcccaaggggaggttctgccaaaatttcggcttctgaacatccatttccagaggggatcgagggaggttctgccaaattttgctcctttgatcataagtttcccagggggaggttctgccgaaatttcatctcctgtgctgtgacgaccatcagctttccagggggagattctgccgaagttttgtgggctgaccatcagtcttccaagaggaggttctgccaaaatttttcttctctcactatcacttctccaaggccaagcagtcctcctggtcctgccgaagtgttctctgaacaagagggcatgcatgcactccttcttgtccctgatgttagactagctagctagcactagcagagactgaggccgcagcgtctgttgagaattcagatgttgttgttgctcgtcctgtccgagcacctcctcctgtccggatttatgatcggttccgccataacccgcctcgtccagtccttctctgtcgttttcctctactggttctatgtcttctcagtgagctgccactgccagtagtgccagtagttgatctcacctttttcaagttaataactcggcactataacaaagaggtagctaggtatatacctgccaaacaaacaagagggagtgaaaaaacttcagattacgcctcagtttgtgagctagaggtgacc

SEQ ID NO: 2040 - DNA, 268 bp, Zea mays
ggtacttccttttacgccccattcttttggtgaatcatgctgctggttgattcgggacatagcatgtattcttgttgtgttagcaggaaaaaggacttataattccaaggaatgcaagcagagtggaacaacttgaaaagaattctggtactgtaaaacattgcaacaacgtgcttgatgttatggacacacaaaacgtagcaccacctaggcaaaaggaagtagctgtgttaagtaccaccactcctggctctgttcttgataagcc

SEQ ID NO: 2041 - DNA, 534 bp, Zea mays
aagaggcacagccacaacaccacccaacgatcgttggtctctgatagttccttcctgcgttccttaacagaaacagactgcattgttgtgtaagcctacagtagccagattcctgcacatttaaatttccacaaacaaatagtagcctctgtgttataaattctgctacaacatttcatcctgtttcacccttgaatggacctgtgatgtttgcctcgtcgtgatatgaaggaactagaaaaaccacctttcccacggtccgggttcacgggagagcaccagcagaattacagttattaagtggaggcccatttggaagcaggctagccaagctcaccacgtgcaaatcagtgtgtgtgtttcttgggctgcagaaattggggcagcgtagcccaccgcccccaatatttttctccgtccctcgttttcaccagtctctcttctctgtctgtcttcctccgtgcttcccggcgcgaaccctagccgagattagattggaggcgagcgccatcaccggaggaagagggcgacacg

SEQ ID NO: 2042 - DNA, 1500 bp, Zea mays
gaggccgctcgcccgcccgcacgccattgctcccgtcgaggtaagcgcgccgctccccttggaattcctcctgtccgttcccgcctgaagtcctaccgagatcggaccttttggccgccggccgtgaacctgggaacggagcaaaggcgggatcttgccaaccctggcggctccggcgccttctcttgccttccaggccgtttcccccctcctttttggttgacccatggctggattcatcagtccgcttagctttcgtcctcgttcatcgttctaccggtggttggtccatctgttagaggccccctctggtatttccacttttcatacccaaacagtgcgggtagggttcttgatatggctcggtgcgtagtatggcagagtagagcaaccgacatctcccgacaggcggggtttatcttcttttgccttttcgtgtacccctttccccttttgagttcaatcgtagcagcagcagtggctgcttgctcgttttctctctttattgtttttttttattattactatagatagaaaagcgtgtgtgctgctggcaatctgctttgggtgcctaatgcgatggaaagcgaggtccccccctccttgtggagacaatctcggaggcgcggtcgacggcttggcagttcttgccttcagcagttcttgtcttcgtctccgcactccagagtccggacttcgctagaacaagtggatggttttttggctactccatatcaattcctggcggcgttttttttgcgccttttgtttctgcttttctctttcaagaaagcacgtgatgcccctgctcgacttcattttcactgtcggctaccaaaattgtgtaggtccaccctaccttattccccgagacgagactactatcattgcgagtagttgtcatgtggatttatgcccaatcctgtgatgaaagtggggaatttgtgccgtcccttaaccctcatggcagccctgatttcatattgtcaagtcaccattgtctttgggcagctcaagcaagagaggggaggagacctgagccatggcttttgtagattcctcttatccgttttatttctatatcagagtatcacacgcctcatccaaatggctgtattttttttttcttcgtatagctcattggcggcgaatacctattctacaacctttcacgattcacaagacactataaattcaggctgctttgtttgcgtggctccctttgcgatcttgcagaatctattcctgaggaataacaggctgctccacgacttgctgtttgttcacatattcgctattttgaccaaagttgcctccatccattgtatcttgattctcgaaacacactcacaggatggcatgctttctgagtcttcctgagatttcacgccctacagcttggttatcagccctgaagctcatgttcgctgactcgctgcttctcatttttagggtcacaacttatcctacacatcgtagctccgcgacctgttcggcaaa

SEQ ID NO: 2043 - DNA, 473 bp, Zea mays
ataagttcattttaatgagttttgagtcaatccaatgacccagagagagaacttgcatccctactgattgggaaaatcagcttccttcctgcatgttgcttctccaaagttcagttcagagatgaagcagaccaagtaacagctttgacattataaatagtagaagtatgtctgatcttgcaagtttttaaccctaaaaattatccaatggcactgacgagagctacgttctgtgtactcccgtagtttcgacatacagtgcacctgcttctggttattgatgatttgcgaattcacctcaggattttttttttcaaaagtagcatgactgcatcatacagatttgattctttttttctgcctagtctgtaatctatcaactttgctcttgttttttgagtaaaatttattcgtatcactgatgtcttgaatttaatcacctagattttttcttcctccaggccattccaggg

SEQ ID NO: 2044 - DNA, 1500 bp, Zea mays
gtagattttttctaaatttttcatggcaacatcatcatccttctgcaccaaaattgtagacctatcaaccatctttacttttgctatagcagtcctagtcgaattcctactggatttagctcaaatccgatctcaagttcggccaataccactggtggccatgtttcagtctaaaaaaccgattgacaccctatctttggacccaattttctcaaaattcttcatggtaccaaggcatgatctctatagtaaagttattcccttttcatagatctacaaaattgatgtggtgacctagggcaaaaactttatggtttggaagttacaaagcttcaaagttgagccaactacactgaatttcagacttagttccatagggcttaagtggtactttttgcaaataggtccaattcataactttttgacttaggaatcctcacatatgtgaactttatgactttaggtaccctaataccttggtttttgcacttgagtccaaaagtgcactaattttgcacttagccccctagggtttaagtttagggctttctaggtttccatttagggtttgtggtacttttagggttttaatgccatccactcattgtgatattttatgattattataactaaactttggagttttctcttggttaaacttcggttatccctttaagcccaatctagggttaaatactctatcctatggtttggttcataaaatgtcatatcaatacaacttgtttgaaattttacctagtgaatgaattttaggtgtaacaaacacacgaaatgcaatgcttatgttgttatgctcaaattttagtgacagtaacaccaagagtgttacaatcacaatgtctcaatgtcaataaacccaatattttcatcacacacgatttcagacaaacctcaccttgcctttgaaaaacaaagaaacacgaggcaggagggtacctcatcttgcctcctaaaaacaaataaagacaaggcgggaggtctcacaaaaaggagcaccttcacattcacccccacaccaggggctctatctgaacaccaccttgccttcgaaaaacaaagcaacacaaagtcaaaaggtctcagaaaagaacacacgcattctctcacgcatacacccacgcaagaggctccatctaaacctcaccttgcctttaaaaaaaatcaaagaagaagacatgaagtctcacaaaacaaaaagtgcacaccctgcaccagcagcgaatcctcaccaaaccatattcataaagacagttcgagaactgtctctccaataaagaaagaaaggtatcgtcaggtagcattgcggctcgttcacgtccgattagcagggtggcgagaagaatcgaatcagtccctatctgaggagcatgcatgcagcgatcgaccaagtatttatcttcgtttcattctgaaagggtagccagccacaccagcggcagcagagctagagctgttagctagccttgttgcaaggatata

SEQ ID NO: 2045 - DNA, 799 bp, Zea mays
cggctcggacttgttctgagcctcgagccgatctgttgcgagaccgagctaactcgtcgagttcgagctttttttctagccctatctgtcgttacgactaatttatatatttctcatgcattccatatatatgttccgcatgtagttgtcgatattcatgtcaaatttgtaaaaatatgtacgaatagaacaaagttattctgagcatcacaattagcattagatacagtatttgtttgcgcagatcggtggatgtgaggtggagtttgtggaaaatgcaagggacagagacataaagttttgcgttgcgtaacaataatgatttgacatggagaaacacggcatgatatgtctggcagtgaaagacatggtgcagctagagggttacgtcaatggaatgcaacggatcggagggttattgtttcaagtttattttccttgaaaattgctttgcatgtaactaccctacttctataaaattcgtagattttattcaaatactaccagtgaaagtttccgtgcatatgtcagtgaaagataggtttgaaaacaattcataaatctttcggtaggagtagtgtggagtgaaaagaaagtattgtaacacgcagagggggttagatgtaaaagctatgcgcagccaagggccaaatacagaggagacagagagagggcgtcgcgatcgcaaccgcccgagcccggccggtcccatcatcgacgccagtgtgcattattacgccccgccatcagccggccggcaactcgacagggaaaaggaagacgcaccgctagagctgag

SEQ ID NO: 2046 - DNA, 578 bp, Zea mays
ggtatgaaccaaccttgttttcctgcagtcataatatattggttttgctgtacacatgtgtggaaacctacttgccaaggttgtggaattcaaagctacttctcaacttttatttattcataaatcaaagtagagtttttatgcatgcccacttgcatcactttagttcatggcagaccacgattaaacctttttatgtttcacaggatacacatgcatatactttcccttttatgcaggtgtaaagtgagggctgtgcagcgtgttggtggatttcacatttcagagaggatagagaaagctctgcgtcgcttttttgaatggcttccgggaggataagctggtgtagaaggttgtggtggaggtcctgcctttttggcttgcaagcgaagggcgcaataacgagcaaccaagcattttgtagcagccaatccttcccgttgaaggacttgagcacagggaggtgagtgggtgtgtgctgctggagggctatgtcctatgtgtagtccctcttatgtctgaaattagtagtctctctggcagctttgtttgttttccttcatgtaaaacagatagcc

SEQ ID NO: 2047 - DNA, 341 bp, Zea mays
tgcgaggcatttcttggaattcttcctcactttgggatttggagatatctttaccactgtcggcccggtatggccggaggacagcatcaacttgttggcggtgccagtttagtgctttgtcggggtagaaaaataaagtaccttgacatccccctgaaggacagcattaaaggacggtgccttgagtggtttaccatggagaaccacaacaagtccctcctcctcaatcggggaggcagcccgacgttcgcatgcccagctagacagagtcccccaccggttcagagctaatcgagtccaaggtgctgcttgctgagatatgctcgctgtaatacaaaggc

SEQ ID NO: 2048 - DNA, 1500 bp, Zea mays
gtgctggttttaatttaagcgatactctagcagaattaggaaagctttggggggcaattatggggccaactttttggcccggaaggtagggaacctatcctcagtgacagtaaaaaataactctaagggctagtttgagaacttcatttttttcaaggaatttttatttttataagagaaatgagtttattttctttaaggaaagtagaaatctcttgaaaaatagagtttctaaactagtcctaagggggttagtttgttaacccattttttcaataggttttctattttagaaatgaaaaacgaattaattttctttgggaaaaaacccttaaaaatagagttcaaactagccttaaaaaaccacggagctgaaaacagccactgccagccgagcatcgttttcacgatcacctaactttctttgcaagattatgatgtctcgtctctgactctctgcactgcactgcactgcatccctcgctcgcgatcgagcgctgtggacctgcagctagccaggtttgattgctggccaaggcgttgactctcaaggaacaccggctttattattttaatattatgcgctgcaagtaaatgatcacggctcgtataagggtaaacagtaggcgcgtgcttgaacgggtcaaaggcctgctactcttccattcatgcagtctcccggtacgtatctatatcttagatacactccatacgagagtatatattacattcggcgtcaggtcaaacggaaaccaggggaagaataggcatgccagcgtccgtgtgagataagccagtttggatttccgttgtggttaggttaaccaattccgtcattttcctgacttgccagcggatatgatgaggaactacagtcggaggaaacctagcacgcagcaggaaagcgctgtcgattgtcagttaccgaagaatgatggcggctaaggatcaccgtgtgtgccggcgtatgacaacacgtaaagaaatatcactggctgtcaccgtctgcttacaccggccagctgtgccccgttgattgatggatctttctgacagccgacccattgctactacaattctacaaaaacgattagctcgaggttcctgtttcttgcactacaggctcagggcggattattctaataaaccttctggacgggctgtgtcgtcatgacttatgacttatgactcctacaaacatacaaactcttgctcgcgggcctaattcgtcagacacacaatgatccattgcttatcacccagccagaccaggcctgcaagagatccattgttgcaagggaagcccaacctaaggcctaacccgcacagggcatagtacccatcaattctttgctggcggcctaagaagaaggatgtgctccgccatactctcgatccaacaaccaggtcgttcagccgcagattagcaggccgcctgcgctcccaagctcctcctttcccctcagcctcccctcctctccggtgtacgtctccgtcgag

SEQ ID NO: 2049 - DNA, 150 bp, Zea mays
gctattctgcaagaaggcaacggagaagggagattggctagagaatttgaccctcgcaaacatatagaagcccacttgcctgttcgagtgaacgaatagagactgagcaatctgctgcagtccatactggttggtgggtgtgttggagct

SEQ ID NO: 2050 - DNA, 439 bp, Zea mays
ctcggtacccggtgaagtcgacctgcagcttgcctacttgtatgcgactctctgactccttccctcgcctatcagcttctctgatcttcgtttcgttcgtgccaaggaaagaagctgtctagcatcgatcaacgaagttgtagtaatagataagtagaatcttcttctgatccaaaggttcatttaaagatttaatggaaacagagataccagaacttaagaaggccatatcaattccagatgccaggccagaggccattatgggctgacgggcctttctctagggcccactgaaaaacgacgcctatacaccgcggaaagattaagaaaaaacaaaagaaaaaaaattaacggctcgtcggacctccacgaaaaccaagtccagcagacggacgcgaactgagaaaaatctcacgtgacgacgacggacgcggcggcg

SEQ ID NO: 2051 - DNA, 1500 bp, Zea mays
tttaaaatttatagtattttaaaactgtagtttttaaatactttatttctaaacagagcctaaagagtgtctaactgtatggtctaactatatgcagagacggagtacttcattgtgcatgcgagaagatcaaaagatgcaaagctaaagggaaaagtcagctgagctagggcagtctatgctagctagctttaggggttgggttgggttgggtagggcaggtgatccgaagaaaactatcttaattgtgttttttaagtacaaaagcatggggatgtccaaccaaactaaagcatttcatatgcatggagactagagggagaaaatctttagtttggatttgatgggagctgctggctggctgctgaccttggattcgagtagtcagtagagtgcatgcatgcatgcatgtatcgggcgcccggtccacctctccatggatctccacgcatgcatgcagcatgcacatctctctcctactaacaatcaagacgaagacgccttgctgcttggcttcaccttgactcaaagccaagcagcatcccacacagcgcaaagtccaagccgctacgtgacaagaagtccgcatatgaactcagccaatcatatatatatatatacacacacatactagcttatacactatatattggagctactccagcgagctctcggcaaagagtgaacctttgccgagtgtcagtacagtaaacattcggtaaagaatgagtctttgttgagtgtcattcggtggacatttgacacaggctccgtcgccgtcacttagcactataacgacgacttttctttgccgagtgttagacaaaagtactcggcaaatgaatygttttcgatagtgatatataattaattgtatatgcgtctgtgcatgtagaataagaatttgtcgtctacttctactagcgccacctaaccatacatgcatgcaaagttgtgtatgtatagttgtataggtatactgtggctccctttggcagggctccagtgctctagctcttctgaaaaaagtttcggcgcagacttcttggcttctccggaggagacgaaaccattttgcaattcgtttggtaaaatagcttctcttgtgtgttttttcaaatgatatacgtgaaaaacgtaagagtcggtagaaaccatattttggtgctctggctcttagcaataaaacactatttttttaatgaccgtttggtaaagatttacgataagctcgagctacggccgtcaaaaggggctctatagcataagggagggtatgcgtagaagagaagggagcccatgcccatgcatccacaaacctcagcacgcacgagcacgacacaggtaggagaggtagagatagagctagctagggaacagaacaaaggtcgcaccatgcaggcgctagcagtatatatataagcagcaggggctgccccgtacgtagtagccaccattccgggtttggtgctggccggtgtcgtacgactccggtcgtcc

SEQ ID NO: 2052 - DNA, 403 bp, Zea mays
gattcgatatttacatccataaagtagtcctaatgctgagatgttgctgcagatgtttctgtttttttattcataaataaacagctactacacatacctcaacatctatgctatttggccattatcagtgaaaagtacacatgtaacaatattccacaactgtcgttgttacggtcttaactagcttattgcaaagtttaagtaaatatatttgtgattcattttctaggttgctttgttcactgtattgaatgttattatgatgacattcagtgacttgctatatatgatggagtgctgagttggtggtattttatttaaaaccatttctttagtttggcattggcttgcatcctagtctcttagaggccaagagtttatacgtgtcattattctctttaaa

SEQ ID NO: 2053 - DNA, 135 bp, Zea mays
gtgagcagtttgtggaaaatagaacccacgtataccgagctgtccacgactgtcgtcccattggaaacaattccatttcactaggaaatattgaagtgtccttttcgctctggacattcccttccatgcacgtgt

SEQ ID NO: 2054 - DNA, 109 bp, Zea mays
ggtacgtttatttccaaattcacgctgctcctcctcctcgaccgatcgattgcgagcgctgtcgacgcgtgcttaattatgcttcgacttgcaaagtacaatcgggttc

SEQ ID NO: 2055 - DNA, 745 bp, Zea mays
atccattgaaacagataaatatatgtgaggcccacagttgctaccgagttgactaagattcagtttttattttaatttaaattcttcataatttatttagggccaggctgacagattctggaggaactgggacataattgtgctggctaatgtgatttaacaaatcagggaaattatttaaacaaaattgaatgggtaccttatgtatggaggcaatggattaaaagcctctctttgagctttcttcttgtcgctttcgcaatgtcagttaacaaaatgatttgtttatacaacaagtatagctttccttgctcctaaagttgccaattattgacgcttgaagatcactcaacatcctcgtcggaaaatcggagcttccggcgtccgttccgcttcagcaacactatctctctcaaaggttggtgccttgtctgcctggtcgcgtttttttcttctttcggatttgggtaaacacacggtaatccgtactttgtggactcaccaactccacgttacacaacccagccaaaaagcaagatttgtcataatcctttgagcctaaatcatttatttatttttggtttctctgaagattcggttcttcccagaggtgtgcagccactgttgtattgaatttgacatttctgtgtccgtgcaaatcctttttcctctcttaatcgcttgattgaaatcagttactagagactagacgctctgaaggtcccgtggccgtggatgcgaatcg

SEQ ID NO: 2056 - DNA, 172 bp, Zea mays
tgttcagttcttttctcatgcattagcagaaaaggctcttcaagatttttatggtcatgtgatgccaaaccctgaccaggcatctaagttgaactggtatcatatcgcatgggtgaaaagcggtcagtaataccttctggttacttaatatttgtcagtgatctagctgctg

SEQ ID NO: 2057 - DNA, 1500 bp, Zea mays
tctttggcgacgacgaggatagaagtgacatatatctggaggatagcggtcccatcatacttctatggaaagtgggagtggagcttttgcggccacacttcctagtggagtgcgggcataagtgcaatgcacttggtctcgatgggggtggaccagctagacatcctagcctgcaagtggagcctgttctcaaaggagtaacaggataccgacctcttctcctgttagtattcgttaaaaccattattttgatacgtacacacacgtggtgccgagctcgtagagcaagcgatcgctgatgtcctcgtagttaagcaagagggagcttgtgcaggttgagccacgcgaggcaggcaatggaggcatcctcgaggcgagttcagtcgaggcgcagacttcgcaagctcgagttcggcggcagtagtgggcgcaacgcgtccatcgtcggtgtcggcacacatggctcaatcggatccaacgagagcatgatggtggtgctgacttggtgggatttgttgtgccatggcgtccgttggtgggagacgagtcggggatggagatgcatggtgtggtgggatgatacggaagatgaagagagatgggcaaggtgattaatttattggagttatttcgtctgtatgtagttagatatctttatcgaccacatcaaatattacttgttgttaggtgagtagcgcttcgcgcgtgatttatggtggtgcaaacaatagaaacttgtggtgctatactgggacagagaagagttataggcatatcgagttaatttacaattcgtttgattttgtctatcctaagattatcaactcgtcttatccaaaaaattatacttattgttaacttttactatgataacttttagcgtatgatatactatagaatatctacagtagttcccttatctcatttctatatcatcctatattttaaactaaaccatgcaaacaatgtcatctacagtttgtgtctttattttacactatctattagagacggtaataagtatgattttgttttttttcttcatttttaaaattaaataaagcaaaccgtattttacactatctattggagacagtaataagtatgattttgttttttcttcattttttaaattaaataaagcaaaccgtttttaactggtaaaaagtcaaacgaattacgaattataaattgagtatttatgtatccggtaccgtaccaatggctatctttatacgagttcctggcgaaaaaactcacaactacactagttgtggcgactcagtcacacacagacacacacgactacacgaggcatggcacaatccgttgctgaatcgatttgtttttccttcgaaacgatcctgaaccctaattcgaatrcggaactcaaatttcggtttccctcgcgtcccgcccacatcctccgcagccgccgcagccgccgagccgagctccaagcggaggagaataggagagaccaccgatccgccgtcggag

SEQ ID NO: 2058 - DNA, 209 bp, Zea mays
gtagagagaagggagatgagaactcttcacttgagtccaatatctaggtatcaagaaggcccagtgggccgaacgcacccaagcaagatcctgcttgactgatttttttttgttgcctcgtacaagctgtagtataatcatgaattcctgatctggatggaattccaaaccaattccacaagctttcccaatcgccgctgccggcgcgc

SEQ ID NO: 2059 - DNA, 100 bp, Zea mays
atccttgttatcgtagtaccacgaatccgccacattgtggtatacactgtgatacagcattgctgattgtgaagttacaatttcggttagcatttcagtc

SEQ ID NO: 2060 - DNA, 321 bp, Zea mays
tgcagccggcatcaaaagtttctccgctgcttactcgaacgtatgtactgggcaattcctattttcatacattacataaaaaaaatggaggtcttatttatgattcggtgcttacaatggatcgtttctgcctcttgcagtgcgcgaggaagccatcctgatatctctgtcgtcatccccatcctagtagcgtagaaaccacctgcattttcattttgatctccctaatccctccggctagctgctttccagtgaccaaaagatatcaaagaccacttcccgtcttcctcccgtggctgtctgtcatctggctctgaaacg

SEQ ID NO: 2061 - DNA, 132 bp, Zea mays
cgagtgattagtgaagttttcttctccgtgacctcccgcccactgcgccaagccgccaacccaccaccacggcaccacccaggccatccgtttctcgttctcctgcctagtgcctcccctccctccttaaca

SEQ ID NO: 2062 - DNA, 534 bp, Zea mays
tttgtttttcctgttttttttttttagccgttgtattacagattttctttaaaggacaaaagctctcatatatatgagctgttgtaaacgctttaaacacctgatcttttctaaaatctacctttcaaatctggcgcatggccaatgatatttaatatataatcccctccatctctaatatgcaccatatattgcgactgtcacagtagtctagcgcaaggcgcgcgcattgcactaattaataggacattcttgttctgttcatcagcccgccatttgtcagacccacatggagatacagcctttgcccttccacgtcgacctctccccagctacttccgccgcccctccccatcgcgtcgcccgtctgcaaactgccgcctttgccgatccgcctccacatctccgcctggaagacgagaaacgaggaagacgatcccacctcgcctggaaaacgcatcccaagacttcaaccttcctttccggccggagatccgcttcgcatctccgcgacagatccgggcaaacgggccg

SEQ ID NO: 2063 - DNA, 1500 bp, Zea mays
aagtcatattgaagacactttatacatgctaagagtccaacacatcaagaagtagaagtgagatacaaagatgcaaaacaaaagtgaacttgacaaagttgagaggaagggctgactgaattggaagtgtttcacaaaatcaaatctactcaaactgacatggcttcaactctgagatgtagataattttataagctttccaaaaagtccaagatcatcaaaatcggagttcggagctaaaagttatgcccacaatacgaagtcggaattgctgaaaaaacaagagtagcatatgggatgtccggtgcacactggcctgtccggtgtgccaaatttactcaaactgatatggctttaactctgggatgtagagaatttcataagctttccaaaaagtacaagatcatcgaaatcggagttcggagctaaaagttatggccaaaatacgacaagcggacatgggctgtccggtgcacaccggactgtccggtgcgccatgtccggtgcgccatcttcggaagctccaacggctacttttaacggctagtacacgtggcatgtccggttatatttgagttggggtctatatatacttcacccaaccggccatttggaggtgtgggagcccaagagacataccaaggcatatggtagacatttccaagtgcttttacacccaagtgcttaatagaatcactcggtgattagcgtaggtgctttgcgaaatgcttaggttagttagaccgctctagcgcttgctctaggtgaaccctagttagttgagtgagttttgtaaaaccacacaaccccttggctcttgcgtgcgccgtcataattgtaccgagtggggcgagagtcttgtgagaccgtgacaaccgcgtttgtgtcacggccgccaccatgtaccggagggaacgaggcccgtggtgttttggccgaagctcaatagtggagacggcggggagcatccgagaggagccagaagcgaagcaccacttgcgcgtggagaaggccagtagctctctacggagttactcgacagaggtgcttggccctcgtgtgggcttctctttgtgtaggggcaccaacgaggattagtcgggaccttgcgcggttccggataccttggtaaaaataccggcgtcatccacgagagtttgcatctctactttgctctttaagtttctgcatttatattaagcatttaaagtttcaatcttgtattcatatttatattgtgtagattgaaacttagccattgcggtagagatagcaacacatagacaaaacctagtttgcacattctagtttgattatttgcataggttttgctctagggatttattagtggcctagtttagtaaaagttttagaaatcctaattcacacccccctcttaggcatcacctgtttcctacaagtggtatcggagcctggtttggctcatttgaaacgatttagcttcaccgctaaaagagccgatgctttttagaggaaggg

SEQ ID NO: 2064 - DNA, 402 bp, Zea mays
gggacgcgcacagtataacacatattttatatataagttatcgtattattatatgttcccgttgcaacgcacgggcacctacctagtttatgatatatttttatattgagtcgctacgcttctattttattgaaaatcaaacataaaaaagtagaaatgaaatcactctattatcttctactactcaaccaaacacaacttagacagttgttataaatcggtaaaattgcaatatttccccacaacagcagtgctgttctgtattcccaaattgccaccctgttctgcgtactcgtcgaaacgacgataaccacacgtctcgaaaccctaaggctgccccaaattgttatcccaaaccctagacctaaacggctccatgctgtgagaccaccaacagtgtcc

SEQ ID NO: 2065 - DNA, 1500 bp, Zea mays
ctgcctaggaggaacttgtttgatcttacgtgttttcaaatttggttttagtgaaaggccatcaaatagtcaatagtattcatacaaaaattgatatcaaattttgctcgtaaactaacaaccggccggctccgataaccgataaaccagccggctagcaagaccgatactgtgaacctagttcgtcctccagtctccaccaccgaacttgccatgcgtccgtccaaggtagtgtgcaagtgcagcccatacgacaccggaccggagtaaactctcgcctgccctgagctgggcggcaggcagatgcagctcctcccttcgcggaacgatacgagcacgcagtatgtggtgtggctcctgctgaagccgtcaggttgtttccttcttcttacctccaccccctgccgaaccgaaccatctacgatgattcattccactggcagtttttggcagccgttcggtcgggccgtgggccgtggctatctatctatcttattcttatctggaccacgttgcaccagccgcccaaaagtatccaccgtgacaaaacggcgaccccacgcccacggtgggcttcttccttcagtctgcagtgaggatgccgtgtgtacgcctttgcggcttgtggacgtgtcatgtcacgtcacgacaagtacagcgcagagcgtgaccggaggtggaggagctttgagccggccggggtttatatgctgctgcttcaaagcagaatggtggggattgcatagaagaaaagaaagaccttaatcacagatctgactcagaacttcagacagagatcaaactgatgctgtgaccgtatctgctgcgcaagcatagcgttttcgtttgcaatgcacgcttctaccagatggagtaaggacatcaaatctaatgtcaacctacggctgttcctgctgctgtccttgatcatgataggtcgttagaactaataagtgtcggcacggccttttggttattacactttttggttgtacctgtatgattgcctctttccaaatcactactcactacccccatcgctattcttcacgttttgttagcagtgttattagccactgctgacggatttgttgtggcccagccgtctcgatagtctcgaagtagatcttgtacacgatgaagccggaatgatggttgttgttgatcattaaggttaattagtaacacttttacaggtattagaacacagctagtctttccactcaacaaaattctgtccattaacgacctagggttttagggatagcgtcccctcagatttcgattaggtttgttcatgccagcatcacttcaaatgaaatgacttgatatttgcttgatgaacacagcaatccagacagcaagcagcgtcgttgagggaattttggatttcatgaactggttacctcttgagatttgatatttgcttgatgaactcaatgaacgaacgaatgagggataaaaggaacaaaaagagaagctacacacttgctgtaattt

SEQ ID NO: 2066 - DNA, 1405 bp, Zea mays
ctcttgcagccttaataggtagtatagattatgtagttttagttgtctcttttaattagaaaaccgttaaaaaaataagggatgtaaatatcctagaaaatgggtctatgatcaattttaaggggccgtttgtttttttcagaatagagacatgaaacaaattctaaccaatttacttctctaatttatataagttttgatcgctcttaaacgatttcgagtttatttctgtacaaccgaacgtaacctaattcttttgagcgacacatgtgtggttacatttttttttgaagtaatacttgcaaagcccccatcgatagagtggtggtggtactggcatcacgtctcaaatgcatcatgaccggtttcacgtctaacgtccctatatgtttaggataatgatcgtgcccgagttcatgtgggggtgaacttatatgatggaacttagaatttctccggtggatagtgtaaaatataggagaactgtatatgacattatttaacattatttactgagtgaagtttgaaatagtgtccattctccaagacctaataatcgtgctcgcaagttcatcatctaaaaccggattcaggtgggcgcgaacacagaacacaggattatggaaagaacaatgcccgtaggcataccgcgtacggattgaatgaatgaacaggctaggatgtcagtgtcccggtcaactcacctcaagggaattcgaccaaggggcctggagctggaggaagcaatggcgtcggcatgcccaagaaaggtgatgaccactcaagtgggggcgctcattcgccggcgccccacaatctgctaaagccgacggggaatactaacaatcgagaccaaaacgatcggcgcccgggccgggcccttccttccctctgcccgagtgcctgctggctgttgccttgccgcagcggttgctttgatccgatgcaacgtccaaaagcaaaagcaacagcacgtagtaggccacagggggacacgggggtgagtgagtgagagagagagagaggccaggcggctgctgcagcagagtgcagacgtgccgagacgttattccaagctcgcattgaactgctccaaagggatcccaaagcgccagcctttctcgcggcccgacgagggagagggaggatggggcggcagcgggcatcatcatgccatgacagcagctgagctgagtgagagtcggctcgtgatgaaaaacaaaatcgcaaagtaatcgctcggttcaaaccggcgccttcagctccccatcataaaacgaccagcactcccctcggtgcccaagagtgcgacacccaaacggccgaaccattttcttcgagggagagcgtggtggtggcatatatcagcagctagcagcttgagagagcgccgagaaccaaggat

SEQ ID NO: 2067 - DNA, 1500 bp, Zea mays
arcgcaggcaagaacataacaacgtaggtaagtctcgaggcattgattcaggcgctcggccaaaacatcgaattgtgggtgatataggcagtgctgcattaaactgagcatccactacatgggaacagttcagtacagaagtggcttgtgaagttccaatcaaggtcacacacgcagcgcaggccatgcaacatgtaaatattgtgtaggaatgcctttgccaccagcccaccactgatactgtgaaaggatggagaggaggcaggaggcacaaaatggccacacgcacttagtgagtaaatcaacgatgaccaagatgcagttgaagttaccagacaaaaggcagaccatattttatgatcattgaagacttattaacgactttcttctgtcattacaaggaaacacgcttttgcaggcatatcttcttatctttgccttgtaccttcattcgctgaaaacatgcttcaacctctgctcatctcagttctcatcgagtttttctttttcccctttcaagatgtaaggaactcatgttgctgacgcaacttaggacttaggagtgcattggttcctttaggccatctctaggagactgtgtatatgagcgtataaaacactgtagactaaaatgtttacagagtgaagtttaaataaggagtgagataacgagtgagatagtgctggagatagtcttaaagctataactccgtaggggcacatatttttgaaacaactaacgtgggccacgacaaattgggccggttgctggacttccgtgcaagcgagtaaactagtatcacacacaattcacagctttagtaggcatttcgtcggtgtataaacagcaggcagtagaaggctagcagtacagagcaacaaacagaacacacatttcttaccttcattcgctcaaaacctagaagcacccgcggcaaatcctacggtgacagcgtgcttcaactacggcgtgaccttcttcatcctgacgtcgaccacctagcggccgatgtttagggatgagcccttttgcagcccacaaaaaagctccaggtttcaattggcttcctaatttgtttaacttggctgtcttgtcaaatactccaaggagtaagtagtaaatgtgagataagtctaatctgacgcttgacttatctacatctacacaggtgggtggtagatagagaatagtatcaactatcaaggtgtatgactatagtgacttggcaaaatagcactgtatatatatatgttggctgatccgttccagtcaatggctgtagtgtggaaaggatgacgactatagtgcagcgctatacaagaaacatcccagaaagtccgcgtcaccaagccgcaaagctagaatccttccaccacagccatggtgccatcacgacacaataattgattgccactgattccagcaaggttctaataaatcttgtagatgcaacctcgctttgcctgccgccgccagtcttccgcctccgccacacacaa

SEQ ID NO: 2068 - DNA, 647 bp, Zea mays
caggtcacacgcttcacaaacccatgtggccgtctcaccaactcggtactgccctgcgccggtgcgcccctgcccggtgcgcacagtcagacccagagccacagcccacagccggaatccggaaccagccgtgccgttccgttcgaaccccgagcgcgcgcgggcgcacatgccactcgccacggcgcggtgccgtgcatttacgccgacgcgggcggcatacaccaacgaaccaagtaaccaacgctcgctggataattccgcgaccgctggcttgcttttgctcgaatgaattttgaatttgaatcgcgcaccggtcggtcgcgtcggcttctgggactgggagccagtgcggtgcgtttctctcgcctcgcatagcctctcgctccgatttatttattattactactcggccaacaaattccgaccgtttcccactagaaaggcagcctcttctgcctgccagtgtccagtgtgcgccgcttgccaccttccgcctttccatgaccacgccgctcctgctgtgtgatcctaggacgacgcgcctcccgactgccctcgcacgctaggagtggggaggggaggctgagcacgagcacgacacgagcgccgccaacgccaacgccaagacgagctcgcgaaggacc

SEQ ID NO: 2069 - DNA, 447 bp, Zea mays
ttggatttgctattgactgctcaagttttttttgttaatgacgactcaagtttgaagtttgctttttcctttctagttaagtgaaattttggtgtaggacactgactcaccttgactcctagagtccttacaggctttgcagccctgagcccagggacctttttttaaccaaccaaactctgctcacacctcagtcacataaaggagaccgggcgtccggaagcaagtaaccaaaagggcagtatggtaaaataaagtcgggtctcctaggccagtcatacatacaaacaccatcaaacggcagcccatcggccgtagtatcttgctcctcgccctccatccgaacaacagcaggagcccgagcccgaacccgatattccgcattcctacccagcaatggtggcccttgtctaggtggacgcggtgcaagaggcgaagcgggggccg

SEQ ID NO: 2070 - DNA, 1500 bp, Zea mays
attgatgttaggttcctaaattgtgcttatatttatgcaaattaatgtgcaaatgtatcaatactctagtaaagaatgaataattgtatcaaagtattcaacattatagacttgcacataagtagaaaaaaccattatgtgcaacgagaatttacatagatagagatatgcgaagacataatacgtgacacaagattgtgagctatacatactttagttggttaggtcttttatgatacaattgtggaagctgtcctctctggattctttgaataaccacacaaatgactatatttaaaaatattattcttataattataaataacacgttgcacatgtatgacaatgcggcggtcatgaagctgattacccatgcgatcatctgcttttgtactttgtactgtgtttatctttgaaaaaaacttagaatgcaagatttgcattaccacgcatggtcaagggttcgtcctgttgtaaattcataattgcattgaaataattaagtatgtttttagggcaataattaagtattgatttggatattactgtaaaacaagtggctccgagcattgatttggcatgaataaaaaccatatatcaagagaaaaaataaaatattacacacttttggaagtgcttgatcagtttttcattatcatttctatgaaaaaaatattgcttttaaatctatgacgtttccattatattcatgattctaaccactacttatccataaatcactgggttactatttagtttacattgctacgtttgcttaaataagatatttatttaaacaccattatattttttattttcaaattattagtatatgtatatatttataatatttcctctttatataacacatatagatatgagttgcagtggtggaagcccatcaatccatggaacgcaaaaggttgcttaaaacctttttaaaacaaaaatgtgtttctacagtaactgaaatgtattttaacttctacaccctttcatatgataaaatgtgatttttgttatggttggcaaaatcctccattttcttgttccatttcacagtttcacacacgtgatccacactccacatcaaatttattttaccaagaaataatgtcctatataaatctaccgagtctccaggattctgcatgctccattctcatccaaaattgagtcacacgaatccccaagtctgagaaaaagaggccaagaagaaaaaaagggttctttccgatcgtccttctcttctatttggtttggacactgaaatcacaggtcatatgctcttctttgcatgattccagattttcatcagaagcaaacttagatctaataatttctttgtggttctttcgaatccagatttttacgtcagattgttatctcctttatcgagaacttatgttctacattcttcctcttcagctttcggagctttatgtggaacgacgtatttccgtcaaggcgtttttttaggagattcttgtcggcaagacc

SEQ ID NO: 2071 - DNA, 346 bp, Zea mays
ctctactttataaataatataatatacaatgtaaaacagtattttacacagccgtttacaataaacagcctgctaaagatgaccttatacaatccaaaaggcccatcgccgccgccaaatgaaaccgtccgaataaacagaggagcccatccccagcccgggaagtagtcttctagagccttccctccgcagcggtggcagtataaaagacacacgcacacggcacacccgtcgccttcaaccatcgttagagtttccttggtagtttttttccctcttgtcacagcaccccccacccacacacacccaaggccccaactgcagtgcccatccggcagtcaggtcg

SEQ ID NO: 2072 - DNA, 615 bp, Zea mays
gtatgtgccgtctgtaagtgcttcgatctattcttatgtgtttttgattgtttcatttatttcaccttcattggataatactatattatcctcttgatatttaaaaaggctattggatggcaacttgtaacatgcctttggttcaagttgataacttgctgcatatggcttaggcttactccgttatcatttgttctatatttgaggccatgcacgtactcagttactcctatgtgctttgcctttgcagttgagctattcaagccattcttacctgttagctgtctaatttacttgtctgttggattaaatgaataaattgaacttgtaaactgattcttcatgtcaacttacagcttatcagctttaatttaattctgatgcaagaaaaaaaatctttttactccgaactgaaaaacctagctcacatgtaaatgtattttttatgtttgaaagcttcttttaacaacttgccttttatgttctattactgtactttgtgcaagcatattttaatacacttaaatttggtcttgcttgttgcctctatcatggatgtctaacattaccatgcttctggattctggtactacttaaccttttgggtcatagatc

SEQ ID NO: 2073 - DNA, 863 bp, Zea mays
tgcttgtgtgaagagtggcaattgaaaaagttcagacaagtggctcatttttcttgatgttgaagaagtgatatttttgttagtggcgaaggagaacagctcgggggtagcaggacacgagttgtcaatggtcccagttatcaaaccaaaaagaggcagaacgtccgtcttgaattataaccttagtaccagtcttgaatttagaaagcaatttaatcacatacttccaccagaacgatcccttgttggtgaaggtgagaagaccctccccgttataatgatttttttccaaatgaggtccacccaggctgttgaaaaacttatgcatgaatttcatgaacaaggcttgattgtgaagctcaaggtcaataagataaagcaagcattaaataaagagaagcaatacaaacctccgttctcgtagcttttaccaataaacattatatacttcgataatatatatttattggacttaaacacaattttataaccatattaatacattaacgaaccattaattaaattcatccttacgaaggggacatgctacacattcttctgttgcacggttttttcgaaataagattaagagcaaccatgggcgaatccaaggcccgggcagggtgggttgttgcccgggcttggtctccagcagacccattatatataggtattttatctttttgtcacgctctatttagtcctacgtctaatccctagcgctagatagttacacgtgttgccacatctgctcatctaaaaaacgcagcctttgtcatcccctggaccctggtgacgtggagcagtagtgcaggtgtgttgatcgtcaactattttttttcgttcatctagcaactgctgtg

SEQ ID NO: 2074 - DNA, 1500 bp, Zea mays
caatgggtattccagttgaatttgcacatgaaaaacaacattgtatgtcacttttacttgaatcattcatgccttcaagaggataatgctaaaactacaaaaaatcagaagcacactcatgtagttcctccacataaattcgaaccagtcacaatgtacaaactctactcccctgtagtgttgaaaagaaccaaactggtactaaaacacccccaatgaagtttttaaatagacaaaaacaacaaacatgtgtgccattctattgtcccaaaattttaaccaaatcatacatagagcagagtatcttcagttatcagttggtctgtactaacatgggtgcctatatttggggggcaactcaaacaaaccacctcaaatcaaagccatggtccaactaaatttcaagtgttcaaaacattttgttgcatcacgggatcagaaacacaaatttgattatttaagtcattcttggaatcagtggagagtcatccacctaaaacaatattactaattcactctagattatctcccaaggaaattgaagatgttcttcctaggacacatcattgtctttgtaaacagctcattaaaactaacctcaccagcacagacgaataaaaagatatataagcattcaccaagcaacaacagagtaacctatacctcggaggcccaattgatgacggtcacgatgaggcggcacaacccacaccaacgtaggtgccatggaggtaggggtgggcgttcgggttacccgaaaatttcgggtcgggtaattcgggtttttaaaatttcgagttttgagaatcgatacccgaaattacaacgggttttgcaatacccgaaaattcgggtacccgaaatttcgggttcgggttcgggtattcccgaactacccgaactattgtgtcgtcttcataaaaacacatacaccctattaaattagtataaaaatatagtttgaataatgatatacatggacatataaaacacaagcaatctacaatcacaagttatgcacacatacacataattatatatgtacaaattaataattaagcatgacatgagtacatgacacatgaaagttcgggtaattcgggtatttcgggtacccgattgtgatacccgaattacccgaactaaattcgggttttgcaagttgctacccgaaattcccaaacaaaattcgggtttcgggttcgggttcgggttcgggtattccgggttcgggtttcgggttacgggttttttgcccagccctagtgtgaacacaaaatagaatttacgcaaagtatccggatacgttcccagcaccaatcgagtccctccactcttgatccgtcggctatgggcctgtggctgctgcgtaacacggtggcatcgcagggtcagcagatcattagaaaacgacgtctcgccgttcttcgtcttcagatctagggttctctcgtgctctgttctcatcttctgctcgctggtgtcccctctctctcaccc

SEQ ID NO: 2075 - DNA, 580 bp, Zea mays
ctgctgcagatcgaatagaacaacgtttcattacaattcccgctgtaatgaactaatgatcacttggccactcctgttttattaagaaaaaaaatatatatcactggcatcccacaggctagaaaagtacgtagtcaagtagatcacacagccctctctagactatatgggaaattatacctcgatcaaataccgggcactcaggcatacacgcattttaaccttacaggtccgtttccattccacaagtctccacaaaatgcccgtcactgttatccaaccaccaccatccctttgaatggccagagagcacctggtgctagtgacgttgttcatgcccttgcatcctcacttcctcacagactttatccatatgaattatagctgcagcagtccgaacaaacaactgtctttaatctcaaaaggcaagccgaacgttgcagctgtgggtcgactcctgtccgtctctatatgattcttgcacgctataaatccacccggacaccctctccgcttctctcacaagccacgcgccacccattccctccatttcacaactcgatcgagtggtgtggtgaac

SEQ ID NO: 2076 - DNA, 1500 bp, Zea mays
actcctagtcgatcctagtygtcccctggtcatcctagtatagtagttatacttatatagctatatataaatgtacatgtatacaactacattatataaattagaaagtcactacttagcagaggcttaggattagggcagccagcaaccatccactaatttggtagaactgcaaagaagagggagatggggggagagtagaaggaaccttgagatgacgagctcatctcctcaatggtgcaggtctgctggagcttgggaaggggcaggtggagactgcagctggtgaaccttaagacagtcgccgcatgtggagactgcagcaggcgagcatgggaaggggcatggtggtgtagccgctgatgatgtagccatcgagctgtaggtctgaaggggyagccaccagcgaycaagtgtgaataagggctggaacagtcgagctagcaagagaggagagtaggagacgtagtgcactgtttggcggttaggtattacagaggagaggagagggtagtctaaagtatactgtagatgggttgaaaatggcccaataacaaaaccctagccaagacgaccaggaaacagtaatcgtgcgattagtcaccctaatcgacgattagtcggacgaccaggacgaccagcctatctagtcgagtcgtccagctaatcgagcccaaatagccgaccagcccgactaatcgtgactaatcacgattagtcagacgacttgaaatcattaggttggataaggttatgttgctccttaggtggatcttgccagcgggttctgtccttcatgaacacccaagaagatgtgggagagtatattttcttttaacccttcatgatggtggagacaaacttccccactatcatggttctttctatggatctcatagttttacgagctctaggtcaaacatctcaactccaactccatgctcgtgctagcgatcttcaaataccattgtgaggtgttcatggggatgaggctctttgtgatgtatacaacccgcgacagcatactacacacatctatatagccaacgtcaacacgttttattattagcactacatgcaaccgcgatgttagcagaaagcatttctatcgcctggagctgagattttgtaggcctaggactatcccaaaatctcggtagctgactactcgctggaccatgagtccatgacacctcatcgtcggaggacaycttccacgtgtgcgcgcgtgcagctacttttcatgcggtgacgagaacgagataggaaatagaacgacacaaagtagcggcaaccaaagcgctttacagtctatcttgtgtaatattgtattagggcatgtacagtggagagacaccaaaacggttctccaagcacaggagacaactaagggcctgtttgtttaccccgcagattatataatctagattaaataatcctaagaggcaaacaaacagttcagcttatttgccgagattatataatctaaccccttggatt

SEQ ID NO: 2077 - DNA, 727 bp, Zea mays
ctcgcttggcagagagactgtggtcgacaaaaaggttttataggccttgtcttaggtatcttgttcttaggtacccgacataaatgtaatggtaaaatatttatagtaatttggaaatggtgattatggataagttagtatctaaattgttattacaaatttactattttaaaatagatatgtatgaagtttgatgttaatcttttcttattttatcaagcatattattacaaataagaataattttttttcataaattattttatacattatttactctctataacaaaaaaagaaaaatatccatatccgaattttgcatctattgtttgaaaagatatacgataaatttaaagtttatcttttattaatctttacgagccaatgtaaaaaaatatatcccaagtattcacaatcaaaaaatgagatccaaataagtatccatttccatccctaatggccacccctttggatcaccacactccattgggtgctttgcacataaataggatccggtgcacacagctcgcggcttgaaagagtaatccgctccgggcgtcatcgttgtatccaaagcgccgtgctagattccacacctagacaggacgccgcacacggcagccaccctcgtgtgcgtgactgcgtctcgcgcgggcaagagtgcgcaggcagagccatggacgtagaagcgcgtaagtccgacgcgccgcccgcgcgcggcaaggcg

SEQ ID NO: 2078 - DNA, 188 bp, Zea mays
ggtagatatccagaacagaaaaaacctcttttggcaataatgctgaaaagcacaatgatttggaaagcagtcacagacattcagaaaagagcagcaaagaggactttgttaatgaggtgaaggctgatcatacaaaagaactcgaatattctagagcagaaaaatataataacgatgacaaatacagc

SEQ ID NO: 2079 - DNA, 1500 bp, Zea mays
cttcttgtgcttttggctctaatttttccaagaaagttaggtctatagttcttatgttttttggtacatacaaatgacactggtttgtattatactttgatctactgctctaagtccctagaggggtttcagattaatttttgggatyaaaatcatatgctctcaagttaagaatttttaatggctcctattcatctctttggtcgcctcaccactcctacaacctcgcctcgaccctgcttgttagtccctgtggcttgctgcgcacgagtgaaaaatgttttagcacatacataatccaggaaaatgctattttctatttctagaaaatatacaaatgtttgtaatgtcatatcctgtgcatgcatggctagaaaattatgagaattttgcaatggctttaaaatatatgtaccttcagtttaaaaatagttttggcatatgttatggtgcataaagtatttctatagatttttctattatttgctttagttaatgaataaaataaatgatgagagcaattttgttgactttcttatagctaggagtgcctaatctaaattattagagtctagaaagaaaaatgtggactgctggtgcatttattgtgttaaatatggcttggaaattggtttaatatatagaaaatagttgaaacgtgctaaaaatgtgaactcagtttttcttgtcaagatatttaggtggcgtttggttcgcgaaatgtaacataaatggtaatggtaacgattcacactcgaatacctgcagtaacaaatttgaataaggcggtatctatttgtagtgtggtatcgattacggttagacttaaacaaacataatctatcgttatcggttatccattccgttactaatatgtgaaccaaatgacaccttagtctccattgtgaaaagaatgttaaaaaagttgtacaagactaccaattgtttgagcaactcaataaacttttaaatgactccactgccgatataaatgaagacacgaaaataacccataagttgacctgaaaaaaattaacaaagtaattaaaatttgaggtaagaaagagaagtagtatattcattattttacgaattatgtattttatttcaaacttatattttttattattttcatgaattacgtattttcatttatttacttatataattatatttgtttttattttaataaaataacgtgttttatattaatttaaagtatgtaaaaaactgacaaagtaggtaaaattatgacgaccatagagctgagaccacctcaagacgtttaattgaatccaaagtatataaataaaagaaataaaaaaaactagagcaggctgcggttgcagcccgcaggccgcgttccggccttccggtccactacttatccctcgtgttccgttctgacacggcgccgactgggactgagaagaaacctccaaacacctttctacctctctacgaactacctgccgccggaaaaccctagagcgctcgacc

SEQ ID NO: 2080 - DNA, 270 bp, Zea mays
gtccgacatatggaggttgtttggagatgtgtaattttactgtcatgtatatttatactcagcacatgcattaagaattggtgctcgactttcgacttttagaagtggcgttatcaatttattagcgtcatacacgcaccggatacagtacttgctacacacataaataacaaacataataatcacaacaacaaaaccaaatctttaatcgacaggacaaccacactagtagttcagtagttgtgacactacactttttataacttattc

SEQ ID NO: 2081 - DNA, 1045 bp, Zea mays
tcttcgataccagatattatggcgatgactaaggttgagggagcgcaaggagggtggccgagggctttgcccacaatcgagtaaggaagggttttctttcttaattcttccttgattagattgatagatctcctctccttatatagagaggattacttgacccctaagcgagcgatccttatcctaacaaaatcaatctaatttatatcttttctaataaaccaaactaatctaatatgttcgacactctacttgccataacctggagccaacaatgtggatttttcatgtggtggcagcaggttaggagtactcgcaggttagcaatcagaggagcctagatgctaggtgagggcttaatagttaatactctggttgttttgggtgcctggacactatggaagacaagaaatgatgtgatattcaatggcgttggagccggagtagaagatcgggccatacttcttgcaaaggagtaggttaacctctggatgttggcaggtgcaaaagggatttgtgccctggtaccagcgactcagcaagtcctactagctgatagcagcctgtcaggactcctgttggtctgttagtcatgtcttagtttcatccgggtgtgaaatgtgaatgtaactattaaacagtgtgtgtgtggcgtgtgttgttctggccattctggccttttctcctacgcaatgatatgcatctctcctgagtattcgagaaaaaaagtacatatgtttaaattgactcctataacattaatgactaaatttctatgcttcaaattttatctcaaaataaaatatatattgtttgtccagaaagtaagttactctttatataggcctaccactattttcgtcctgcagatgttatcaaagtcaggcttcaaatgcagcttgctgggcaaagaggaaacttagttggaatggtacttaaagtcacagcacctacaggtttcatatttcgcacatcttctgatgttaaattcatttcctagttatatgtgtattgtgaaatatgttagggaacaatatttacacaa

SEQ ID NO: 2082 - DNA, 342 bp, Zea mays
cctgcacacacgaaatatgagcctgctttactgacattaaaccattttggacactaatcagtagctagctacaaaaaagagccatattgtttgttgttttaagcaatggatacagcttcaaatgacatggttgctgtgtgatacaatgtgcagtaaagaagagccatacagaccatgtatagcccagagaaagaaatcaactgataaatagataaacgaacaaaagcttaacaggtcaataagtacattcagatgataaatagactgccaaatagatagatctattcatagacaaaattaccgaacaattaaatagccgtacataagtagtgacttactgat

SEQ ID NO: 2083 - DNA, 401 bp, Zea mays
atacatatgtttatttatatactctatgacaatataatttcgtaaaaaatagatagatttaaaaaaattatctagtaaaccttttgcaattcagaatacataaattttattacaacgtaatttcaattatattttttttataaaataggaccccttttgaagtttaatacatggcctttaaatttgtcggctcgcccctgataagttatagtgctgactgctgagcgagcagattcgaatcacgtaggaagacgagaagagccgaagagggctcatatgtataacgtgtgtatgtatgccctttcctcctaatcttccgccccgaacagcattctcctcctccctccctccctccctccctccctctctccgcttcgccaaaccctggtactcagaagaca

SEQ ID NO: 2084 - DNA, 1113 bp, Zea mays
aataaagcaactaaacatacagtattattttattatatgtctgaaccacagcacattcctggaagcacgtaggatagctgagaggaatgttcttcgcagctcctcctatattccgcctactaccagtgcacagttaaaaaaaacgacactattttatccgggccggtgccacatgctgaggcactaagggcttgtttgggagtaaaggtaatgaagtggattgaagagcatataatcctccactattcaattttagatagcaagggattatagtcctatcaataccctccattccacttgctcccaaacaagccctaagtggtccgcttttggcggcgaacgcgttttcgtggtcatctctcgccgtaagataaggttggagggagccgtaatgattaatttctttggcttgaatgcacggtgacgcgctgacggcgatccgcgcgctcgctgcagtagtacacgtcccttcttcaagctcaagcatatggagccggagagggatgcggatgccgccgccattccactgtatgtatgtagatggcggccggaactcgatcgattagagattcagagcccggccgacctcacgatttgatgccgatgtcggcatcgcccaactagcatcaccatgatttcagtctttcagtctactcatcattttttgttcttcctaattattattcctagaactgtgcttagcatcgcatcatcagcaggagagaaaacatattaaaaaaaaattagctttggatcacaacacaggaaagaaagaaaacatataaaactttgagctttggatcacaacacatgcccaagagaatcagcaggacggttccaaccaatttgagttggagccagccacagccagtatccaactgtccaatcggcaaccaggtcattattcaaccaatcaatgtactggttgagctatactctgctactactgctgcacatgacacataacattctttctttgccattgattttagtactaaaccagcgagaaatgaaccggaggccaaaacaaacaagcacggtaccgtccttgttacaaaatttccattccatccaaaagcaaagagaagcagggagagaaatctgagagagaga

SEQ ID NO: 2085 - DNA, 1127 bp, Zea mays
tgttgagaatgatggtagagaatcctagagatagtatacacctgttttagatacactagcgtttggtggacacctcctctgtgacagaaacgacctccaccctgtaaacggtgacagacgtctgaaatgtactgtacttcgtatatattttcacactgactgaatcatgtgggggcctcgagtccggaccgtgcaaggcatcctcacgcatattttagcttggcagggtacttgttgaccccatgtggtcttcgtccggttcagtgcatcatttgtctagtccatgcaagagtagtagtctagtagacgacatgcctagatgtccgtgttggttcgaggcgctgctgatccaccgtgcaactaggatagcgtcgtcttctcggaacgaacccatctgtagaatcgccttgttatagatggaaaatgggtggaaagcccttaaacatgaccagtggctgaaaagactgaaacgattttttaaccggatagggagctaattttttgaatggtcttacgagttaaagggtaagatatcttaaatttcgaggagaagttttgttcgggaaaaaaaaagtttgaagagaaaaactataccacatcaacatactatttcatgtcttcatgaacgtgtaaaagactttttgaaagaaacacggtccatggccgcgacgcggagggaatgtttaaccgagcacgagcagatagacgactgcttccacgacacgacatgacaggaggaggagggagccacccgtgccgtgccggcgtgccctagtcaaagtcgagccagagggaagctgcgcgcttgcctaaacgctgacgcggcaccagaagcaccgcctcgcctcgcgtcgtcaaagcgcgcgcgttcccgtttcggccttcccccacccacccccaccctctgcctagcgtagcgcaccgtccgcggcgacggcggtgtccgcccgcccacccacccaccgcsgcacgtttcytcytgcgcgccgcctcggatcagcccgagcccaccgcgtcggcgccgcccccacccgtctaaacaaccacggaggccgcggccggccgcgtctctctctctctctctcctcgccgaggccaccgtccgtctcatctagccggccgcgggg

SEQ ID NO: 2086 - DNA, 478 bp, Zea mays
gtccctctccccttcctgttaccataaaaaagacaagaaaaagcagatgtatgcaaatatataaacacgttttctaaagcacagatacctaaattaagatttgagatttgggagagagaacgagaggatgtatagtgctgattttctggatgtctagacaaagattaaaaaactaaaaaaatcaggctatatatatgagaaataggagctctcgtacatgtaaaacggaaaagagcacaacaaaaccaaaaagtacacgtatgtccacaatcagcgtgcactttatatccctccctggtcggctcgtccacacatcccaaccctaatccaaaccccttctccatcctctcttcccttggtcgattggaaacaaatggaaaagaaactagtatcacacacacaggtaccaccggcacagcagcaacaataagcaaagagcagtctccaatagtatagcaacaccaagaaaataagcgcc

SEQ ID NO: 2087 - DNA, 643 bp, Zea mays
gcacggataatatgtactacacacctcgttagcatcatggctagcttctaggtttgttgtggagtgtgcatgttgatcctgtccaccaattcatcccgtcaatgtattgtttgccaatcattattgtgccacatttgaatactaaccttgaataagtgtgccattcaaagagttatcaccctaatacacatgctatgcgactagtagtgtatcgctcacttattgggccccccaaaaccttactaaatatgtagtaaaagactaaaagcaaatgtaaataagtagtaaccatacaataggagaagatgagaaaagtgcgcagacaggccctcaaaaccggcggctacagcagcgacactgacactgacaccagggagcggtgagcacacctggagatggtgacgggaatccgcagctgtatactgcctccctccactcggctatcacgcttcccagcctgcaaaccccgtgcccacagctcacctttttctcctctgcagcccacgcctcccgataaattcgcaacccagtcccccccgtcgctctcattcctctcggccacaacactgcgcgctccgcagacgcccaccaagcttccgctattcgccaaaaggtccccttctgccctccgccctatctatcc

SEQ ID NO: 2088 - DNA, 401 bp, Zea mays
tgcaggaaaaataaaaataaaagacaaaatcagtcggcccaatagccatggaagaattgctctgctgcttggtgtttttcctcctcccgttcacctcgccgtcgacggggccaggcggccgaacacatccttgacgaccgccgtcgccctactcgcagcttcctgggtttcatcggatcctctgctagcgacgagcaccccctacaccaggtattccccctctccttcccttcctcgcaaaactgagcatccgaaccctaccttaagctatttggctatttgtattcagatctgacaagtatttgcatgtattgtgcctactaacttcgttttttctggcaaaaattatcgggtgtgctgctgacgcacacacgcaaggccgttacttgggcgccggtgcc

SEQ ID NO: 2089 - DNA, 1500 bp, Zea mays
tttcactgtatctcaatccaaaaataaaaaagaatcaggtgctacctgcaaatctgcaactctgggagacacatgcagcaaaagtacaccaaaactggagatctaaaatctagtagtgagctcgtaaccagatgccaatgtgagtttattaatgacaaaaacaactaatctcaaactcaaactaaattagtcttcaatactccgagtcaaagatcatatcgcattcgagcactgtgatttaccgtgaaacattactacctactatttagttaccatgattggattatcctcctctttctggttataaacgcagagaacttaaatcatctgaaagaacatataggagggatgagaatagtcacaggaaaataatgcaagaaaactatatacacacctccttcctcccgccagcacggtcagagagcatactatgacagcctcaaatcctacagtgttaaggagagtcactaagttacttaacatcttttttcgaaagaatattcatccatgtactgtgtaaatatgaaataacacgcagagagtaaggagcgaagaacgttaactgtaacatgggggggggggcaaagtaattttttggaggtggggtgattcacttttcacgccgaagacaagacacagaccttagaggagaaatatggttgcggtttaaggcgcccaacgaatccaaaaatctaagatgcgaatcgtaagaagcgactaacagatccaataaatgtgaagcagaaggaactagatctgctagaaggacaaagtatcgggaaaaaagaaaacatgcctttttctaacctggcaaaaacgtaggaagacgaagtggctacagatagacaagacggagggagtaaggacgaagaggagcgtggcagaaagaataatgagaggcgattacagtggaagactactggtcgaccgatgcaagctgcagaggatcgacggagggagtgaggagaaagagagacagaacaaaacgagcgagggtgggtgggaagtgaggaggaagagagacggagcaaaacgagggtgggtgggaagtgaggaggaagagagacggagcaaaacgagcgagacgaggctgacgctagcgtcacttggaagtctctagaggcgataagtacgaggggcgtatgagagagcaaggaagatggactaatgatccatcatcgaacggctacaaagttttctgacgacgtgaatgagctagtaggcgccgtccgttaataataaggaaatatgttgttaatatagatgtttaatgtataaaggaaaaaatgagatatcgaaaaaaaaatattttacgcgaggacggataggacattcggcgttcctaggtaccccgctgcttccgtgctcacctcgcctgcagggccgcagccgctggaagaacacgaagacgacgggagtgcggggtggcgtcgccgctggagcaccagctgtagccgccggctaggcctccgcgccgctctccgtggccaacgcgccgtc

SEQ ID NO: 2090 - DNA, 1500 bp, Zea mays
tatttgcgggcggtgtccgtccagtgatcgatacgatatgatgattgggaaagaagaaactaaaccatatttttttttgtttacaccttttccttacagcagcagcagcaagtgtgcgagattcatcgttaatgacagagagttgattggcgtcagtcacagattccttgtcaatttgtacatagacgaagctcatcgagtaatgattgattaatacattctttcgatcggtttgaaaatgcaaatccaaaagttctttttaaaaaaaaaaaaaatcaaaacggaggtttcgcgtcgatctgtctgtgttgccatcgacgataacgcgagcggatgggctactccgatccgtgcagcatccggttgctttcaggtcaggcggagtagcctagacgcgacgtcgagaccggtagcacaggtacagtacaggtggagcgactctcaccggccgggctcgtctcataaatgggcggccgacccgtccaacaacccaacggacctggctctgactgacctctcattccgtgcagctcgcagttgtcatgcccggctggcagtcggtccaatcggccggccattatactgccggccggcgtcgtcgccgtcggcatccgggacggcgctgccgagtgccgattgccaacccattcatggcgtgaccgcgagtcgttcctgccacctccgggacggtcgggcccccccgagtcgtgtgagcagtgagctgcccgcgcgcggcaggccaacagctctgcaagcttttccggtatcaatgctggccctggcccaggccgtggcccccaaatggctctcactatctaaatcattacttactcgctatataaattattagtcgaagaataatttatgtagaaatgctttatatttttttcatactccaacaacagttttatatgttttgcgcactctaaaaacaacaattatgcttctgtttgtgtggagtcaaatgccgtccatactgggaccaatcttcgttctcacttctccatcacatattcacatagtattcacagcggatcttttttttttcaggtggctatacaacatagtatcctgcaaaacccatagaggccaaagcattttgtgttgttgttgacagcaaaacttcctactgcattcaaagacctgcctttataatagataatgaagttttttttttttttgcaactgcgacgaataatataggccgggacctcctccataatccggtcattgcggacagtcctaggctcctagcagctaccacaacgaacatgatgtatttttaccagattttacagtcctagttcttgtttgttatttcatgagagtatcaggccacaaagaacatgggccgtgctgcgcggaacacatacatgggctcacactggaccaggaggggagaagaaacacggaagggaggctctcaccagtcaccactcacctgacggctgacgacgagtgagcgagaggaacggggagagggaagttaaacgcgcggcg

SEQ ID NO: 2091 - DNA, 1016 bp, Zea mays
gaccccgctgccttgccggaccgagctcccaacccaaccaaaccagttgggcttgggcggcggggccagcgccggaccatgacgccgccgccgcgctttatttctcggcgttccaacgggttgcccgcacgccacagcgggaaggaaggaagaggcctgcaggtgggcggcacgcagggcctccaggttctcggcagcggcggagtataattcgctggagaattcattgcggcggttgggaaggtgggtgtagatgggtggccagcaagcaccaagccaaagcgggtcaactcaaactcaaactcaagggctagcgacggccgccagcagcaacagctacacacaactaactgtatcctgccaatgccaatgccaatgccgcactagcaatctactcaagtttctgtggcattaaaatggtccagtcagagaattaaatatgccagtgaactctgtcgttgtgttccccctttttatgttaccttttacttctgttttatgctctgtttatacagtgaaatttgaattagaaaaatgtgataggagagctgctagcatgagtgcagcagtgtcgtgggttgtgctcctgccctacctgtatttgtccacgtctccttcgaagcaatgaggccccctcctttcccctcgtgtgtgttgtcttggcatgtgagccttggcctggcctggccgcctggcctggccccctggagcaacacagtggtggtgctggacatttgttttcggggtttcgcttcatgtcggggagataaatccagaggccagtacgtaaagcagcttaaataccacttcagccttgcgttgcgttccttgccttgccttgcctgcttgcgtgcagtgcagtgcagctcacagcctcacaccatatcgctctgcggtgctagctccaggcctttatcaagccttccctgccccccttgataattccagagagagagaaggcgcgcagctagggaggtgcagagagaggagcggcaaggcgtgggctgtgggcacac

SEQ ID NO: 2092 - DNA, 109 bp, Zea mays
ccctggccctggatccgcctcccgtctctgacctcctcacatagccgccgccgccgatctccgtcatcggcccagcaatgcccgccgccacgccatagctcaccgcgcg

SEQ ID NO: 2093 - DNA, 1500 bp, Zea mays
atagaaacgtcgaaccatgtgtttgccgtctctacaagtgcttgcaagcttcgtacacggccctagtacagcgcccgtcacttctttattagcttgcacgccagaaataaaatcccagtatatttagatggacaactcattgatcagcatacttaaaacttttatctatcttcatctttatataaactttattctgcaaatagtgcagtctatagtttaaaataatgatttgtacgactatatgggtaagtttttggaggcggtccaacagacccacttcatatactaaataattcagttgttgtaccagtcgagaaaaagaacatagagaattagagagtgagaaaaaagaggaggggaaaggtatactgctgctgttgcgctagatcaaccaaacactggcaacctgtctcatcacatgcaaaacaggaacacaatccagtacaaactcctaccgtcttgatcgcggcatgaacggcgacttgcgcgatggcttccggacgatgaaagacgacacgcatgagcgcggccagttgggcctacatagcatagcataggcaaaccaacacgatgagtcaatgagcgtgaagaaccgatgacaattcgtgaggctatcactacgctaatcggctaatgacggggtgcggatggagaggctgcagccgaaactcgccaccgtgtatctatgggagagcgcggcgagtcggacggcctctttgaactgaagtcctccgtcctgttccgaactctcgccgtcgccgagggagcagctagtagcagcacgcggcatcctccggtcagatccacggatgctcttgagccggccagatgcgccaattgggacgcaaacgcaggggatcggcaggaggagccgactgctgcacttcggatcgacaacagccggtcgtcgtgtcatgtctgagccggatgcagcttctcaggatgtggatgggcaacactaagtgtgttagagtgggccgtaggccgtgtttagtattctaatctagtgtcatgggttcttttagagtctgtaatagcctgttaagcgaggggataaatacgttgtacttagccagttggcaggaattacgaacagaataatccacagaacagaatcgtaacaaacttaccctggttgttgcgttttgttggcactccgacgagctcacgtcccggcggtggcgcgccggcggccacgggtcgtctcacgccggcgatccagcgcgtaggatcgggcggcgaggtggaaccgtcgaagacgggtcatcaagacgggagacgtgttcagcgtagggactagggaggcattgcctatgaccactgggggcggtggggccacacattacatactagacccacatgtcagtggagtccatgaaaaataggggtacgccacttccgtgagtcccaggcggccaccaattgcggcaccgtcgcgagccgatctgtctctcacttccatctcgcctccgcggcgcgaaaccctaggttcgcgacgcc

SEQ ID NO: 2094 - DNA, 488 bp, Zea mays
ggtatgagtagcactcctcaggtcttgggttcgactcctcgtgggagtgaattttaggttgtggttaaaaaaatcccctcatctgtcccacgccaaagcacaggtttaaggctcagccccggtcgcggtcgttctcacatgggcttcgatgccgctgtgtatgggtggggcggggggttccggggttttctcgaagtgtgtgagaaggtcttcttcttaatacaatactcgggggctgtcttaccccccgtgggtcgagtttttatagacacaatctagtttctgtgggatgtttaatggactaatcaggtatcgatgcatggaaaggacgttttgggtcatggcatcccatgcttacaaatgaaaccatcattacttcagtatataaagcaaagtttacttacaataaacaacaatgcaacacacttttgccatgaggtatatacattgatgttcagctgttttgttgcattggcctacattatgaa

SEQ ID NO: 2095 - DNA, 1500 bp, Zea mays
tccagccggccagggcgcgcccagcctgtccatacgcgcgcagctatccaatcaagccctatactattctactaagcagatcggcacgcgcgcatagacgcgcaccatacactagtaatctacatatttgcacgatgcaatgcactcccgttttctactgtccggccgagccaccggcatttgccaaacgctcacggctgctgacgctgacgccgcaccagtgtgcgccgccgcagccaccagtcgatcccacgcatacaaaatgccaaggtgtttgaccatttgacacaaggccccaagccctgtaccaaagcrgcggctttcgagatggccccgggggcctgttcatcacgtactagacctgagcatgggccacccgacccggtcgacccgacccgacccgcccgaaaaaaacccgacccggtcggaccgggccagtgtgttgggcgggctcggaccgtgttttttaacccgtcaatattttcgggtcgggctcgggcctaaaattaagcccgcgggccagcccgtcagcccgaaatctggactggtgacttgcgttcaccgctaatcttcaatgttgtggtagagagatcagcacagcaggcctctgctctgatcacggactgagcaggtggcctgtgcggcgtaccgtgcccggttttttttatcacagagacacagactcacagtgcccgaccggagtaccgtgcctgtgcggagtcagagtgcgtgcgtggctgcgggggtgagaagaaaaattaaaaaaacgcgtccacgcctgtagccagcagctggtgacacgctgcctgtcgggtcatcgggttggcccgtgggccatcgggtcgggccacgggcgggctcgggctgggattttacattttttgtcgggccgtgggcgggctcgggctaaagagtttttatatcgggttcagtatggcccgacccgaacccggcccggcccggtaaatgatcaggttgatcaygtacacataccaactgaccaacaaacaccatataccgcgctarctgtaggctgtagcaacctgtttcgtctaaaggaaacaggcacacactcccactcctttcaagttccagcgcaagcagttcacactggcaggcacgtctcaacatggccgttgaaaaagaaaattaatgcagcttaattgcatataaaaccagctcatccagcggggcaccccctccctctccgtccccatccatccctgcagctgcatacccatcttattcccctcaacaacctgcacatacagagcagctgcatatatgctgcattgatacagatttgcgcttgagagccacggccaccacaacaccagcactaacaaatccccaaaaaaaaagtctagccacagcccacagcacttcttctccacaacgaccccacagagggccagagcaagacatccgcaccgcatcgcatatacccagagctgtgatcgctgccattaattctcccctcataggcctccaacaaggtcg

SEQ ID NO: 2096 - DNA, 160 bp, Zea mays
ctatgtctttattactttatcatgagttattttccttggttaacaatacttgttgttttgccgatatttgcaggttcattaatttgtctttttacctcataaaggaaataaaatcgttaggtggtatactatagctatttgtttattacaattccttcta

SEQ ID NO: 2097 - DNA, 1500 bp, Zea mays
cattcattggagtttggctgatacctactttcctcgttttattagaaatatttctctaacaattaattatgggacttgtttttaatatttgggatagtatatggttcaaaattttaattattgacagttaattttggctatatgcaagggccctctaaatccatggaaaaaaggttttgagttgaaaaggtgtgcttacttaaagtaaatgatatgctgaataaatgatatggacgggccatgatattgttgtagattgctggacagaaatggttatagcgctgagttgagtgatggttgcttggaaggattctatggtctttctcaataattgatagtaaaagaaggcgaagttagagtcgaatatcaggaacaggaagagccttttttttagttgcaggaatgacagggtccatctcaacacctccaacacttgcttatttccatcggaatctaatagttggtgctaatttargttttgcttttctttccatatatatattttgtatgattcttattagattttctacatggatgcagcccagcctccacaattgctcgacctagtgcaataagttgtattgttggtatagaccagattttgtttcttttagtttaagcacagatttgtttatgtttttgaacgaggtaactaaatgggttatgtattgtaccttcaaaattagaaaacatagacagaatctgtcattcaacagttaactgtatcaactcaaagtgtgccatgtaaacacagaatattttactaatcacaccttgaatgcaaggcagaactcctgatctttttcttcaagaaaaaaaataccaatcaccaacatttactctgttttggatggtaccaacctcctcaaattccatactagtgtgttgcagccttatatttggatgtgtttctgctaagacatattttgagaacacctacaacaacagctagtgcatgccatgtttcctaagcgcaataatacttagaagtgcacacatccctgcatcccatgtctcaaaagatgttgccaaggcaggctaagatacagggcaaagaaagggggattcaaactccccataattcttttccctttaatggctttctcttcttttcttttcttttcttttaactcccctcctctttctagttttacgtgattcccttgttcctcgcgggccaaagcgcgctaagaatcaaaggcacaaagatagctcaccctcggtttcagcatcccctccaaacatcactataaatacccctgcacacacgcaccttgctgcatcaccaccatctcacttcatataccactccctaggaggacccagcaacacacacagccgagctttgcttaggtaatttagctttgtgttagcgcgtaacctacatacatatcttcttggattatgcttttgttctagctcttcgatggtatcttctttaatgtgggtgtcctttttttttttgagtcgttttgacggtgtgtaactactgcaggcaag

SEQ ID NO: 2098 - DNA, 1146 bp, Zea mays
ggttagaagagctgaactctgacaagccacgtgttatcttggcaaaataattgggaacggttagagaatgcagtgtttgctaggttcaaaaactttcgaggagatgtcaatctaaacatactgggaggttaaatattaggtactcttgtaaatgctcttatgtaactaaaaataaaggagtaccgatgggagtgagtagatgaattaacaagacctctatactccagatcctattggttcttaaaaacttgacaatattagctaaactcttggacaaaagtgttcgcatctcgttttcccaatggctacctattactaactcgtcattatatttattcatagctgaaaattcacttgaatagaggtaatacatagatttatgtcacataactatttctacacgattcttgttttctttcctgaataactgttaggactagccctaaaacatcacaacataacagtacattatattgtaaaatactgaaataaagggttaaaacatgtcatttacaagccgtgtttgatatgccttgacttccgcatcgtgtgagtgcactggcttcacatgaacggcgacacggcgtcgccgcgcaggcacagaaggaggtcccctgcggctgcggtcactgtgcatggtcgaatttgcccctttgctctcatccctggcctgccaggacaagtcgagacgagacatcatcccctctctccccatctctcgacccgacctccctcgccgtctctgctgtgccctgcccctgtccctgctcacccagctgcgatctctctccctctcgctgaatccctgaatttctctctctccgcctccgccccacctcggatcgggtccaagccgcggagcccactccgctgacccagcccccagacccccaatcgagcccgaccggagcccgtcgattccaccggattcgagctcccgccgggtgaggcggttcgcccgaatcgaccgattggactcgaattcgggtgtcccggatgcgcgcagagcggaggctcgcggatctagggtttcggagggcctagggttagtgccggcgatctggtgatggtggcgcggcgcggcgccggagctcggcgaggaagagggttcgacggcgacgttggggaagatgcagcgagccggat

SEQ ID NO: 2099 - DNA, 345 bp, Zea mays
ctatctgtgtaagatcttgaaatccttttgaagacgccttacctgattggacaaaatcttgtaaaagtcactcataagttaaagctaaaaataatagtggttctgaccagcagtcttgaataattaaattgctagtccaattctgcatgacacttctattctgttgatataatgttacttgctggtgaaaaggttttgttcctaattttgcgaaggatctttgtccattccatgtttgtatttattgcattaatccagttctctacatttatgtagccaactttaagaaaaagggtaagagaacactggagttggtgaatttgcagaatagctcagatttaactg

SEQ ID NO: 2100 - DNA, 1500 bp, Zea mays
aaataaaatatccaatcgaatacttaacctctaaagatgcacggataatatcacacctctctaatatttttttaaaaatatcctcccgcctccattctttcggttcatgctcaaattgatcggctggctgaatagctgttcgaactgcgatcgagacaaagcaagccacaaccaacagcagtgtgccactttgtggtcaacagttcaattgtgctaaggctggctccaataaaaccctataaagggtgctataccctaaatttagataaaaggacatcctcttgctgtgtactatttgaatactttaaacaaccggtttaataaaactaaaatatgtacaatacatttgagattatgacaaatacaaatgtacaaaaatttaaaaattaaaaatgtctttaatataggtatttacatatagaggacgtgatttagaggacgttgttggagagaaagtagatatatgagatagaatcttttagagaagactgtaaatgatggatatagatgatatatatagaggacgttgctggagacagtcttaccactgaaaggtaaagggtgccctgcccagattgcagaagcacagcagcgatgtcggtgccactggcattgattccaatggcaaagggctttcaaaagtccggcaataatgccaaagagcagacttaatggaaacagtgtgcttccgggtagggttggacaaaaaaattcgcagctcgttaactcgctcgactcgactcgatagtggttcgacttgactcgtttataatttgtaacgagttgagcttgtatttcaactcgttatgataacgagccagctcgagctggctcacgagctgactcgcgagccaaacgagttgaattaattagtcaaatcacaataatctcggatccaaaatagttaatcttgtactctactatagttaatcttgttatttgttgagtgtggaatcttaagttgcaaactctattctttttttctaaatatatctctttcttttcttttgctacatatttttatatccgttcgtagacactagacatgatattatcgagctggctcgcgagctaaacgagccagctcaagttggcaaacgagtcgagccaagttggatctttagctcgttaacataacgagtcgagctgagccagctcgttattttaacgagccagctcgtcgagccgagtcgagccagctcgatatccacccctgctttcggggtacgtagttcagtcaagggctttgaaatgacaccgaaattcctcacacatttccggtaataacccggccaagccaagaaagctgcagagctctttctgattagctggcactggacactgaacaataggagagatttttgctggatcagtaattttgccctattcactaatgttattacccaggtaggcagtctggcaattggcaaaggagcatttgtagagctgtatcttccatcgggtcaactaaaacacgggctaatatatgattgtgttaga

SEQ ID NO: 2101 - DNA, 1500 bp, Zea mays
gctgtaccggtgaaattaattagtctctccacgctcggattcaagtgctagcgggaggaaacgcatgaaattaatttccccatgcttggattcacatgcttgcaagatgaaacatgcgcgtcgattctatggttcactattaaacactccaaatataacaagattttactgtgtaattgacgagaccacgaattgggagctaaaaaaagcatgttctcatcttatccttgttactctctccgttcaagcgtgtatgatgatgttgttataaatgaatacgacacaaagaggatcaatcacagagaatacacagatttaacatggaaaacccctctaaagcgaaggggaaaaaaaaccagggacgccggctagcaactcttcactattttcgggtggttacagatcgtaggagatttacaattgagatgattatctcctgcggcttacaaagatatttatagaggtgaaaccctaaaacgagtagggaaacgatccgtaccgcttcgctcgccaacttggccgccttcttcagaattttggatyacaaactcaacagatgtgttgtggtaattggaaagagtgctgcgaaattcttattgagaatagacttaattagtatcgattagtgacaaaagttggcactaaaggcttcgaagctttaataccagttgttgataatcaggactgttaaagagacctcagaaccatatctattatcaatcggtatttatattaaagctcattttagtaacaagactaatgttagggtgtaaagcccttttatatagcagcgttatcaacttaattagcctgaactcaattaaatatacgtaacaaactataagataaaaatttaaaactcaaatcctccaaacatgacgtctcaagaaacggtttgaaacatgaaccatcacaacttgttgaagagaaaacagacgggcaaagttgttgcggcggggaatcgctgttagtggcatgaccccctagagtttttgtctttatagattattttacagagtttttatctttatagattacagtcgcagcagttcgaacaactgactttaatttaaaatgaatagctccatgtttttctcccgtcgaaagaacaagttgatgagctgtgctgccgtctgcacctaaagttttgcagtgaatttattgagtcactactgccagctacagagggacgacgacgagcattgggaccagagcgcgcggtaaaaaaaataaataaaagcgtgtactttagttgattttgggcctccattgctaggagactacgtactcgattcctttggcacctctccccttctccctctactcctctctaccagtgtacctatataaagatggcaatgggcatgccctctacagctgaaagagctaaactaccacacacacacacatcctacgcatcttctcgcagccatctttgtggaagcaaggcgggcaacatcgtgtggctagccagcaagagggagagaaacaagcacaagt

SEQ ID NO: 2102 - DNA, 1500 bp, Zea mays
gactgtacttttgctactcgtacgtaattctagagtttagaatttgtcctgaaataaatacgcgtctacgaataatgaaagagaatctccaggtttaaaaatagtgggtcgacaaaacagggttgttcagattgttgaccggtggatcacgatttttagagctagtttgcaaactcaaatcttctttggaatcggagagggtgaagggagaaataaactaatttctatatcaaaattttccaattctggaagtgatttaarttttcaaattagccctctacaaaagacggtaacaataagacatatcagaaagggggatttaggagaatcaaggattaaattatgatgagattaaatcatgcatccccaacaaagtgccccaaaacagtacactaaaaatttaaaatactccatcatttaaagtgtttatgacactataaataaataaaagctacaacagtatgccgtaaatcaaaacaaattacattattagtaaaaaagggttgaggattgttgagcaccgtttacagagtacctaactagaagaagcaactaacaaacttagtgggtgcttggtttctagggactaatttttaatctctcaattttattctattttagtctctagattatctaatatagaaatgaaatgatttttagtttccacatttgttgatttagagactaaaatgaaataaaatagaggaactaataattagtcccaagaaaacaaacacccactaagtttgtcagttgcttcttatagttaggtactataaatttatttttttataaagatggcacactttaactttaaatttaaattttgtggagatggtacatcacagtgtcttgccactccactggtgtctcggtgtcgtaatatgattggcgtgttgccggaaaacacatgtattatactattattatattatagacttaaaattaatccaacagttctaaaattcgtaaaacttttcaaaacaatttatctgtttatacccgcgcgcgccgcgtgctgaagctagtacaagatcgaccatgcgttgtagtaatactatccgaagtgtgcagctggcattattaacggcttttatattgggctctgcacgtatgtacgcgttgatagaaatgtcaccttggtctctacgtcatcgatccgatcgtatgggtccttgcggagaggtgtcacctcggcatcgatggcgtcgccgggagaaacaaagtgccgtcaagatccaaaactccatcgtcgccgactacgtacgccagacaactggggtgttataagcgaagacgctaggatatcctgtataagaaactacaggttatttctcgtcgtgcaagtgttgccaaaccattacagctagctcatggcgttcgtgcttgggagacatcgaagtcccgaaatacacacagtctactctatctatataagttataaacgcgcgcgagatgatctttgcattatgatggtggagcatcgagctcgatcgccac

SEQ ID NO: 2103 - DNA, 440 bp, Zea mays
cggccggctccatcgccgtgtgatgatcggctctggctgagcttggctttgcctcccggccccaggcaggcgtgcgcgtgcgcatcgataggtgcgactttgacgtgtcgcggccaattggtcggtcattcggataagaacgcgacagcacgagtaaatgagtaattaacaatgctgcgcgcgatattggattatcttgtctcgcagttctttccactttcagttcgttcatacggtgtggtacggctgttcatttttacgtgacgtatgcgcagcagcggaagtctaggaagatcatagtatcgcagcgcagcccatcatctacggcccattgggctggttctgctgcttgccgacggtccatccctacagccagccagccagccagggcaaaccggcaaaaccccagcgcaggagccacacagcgtcgccaggcggcg

SEQ ID NO: 2104 - DNA, 1083 bp, Zea mays
tatgaactagcaagaaaaactagatgtatttggaagaggtgctccgattaccatgtaaaatgtaatctggtgtcatggctttaacaggccaggcacctaatctatttataatagctgataaccatattacaacggactctttggatagagataaagtctgactcaaaacagaaaaacgataaggataaatgctaaaatatcttaacaaagtaagattagatgctagaatatcgtaacagactaggaatatcttaacagtagcaccatcaaaattattcacaaggaactcatgtagtttgatctacgataaacaagcagctagaagtagcaaattttgagttcttgtatagtacaattacaaagcttatctatcataatgtcatgctctgtaaacacttcccatatcaaaccttctcaaactccaattcttatttaaaaaagtaagtcataagcaacataataccttcccatatcaaacatgtttgtatccaaggattacgaaacataggaaagcttaaaaaataaaaacaggaaaggaatagaacgccaaaacataggattgtttggaacacataaatctatagcccatgaattggaagaatccagtagtaaaaatcatcattaatgtacgacaatagatcgattaataagyatatcattaaaggataattatatatacatggtgacatactgatgctacacagaatcagttcaaacaaaaaaaggctttgttaaactttattaggattcttttgttgtatagaatcgcacatatttgttcaaataaaaaagtatagcatcgtacaatgcccatgcattacgatgacacacaaatctcaaaatcaactctaacaaacccaaatgtgctagttgcagctaatgtaagagaagattgttttccgtacagacgaaatgattggctcggctaatgggtttgtgacaaacccaccctgaagcccaaacctctgcctctcccacttgtaagaagttctgctcccatctgagctgtttgctgcgtctgagacagaaaaccttgaggaagacctaccaccattgtgccttctccagaattttgggctcgga

SEQ ID NO: 2105 - DNA, 570 bp, Zea mays
cctcattaattcttggatgtctaatactcctatctataccatatgcccatataccttctgcccaaaacaacagtaaaaaagatggatgccatcaggggaaagtttttttagcagggaggcggtgacaaagaaatatcatgtcataaaccggggaaaggtttgcaatgagaaaaagaatggtgggcttggtattaaggatcttatgttattaaatattagtttgctttgcaagtggtggtggaaattagagaatgaggaagggctctggcagaagttaattaggaaaaaaatatatgtacaataaaaatgtgcataaagtctctaacagtgttcatggttcacctgtttagcatgatgctgaaggtcaagaatttctatttgttgggtagacaagtgattactaaatctggtgataaaactagactttgggaggattgttggttggagaattaatctctttgctgtattgttccgaagttatatgatatatgtgattgcaaagatattacggtaaagcaggtccgggaggtaaatgcccaattatctttcagaagattgcttcgtgtggat

SEQ ID NO: 2106 - DNA, 144 bp, Zea mays
tccaaaccacaagcgtagtcgccgtcacttctcccatggccgctccctccctcagccgtggcgggggccgacggcatagcgctcatcaccatcaccaaccttcctgtggtggatgcgccattgcctgatgcgagccgcggggaa

SEQ ID NO: 2107 - DNA, 353 bp, Zea mays
ctgcagaaggtgttgtttgcatcaagtgacgtgaaaacttgcaattggtcattttgagtcttcaaaacatgaatgcactgaaaatcttctgtccttgtcatgtgatataaatatgacctatctaataacgaacttccctaaaatatgaaaacgaagctaatgatcttcatcactgcattgcatctggatgacttgggtttatcagcaaaagtgttttgttgcagatacaatatgcataatttggttgaccatttccacgagcgtggtcttaatcgctcaatattcctcaggtattaaattggatatctaatgaagtggtatctagtaacgattagatataacagtaaggatta

SEQ ID NO: 2108 - DNA, 62 bp, Zea mays
tttccgttttgctctgcgaatccggaccagtgcacgggctctagctacactacacggcagtg

SEQ ID NO: 2109 - DNA, 132 bp, Zea mays
ggttcgtcgtcggcccacccgacggcgccgccgtcctgcacgtcgaggtcctcctctagcgccagagcacacgcacgcaaaaggcgccgctccttgtccttggccgccgtacgtcgctcatctcatctcccg

SEQ ID NO: 2110 - DNA, 196 bp, Zea mays
tgtccatgtaaattgaagttcagtgtccttttaaattttgttctgattgctaatatttattttgtgaattgaagttcagtatcgttgtaaattgaagttcagtatcctgttatttttttattttgtgatggtggtattctacttatgtaaatgaatctggatcatgtggttgctgaaattttgatatcataggaaa

SEQ ID NO: 2111 - DNA, 1500 bp, Zea mays
aaggcttgcctcattttatccttccccatgtctcactcatgtgggagcctctgacactaggtcaaaagttgtagactaaggcatgaaatggttatgcacaactcaagatacttcaaggataggtttttttggaataactggatctataccattaaaagattgcaattttagatatataccattggcttcacatgtcattgacttatgtggatcccacatataagtgggatagcattgatatatatctaaagttgtaatcttttaatggtagagatctaaatttcccttttttgtgtgttatactgtagcatctatgtttgcatacacttgcaagaaacactggtgtcagatgccaaatgcttatgaaatggttgagtagatgtttttttacccatcctctcgtcaacataatggaagttaaataagacgctaggctttccttggcttatggacatattttaattttgtaattactggacactaaaaaaccagttggtaatgcattaattgtgtttctatgtttattttactccttccgtcataccaaaaacaaaagagacagcaaactgctttctagtgttttcattttttcttgattgcttctgtcaagaacagtttgtgttataatagtattgtatttgtattgtgcagaagtgggcatacaagttgcgataaagcctgaattccgcattaccccacctgtgagtaatttaatttaatattgaagtacattttgtcttgtattattaggacttaggagctactggtctactgttttttttctcgaataaataggagagctatatatcatttcattacgagaaagcaaaaggtaaaaaaacacacaggacaataaaggacctgacaaaccacacacccccaggaagaggcacacccacctcctaaggccttgttcgcttagccccttcccggcggggatcgtggcctaatccccgtggatctgccccgcctggacagaaacccagtctagaagaaaatagtgttcggttaagcctcgcacgggctacatccctgctgagcccggccatttcccgcctccccagcctaggaacgatgcccggtccctagggggtggaacgacgccccggattgcgctcgtatgtgaagcagcacgcgtgaaaggcaagcaaaggcggtggagggctggaggcgacgtgagatttcactctccggctgccaccttctccccggtaaacttatttctcctgtctcttcaatagtttcagataagaaggcagtgaaagaagtgatagtttcagacaagaacacatagatgataaaaagatcaccactagaaggagaatcttctgaaccaaaccagctgagatggaagcaaaggtggacacacaaagcagcaagatttgttgatgtctcatagctgtacacaggtcccccttattacatggtttctggaaaacaagttgatggctacaaaagttccagatctcccctgttgaagccacaccccatgacccatgc

SEQ ID NO: 2112 - DNA, 1145 bp, Zea mays
ctccccttcttttaagtattttaaaggaattatgttttatggtaatcatacttcactttcttttgagaatgttaagtcaaatttgttgtttaaggaaaaatttgatgttgattcttgttctgaacccagaggtgaagatttaattgttcggtgatctggagatcataaatccaacctttattatcgttattgtagaaaaaatactcgcccaaagtgagaaataaagaggagagaaagaaaaaagaattggataagtcttctcctgaagccaattttgttaaaactttaaatagtggagaagctctgtttattgcctatgttaacaagtgctcttcttggattcttgattccgcttgcacttttcatatttgttcgcatatggattgatttcctgattatgttcagtctcatgctggtgaggttattattggagatagatctacatgtgagattattagaatcggctctatttatattcaagttatttaataactatcgtataagtttttaatattgtggtaatgtttttaaaagaaaaaatatgtaaattttacgagaataaaaacgtttaaaacacgattactaactataaaataaatatttgtaaatttacagaataaaactgtccttctaaatttttttttatttcattctatataagatattctcaccgatgaaaacatcactacgagggacggacaagtctaacactcaacagtcccaaagcatgcgcaggcagcccgcaactacctccatcaaacaaaatcaatcttttaaagggcaaattggtcacgccaagtacctttaaaaatcaaggggaaaaaaagagttgttgctagacctggagtcctggacgagtaggggacggtggccgagaagaagagctgaacgaagaccagcaccaaccaagagaaaagtagcaactcacacacagtaggagaggagaggaaagaacccagcgatagatcagagtcggagagaaaattttgcctcctcccatcggaatctagctaattattttccagtccttctcccccatgtaagtctccctctcccatccccgtcgcctgcacctaccggaagcgaagccttctacagttcaggtccatatccgggtcgccgccgtcggctagctctaggcggac

SEQ ID NO: 2113 - DNA, 1415 bp, Zea mays
tagatataaatctgcggccgcgacctccccttgactatcgcctcactacctccagcagggaagaccgggcaccctatctgtgcgcccgctgccctgcggacttcatcgtggcgccgtggaagatctgaagacccacatcctcacccccatatccctgtgtttccgtgagtagcccgccacaatggaactcgccgccatcagcatctgtgtggatgaattaccgctgcgcatgtccaggttgccaccaccgtcgacccgcgtcatcgtcaccgttgtggcttcggacctgggcgctgtgcgcaggcacactgatggtgcacatggaattttcgggcgtgattaggggcaaacggtgccgcaattcctctccgtgtgtacgacgccgccgcgattccgccctcctccgtgggcagctgccaccacacatccaacaccggtgagacaccctatctctgttcacttgagcgtccgcgtcccgcatgtatctcttaggtatgctytggtactcagggtctggggctatcgttctccggcgggcggctccgccgtggtggcgagcgcgccgcctcctggctcggccgggcaaggggggagtgcgatgtagtgacggttgatttggcgatggacttccaggattacagcgtgccttgtctccttcgtcgaacggtcgtgtccgcccgatcgtgatcgagcgattaggaattgaatccaccttaagggagtctagattgatcgcaggccgttgatttttgatcgatggatgtgattagagctcagggtaccccttcatgtactgaatcccaaccgttgacgtgagatcggacgggtgcgtgctgatctcgaccaataaaatcactgacaacacacgagcggagccgtctcgctgtcaggccgttgctaatcctaatctcccccgtccgcgttggggcctccccctcgggttcctgtctgtacgccaccacgggacaaagcctcgctctcgtctctaatgccaatcgctctcccttaccttcctacgccctgccgcgcgctacgtacgccaccggaccaccaccacaagcgctggacgcgagcggcccagcctgacgcagcgcggatagagggataggcctcgacgccgattccgttggagctccgcgacccttggctcccagcctcactttctcgctcgccgtgctaccctaccccgcagagacacgtcccgtcccgtcccgtcccaccctgtgccagccagctcccgaccggcgcccgccccgcgggatcttgtctaataatataccgtgcgcgcgggagcagcagctggttcgtcgtgcccgcgcgctcactgcactccgtgatcaccaccacaccgctatcctgctagctaggtagctgaattcggagccaggctcgagcgaggggagggcggaggcgag

SEQ ID NO: 2114 - DNA, 187 bp, Zea mays
tgacgaggaccttcagggaattggcaatagtcataatgggtttggttcatctctatcggctccagtttcaccagtttcgacaacccctgcaactcggaggcttgagaaggaattcagttttgccagaagcaggcacagcagcttcaagagctcagatagcagctagtacaatatagaagaactggaa

SEQ ID NO: 2115 - DNA, 337 bp, Zea mays
gtcgtcgcctcatttatttgctarcttttgcgctggtttctgtccgagtgcgggatgtgtaagccaaaagaagctgcgtttcttggggatcgggcgctgtatataagcatgtgattcgcgcaagaagcagccgagaggagttgccagagcgtcaagtctggttcgccgcacggcgtcgcgacgccgacggtcatgtcggggaagacgacgccgacgaaggcgacgctgagccggccatgcgttctggtcataggtaatttaactgattaataatgcataccggccgcgactgtcttttgaaagtaatgctagctgccgttgtggtgtgtgggcagtg

SEQ ID NO: 2116 - DNA, 82 bp, Zea mays
tgtacgcctgaaaggaattctttgtaaatttcccctatatctggttctgttatcatcattattttccttgcgttagacaata

SEQ ID NO: 2117 - DNA, 183 bp, Zea mays
ggtacatctcctgttgcacttcctgttaattagagattaaatgttgcattcttatcttgattgcatcatttgggcctaaatcaactaatcaagtttattggtgaactctgacaggcattgaaaacttatatttggcttcagtgctttgatggctccatacaacaagtggaggaagaagttgcg

SEQ ID NO: 2118 - DNA, 1248 bp, Zea mays
ggtcccatcatgcatcccgtggagtcaatagtcgagaaagacctgaattcacggagctaggaaatgaggctgtgttgaatgtggtcgcaagatgctgtttttcactgtagatagtaataatgactacatagaatgaaattttagcaccgtttgtagagagtgaaaattttaaatgagatataagataaagaatcaaataggagagctagctgttgaaggtaactttttttttttgtctttaattaccactgtatagtgtgttatacagataaatcaggggcaccttttctgatgtatagtgtgtcatccagataaacgcgctatgaactcaactaggagagctccaatctcacccatgtgtgcatgaaatcatgacgcatggttgctcgtgctttgcagtagtaacagtagtaaattgaaggcagctgttgagtgttgacatggccggccgggaagacgactgggcatgcaatgcatgaatgttggtcatgattagttcatgtctcgggactgtaagcgacgagcgaagagatctgttgatgaagagcagggaacatttgagttgacagcaagacgactttgtaacactcgaggcatgcggtcggtctactcctccgatccatcctgctagtagtactactagacatcatcgagtgcaatggttaaatgccattgaccttcttgacgctatatatagctgcatgtgctagctgctgctaggagggagccagctagccactcgtgctccattttctacgtgctccttcctatagtaatagtatagctgatgaaagccctgcctgtatgtgattaggtcagctcattagttagctcaaactaaagcactacgtatggtccgctgatgcaatgcaaagccgagagctagcaagggagaagaatgatggcgtgcgtacgtgcgtatcttccgaggagtaggacgactggctggctgcctacgtcatcaattcacctccatcatcacactttgctctgttgccaatgccagcctcgtgtcttgaaatgcagctgccgcagtactccagtccagatgacatgacgaccagcattgcagctcgtgaacagctagctagcctttgcatgcattgagaggctcttgagggttcgggttcgcctggctataaataatacgccccggcggcccaggcatatcacagctagcagaatacacctagcctccttcattccttccttccttccttccttccacaactcaaaagcaaccggtat

SEQ ID NO: 2119 - DNA, 956 bp, Zea mays
ttttagtataggatataggctagttgttaggactggaactagggttgcataacttcttttacgatagagatagtaacacttaggcaaaaccatagtgcacattcttgtttggttatccgcatatgttttgtttaagagatcagttattagcctacattagtgcgtaaaatagaagtcttaattcacccctccttcttaggcgtctaggttcatttcagtcttctctgaactttattatcttgatgaagacctagtggagagtcctcggtcatctagccacaatctaacccacctcaagatgctaatgcttaatcatttgagacctatgttgtaatagctaataaatagggcttcctatgagacattggcacctatgaactgtggtgtaattaactatgagtttggacgcgggtcgacaaaattttgagggagtttggacgcgggtcgacaaaattttgttcggaaacttgtgcacatgggctgatgggccacgatctgatcgcgtgcatcagactcaaataactacgggccaagatccgacgttgaatgccgtaatccgaggtcaaacgggcgagatctggggagagattgtcggcgccaagggaaagagtgcccgcctctgacactcgtccgtttggcagaccctgacactctacgtacgatgyggctgccaattctcagcgtgtggtagctagacgcgtactcattgacacctgtaggagcacatgcatgcgacgtgctactagaaggaagccagcaggcagggacgcctcacacacatttaagtaacgcaacagaaacagtgcctttacgaraatagaaacaaaagtcgtgtccttcagcgtttgctgcatatatcatcttccatcgtgtaggactgactgactgactgactgactgtagggagtaragacaaacaaaaagacggccgcgtcactgattcaagctagcccgcc

SEQ ID NO: 2120 - DNA, 189 bp, Zea mays
tgtctgtctcggtgcagccataacactcaccatttcatttatgtatgcmagtaaggctcttttcagcagcttacctatccttgtacccatattcaaactccgctatgcaaacagtacggtctacagtgcgaaatagtgttttgagtgaccatatgtgaactgctggacacatgagctgaargcctcgtc

SEQ ID NO: 2121 - DNA, 899 bp, Zea mays
ttttttcaatcccatccaatatatacgtaggtaggatgggaataacggacaatgccttatatggtattttgtactattgaggtacgatactttggacatgcaataaccaaaggatctaggtacggtaacgagtggtggactgctgattgaataattgacaacaaagttgtttagttcttttaggttgctactgtcaatttatgtgatgtgcagcggcatatcggagcaaggaagggaagtttgacacgggtttgtgacaaactcaaatagagtaacgatttcgcttagaagggtagttttgcatgtactaaatatagtcaaggtagtactgtacttggtttgttttatagaaccttcgactagaccctttgttttatgatcaactagtcctattcaactccagctgaatccgacctaggaccactctatttcaaattttatttaaagctacgaaagtcgtggtccagatgattagatttaacaaaattacacacacacgatgacacgaaccaagccagtgtctccctcatggctagatatggcgcaatagggtcatttggcaggccatcatgggcccactgtgaaaaccagctatccactcccagggaaaccggaggctttggcactccagtatatccacccgccggtcgaccctccctatcgagaaccagacgcggatgcgcctggcgcctgcccatcccatgctttatatactgcacacctccgcctgcagatatactgacgcgcacactacaacagtaccacgccattccggtctctgcccgtctccttcctcgagctagcggctagcgccggtgactcgaccggtgaggccaggatccttggctcgaagaagcgattgagcaccaccacacggggttatagacgaaggatccagg

SEQ ID NO: 2122 - DNA, 1500 bp, Zea mays
tcagggccgggtccaaaataaacttgacgcgtaactttccgttcgtttgtgaggggaaaaaatctagaccgctttgcggtttatctttttttttcccggttataagtataagagaaaataccaggtccagaatgtttggacacgtgcctagaaaacagtaggcaatgcctgtatatatacgacgcggctccagaaaggacggccgtcccttgccacgcgcccacgccgattctacacacgattttccgatgaggagccagggccaggcacaggcagacgaacggatacgcagcccggccacggccaaccaaggcgaggcggccgccagaaagtgacgggctgcgtctggaatcacacgccatgcttttgctcaaagccccccacctcaaagcgacgcgagcgcagggcagggggtgggggacaagtatcgcgcgcctgacccacgaaatagaagctgtgggaaaggagaggagcagcggcggtggggagggccagccagccactcgcagtcgcacactcgcaccacagaagcaagccacccgaacggaacaggaacgggaacggcgacgcactcttggcttctctgtgtcttcctgcatcgatagccagtacgtagtccactcggtggttcagtggagacccaagaacgaaccgtagacaaatcaaaagcatgtggattatgctagctgctcgactttggaaattcgctggaatgcttgtgctgcgttccgccagaacaaaacagactagcatcatccagagtgtgcgtgattcgtcgattttccacggaagagaaaaaaaagaaaactgacaaaacggggcggacggcccggcccggcccggcctgggcctgccttggaggccgcgtggcgtgcgcgtgcggtgtgccctaacgccgtggccgtcaaaagggacggcgcagcagcgctgtcgccgtccggtcctatccggtggagggctcttccgcgtcccagagaggccattaaaatcggccgcccccggcaaccatctcttcccctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtggtcaaaaattgatggtggggttcatggaatgggtgcatgactggttgctgtgggacgccttcctggagtgcggagggatcatgaggccaccgattagatagcggctggggagcgagggaccacaggaggcggaggccgccgttagcaccccccaccaccccgcgccgcgagcaagcagcc

SEQ ID NO: 2123 - DNA, 1060 bp, Zea mays
tatgggcagttgtgcgagtggtcagaagaaaaatcgacctaatcgtatgcctcaatggtgatttcaatcagtattggcaaataagatgtgcgactacaccaacaacgacatcatcccttccaatcgatgctacaaccaaagcaaaatagatctaatctactaggcatatttcttacatgcaagccatccatataaaaactacatagagctagttatgatagcactgcatgaaaaacatatacgctacacactagcatatctaccacgatcaatcaagataacatgcgagtagtggattattggtcgttatcactggacacgcaatatagtggaaaaataatacgcgatgtagtgaaagtattcgaacgttctcgtgtaccaatagtagcaacatattcacatgtgctcaagttcgttgccaatcaacatcgcatgagcatctccattgtatctacacatgcgaggataagacgatgtgacactggtgtgctagcactgtattcccatcgagagaaactgcaccaatcttgagcatctacaaccctaggagagagcgtggcggtggctaagattattctctcaagtacactaacccatatatatataaactcttgctaatgagctgttatcctaaagatttagtattttcatagattataattgcctcttagatatatattcttctacggcttctgtgaaaattttagtacgaggaagctgctttctgggtagaagctgagagaaagctaattggtttgtttttaagaaggaaaacagatttggaagaacaatgaagacctaactttcacactgacactgtggagtgtggtgcgtgctgtcaatcgagtctaggcccatccagcccactgtccagtaatgttggttggcccaaaaagaaaaggcattaacaagacaacggccgggccgctcgtcgtgtctcctcgactcctctcttcttcctccgctccacttcctgcacccgcttcttcccccaaaggccaaaaccctaaatctcctccctccctccctccaagcacctagctgccgccggttcccgcgt

SEQ ID NO: 2124 - DNA, 754 bp, Zea mays
agtgatgagctcactcactctcaagagtgagaagagaagaaaatagctagcatcgttgaattgaatctatggctgctaactagctcgtcgtgcatacatacatacatgtcataatgcaacaagtgactcctaaactagcgttctccaaactaagcaagtgtcgtcgtttagtcaaacaattaatacacacgtatatattatgcatatcattccatatatatagtactctcttcgtttttaaatatatgacaccatttttaaatatatgatgtcgttaactttttaaaaaaaaactttaaccacttatcttattcgaaatatttatttgaaaatctaaaatttcaagtcgtgttcaaactaccttaagtgataaaacaaattataacaaaataaataatattttacaatttttgttgaataagacgaagtgatcaaagttttcaaaaaaatcaatgaagtcgtatatttaataacagaggtggtagtaagtagtaatatcacacaatgtaatggagacccattccaccctagtgaattaattgtattggtattttgaccactcattgatgtgttgtattactaaaaataaaaataaaaggtagtgtacttatatttatagcctatagccggcgtatagggaagggattcctatggctatatatagtggcagtgcgcttgagttagttggcgtgcagatccagtagagacggagcacacacacacacaacacatgatatagcaaattgaagcaaca

SEQ ID NO: 2125 - DNA, 1099 bp, Zea mays
attggaataattggttcacaacatccataaagcgagtgagttctgcgacagcactgtccttataaatcttcaacatgaaatattctaccaactttttcttgtatctaggatcaagcaagcaagccactgcaagagctatgttggctgcacaaccgctgtggcttgtgggctgtggctgacgcctgacgggttgtggccttgtgggctgtagttagccatgagcgtgaccatacatgtgggctgttggcatgttgccttgctgtcttggccatgtgggctgtggccgtgggctgggtttggctgggcgtaggctgtgatctgtcggatatttgttcggataaatttcggatacatccgattaaagtcgcggatattcgatatccgacggatatcaatcatattatattcggatccgacatccgatcagactatccgtattcgtatccgttatccgaaaaaaaatccgaatatccgaaaattttatccgaaccagtgttcaccatcttcgaatccggatccggacggatattttccgaaccatattacatccctatccggaaggagttgacctgcgaagcaaaaccagcagataataataaaacaccaaaacgttatatgtaaagcgaggaattaaaagaagaagaagaaaaaagtaaatcatggacagcctagccgtgtctaacggagccgatgcatgccaagaatgaggagagaggtgaaaagaagatgagcttggtaggtacccttatccaaatttacaccagcggccccaatatatctcggcagaatcctctcacgtccgtccgctcctcagtcagtcctcacctcctttttctctataaaatcccctccccagtccaccgttcccgagagaagaacagagggatcgtcatccgccccacccacaactgctccagatccaggcacggcacggcacggcagccgggccaacccaagcccgtcttctcttctctctcgtccgtccctcactcgccgcgacgtgacaagacaacgcgacgcgcgcgcagcgcatacgtcgtccaaggcacgcaggggccagccaaccaatcgcgtccgtccgggtctggtggtggccgga

SEQ ID NO: 2126 - DNA, 63 bp, Zea mays
ggtaagtaaagtagtctcagactccagaagggtggtggtgagttggtagcgcttactgatgat

SEQ ID NO: 2127 - DNA, 1147 bp, Zea mays
aagagagaggttatatataacagaggaagctaccaccaattcttaacattgacgcaaagaggaggcttgcaagcagcagtacttcgagttactccaccgctattaaataatgaggggaaaatgaaataaatggctgaagattacggaacaaccagatgacattactctcaaagatgtgttggatactctacctaaagaggtgccaactgtccatgccagtttgcttttggtgtttagaattcacaaattctaactgaacttttccactaccgcgatatattttgttgcacctatatatatttaaagcaatacttatttaaatgtgtaaatgcatcgttgtttcattcatgttgtgtatactttgtagtgcagttgaaaattattcaagatatgatccttgtagtgttgaaaggaagacttgacacaactgtttggtgtctttgtttgttgtaacttttcatagatagctagatgttacagtttcttccatatcttttggtgtctgaaagtctacatgtgtatttggcttaaaggatttcaataagatcttgccaccctactcagtaggaagtgattatggccttttcatcaaatatagctaatagaaaggtgctaaaatctagagctaatccaaacaatctagattagtcaaaatttagctaataaagtctacccgcttgactgcttgaaggacagaatgagtgaaaattgaaacgcgcctagcaggctagtggcttgcactggaaatggtccacggacgctggaactgaagctgggtacctgctaaccgggtatccgtatcttacccgtattttccgggtatttgtcggatagtggccatcctgtatcatatccgtatccgactgatgtatattcggttagtattcgtatccgacccgtatacataattacccgtatccggtacctgaaaaaccggatattataagtacccgtattcggtaccggtcgggtaatctcgtccagttttcacccctaccatcaaaaacatggctgcctgcttgttaggtctataacaggaattggataatgatccccgtcagtagtcgggtgttgagtaataaccactgaatgacgagggagggaggaacccggacgcccaaaaaatccccccacccccagcgcggca

SEQ ID NO: 2128 - DNA, 1433 bp, Zea mays
cgtaagtgtgttagtactactacacgctagctagcttgcaacatgcacttctctctgacgacgaccggaattcaactgcggctgctgccggccgtgtgtgtgttttgcttttgcattcctgtgttgtgttctgttctgttctgcaggaaagtcaaatgcaactgaccagcagtagtaacgtacagtacgtatactcgtagactagtgcagtactagcatgtttaatttttggctgcatttacatttagtggccagtggtaatactgatggcataggcccagaaacatatgtgtcgatcgtagtggacggggatagcagtgtagctgcagggattcctccgatcccatatcgtcctctcgatcgatgcagtcagatagatgcatgcatgcagtagagtgcagaaacgcgcgcatccttttccgtggtcagtcatgtgaggatcaagagagcgcggcgatacgctggcctgcatgcagctgtgcagattctcaggtagtactcccatttgaccaggatgctgtgctgcaaatcgatctgcagctgctagagcggtttgcaggacccagcagaccagcaggaaatcggcaacaacatacatactgcaagctcaaagtccatgcacgaagccaacaggccggcctctccctatagctttttggccttttgtttcccttgcttcttgtccgttctcttctctctctctctctctctctctctctctctctctctctctctctctctctctctctctctctctctctctctctccccatgcatcttctcttctccatctctccccctacctccggccggtcggactgtgacatgtaacggactgctcaatgatttccccgcgatcgagctgcatgtgcccgcggcagagcagtacacgcagacgggatcatctccatcggccagtactacgccagtggctacactagtctcgctttctctctcatgcatgcatgtatatgccctcctcttcctctctctctcctgcacgctgtgcagcaagtgcaaagcagccaagcacagggcacagcatctgtacatgcatgcattgtttgactcgatcctatccgcttatctttcggtttcagtacaggcacgccttagctgtggccgctgtgcgaatccctgctgtcccgtatctcccagctttctcgtgctactgactgttgtactagtcctactacactgcacagagcccagctagtatcgccatgattgaatactgcaactcctgctgcgtgctgcatgccacaccagagagcagcgtttcaagctcttccccatagttcagtacttcagtatatatgtgtgtgttgtctgatgagaacgtacatggccctctagctagctccggctccgcccactctctatccagtagctagccacaggctctcatccgcctcttgttccttgtcttgttc

SEQ ID NO: 2129 - DNA, 54 bp, Zea mays
agtttattgggcggcaaatttttcactgatatttgagaaaatggcggccgagaa

SEQ ID NO: 2130 - DNA, 696 bp, Zea mays
gtgtgactgtagcaatagaaaatttgtgggctgcaaagaaagaaagtgatgccgagaaagagcagaagaaagaggagagattcaataaagcatttgcacttgaagttgatcgagttaacacaaaaaaggcacttctcgaggtgaggaaagaggagattgaattacagaagcgaagagatgaagagaggataataaatatggatcttagtgggttgacagaagagcaacagagttactacacgaagttgcgagctaagattttggaccaactttctgatgcttaggtaaaaaggcattgattttcaattacttattacttgtgactgcaattataacttacacaaatatctatctacttgtaggttccaggtgctcaccaatctacttgtaggttgtatggtgcttgagggttagtgctaccagtttactagtcccatatagtggagtccatgtcagtgttttagttgatgtttactagtctcgaatagttctgtcattgcttccagtttatttactgttttcagtggatactagttatttatgatagtagtctcaaatcagtggatacttgctatttacctttgggttctctcttcctaatttattggctttgttctttctctaaatttatgttcctatttgtaaaacgaatgtgttttcacaagtccaagtctgttccaaacattccgaaggacc

SEQ ID NO: 2131 - DNA, 599 bp, Zea mays
tcctttccctcgtctccttgtcctcgctccagctccccagtctacgcgcctctcttcgtgaaggaagtggacacggctgcgaccgggaggatgagccctgtaccggcggctggatggcggccgggggcggcgagcggtggacggcggggagtctggcaggtgggggagaggggatcggacgaagcagagaagtcagagcaggaggatggaaacagtagcgccccacggtcggcccaaacgaaacgaccacgaccgggagacacacgcgcgactctattaccacgtcactgggcccctacataggcccacctgtcaatggcacgtggcggctcccgtcagcagctgccttccgtgtctcccttccattctacgsccacctcggcagggagcgttaaaagcgtcgcccgcgaagaacgtgggccagcgtcggctcgccgtctccctccctccttccagatctcggcgcgagttcacccttcagatttccatttccaacacgacggcgaagaagagctgcgatccggaggagtaaaccctacccgccggttgcccggtgcgcgggcgagatccgggcggagatctagggcgcggcgccggcc

SEQ ID NO: 2132 - DNA, 719 bp, Zea mays
tgggtagcttatttcagcttatttgtaatcacaaagtggtattttacccttctatccttccatcataatccaacttatataatgaggcaaataaacagggcctaagtgttagttcaaaagttgttggattatattatttggacagattataatctcaaacaaacaccccccttagttcggacatacttctgaaaagtcttgcaaggtccctcacgtttttgtatacatgaggctgtgcctctgagggagtttctaacagagctacagttggttttcgcttgcccatgagaccatgagggagtttctcacagatttttgcttctactatcaacagaccaacattcttgctttttttttttgcagtgtccttccgggcgacgattggttcatggaggtctcccaagaagttgtcagcatcatcagtggaaggggtagagttgctaatggtgacagggaagcaaacagcccaacggcctcggtttcagcgcactccatttcttcgttcagatcccatggcagctcctagtttgcaagttggtattttttttggtaggcagatcactgtataataatcgatagtatattcttccaacctattcctccactcatttgttttttcttttctttttcaaaacttttgtgctagtattagtagagagggataattgtttaacctaggaaaataagtcttgagtcattttgttttagagagctgagtc

SEQ ID NO: 2133 - DNA, 597 bp, Zea mays
ttattagctcaatgatgatagcggtgtagtgagacaacgtgacagtctgggttttagtgtgttgttaattttcagcattgatattatttgtgcctagtcatctctttcactatattgtgcaggctgattatttaagttcattattgttccttaattcctgtgcacactgttttgatcttgatattcatgcttgatttctaggcttataatatttgatctaaaaccctgatttggtaagataggactgtcacgttagtcgaggatctttgatcaccttttagcgttggagggctgtttattacagcaacccgctattttgagagcaatattttaagataaacaatcatgtttattagtttaatctgccttcttcatctgcaagccatgtttaattataaaatggatctgagtagctattttacatgtttacatgttctagaattgctactgttcattgctgcaataattacatatggcatttatctgagttatatgcttgttttattcggaattagaatatttaatttatttaaatataatggaagcatgtcacttatttctctaatattacaacaatccagaaaaccaattcgtata

SEQ ID NO: 2134 - DNA, 499 bp, Zea mays
tgcagaatgagctgggccacatatgttacttcttaatgggcctgatgaagatccatcgacgtgtggcccggaccgatatgccttgagttcagtttccgcgaccggactttaaccggacattgcggtgtagtatagggtttagcagacaagggaggggactgagaactgggaagccgacgctccgctcggcaaagcctgaggcggcgacgacgcttgatctcagcccgactcacaccggtaacgaattccttgccccaatctttgggatacagcggcgactgttatcaccctacttatttacctgcctcaaagctgcgtgcctgcgttcattcgaggcgtgcgctccttcaattttccctgacaccgatgcatagagttagagtaggcacaataatctgtttttttttcttgggatgatcgtagttttgtctctgaccactaaacagttcgtttttttctttctatgcccgtggctaacttctagtgaggagttcgaggg

SEQ ID NO: 2135 - DNA, 159 bp, Zea mays
atcgaataaggctaaattatatataaaaaatgggcccacactccaaaccccccctttccctcttctcttccaacgccactcagttctcttccctctctgcgcaccaagaagaggtgtcttgccagaagggagccgcctcgccgcagccgaaggccaccc

SEQ ID NO: 2136 - DNA, 1034 bp, Zea mays
cctcaatcggtcggaagggcggagcagcagcaggagcacaacgaggctgcctcctcggcttttctgggagttcggacccgtgcggcgcgacgggcgacggcgactgaacattccagaagggggcgcgtgggaaagcgacgggccggcggacggaggccgggtgggcggcgggatcggcacaacaactcaacaaacttggcctatttcttgctgggctttgtgcgggtcgaaccgccctgtgactgtgattctgtatggttgtggcccgctctgtcgggcgcatttttgggtagacgtgtggtctggtgacggcgccggcctggccaaaaagtggcgtcgtgcgctgggcggcggtggggtctagccgccgtctgggcgctccgctgccgggtcgaaggacctataaaacggaggggtcgaggaagctagtgagtgccatcgttgggccggcgcaaaccctagtcgccacatcactgcctcctcacaccatctgcctgtggttcccatgtcatcctcccccgtttgaggtcttcctgctccttcagatccgtctatgtgtgtgtttgtcgtgcctgatactggctcggaaggtattccgatctgtttcttcggtgccgtatatttcgttgcgattttggttcggttctttcttgctcttcgtgggtcgttgctggataacacggatcgatgatgctgttcaagaagtactgcgttatcttcctgatgcaagtgttaggccctcgttacgaaggcttcctgacgacacaaatatcttgctgagatccaagtgcgcaacttctctcttttttctctttcttttccgtatttctcgccgtgtgctttttctcctctggattgaattttgcgtacagtttagttttcaccaaatgcaatcgtaacttacgggcaggatgtttcagcaacgaagtaaaggaggagattattccgtcaaccgtaaggttccgctaagagctttagaatatgaaaggcattagtggtaacaagatttgatttggttaggtgttagtacaaaa

SEQ ID NO: 2137 - DNA, 1144 bp, Zea mays
taatatatgaccgagttatagatttatctagataagttatacatggtccaataaatatgaatttttatgtatagtcaaaacatgcaatgatttgttcaccatatttttaccacatctggatcataaaaactgcagctataaattaattatagaaaacacatatacaagcttatagattaaattttataataaaatatattatatcatatattcattatacatatatatattcatgtggagttctataaaattgattctttattttatgtttttacgtgatttattttattttataaaaattatttagtcaaaataaacataaaagaaaaagagaacgaaggaacgtctagagatgtcatgtgttcggtttttagcgatgagagaggatatatgtccggttttataattaaaatagaaaaactgattttttatgaaagttgtgcacgataaaatagtttttttaaaaattaatttttatgtactgtagtacgttattccggcgcatcgtatttttagaagaaaagtgcaagaggaaagagggcccaagtgattccgttccatccgcatgcatcgcggcccatcgcggcccagcccatgacctctcctcaccttggcgctcgacgctcgttaggcatcccgggcccggggcgggtctttttgcgcagaaacccctttacaatcgcataagaaaactgtgggcactctcgtcattgcgcacagcgcctgctgcatcctcctggtctcgacacggagccccattcccacccatgccaatgacacgtgggcccatcctcccgcagcccacgacatcagaagccgcgtaagaggataggaggtgtgcttagcgacctgtccttttccctcatcttattttcatcgctcccgaagaaatttgctctaaataacaaaacatagggcaagagcctagactgaggggccaggagagagggagaggccgaggagagagatagagagacaaaggggagagaccaagcgccagtgacacagagaaggggcggaggagagagagagagagagagagagagagagagagagagagagagagagagagagaggagaatcgcgggagggaggcggggtttttgcgtgatttgagttctccggttttccccacgctcccgcc

SEQ ID NO: 2138 - DNA, 406 bp, Zea mays
gagagttattttgctgttaagtagttaaaatttggattgacaaatcatttagctagtattttgtagatgctattacatagggtcaataagcttaatcttcagcacaagctgtacgcagtggacgagattagtcaaacaaatggctgcactgcacaacgtgtcatcacgtgcgaagggtaatgcgttcatcactagtatcagttgcagttccactgacccaaacctccacaccgcagggacgccgccgcacccgtatccacgctataaaaggcaacgctgccgcggcgccattattgatgcgagctgaggcgtgatctaacaagcaagcggccggagcagctggtctctctctctagctacgtataacagggagcagaagcttgtgcgagtggcaaacgcgcgcgcg

SEQ ID NO: 2139 - DNA, 214 bp, Zea mays
accttggggccggtgcagctttctggtccatgagcggctaaatagttggggttttctgatgcattggaggtagatgaatgaatacagtaatgtggtgttgcttgctaacaatgaaaacagacttcaagactcgcactcggcctgaggtaatttgagtttgtcgaaggtttgtagtgtggactggcgaaatgttgtgcaagttcaaccttaaccc

SEQ ID NO: 2140 - DNA, 599 bp, Zea mays
tggccggcgccgcgccctagatctccgcccggatctcgcccgcgcaccgggcaaccggcgggtagggtttactcctccggatcgcagctcttcttcgccgtcgtgttggaaatggaaatctgaagggtgaactcgcgccgagatctggaaggagggagggagacggcgagccgacgctggcccacgttcttcgcgggcgacgcttttaacgctccctgccgaggtggscgtagaatggaagggagacacggaaggcagctgctgacgggagccgccacgtgccattgacaggtgggcctatgtaggggcccagtgacgtggtaatagagtcgcgcgtgtgtctcccggtcgtggtcgtttcgtttgggccgaccgtggggcgctactgtttccatcctcctgctctgacttctctgcttcgtccgatcccctctcccccacctgccagactccccgccgtccaccgctcgccgcccccggccgccatccagccgccggtacagggctcatcctcccggtcgcagccgtgtccacttccttcacgaagagaggcgcgtagactggggagctggagcgaggacaaggagacgagggaaagg

SEQ ID NO: 2141 - DNA, 1500 bp, Zea mays
cacaatgaggatttcatgtctctgtttccaaaaatgccacatcagatttatggatgaatgaaataccctctctcaatagagagtttcatctcactatttcatatgtcaacatacttcttaaatgctacatataaataaccaataggatttactcaattatatgaagatgaaacaaaacactctcagtggaggtttcacacagtttccaagatcttggaaacgagttaacatggtttcatccccatgaaactccatgaaactcttccttcttaaatgatgtgacatgtcatcaaaatagctgatgtggcaggctaattaatacatgaaacaccccatgaaacctacattgtgaatagcctaatggtgcgactttgtggaagattggtcgttagttaggcatatagtacgtactatactagagtagctggcattgggatgatgggaacatttaagcaaagtcttgtgagcttcgttccaatgctccggttaccgatgcatgactagttaatctgccgacaagtacgcgtacgatgtctacatgcatggacgacaatgcatgcagtgaacccccacgacaccactctgcgtgccaccggccgtctcagctcagaaccgacctactactagcttggtagagtagtcgtaatctctgctaggccggttgcagcagtattgaatggtcatcagcctcgagctgagctgctagaattaaacaacttgctgctttctcgactctcatgcatgcatgcgcgcgcgcgtgtgacgactgacgacgacgactcttggactggagcttttgtcgcggatgcatgtttgctctcgttgaatcttgatcggtcccccgtgtatcgtgcacaacgcatgcatgccgcagcagtacagctacataggtgtgtactactgatgatgagatgcatgcatatatggccggtgcagatggcagttcagacgacattgatagcgctacatatatatgtactaaaccctagtcccctggtatactactacagtacaggccactccagtttctctgacgcagacaatatttgtatattattcacgtattatttaccaaacattttctatttttcccttttcttataagaaaaataccggccagacggccagtgcatgctacaatgaagccaaaatcggtcggatgatgatagatgaatcaataccaaccatatgtactctagtagcactatctagctagcttcgctaggccggccgtgctgcacacaaaccaattcaaagttgcaaactgttcattaaataagtaagatgcccccttttataaagtagtagtaaactattattagcctttctatttatagtggctgagagacgggccggacattctcgtaccacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggcc

SEQ ID NO: 2142 - DNA, 646 bp, Zea mays
agtaaggatattttttaaaatcaagacaatcctgcttagttcagggtctgtttggaacatctagagctaataattagctgtggatttccaaacactctcaactaaaaactccagctaattgtcaggtacctcacaactaagaattagtcattagctggctcaagctaaacccagttaacaatttgttagctggctaactattagttctagcggttctaaacggggccttaccgtatagctaatgattggcatagggaggtatcacaacccagattatatctcaggagttagccagttaggtaccaaatattgtgctaaaatttcgatacatccatagttatactttggtggtacttccatagtagtgtaaaggctctgccaaagacttgggatcatctcctacctttcaggctggttctggataaatggttttctgaccatcaaccttctaaaccatttgttagatctatgcaccagaattttaatagtcgtgtccttttgtgaaccagatgtttattgtgacaacttctcaggctggttaagcatttgacgtcactgctgtgctaatgttatatagattgacctgaaattgctccctgctgtgcaccggacaggttgcatcacaaccaaggagctcggaactgtc

SEQ ID NO: 2143 - DNA, 1500 bp, Zea mays
acttgtacaaggccgaagacaactcagtcgtggatgaagcggaggtcaatcttgatatagttggtgtattggagctacatcgggttactcgagagataatctacactgacgttatcgtagtaaacgagaatatcatgtttrtaagagttggtgaagtttatgcaagagttgcttaagtttgccagacagccttggcaacatccttttgttatgttacctgatcttaatgttagaaagacgcttgctggatcatgagatgaggttatcattgaaaaacatcacatagtccaatgtgaatttgcgggtgttggtgcagacaacctagtcgatgtcgacatacaaggtgaggatcgcagctggagcgcgacctagttggtttgagtgccaacgagggtcaaacacggacaactctaatttttaatccacaataatttacaggtcaaacacgggtcatattttttgatctaaaagtgaatccaaagcccaaaaaacccgacactaaccgaaaaacttaatccaacacgtccaacattgttgcatgagctaacccgatctgatactagacacgaatcgaatatagactgtgtcaaataattcatgatttgattttgacccgtctccacgtttgacatgtctaatcgtaaggttcgaccggttcttagtcaagatccgttcaacgggagtcatggaaagcgggtgtgccaaacggtaagctcctggctcaaacttctctgccaataaataacggcccatttaaggatgcagcccaaacatcgtctggcccattacttctattacaacaccgatgagaacccttgttctacctcccaaagtcgggttcccacccagcgtgcccgccgccgaccgcctgcacaagcctgcggcgagatccggcgtcgccggcgagcttcagcaccggcacgtgctccggaaggaaatagcttccggtgacgtacgctaccctctccgcggcgtcccggggagcggggacggggagcgctttttgctgtcacccgcacacgagcgacgagctccaccacctgcccaggtttctgtctcgttccctcactcgtagtctcgtcctcttccctctctcgtggtcaatccgtctagtcacttggtctggctgtggaggggaaccagcagagacgcgggtgacagtaaccttagtcgttgtagtgttcggcttattggaaatctcaggacagctcagttgcaagaatgtagggcaatttgtaatgttcctgctatgctgctatgccttttgaatttctaatgtggcttatcgggtattatctgtgtattgaaaagaaactaaaatgtaggtgtatgtgtttttttagaaaatatcacattagcttggcatatgttctcatctcaccatgaaccgtgttctttggagcagggttagttgtgtatggaacaatgacgaacatggcaccacggcagggacccgtcactcagtgctgttgattctggaacatcgcctcgctaccaccc

SEQ ID NO: 2144 - DNA, 347 bp, Zea mays
ttattgatggtatcttatttcttttctctctcttcttcatcctcatcttcctcctgctgaaagagtacatttttttgccagcgtgcctgtagtactactagtgcttcatccccttcttctctggctacttcctcttctccctttctttccctttcccccctctctagcctccttcccttctccactcttatccctctctgaggtccgtctatctctcctctctgcctcccatctttttcacctgcccctcatgtactgatcgtttcatgacctccatttcccagtggtaacacacctggcgacgtgcacgagtgcgcgtgtgcgggagcagtagctgtactgtaagc

SEQ ID NO: 2145 - DNA, 47 bp, Zea mays
rgttctttgcgcttgtgttttgcaggaggccatactgcaggctgtca

SEQ ID NO: 2146 - DNA, 676 bp, Zea mays
tctggagcttgacgggaagctgttcgtcaacacgcagcagggccctacctggcgcgccaactgtcggtgtttcgaccccggggggtccctcgaccgacgagtaaattgtcaccgcgtgtcccagtccagatgggtcggcgcgaggtggagcacgaaggggggaagaaacaggcaaaggggaaacccacggccttcgtgttgccctgcgccgaggtcgggtgcgcttgcagtagggggttacaagcgttcgcgtgggaggaccttacgcgtcggcccgttctcccgcgcggccaaccttctcgtacgagagccctggaccttccttttataggcgtaaggagaaggtccaggtgtacaatggggggtgtagcagtgtgctaacgtgtctagcagagaggagctagagccctaagtacatgccgtcgtggcagtcggagaagttttggcaccctgttcatgtgatgtcgtggccgtcggaggagcgctggagccctgcggaaggacagctgtcggggctgtcgaatccttgctgatgtctccttgcttccgtaaggggctgagagccgccgtcgtcatggagcacgcgaggcgccatcattatttgtttaccggggcgagccagatgggacgccggtcttgtttcccgtagcctgagctagctaggggtagggtaatg

SEQ ID NO: 2147 - DNA, 303 bp, Zea mays
ctaacccacacggcccacctgcaccgagcggttgccgccgttaaaccctaccgctgctctcgtcaccatctctccgactcacccctctgtcctcgcaagccgccgccggccaagtcctgtccctctcccttgtctggttcggatcgtcgttgctagccaggtaaatctgactgattcttctccttacctgcttctcccggtgtggatctcggctctcgacgagtttcagaggggttgttcgtaacatctgctaagatccgtggcggctgtttaggtgctggatccgtagcggcggcggcggcc

SEQ ID NO: 2148 - DNA, 1500 bp, Zea mays
gtgcgtgccttgaatagaattcacggtgacgcttgcttgtttgtgtgaaaccaatttcagaataggttccccctgaatatgaagcttaataaaaatggatcatgctcttttgctacagcagctggtaggtacgtgtacgccgtccaacgggcagggcggctcatcaattgcacagcttgttgagtgttgcttacgttgatcgcttgctaccgtactcccgtagtccaacaatcaccgtgcgccttggtgaatgatgtatgtaaatgtaatgtactcaccccttggttacagagagacagacagagagaaagaatgtaattcttgttttttcgatgaatcaggtagtccaatagtagagctacgacggagctagcgggaaatgccacatgtctccatcatctagatgtggcaatgtcaacgcatattttgttttcaaaacaatcgattaaagtcagcagcacattggagacccggaaggcgactgcagactactcctcctgtccctctactctactacctgatggccgatgccaaaagccgtagtagcatttcataatcaaatcgacggacggattcatccagcagtaatgtaaattcatgtacagtggagtacgcattgtactccatgaccttccctcgcgatcgatccgatcggcagctccagtgccacggcgatatgccataaattcatgattcatccatcagtctctctctctctctctctaccatgtacaacagtccatacaatcatgtgatttgtcaagtattttttcttcaagaacacaacgtcacatatccggtggctaaggtttacgagcaagatctattcagcctaacacaccctctaagcatgcaaaaaaaatttaaaaaaagatgaagaccggaacgtgacgtaagccttgtattgactaacaatgtatgtatacttttccattctcaaatggagcgagtaggttttaaccacacggcaaatatacctcaatggtttcaaataaaacacacacggcatgactcatgagcttgaatgtcaggccacgtggcggcgtccgatgactagatacacccatcacaaccactctgcaatgcatcagggcgacgtttctatacagtagactttcaccgtgaatttgtcgccgataaagaaaaaacagtgcatcttttcgtcaggtttcaagtctagcaaacggcacgaaatttttaaatcagttttttttttcttcttccagttgttccattttgggccgattccgtcgttcatggaactgggaatctgaaacgccgggcccaatggttctcagaagtcaaacgcaggctgcgcctgattgcctgcggccaagcttttctatccaccttctttgaccgccattgctctcgtcaaagagcatttcagcaaccacctccctcctctacaaacgataataaagccctacctctcacatcggcaacaggacgaggccagggcatccacgaccacgacacggacacagggagccgcccgcc

SEQ ID NO: 2149 - DNA, 999 bp, Zea mays
gggatgggttgagaaacaagatggagggagaaagtgggcagcctgctggatcttggcatctcgccgccgctcatttccgctccacctggtatgccccgcttccctctcactaaacagactccgctggattggattggatctttttttttccttcatgcgtgccgtgattgttagttagccgcttctcgtcttccttgatctgcgttttgcgcctggacgctccaaagatcaatcttttgctgctgcttcgtgattcggctttgctgggcatcggaatggttggtgttgacgaatgggtttggttggtggagcagtatgcgtggatcatgtgatctatatgctctcttttttctgtttgctgaatggcgcctgactcgcgagatttgcttccaaaacccgcttcttgccttctgctagcagatatgctcatatgcagaagcatcgcgcctcgatgttcccgaggctccgtttctggggaaacgaattttgggttctgttggtttcctgtttatttatttattwatatatgtaaaacaaacccttgattgcattgttccccgttatattgcttaccttgcttatcagtcagtttgacagaattctgattgctttttttacgtcacacgaaggaagcgttgcactatcacttcagtagcgcttactgtgcatgcacaacttttttttttctcgtcatacagttactgagggaagtgctatctttttcttggctcctgtttggtgcagtgtgggctagttatctactagtagtatcttcgggccagttcaagacttagccgctggtacgtactaactcgtgtcatagtcatagccatggtgtccttgtgtcctctccatcattgctgttgataccatactttattgatctttttcaagttatgattttgaggataagatattgcatctctgcacagttctaagcgctgaggaagtaaaatatcatttatcggctagagtagtctctgttgctatccggcacca

SEQ ID NO: 2150 - DNA, 973 bp, Zea mays
ttgcctctcgcgtgtcgcgctattagagtccagcgacgcgagggtaggaatgtagcgtcagagcagcgcagggtcgggactcggggtggagagaactcagagaagtaggcgccgcgcgcatgccgccatgcatggcacgcgccctggatcgcggacgcgtgggcgtgtgagctggtgcggcggctccgtcggcttgtgcggccgggtgcagccgtgcaggtgctggagagtggagaccggagagtcacttcaatgctttgatgacgtcagccgagtagtggattggtgttgttagaattccagactcacttgtgtcttggtgctgtaagctgcaacattttctgttgattgtattcaatataaaaaggaattacatgttgtattacaaggaaataaaataactagccaatcccggcatactcgtgatgagtggttgtcatcccaacctcctgggtcataccgtaatcagtggcttaccttctataattagatgctcaggactttattcaaacaggtgtggccggggcgggctggattatttaggctgcagcccaactttgttggcccatcaacttggcagagcttgcaaaatttagcatatggctagattagaggcccaaatgtttgtaagaggctggaaaaggcccatttatatatgcgacagtaggcgtaataaaatagaaatacacacagtggcaggccgtaatccatatggttgtccggtgtccggtgtcccttccgttgccttccgtaattcctgatcggctattccgtggaagaaccttcgagaactgggatgcaactatgccagcacgcagctgggctcctctcggttttataaaaacctcaaagcttttcgccttaatccccatcaaccccccccggacatttctggtcgcaccctcctccggccctcccagccgccaagccctctggaaccttcgagagctcgatcggatcggagccccctgcc

SEQ ID NO: 2151 - DNA, 607 bp, Zea mays
agttatttaacaacttcttaaatatgtgatttataaagctaaaatttagataattattattggagttgctcgtacattgctctccgatagcttaacaacaccattatgcgacgtgcatggggccttgttttagaaaaaaaacatgtctacacctatctccaaaccaaaaaaaaggcaacgagataatgccgtccgccatggggccatccggccatccatgttttcacgagcaaaccgaagcaaaagtggcgaactcggagggcatatctggcattcctaattctagtaggcccttgcttgtaagcggcacccaatagcataacaaccacacctgaggctgcggcctttgtgccatccaggggtcgtcgtcgtcactctctccctctcgccctcgccatcgccatcgccctcgcggtctcgccgcggcataaacaaaacaagcaaagcaaggcaaaggcaaaggcaaaaccccacctcctcgctccgcacctcgtcgtctgcttttcctcggtgcggaacacaagcccctgccgcctccattaccgggctgtgcctgtgcgaggctgcgagcgtggtggctgtgtctggctttgcggcggcggcggtg

SEQ ID NO: 2152 - DNA, 610 bp, Zea mays
caactggttttaccactgagcactacaaaatttaacaggaatcaactggagcctgcagcatcggcgcatcgacgccaagctggacgatggcacagtacgccacgctattgcgttgagcagcctagatacctgtagcgttgctgacagttgggtccacaagaaaaaaaaggtaaactgcacttgcccagtttatcactactgctcatcaccggcctggccttcggcgatcccatattccccttccgatcccatcccttccgcatcgtccccgaacgacgcagacgggcgcagaggcacggcgccgacatctccccgtggcccgagggcccagacatgaaggccctgggcgcgcacgccgccgacctgctccgaggcccgcacctactccgcgccgccgtcttcgctttcgccgttgcgctcgccttcctcgttggctaccactggcccaacgcctccccgcgccttgtcttcttctcgtccgatgcctcctcgtcgtcgcccaggtcgtcctcccgctctccttccgtcgtgctctcccctaactctaacgtctccttcgacccatccctgatccctacccccagcaccccgcctgcttcttctactccca

SEQ ID NO: 2153 - DNA, 1236 bp, Zea mays
gggtggtcgaccatttggaaaaagagcaccttggggatgtgttgcctaaagtgttgtgtttagctttgggcctgtactcacatatgatcgctagagatcacatcagaggaagtgagaatgattcctagtatattgcattgaacaattgcatcatggggcagtaggtggtcgagttgcaagctagtggtgcttattactcttagaagctgacacctcctagacgacttgaggttgtggctccatagaagcctacaagcagttttgcgtggctaagaggaggctttgtgaggggtatcatgcccaccctgcaggagacgcaaagtgaaacactggttgagcgaggtgtgaagagcgccacgtggttcgatcggatcaagtgctagagctcggacgcgatcactccacacgagagcgtgacttgcgagtcgtcaccagcaagaggaataattgatagcaaccttgggcttgcgcctcaacatgcatggagtgtggctgccaaaccaccgagcctcccgagagttgtcattgtgtcaacatttatcatctcgtttgtttccatctcccaacactagagcttgttttatttttgtttatatttgaactgacatagactgtggaggctctccatgttttggccgaactagtagataaaagaccaaaactcgaccaaaaatcaattctgaactaaatgttagattatacgaacagtacttcatttaaacaattagttcacacagacaggacaggagtgagcaggcacatacctttcgtctacgtctgtgaggctgcgacgagacacgcgtacgtcaaacttatttcaaaacagctagctgtccgagtgcgatctctgccccgtaacgacaagctacgcttcaactaaacagttatgtgtaagagcatgacatgttctttgtttgcttgcgaggtcgaggaaaggaatgtactacgagcgacacaagcctaccgattttgtcgaccacttgagacttgcgatcaagcgaggaaaggccgaagaactccgcccaattttccatggcctcaggcggcctaacttattagtttagtttgactttgactccagttgcgcggtggagggctacgcttttgcatgcaccatgcaactctacaaataggcagctcgcgtccactcgccaccagcagcaagctaccagtacactgatgactggtcgagagagccagctgatcgatcgagttacccttagttattagacagac

SEQ ID NO: 2154 - DNA, 228 bp, Zea mays
ggtattgatctactcacggatcttgtgaaatagctcagttgcatagcatcacaacaggtattgatctactcacagatcttgtgaaatggtggcatttatctacttacagatcttgtgaaatggctcagttgcatgtgttggcccatgcttcctcttttacatacatattattatgcgaagaatacaaaattgctctggccaatcctttaaactttgtattttatatat

SEQ ID NO: 2155 - DNA, 313 bp, Zea mays
gcatctatttagatgtttaaatattattactatttttaataaatttaaccagaccaaaatcactttaaatcgcgacgagatagtactatttaactcgaggccccacctcttcaaaacactgccccatggcccattgcttacgcataactgcggcggggacacgcgacgctaccgacttcgccgccgcctccttccttccgcccgtcgagtcgaccgaccgattgttcgcgggtcgcggcctccctcctagtcagatccactcaatcccaagaggccaagtccaaaccctacccaccacccttctcaaccagcg

SEQ ID NO: 2156 - DNA, 54 bp, Zea mays
gtcagggtatttgcaaacggtgacaaaggttctgccttgccttgctgtggagcc

SEQ ID NO: 2157 - DNA, 585 bp, Zea mays
gttccaaatttctcttcggttcgtcgtcctcgtccccactccccacctgcgcagctgcgctgcgccatctcgaatcctctccttccaccatctcgaacctctccttccgtctcctccccggccgattcttccagtctccagccaccttcaactgccggccgcaagtggccccgcgtctcacccctaaccccagtgaagaatctaggcgtcgtctatccagccccgtcatcatcaccatggaggaggtactccgctccatcctctcttgcttctcctcccgctcccgctcccgcacccgcactcaatccgtaagttttgctcaatcgattcgaatcgtctgccatgctttccggattgtgtaaggatttccctgtttggttacatcctgccaccgataagcactaacccgaccttggtgacggtatttctatttcgggaagatgcctgtgtagatgtattcggcgttcgctgccattcccaacctctgccaaccggaaccaacttggacaaaattgtctgcctctgcatatctattacaacttgttcgacatactagattacactccacatatttacgagtctgat

SEQ ID NO: 2158 - DNA, 1010 bp, Zea mays
tcggtaccctgtcatccaagaactttctactcttggattacacggataaagttgaagtactacaagcaactataaacgactagagcctttgcttgagtccttttatacgcggtcgaagagtgtttgcctctttatttatttgttcagcaggccccgagaatcttcaccgctgaagcacacccgacccgaataattgataatattgctcaaatcatatgagatggacgctggctctgcagcttttagggcctgttcgtttgactcggaattcatcccggaattgttccagctaatcaaatgttatataaattagataaccaatccggctaggaatagttccggacggccaattcctcagaatcgaacgggcccttagctagtttcgagtcgtcggaatcagcttctgctagctaaatgttttgcttttcatagtctatttttgttagaatcgtttatataaaaattacatctaaatatagaatctatcgaatcgtcgtgatagtatgaatgtgatgctgcgcgtagactcctttgtcttctttagcacataaatggtataaaaaaatgtcgtaacagctatttttttaagaatccagattatcagaaatctttgggaaaaaaagcactctctgaaaaagccccgcgtcgctacgtgcagctccatctgctccgtgttgtccccatcccaatcaccgctgtcgcttcgccgcaggcatcccagcagcgagctagcatgcacgcacgcacgcaagcacacggcggcagctgcacggatgcggccgagtgcggcagcacagcagcgcgcgcgcgctccacatcgccttcgctagttcgctccgccacgtacgcggcccggcctccacctggcggcgcgcatggctgcgaccctcgccgcgccacctcttcatatacgctgcagctcgcctcgaaccctcgcatcgaacgcacactcgcactcgcagtcgcacgtacacggtacaccacactagctaccacagacgacgagcgcc

SEQ ID NO: 2159 - DNA, 1446 bp, Zea mays
tgtcgcctgcctcccaagtctcaacggctacaactgaactacgagagaattacctgaccaggaagagattccttggacggaattaattagctagctccaggcctctgcgcaaggcaaaactttgctatttttttttttacagatttcatggtgcggttgcgcgtgaagttaggaatgcgtgtctttctctgtggccaaagctagctagcagatgcatgtcatgtcgtcgcccagacgacgagtccgcagaccgcacatcacgcaagtcagagcctgagcctgcgggtgacaacgtttcgacgaacagacacttccaaactctctctgctggtgcactgtcattagccaatgcaagatcaatagacatgacaccggctgcatgcaatgcaattcaatggcgacgagtgagcagcagtggccaggccacggagaagaacagatgcccacatgaactgccatccatagacatgacaacggctacatgcatcactctcttccagtcccacctactacaacaatggatcatgtactgccagtttgtacaaagccggtcaagatccggaagatgactctcagatttgatcgagcagtcattccacacacgccacgccgtctaagtcgggaagaagaacgggtctgtagtcgggaacggcgccggcggtagagaatcctgatgatgctgcagagtggcgcgacggcacgtgcggggagccctgcgcgtctgccatgcccatgtggggaacggctgggcgcccagctcaggccttcgctccaccggcctttcctggacctgcacgatcgcagcagcacgagcatgagctttgtttgtcaggttttgaccacagtgaacgtttccacctttaagtcgttcacaggaaacagagcgaacaaacaaccaagattggatatcggcgagcatgattaatctttcatgattctgttttaattaattgattgattttaacgtatgtgcagcacaatgaagacttgatgctagctctatttcccgtaaaaattcagagaatcctcaggactacagctgcagctatggagaacactagtgcttttggtcctaggtctaatccaactgctgctcagtatgttcagccttttattgctcctgaatcaatccagcatcaacctggagttcccttgagggaggtttatcctgaaagagcataccctgaacccatgccgtcatcatatgctgatggcaaagtagctgtttctgcattgcccctcaccgaccaattattcaggttggatataaacacaatgaagaaacttgaaggacaagatgatgggaactctactcgaaatgtgaatgaaacaactcttttgcatgctgtggatgaaccaagtaccttaccccaccatgttggatctgacatgaagtcgatcctaagcaggagaagctaaccgaaaaagaaagcaggcaaaagcaac

SEQ ID NO: 2160 - DNA, 1500 bp, Zea mays
ttggtttgtctactaactcctttctgcaagaaaagtgatgtttgaacttaattttaggcatatcgaaaaccctagtgaaactatggcgaaaaggtatgtttcctacacttaggtcctgtttagtttggggtgaactttagtcatgaaagggaaaaggcctcaaccaattcctataatcgattttggtgtttgacgcccatcacaaatcttatggtctaactagtttgcccagttgatcatttctcacgttcataaagttcatatacatcaattctaagtctaagttcatatacaggagaagttttttggaaaatcacctatgcgcggactgcctgggcccttgcggcggaccatccgcgacaccaggtgagcctcggacagtaacactgcgaaaacacaaattaacactatgggttgtccgaaggagaagcgagcaccgttcgggaccaaacgcggactgtccggcctcaggcgcggaccgtccggtcgttgaaaaactagaaaaaaactcgaaggtgacgggttcggtaaaatacatttatagtctcctccggaccgtccggggtgcacgaccgaaccgtctgtgactgctctgtctgacatccgacgacgcattaaatgcacttatagacgttgatataattgttactgctgaccattgcgatttcagccgttgatgtacaggggcggaccgttcggaccagaggcgcggatcgtccgctgtcggcagaaaaggagcaacggctaggaagtggttggtggctataaatacaaccccaaccacctctattcacttcacccaagaatctcattaactatcattcaatacaagagcattcagttcaaccaaagacacattcaagcatccaaatctctccaagttccataattgtgaccaatgatcattagtgattagtgacttgagaaagtgtgattttgtgtcttttcatattgctcttgttgctcggctcttaattgtgctttcttcatctctctctaaactctctaagtgttttgtaaagcttgcaagagacacctaattgtgttgtgatccttgcggggccttagtgacccgtgagattgagaaaaagcacccgaccggtctgagtgaccgattgagagagggaaagggttggaatagacctagcctttgtggcctcctcaacggggagtaggttctttggaaccaaacctcggtaaacaaatcgtcgtgttcatttgtgttgatgtccactcgatctgtttcccctcccttcctctctctaaaagttcccttgctcatatagatttgagttggctcccgaagttacccgcattgattgagcaactcatagcaaggagaactatcttccgcactccaaattatttctaacactaaccccgggcatagtgcgtgttcaaagtttataattttcaggtttcgcctattcaccccctctaggcgactttcaattggtatcagagccagtgcttcattaagagtctaacaaactcgaagtg

SEQ ID NO: 2161 - DNA, 731 bp, Zea mays
gtcgtggcggacaccatagtcttcatgttactttctggactactagtttagagtcgggcatctgaactgtctcgtgtgacagggaaatcttatatgtggccaccatgcaaatctgagccagtagttctcgtagtcttgtagactagatagctcgttttgtttacccgttcggaaagatgcctcctgttgaataataaagtcttccaaccagcaacttggtttcattgaaaaaatgatgagcagtgtagtatcaaacttcctcttcgcccttctgcaacttgctgttttgtaaaacgcatagatgaagcaggctgtccacgcgaccattaaaccctgctcatcttaccaattgattgtacacacaacacagttcagtcatcagatgtgttcgtttttttttgtggcacagtatcgattcgtcgctcacaagtgaagaaagggagctgaagcggaagcaagcccgcgtcagagccacgttcgtgcaggacctgctgctctctactctattcggcgactgatgacgaaccagagcgagcctggtattatcactggaaggtgcagagttgatgtgggcgtgatgtatctttctaagttattgtaagccggtctctgtcttcacaactgacgatctgtgtgtggtacgcaccacgcacgcaagtcgcggttgtgcgtgtacgtctgaactctggagcattggtttgttgtaccaacataatgagtcacaacggcgg

SEQ ID NO: 2162 - DNA, 527 bp, Zea mays
cataaattttcttattatagtagtatagaagagattatatgaatgcaggttgattctaaaatgtagggctttttaaaaaatattaatgcgagatgatcattgaaaccagtgctttaatatagttgagaaaatattaagatagaaaaaaataataatataatccgccgcaatgcgcgaacggtacggtgtctgttttttcttctttcgtggatggaagtcattttcgcttcggcatatatcgatcagcaggttgctggtgagctgtcctccatgtgtacttcaattccacacgggtccggtccggccggagaaggaacaatcagaacctagctagctggctgaaaaacgtgccccggtcaactctcagcagctgaattccacgcgtctctctctccctcgaatgtactctgctcctccgatcctataaatagctgactcgattctacctaattctccacaccactgatcaagcaataggacgatcgagcaagaagcaagcagcagtaacaagaaaccatcatcgatcc

SEQ ID NO: 2163 - DNA, 88 bp, Zea mays
tgcagcgcgcctaccatgagcgcgtgtccaggcgttgacgcgctcaatagatccacttccttttcagagttctcctctggtgaacgcc

SEQ ID NO: 2164 - DNA, 1500 bp, Zea mays
ctttaaacrgttctttaaatttagaggccgctgctggatcctctatatataaagtttctctaaatggttctctatctatttgaatactttaaacaactggtttaataaaactaaaatatgtaaaatacatttgagagtgacaaatacgtatgtacaaaaattaaaaaaataaaaaatgtctttaatataagtatttacatatagaggacgttgttagagaggaagtagatataagggataaatttttttagaaaacactataaaagacggatgtaaaggtatatatagaggatattgctggagacagtttgtcgtaccctagccagccgctaaaacgtaaggagtccatagtgtgaggaccaccacggccctatgccccctacgagcctttatggttccggataagcaagagggtttggcatataacaaaacttgataacaagacgtcctaaagggataactatatcgctaaaagatagtttggaaattcaaatcctctttagaattaaagaggaatgcggcaataataaactaattttttctaatccctctccaatcttaaagggaatttgagttcccaaactagctcgaggagtcttgatctagggtacacgacactctaaggacttggctcatagatttatgtgagttcccaaactatcccgaggagtcttacataccgtggatgcacagttgttcactttagattaaagtcacttatttatatttctgcagttgtaatctatagacaaaacactgtaagggctagtttgatagtccaaaaaccaaatgagattttagggactaaatttccattcttatttaaattagaataagaatgagattttatctttctaactttcttctattttagactcccaaactaattctaaaagtagtaggaggcggttcaaattatagacaaacaattaagttggtcagcttcaaatcttgtgccgtacaaatcagtgcccccaagtgggcaacccaaccgtgacgcgcacaggctcagaccccacacggcgcggcgcactcacccgcccgtcggtcgataggcgatagcgcagcgccagcggcgacgacacaggactacactacaggcgagacgagtgggtgtgcgagcgggcggacgaaagcaacgccccaacaacctgatccctccccttcaccccatcgcacgccacaacaaagcagagcgcggcgctacacctacacacctccacccggaccacccccccacagtcccacaccacaccacgcagtgccgtgccgcactgctgtcctgcaatctcccataaactcactcgcctcgcctcgcctcgcctcgcccacccgcccgcctgtccctccccaaggccgcagctcactcgtgtcgtgcacccgtcccctcccacccgccaagaactagcattgccgccgccggtgccagggggcggaggagaggccgcggcggcgagggagcggcaccaggcgcagggggtcaggagagccgccggcagg

SEQ ID NO: 2165 - DNA, 554 bp, Zea mays
atctggagaaaaaataggaactcgcgctcgtcgccttcctccaggcaaatgccgacgtgttcgcatgggagccgtcgtagatgcctgggatccccagggaggtgatcaagcaccatctgaagatccaccctgatgccaaaccggtgaatcagaagcctcggagacagtctgttgagcggtaggacttcatccgaaaggaggtccggaagctgctggacgccggcttcatcgaagaggttcatcacccagtgtggctggccaacccagtcatcatccccaaggcgaatgggaagctttggatgtgcatcgactacaccagccttaataaagcttgtcccaaggacccgtatccacttccacgtatagatcaaatcgtggattctacctccgggtgcgacctcttgtccttcttagatgcttactctggtttccatcaaatcttgatgtctagggaagataggaagcataccgcttttgtaacagtggatgggctttactgctatgtcgtaatgccttacattctgaaaaatgccttgccgacatttgtgtgagcg

SEQ ID NO: 2166 - DNA, 1500 bp, Zea mays
tatatgtgcctttggcttgcctagctcacccaatggcaggggcatgtgttgaacaccacttttggcagggcgaacggtccggtcctgaggccagacggtttacggtccggactgtccgcgatgttggtgcgaatggtcctcccgtgcgcagaatcagttacggttactcgtttcttgcggtatttgttagtgatctccatatgattagctcgggaaccaacttgtaacgggtttagacctttccccttatatagataaggggtacgaccaattaaacctctacaatcgatcaatcaattctacttaccatttttaccttatgaattaggagtagccctaatttagccttcctctatctgaaatcttcaactctcttcagttctacgtcgactagagacgtcttagatggcctgtcgaccctaagacacaccctaggatctcacattccagaaaacgagatctagatctgccgcgaagaagacgatcctctgcatcaacgcgggtcgtccgagcctcacacggaccatccggacgtacacagagaaagagtcactactgtgctcaggtcacaaaccgtctagcccgtttatctcctgtgcttgacgtactaatcggcgtcaacatgtagtccatgtaaagcaatgttgacccttttcagggaggcggaggataactggatcgagagatgagcattgactactccaatggccatcagctctccggagctgcttcgctggcagagcatagatatcagatatgtcctcacgccgtccaaaaaaataagtgcagttgagtgacggtcgattccgaatttctgagcctgtcactgcggcaccacaaaattctacggaatactacagttctgaagtgagtacagcaaaaaaaaattgttccaatgattatcaaagacatctgcgcaaacagtttagtcagcacaagataagttgttcaaaattgccacacatttttatgacatacttgtctaaggtatctaagattagtcattcaaattatgcgtcacagttttccggattaaaaaaatctttcgcgtttttacaagtcattaatgagtgagccctacgtagtaggataaatctttttgttatacatgtggctctcaatcatatgtatacctaatttggttaaatttatctaagacgtggtaaattatggaggcaataaaccaaacagcttctgcatagtgttctttcccgtcccttcaccttgtggtgcgcgggtgatcggtgatccacgaggacgaggaccaccgaagaaaagtctcgtcacattcctgctcccgtcaccatcactccgcaggattttgtattctacagttcgtagcagcagaagatgagagaccacagacaagcagtagttgtttgttcaatcgtctgccggggttgcgggttgtcaaatctcacttgttttctcctaccaagcagagccaagcctactcttccaatccctgtcagggtggttagtctttgagctggtgggatc

SEQ ID NO: 2167 - DNA, 1175 bp, Zea mays
atgaaactgtcaggggcgtatttgttgggaaaaaaacccgaaaagggccaatttgcaaaaaagttgggacggctgtcacgtcgcgtgggctcggtggcttcgcgccgttcctcgttaatctggaacaggacggaacacctctgcggtcctgcctctgcttctccccacgccaccgaggcagtccaggccaggacagggtgccacaaaaccaaaaccaaaccccaccaccactccgcacgagatcatttcgccagctcatcgccaccgccctcctccgctcccgcgtctccttcccctcgtcgtcgtcgggttggtgggtccacctctcgccgtgccccgccgtcgacccgcctcaggtaaacccctctgctctctctctctccgtctcgcgcggmggggttgttccgcgggggcgctggtgtgctccggctggctgcggtgtgctgccgataggttttggcgcctgggcgccgtgctggtctccgcttggggtggcggcggcctggcgggtggaagccggggcggcgtgggtgaagttgttctctgatgcgatgtctcgagggtctggatgactcaattacggcccgatgcagttttttcttgagtttcaaggttcgcggcttgagcccgggacggggacgagcagccgtgcttggtgtaaacgtgtggtgcggtgactctattcgtggcgatttgcgttgccatggtacttctgtcgatgatagagatacggaaagtatgatattagcactctggcttataaaatgcggtctgatatggttgtacatgggtatccacgttagttatttatcgttatacatgattgatggttctgtttattgatttcgacacggagtataattttttttttatctcgtgatagttatgtgatcaccaaatataaggaattcaacggtatagattttgcagctggtcatagtagttcactggaaccaggattggttgccagctgccagctgccagcctagagctcttatgttttggtcagtggaactaacattttccttatgaggcttgggagcactgttttctcgtttgcatgtccacatgtagatgaagtgacactttttagtcaaaattggtgtattatggctaacttgttctctttcgcatcgatggcatagaatcaaagataagtcaaaggaaaggtcggt

SEQ ID NO: 2168 - DNA, 1500 bp, Zea mays
ctagtggttagccctaaatttttagagcagggggcgtggattcgagtgctcgctctgcactattttacgaggtgtgatagttgtatgggcggggttgggtgttggacaggcgatgtagctggttgcgcgggcgctgggggtccatagggcagtaactgagagagcgtgggacccacagagcacgacatcgagtcggggcgcatggggcaggcctagagtgtttatatggaggccgtggtagcaccaggtgcctacattaagtttttaatagagtagtataaatttatgatcggtgctcatgcaagttagaataactaatgtttaagaatgatcaatataatgagatgatgcatcataagtttatttcacaaatttgatgaaatgagtgcattcctcgtattattactaattattagtttatagaggaataaaacagtgatatatcaattcattctattccacaaactaaataaaaaagtgaagagcgaaaagatgataaacaatcttattccaaacacgctgatagagtccggttcctatagatcacttccatcatcgtgatccagactgatatcgcatgctcatacaggtcaatgatatggaatctgattatagcatgtttcgagtttcgtcacatgtttactgatcctttattatgtcctgatttttcttttttgataaaaggactgtttctgatttggagcaagtaatggactaacacgttcgaggcgaattcatcgcaatccggccatggagacatctttgctaaagttcggcgatcggggctgccccaggattgaattctcactcatttttttggcgatttgataaaggaacgtggtcggcatgcgcagagtttctttttctttctttgctccccacatggcaaaactggatcgcaactaacccctcataacactaaaaccaactactactaatcatagagctacagtgtaactcgtaaacacaggaactgaaataatccaaaataggacaaaaaattgagtacaaaaattgcgacaggtctcaacagagacgcgcagcagatttgcagccactaccaccgaaaccaaatggctctctccctatcaaaaaaattgctagggtgccccggtccttgtctcgcggttcacagtagagcggtggcaccacgtttttcctaatcctcttcctgttctacttctacccatttgttccgtcgcttcaacggcacggaagagaatcgctacccagccaatcgaagtcttctcttgccctgctgtatctcatatcctgttgcgcgagattcttggcgattctgctactggtttttatttttattttgctagttcttgaaatttctttcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgcc

SEQ ID NO: 2169 - DNA, 1500 bp, Zea mays
tcactcatgcacacttgagaaaacttcttgattggtcacccatcccaaattgctccaagccaagcacgctttaacctagatgttttttgagatagtcttccaaaaaaagacgcaccttgtttatatgagtactctattaattatattaagccttgagctaggatatctcattcaccggggccaggatatcacaatccacccccttagaagatcgacgtccttgtcggtcaaccccaatccaggaacctccctcttagccacgtctatgtgtctagtgtcgtcatatgccatgccatgtgattactccgggcccacatgcaccatgcgccatatacccgaactcctaacccacacaagcttgtgaaaccgcgagggtcggctctgataccacttgtaacactccgtccacttccggaccggtgatacttattccttgcagctctctaggatcatatattgtccccacagaccaacacgggtcttttgtgcacactttgtcctcactcatgtgcacctgacaaaacttcccgatcggtcatccatccaaattcctccaagccaagcacgattaaactggatattctttcgagatatgtttctgaaaaagaagatgcattttgtttatataagtaatttattaattttattaagtcttgcgccatgatatcccatccaccggggccaggatatcacaacaacattaacatctcaatttagaggtgttaggggccttcctcttccgaaggtcctcaaaaacatgacttaccatttgcttttagcatactactgaatattacaggagcttcgtcactagaaaagttttggtataacacaagaggagcgaagcaagcttcgtccaacaggcttcatcacggtgaaacggatagacaatgtggctttggcataacgaaaagaaagtacaatgaagcacgcttcatcaaacaggcttcgtcacgacgaaacaatgagacgatacaaggagaaggtgttgcccaagttattaaatacaaatgatgatgttgcccttgtgacatcttgtaaactcggtatgtaattgttgagggtataaatgtaatagtgtacgaacccttacgactgcctataaatagatgaacaatacccctatactgttcatgatggattgtaattgctctcgtgtcatcaccttcaaacaagccaaaggtatcaatgtaatataaattctgataatgttaatatgtttatcagggaataaatatatgaatagataatacatcttgtgcatataaactcttatttcttatgaatcatggagacatgttcttcatgaccttcgtctgaagatcattatatccgagaggagacaatgcttcgaaggatgaatgtccttaatgtttgacaattgtgttgccttgttcttgattcacaacatttgagaacaagtgaccaacattggcacccaccttcggcgaactcaaacgaccatcttcgacaccaagaactcgaacaaccaccttcgtc

SEQ ID NO: 2170 - DNA, 1500 bp, Zea mays
tacgtgtctagtgcctgaaatttgcgttcttttcgtcagtcttttgccgacgaatgaagtcactgaaagggtcagttcgtgcaaatgttcgccacaccaaagtgaaagcgatgccacaccaaagtgaaatgtgaaaaccattttaacctaccagaaaacaacatgctgttacagcctagcctaccttttaccagatcttcaggttgaaggagagggaaagcggctgtggaggggccaaaaaaaaaagaatggttaaagaaaagcctacaaaagaccaaccgtatttccctgcctgcttcctaacgctgagcttttgtatggtaggggaggggaggggggagggaaaagatggctccgggctcacacctccttgtccttttgccaaccgccgtcgtccagctcaatcctttgtggcctcttcctcacgcgccaagccagcccgtgatgctcggcgacagtagagtagtggtagccgacacacacacacacacactgcgcatacgattccctactcccatgatcccatcccatcatctcccacccagcattcacaaaaccccaagggcaaaataatatggactgtagatgctgcagtgctccactccattcagagacagacagcgctcggttcatcagttgcattgcgttcatctgctgccccagctcgtgctctctcccagtcccagtccctcgcaagctgacctctgcgttccttcagcactggcactggcagtgaggcgctgtgctgctccagtagctgtagctgtaaggtaataactgaagctcctgaacttgtgtttctggtttcttggaattactactaataatcatatcaactggtgagttttaaaaaaaatacggtgattagtagtactaggaggagtaggtgacagtgccgagcagagatgatgcttggttaacctgacggtgcaatcgctgtgcagccctgttgccagttcgtgaagaaagggagcaaatctggggtgcctgcaggagggggtggaagaggggagaggcattggcatccagtgcttgcttgcttgcttgccagggggtgaaaagaaccggcggtctaccactcagatccgtcccctgtgcagtgcaggattggacatttttttttctggtcgccagtagctatctccaataactatacctcgttgctgcgagttcccaagttcgttgctgccttcgttttgctggctcaggctccctgcgtaactgcattcagagcttagaaatcttttcttccagattctagatgtgtgggtgattaccaagaggctggagactcccactctcttcggttccagctcgaggtcgagaaaaggtttctttcgccgtttctgatcatttgctcatcatttctggcctcgctgccatcggttgcgcagtagaaagctggcaatcatcagaagaattccaagagagaggaggaggagaattctctctgtgtgtggcaagctagagctagcaagcgtaagtaagtaaggttcaagg

SEQ ID NO: 2171 - DNA, 1500 bp, Zea mays
aatgttcattccattgtcccatatatcgagcatttcaaaatattattacaatgaagtctactcttctctgagaactttttccgcaacttcgtttaaaagtttatcgagaacttcgtcgataatggagtctgccatgtttataatgtccagcgcttccttcatttctagatcagctaggggatcgtacggttccagcggcggagatagttcaactgaagtaggtaaaattgatttgttcgaagccacaaaataagtaccgaagctaaaaaccaaaaaataatacctatacgcctttctgagagcacctagaggggggtgaataggtgatcctgtaaaacttgaaacttaagccacagaaacttggttaggtgttagcacaataatcgccaagtggctagagaggagtctcaacagaacacaataaccacgaagatatcaatcacagagatggcacagtggtttatcccgtggttcggccaagaccaacgcttgcctactccacgttgcggcgtcccaacgaacgagggttgcaatcaacccctctcaagtggtccaaagacccacttgaataccacggtgttttgctttgcctttcttaatcccgtttgcgaggaatctccacaacttggagtctctcgcccttacaaagatgttcacaaagaagcacggagtaagggagggatgagcaacgcacacaagactcacaaatcagagcaacaacacgcacacaagtcgcaacaagagctcgcaacacaacccaatgagtttacaactcaactagagctctagatgctatcacaaagaaacaaatgcgtggaatcgaagtctcgatgcttaggattgctttgagtatgcttggtgttctcctccatgtgcctaggggtcccttttatagccccaaggcagctaggagccgttgagagcaatctgggaaggcaattcttgccttctgtcgcgtggcgcaccggacagtccggtgcacaccggacactgtccggtgcccgatttccttcctaaaatggcgcagccgaccgttgcagatttgggagcctttggcgcaccgaacatgtccggtgcacaccggacagtccggtgcccccttctagccgttggctcggccacgtgttccgcgcagatcgcgcggctgaccgttggcccggccgaccgttggctcaccggacagtccggtgaattatagccgtacgtcgccggtgaattcccgagagcgccgagttcacgccgagtcagcctggcgcaccggacactgtccggtgcaccaccggacagtccggtgctcccagactcagcagattcttggctgctcgagccaagacatttccaattggatttttcctgtttccagcacttagacacaatacattagtccataaaacaatgtactaagtctgagaaacataccttaattcttgatttttactttgtccacctttttacacttaggcacttgtgttggacactaaatcaccaaaacacttagaa

SEQ ID NO: 2172 - DNA, 824 bp, Zea mays
  unsure (1)..(824): unsure at all n locations
ctctgnggactgcgggcttaactccctggcaccggggttaacacgtgcatggcggcgtggaggccaggccatgctttcggttcgggttcgggctctccgttcctaggcagccgagattagaagagctccgattcctggcgcgaaaccgctacaaggtccgctgcgtcgtgattgccaagggacggggagattcgatgcgctggcggcggcggccggttacggcggagagtgcgagtgtgagctaatgttaacgtgaccaagttccacggaagtttctaaggtttgacagatgaagtgctgtcaggatccaagaacaaataacttgatgggcggtttaacaaggtaacacctaatctaccacacccatgagtaattcacccctgtcacgtcaatgtcgtaccacatgtctgatgtggcatccttacctctaccaaaatggttcaaaccccacctgtaccatggcagtaacacaaggaaaggagcagtgcatcaagacaacaagtgatgacgtccactccatatcataatcatcacagtaccgccatgaactccacaggatgccacccctcagccgaaccataaaaaataaaaaagctctggaagcgactggatccacacaatgacacacagccatatagaaatatcacagccttcccccgctatcacactcacaccctgctctgtttccatataagtagcccactctgctcccgcctcacacaagcacatcgacaacacacggtccaagcacatcgacacacacgagcacagaagagaaacgggcacacgcaactgatcaaggcaaccaatattcaccgtcggca

SEQ ID NO: 2173 - DNA, 309 bp, Zea mays
cgtaagtattattgcacataaaagtatagaacccatgtggatctgaagtcctctgccgagctaataggtacagctaagcagatcatttttcatcttgaagacaatatgagcctacggatcagtatttggtgcctctaccatcactttgcaacaatctattcagtgctttctcaaattgctatagaaaatgaattgttatggacaaatatccgctaaaaaccagtcaaacatcctcttttcgggtttatactgtttaaattatctgcaatcatacaccttactgaattggcaaactacgtgcatgttgcc

SEQ ID NO: 2174 - DNA, 350 bp, Zea mays
tgtaagcccaaccaatagattgttcattcgaactactacttcagtaatcccaacactcagaataatgttggattcagacatatattagatagaagaagtggagcatgcttgtgaaaacaagcagcgccagtaattagtcattttcagcctgtattgggtgaactgatctgagtatctgaccttcttgcccttgtgttataggaaaacactgctgaatttctcagctggtgcctagtggtgggaaataaagctagggacccagcatccttgtgatagcaatcacatcattggtgttgttttttcagcttacgctgaaactagactgatcaagaaggcgaccagctgtcaaa

SEQ ID NO: 2175 - DNA, 1500 bp, Zea mays
ttggccttctatcagtccgtcctgaattgtaaggcatgcagtattttcattaaattttgttggtctctgaccgacaattagtctaatcacatgagaagtttatattagtgaagtgatgacaacggatttgtatttagagatactttctaatgatcacgccctatcttttgggactttggttctgtaccattttttttaaatctttgcgattttgtgttgccaatctgtcttacttgacgtctaaaattcgtctacatatttgcaacacccagtggtcttgcttgccttgcctcctaaccatactatcatgtaactcatgaagcttgtgtatgtagctcataattagtctgtattttcgctatatcaaccggtcttgcatctacatccaagatactgctgctacaacactcacctctgcatcaggctgaaccatatcactgttaattggttttttttgaaggcgatgatgctgttggaattggaaaccatgcgagtggcgatgatgcggttggggaaaccatacgagtgacgatgctttggcttcgaaatgatggtgaagatgacctggattaaagttattctagattcattttttattttgcactattggtcttcacagagcctgtatggttgggggccttgttttggcaaagctgtactgatatatccctaccccaagaatcagaagcctgccaaagttttgcgactatgtacctcgtctgcgcttgtgtattgtggtgcacttgaatgatgcgaatgttatatcgaatccccgtccttgatcgtgatgttcttgaacgttcacctctgggaaattaactcgcatggtgagctgagctcgtgatcggtggcatggtcgatccaaggtcgggtgtcattgttgtatggtcgagctggacatgtaggctctgttactatttaggtaactatttagaccttattccaaaaagttagtagagatattcacttgctatggatttaaatctaccaaatcctctccaattcacgtggatcggaggaaaccgaacggacgccattggcttttgaggcatgagatggctagcgcaaaatgtcactgcagtgaaattattacacaacaatgagaggctgggcgcacccaccttgactgttcccgatactttctagtgagtctactgctgctgcctggcacagcagatgccacgttggcacacctctgccgtcacgagggacaagacccggccgccttgccggcttcaagctcatggcacggccgccttgccttgccggcttcaatttacaggtacgacgagtggtgtatcgcgcgtcgctttcatattctttcctattatttctcactaaactaatcgccgcagcctgcacttgcattacgttccatgataataccgccctgctcttgttccttcctagccatttccacattcatcctggtccttcactcaccacccgtacgtaagcacagcatcaacgcaagcaagaccggagagcaaaccagcaagc

SEQ ID NO: 2176 - DNA, 1500 bp, Zea mays
ggcgagaaaaaacgatgctgaaatcctcaatacaagaaattgtttcttcggcgtcgagaataacgcgaggacgacagcacaacaagcatctcccctagtgggcggtgggggtgcgctagctctccactgagatgcgcgaggactgcgacatgacgaccacctcccccaacggtcattttattagtattagaaagcaattgaagttctacgagtagaaaatgggttggggaagcgattttgccattgctgattaaggtcaaagctataaaattggaaaaattatggatcgattgatcgggtatttataaactttaactaaccaactaactattatagtaactatggaaaattctctattgagtagtttatgtgattatgataatctgacctcaagattatataatctagtttaataatctgactgtttgttcctatctagtatgatgtttggttctctatagattttaagaagtgcacaaaatataatacacatcacattatcaagttttgttggtattgcgagactgacacaaaatccaatccaaaattcaaaaattgtttggctaataatgagacgacactgcaaaggtgcacggcaccaacctcttgggattcctacgcaacaactctaccttgttttatcacaaatgacatcccatacttcctaattatcacatgtgaacccattgcaatgtaacgttgcttttcaacgaaggcaccgtcatctcatccaaagtgagggaattttggcatatggttgaatcatggtaaaccaagaccggcacagcttgttactggtaggatgatatgcttctcacttttgagtttcgacttccctcataaagaacattcattcctgttgatgaataatttcgcaacgtgtaaatatagccgaaagacactcaaagttgatgctttctgatcaagcaaacctttgatattcgaactgtaatatttttatgacaatattggcttgagagcttagatatgtaactccgtcatgttcattcttgttcttgttacatatcgaaggaaaagaaatggcaagaaaatcatagagcaaatgcaaaatgcattaaaactctccttttttttccgtaaaagagagagaagtcccaaagaacaggttgattggcgatgagcagtgggatggatacggtgggggtcgggatggaagctggcgtcgtgggtgaccgtgcaatacatccaaaataggaggagtgacgtgggaaagctccccgcgtcctcctcttcctttcctcctctcgtcgtccagggaaggatgcaggatgctctccgtccctcccccaccacctgaggaggaaagcaagaaatttttaaccaaccaaacgcaccaccgcgtgcctccgtgattcccagcccaattaacccggaacagaagagaagagctcgccacgccaccggtgggatcgccggacacctacgcgggsctggccttgggatccccggaacgcggggcgtgggaaaccgaggaggagc

SEQ ID NO: 2177 - DNA, 1500 bp, Zea mays
tctgattaggaagtccttgtgggtttttttaagttagtcacaacatggaacaacaactacataaaaaaatataaattcttgtcagtggcgttcataaaaaaatatggacctatatatagttttgacttgactaagcactcacccgcctgtcatcccaatcccctttctgacaacaacagtagttaggtagagcaactgctgcgtacgtattgatgtactaatcaaacgtggagcaattatggtgcagacaaggttgtctgtttccatcatcaaaagattccaaatccacacgtcgtcgatcccaaagagttcaattatgtaaagtcaacgccgggatcatatttaaggttctttttttttgtttcttcttgttcacgaactctagttgggtgtagatcagatgtgactcataatcttgagtctgtatttttcttgtgactggaaaggttgtttttcattttcatttatgtttcattgtgaccttgccaccttcgattcctggtttcctgcataagcgtcaatacatgcatgacatgtgtttcctatgtttacaagcaacttattgaaggtggaagatacgaggtgcaaacccctctctatccagacatttttaaattttatttggttgtgtgagagtaccaatgatctttatgcataccacctagctagtactctcaaccccgggttgtcaacgtagttattatatacggtaacatgaaacccttgacccttgaattctggaataagaaaaaaacaaggaagcttgacccaaagtatatatatatatatacacatgcaaggtggaagcatacgtacgtactatttcaacaggagctgcagtatgaaacaaggtactccctccagtgcagtaaaggtagttgtttaggacatgattgtgcataccaaggagtgattaattatcatagagttttccctgtttgcccctattaaatagggatatgggtgcattaacgtcactaaaacaagcaagcttgattggttgttgcagcagctctaaggcattctagactggaggtctcaaatttgattcctcttaaatgcatttttttttgtgcaattactaggggcaacaacgtccaaatcccagacccacgcgtgctatgacttctttttgtgcacgctcggtcacgcgcaggatgacttcttttactgcactggagggagtatgtcgctttctatatcctaaacccttccgaccacttcatagtcctccgtacgtaatctctaatatacttagattctttccatagtcagattttattcacagccagaatcctttaaactactccatcctcctccgtacgtaatcccaattcccaacatactcagattctttacatagtgaaattctattcaccccaaatttttagaaagactgataataaaaaagctcaaccaaagggcctttattgttgtgggcgtacgcgaccagtgaggtgcggttggccagccagcggcgagccaaaccgagcgtacgcc

SEQ ID NO: 2178 - DNA, 223 bp, Zea mays
ttgcgctggcaaacgaagcgccgaggccttcgacttcccaaaccctaggctccggaacgagggcggtagggaagctgggggcggtggtggtttttgaagggtttggaggcggtggtgtgcaggggaaggaaacgaaggggagcggcggaggcagagcgagccagcgagggcacaagcggccaagggcgtcgggtatttgaacggccgctccacccccccgaaa

SEQ ID NO: 2179 - DNA, 1500 bp, Zea mays
tttaagtgtttttttaacattacgcgagttcgcattttgaattgttgctgtgtccatccaaacccaattaaggttaccgttcaaaaatgaagttgatcacagtaagaaagaacatctagcccaacggcttccggggctagaagactggcccataacgacgacgggccacttgacgatacgccaagcagagcatagatggggcctcggccacttgacgatcctgattcatgacggacgctaatggtacctgtgccaggatctcggcccaaaccaaccagccagcagtggcgtcttcctgccgactgcgccaagaaacgtgcggcgtggtgcgtccacgacacggatttggcaccttgttaacgaaaagtccctgggggggtttatcattagcggggcctggcctgctgccaaaaattaatggagcatgctgctgtgccgtgtgcgcggcgcgctcccgctttgattaccgacaccaacggcctccagtcgtgtcacgtcacgtgggcttgtgctgttaccggagcattctcgcgggtgcatcctccaggtggtacggtattcacagatgagcccctgggctaaacgtttaaaagtttacagaaacgccctcggttagagtaggataatatccaaaccagccgtgccgcgagcaatcaaccagcccaccggccgtgctaacccccgcacttaccaagagagagaaaaagcgagaggcgactccacgcgtctcgtctcgtctcgtctcgtctccctctctctcgtccggtcctccctccccttcctgaggcgttccctctctctcctcccctttcctctgctggtctctactctcttgtcatcgcacccgtctccccgctctgactccgtcccgagcggccgactccgcccgcgccgccgccgccgccgcctcgtcccgatcgacccccgaatcgccggaaaccgtggacttcgcgaggtgcgatttcgtggaccgcgtctgagcctgatttagtttctggaggtggtttgagcttgggatttggtactggggaggtgtttggttgcttccttgtatctgatttgctttctaggttgctcaggcgaggaaatatgggctggttttgcatcgtttcgcgtttgtttcgttgggcggggcttgatgatttgttgcaaagcccgcagcttaagtgatggcttgcatggttttctagtgggtttgggatgcttactgcctgcgctcttgctcaaattcgtcagttaccatcccagaccggtttgatgcaacttcggtgtctgcagctgttccaagcgtttcttgaattttcaactctaaaatgcctgtagcttttggaccctggttacatacttacacttacagctgcttgcaatacctagaatctagctgttaattctcatgtactcttgctgtgcaggttgtgtctttacctccgagcggtgtagggaatataacagggtgacagctgaattgcagaaaaaaggaggacatttggttgttgcatg

SEQ ID NO: 2180 - DNA, 467 bp, Zea mays
tgtacgtcgtcgaggccgtcgtgctgggcctcgcgctctcctgcttcttcctctgctgcggctgccacctctaattgagctgcccgcttttatttctcccgtctcttcacttcacttcaccggtcggccttggcgtgtaccaaatgcccatcgttttgttttcccctttcgatgttcttgctgtacatctcctgcttctggaacaaagcaatatgaaaacttgcggtgccctatcgggtgttgattattttaatttgcgtgtttttggattcatgcaagaaattgcgatcacggagagtgggacccagcgagtttcttgtttgtttatgcacatcactgtcgctgtcccgttgaaaaaaaaaagaaagcaacggcgggatatcttgcaatccaaccaaccaaccaaaatcgtggctgcggctrtggacaatcggcagcttgcgagtagctccggtacggaggggatc

SEQ ID NO: 2181 - DNA, 609 bp, Zea mays
gatcgcctttgtcgttgtcgtgacccagtgctctatggctagagaaatttgttatttacactccattttagctttatgttattataccatctcatgtttatgattgatagaatcatttgtgacaatgatttatagatccgataatatagtagcgaagctcataaatgataatgacaaaattgcaaatgtcttgtcagtctatagcacaaatatggccgcgccccatcacctctgtctcgagccgtccctctcaatcccccgcaccctctctccctgagcgctcgcgagcctgcggccaccaccgccgtctccacgccgcgcagatccgcccagccggttcggccccactcgagaatacgtgtacggacgcaggccccgcccacctcgccgaggactcgctcctgtgtcgtgcgcgccagcactaccggtggccgtgcgcggctgggccgtgccgattcgaccgaatccggtggaattcaccgtgccgtggtgtcaaatcggtgagctccgttgggttacgcgtgggtggaggctcgttcaggtctgggcggccgtaagtggcgccgggcatggttctagggtttggttttggtcttttggcgtgagggc

SEQ ID NO: 2182 - DNA, 1402 bp, Zea mays
gactatatccatttgcttatatctgcatgcacctttcaaatatcctagttaagctgctaagctatcgagctaggtagagctggcctacacatgtttagttagtagtcacataaaactatgcaactaatagtcaaataagctcctccattgacacttaaattagttcagcaattaacaagtcaaacctatgtccacctccacggcgttttagtctacataggttgtcacttaattaccaaaaccaaacaagatcatttcaatctttccttttctttgctaattgattacatctctataaaaatatagaagctaagtgcattctaggctagcatttcacactagtgtaaatggctagctttagtttggatcctatgttacttatctaacattaaaccacttgataagatttagataaacactttaaatgacttggtagtgacacctattcctacatatgtgctcaaatcatttggtttcaaggtcatgcacatgcataaatccaaaaactgcaggagtattatcgctattaagtgatgctaatgtatacaaaatagaaatatacctttataatgtatatatcactttttaaatcacccttaacatcaaatcttgttagaaacaaatgaaactagatagcatttgagattaccatttacctggtcttggttatacacaggaagaaaattagtacacatcgcacaataagcatgtttatctgcaactccatatgtataccaagataaagtttcgtgtgacctctaatgttcttttcctcctttttattttcttttctttttccaaaaaggataaaaatggctattcgagggaagtaaaataagtgagccggtggaataatcccttcctcggcatccttcggtcccggaatatgcccccggcgtctccctcctcgcgttcctctcgtcggtgagctcctgccgcctggctcgcacagccgatttgcctcaatccagatcgtgcctccttcttcctagatcgggtccgaattcggctaccctcgccaccgccctacgccaggtgccgaggcctccgccgatctcttcgccggcgaagagcggccaccagggtattgcccacacccttctcatctcttcccctgtctgctgtgcgaaaccgagtttccaaactcttaacctcaagctatttagctattttacgccgaccagcttctaacatttcgcaaacaaaataaaattatccgcctctgattgacagcacttaaaggttgcaattaatgttgcgaattcagaattctggtggttcctgtagcttgtggatggagcagcaggcgctgggtcgtggtggtggtgaaaagctttgatttcgtagccgtggtggacgccgctgctaatgcccttgccgtgcctcgttggtggcgtgcaag

SEQ ID NO: 2183 - DNA, 193 bp, Zea mays
ccacgcacctcctctctctcccctcctgcgctagcactactactgctaccagcgagtgcacgacacacacatcctcctccccccttcgtctctctctccctctctctctctgcctgcgcgcctgagagctgccaccgccaaggcgaaacggccgtcgccgcatgctgcggctgagctagagacgagaggcgag

SEQ ID NO: 2184 - DNA, 1500 bp, Zea mays
ttcatggaaattgtatatgtttttctctgaattcaaaatcgtccctattctcccaaagctttctgaggtaaggataagataatgacgtcgtgacctgtttcaatttattttgtagtctctttctcttttgaaggcgcacttgcattctctctgctgcttcttttagtactggttaccgaaatttggactctactgtttggtgaccagtgatttccacagagtttgaaaaaacatttatagatacagggctgcatatatagttttggtttgtgaggttctcaaaggacaatttcatgtgtagtaaatctaagagacatgttaagccattttgttgaatttggatacttttgatttaaggactccagacgcggcatgcatatctgtgtaggtgatcaattgctggtctcttcattgtaacttacataacaagccactcgcctatcttactgttgttcaaatgcaactgcgaaatcttcagttatctttccattggtctggctgtcctttggggttacttgtgtgcattttgcattctgaatgccgtgcatacagaaccatcaatatttcatcattgtggtggcacaccagcctatttgtttttttatcgcaccactaaaagtaatgtagagtgcactagcragagtggcacttttctacatagttgataatattcactttcaaagcaaagagcactctgtaaattgtttaagtattgacaaaattttaggactgattaatgctagaaacatgatggtgtttccaacagtctgcattgatgcttactgtgggaatctacattagaagagtaatatggagatagaatcgctacgcaattgcagaatataatttttaaggcatatggattaatttataacctatggatgtgcttgatcatcgaaaattcatgagccttcaccttcacccctgaggtctgtgcttgctattggaatatggcaacatgcattgcaaaagtagtaagaaaaacagagctgctatacatcaatcaatgaaatttttagagaccacatggaatttctagcttgttaatgtgcttgaagattcttccaccttcatcttttgcttagcatgtgtcactagtgcctcacatcatacattcagcaaagctcaatgcctgttttgctggatgtgcttatatttctaagcggtgaatgtttttagatttctctcatattgattccagtttcaaggccacatgggacataagggagaagcaagcaaagagctgatagtgaaggtgccatgtgtgtttggaacagggtaggaactaatagtggagagtgatttttatttgatgtagcactaacatttaagggtcaactactacataagaaatactagtgttttatatagacagaccctcaattgccttctttaagtgtgaagaactcatatgcactcattttctccaaatatggttctcaatgcatcttgttttgcagcgcaggaagaaggatattgtccytctccaaaactataaac

SEQ ID NO: 2185 - DNA, 1500 bp, Zea mays
tgaaatctatggagtggtcagcaggtcaaggactcacctagaggacaagagcacgctggaaccccagaccggaacagaaagtgtgttgtgctaatgtgctcgcggttcagctgttccgtgcacttggcatccgagattccctctgtctgaatttgatgataatggcaagccatcggaattgggcaaacacaatactactagcaaagacagcagcactggacaacacttgtccattctactttctacctgcagaggccctccattccatcccgccgttgtttgcccatactgtactaccaaccgaccaggaggactgcagtagtagagcatcatgtggttgtgatgcaaaaaaatcgcgagtgagaagtgatgctgatgcaccaggtgaagaacgccggcaaaggacaccgcgagagaatgagatccacctgccaaattattgccgcgggcacggccaatcccaggcgcccaccgaaatgccgaaaacgccaaaccgtccctctccggcgtcccgtcccgtccgtccaggagcggcggacacgataacacggcgccctcgaggcgcccgctgtcgcggtaggtcccatgtgagcctcgcttttctcctctctctctccccggcatttctctctctggcgtcactcgcgtgtcaggcgcattctgcctctttctttctccccctcccctcccctcccctgcgggcttctctcacgagctcccccggcctcgccgccgccgcctgctccggcgggcgggacccagctcgcagcgtctcccctgcggcgaggtacgccttctcctctctgcgcctgcctctactctaccctcccttagtccctttgtcctcccagcctgccaattgggatgcgcgtctgggtgtttgagccgtgaagaagctgggctctgacgctgtggctcgtccccccgatgctactagcggagagggatttcgtgacccggctagctctgctagatccgggtcctggcgtcgtggatggcgcgctaggggtgcctgtgcaggggttggggatttggggttggggctcgggcgcttcagcttcatttcttttataagctagttgggcgcgaatagtttcagaaaataggttgaggaattagcaacagggattctggttcgcctccccgacctttccgcggagtaaaaccgaggcgtgctgttttgaacacatgttgctcggtccctccgtgatcaggagcacggtggtggggtgtagcgggttgttttcaaactgtcgaaccttgtaatttcgttgctgaagtaatgaaattgggttttaccgtcgaggaattttttttggcgcgctgtgcctttgcttagcctgaattgttattacttgtttcgatcgtctaggtccaaccttcgaatggtatcagtgcttattagattttcatactgatgagtgcgcatggttttagctctagttttttcttttacgctcaaactaggatgatattcgatgactgtgattcaggtacacg

SEQ ID NO: 2186 - DNA, 552 bp, Zea mays
aatttgtactagaagaaaagatgttttttggttatagattttagtataagtcaatctttatgattgacttttacgttttagaaaaatcaaaaccaggttaaaaagattaaccaaagaagaccatgttatataaatacactggtcccaactcagacagtacatgttccaaggatataaatgttactgatattattttaacttaaccaatttattgtagaaaaatagccaatacgcatctttcaataacacatttttgaccgaggaagtgccatttttatacataaataacaagagcgtcctttggacgcacacaaaaacgctataagttacgagagatgaaaaccgttagcggaagcttgtggttacgcttccgccataccaatagcatccgtcctaaaatattaattgttttagtattttaaaaaaattagacattaccatcgcatcgcaaaaaccactcgagcacaattcaagcagcagcgaaggtagccacaacatccactctactactcgagagctaagaaatcgttcaacaggtgatccagaacaaag

SEQ ID NO: 2187 - DNA, 243 bp, Zea mays
gccaaactgtcgttgccacgtcagcgctcggcgccataggctatggcgccgagctgtgttacctcggcgccacaacctatggcgccgagcaaagggtccaaacttgcaaataaaatttctggcggtccaaacgtaaatttttgtaaaaaaagggctaaaaaacaaaaaaattcgggaacctcgtcgcgggtctgagctccgcggcgtcctacaaccggtgagcggcgatcgttgccgcgcgca

SEQ ID NO: 2188 - DNA, 177 bp, Zea mays
gcccctgtgtgtattgcatagttatctgcagtgtatacttgttacaacttctgtatctgtccacaaaatgatcttggaatgatgctagttagctcctattcatgtctgatcgcagttgaagcggaaagatcagaagacccttgaaaaattgagggctgagagaaaagccaagaacgg

SEQ ID NO: 2189 - DNA, 943 bp, Zea mays
cgccttggtcgcgtcgcgtcgatgcggtggtgagcagagcagcaacagctgggcggcccaacgttggcttccgtgtcttcgtcgtacgtacgcgcgcgccggggacacgcagcagagagcggagagcgagccgtgcacggggaggtggtgtggaagtggagccgcgcgcccggccgcccgcgcccggtgggcaacccaaaagtacccacgacaagcgaaggcgccaaagcgatccaagctccggaacgcaacagcatgcgtcgcgtcggagagccagccacaagcagccgagaaccgaaccggtgggcgacgcgtcatgggacggacgcgggcgacgcttccaaacgggccacgtacgccggcgtgtgcgtgcgtgcagacgacaagccaaggcgaggcagcccccgatcgggaaagcgttttgggcgcgagcgctggcgtgcgggtcagtcgctggtgcgcagtgccggggggaacgggtatcgtggggggcgcgggcggaggagagcgtggcgagggccgagagcagcgcgcggccgggtcacgcaacgcgccccacgtactgccctccccctccgcgcgcgctagaaataccgaggcctggaccggggggggccccgtcacatccatccatcgaccgatcgatcgccacagccaacaccacccgccgaggcgacgcgacagccgccaggaggaaggaataaactcactgccagccagtgaagggggagaagtgtactgctccgtccaccagtgcgcgcaccgcccggcagggctgctcatctcgtcgacgaccaggttccgttccgatcctgtccttgagtttcgtccagatcctggcgtgtatctacgtgtttgatgatccaggttcatcgaatctaaatctgtccgtgcacatgtcttctctctctctgtctgtctgctatgcagtggattaatcggc

SEQ ID NO: 2190 - DNA, 329 bp, Zea mays
tcacggacgatccatcagtgagcgtgtctgctgctaccccaggaggtctccaccaccaggagttcgacatgctaagcacgcctaccactgctgcacaggagcagcaggcagcagcagcagccagctccgttccaaaccctttccaagagaccagagcaaacccagtgagacaggtgcagcacttgccaagggaacagcagcgtcctgcacagccatacccataccacgccgccgatggaggttcgtactacggagaccagcagcagagaagcttctccgcggtcgcgaacaaagccgcagccccagcgcctcaggttcaggtatcaagg

SEQ ID NO: 2191 - DNA, 93 bp, Zea mays
ggtcagttctgacgaactgcgtgctctctcgcgctcagctttcagcgtatatactatgtggcttaattcgttcatgttccaggtgcctcgttc

SEQ ID NO: 2192 - DNA, 1500 bp, Zea mays
agtctctagggtttttgctagatgggccttatagaacttaattgatagatgggcttcacacgttaaccaaataacgcagcacacgcaggctaccgcggcgcaatatattgtaccatatcggctagccaaaggttgcggtagcaacttataaaccttcctgctacagaggaagcaatcagcttgtgtaatcagctcttggtattatcaaattgtgtcgaatttttgcgcgaagcgagcgcggatggggcggggtgaggaggttagtgtggcgatggacgatccagattgaacgaaggcagaacggcaggctacgcttacagccttaataagtagtagagattagagtaagatagtaagaatatatatgatttttttattttttaaacttctttagtttatgtaaactctatatgcaccaaagtttatgtgcagccgacatgttaaatatgaaaagagcacagcaaaacctatctcgggttacttcccgtgttccgtcatccctcccccagtcatccatcactccgcagcagctgcctgcccgcctccgcgtctgcgacgagatccggcgccggcagcgagctctggcagcccaggtaaatcgactacaagctgattgcatgtcggcggctagtttcttctgtcccatggacggggatccagccgctacactaagtcaaccttggctggtttgcatatatggaagagagcaaaacggaacgatttcattgctgaatatatggcgatttttatgttcctgctttgttgcaactgcttttagaatatagggcaattttaatcttcccgccatgtctccgtatgatgttttctggggaaaaaaatatatgggagaatctgatatttactattataacgaaacaccttcgtaaaattgctatcggacccatgtttcatagacacagattgacccataattcatatattataacaaggaggcaacgtttcaagtgacaaaataccaattatttcacagaaataccagcatccttctgatattgtgtccatatccgtacatacatataatatgctacgtagtcgcctgtcgcctcgaacccgaattgctattgtttaattatttcgtgcctattattagttgttttacagaacataagctgtggtgtcctgattgcagatcttagtttaacgagactgcaccctgagtacatctaagacacatgattttcacttcactttttattagccttttcgcttacaatcctgtgaagtgtggtgtaaacagtggaataatgtatccttgcaaataatacttgttaataatttctatgtatctttggttcctgacaactatagtggttaataacttatttgctactgatttcagagttttcagtttagtttgttctcatgtttctgtgtaaattctcactaatatactcacaccttcacattactaacacactcataccttcgcagcaggaataaatattggtattggtagtgtgatcttcataaggagtcaag

SEQ ID NO: 2193 - DNA, 559 bp, Zea mays
ctcgctcgctccaaaaaaatcatatccaaccagtagtggagaaaatcgaacagcgacttgccagatggaaaggctaaggagtaaggactactgcagtgtggccactgaaagtcgccgcggcggcactccaaacctgctggattgggcctcttgatcgtgttctgggaccctgcagccacagcccgactaaatgggcggtaggtatcaagaagcagaagctcgcctttagcgggcctagaaactcttgttagagaaataagtgggccatccggggtatcaggcccggcccagaccagccaatgaagatgaagaacgttctagagggcacccgcgagagccgagagccgggagcacgttgccacgttgcggcggtgcggcgcacatctcccagggacaggctcgtaatttttccactggccatcgcacccattcataaaaccctaaacccaggacccaggtttatcggtgaggcgagccgcgagtggaactgtggaagcgttgagcttttttcttctttgtcttgctgcgcaagaagaagggaaacgagaggcgggcggcg

SEQ ID NO: 2194 - DNA, 250 bp, Zea mays
ctcctcctccgcctccgcctctctctctttctctctctgcgccaagaaagagaaggcgccacgttgacattgcggatgccgtagcgggtgggcgggcgcgcgcgcgtgccagccatgcgctcgtgatgatccggccgttccagaagatcggccacggcctcgaaaaggttctcgtccaggcgccggaggtcggcgtcgtcgccgccgttgccaccactggcctcggacggcacgggcgcctgcctcctcg

SEQ ID NO: 2195 - DNA, 1192 bp, Zea mays
tttccgcggctgcaggcggttgatggatggagctggggagcccaggtcgcggggcttggcgggcaccaggaaatgtgacgagcaggcgagcagcggcgccggcgccggcgtcgggctggaggtttcagatgtggtgcgcggcgaggcgtgggcgtggtggcgtttgcggtggtctttccgtattgggtgtgcggtgtgcctggtagtagagtagtaacgtgcatcagcatcgcattgcttttcttcacgtcttgggaagggttttcttttttctttctttttcgtttttggaccacaaccacacgacacggagccttctggaaaaacagcccatgattccgttttggctgaacggacgatttagcctgttgcctcccgcgttcaatctacggtgttctgtccatgctaatggagatggagttgtgcgtgggtgaaagggttcggttttcttttcgtaccaagcagcaattgtggtctgcttagcgtgaaaaaacaatggagttcactttttcccttaaactcagcatacgattaagtcctctatctctctcgtgtagaaacgtttttttactgcagtgtggtctgtgacattttaatttcaatgtacggtacttttgtactagtaattaaactgcagctacaccttaatgctgcagcgaacaccttaattctgaacataccggcctcgggcgaatggtgctgatcgatgaagctttatcggtcttttcctgctgcagagagcggggcacgtgacgctagtggtcgaagaggcgcgctgctggttctcgccttctcggagcgctaccaaacgctcccaaataaacgccatagacctgcattaatttattcaggctgtttcataatctgaattgattccctaacatgcatgcgtccggttattttagaaaaaactgaataaacctgtctgcacgaaggatatagagagaatgctagtagtagtaggcactattactctataaataagcaagcatttgaccttgacccgcaccaggactggactagtcgtgagactcgtggcgcgaaggcaatgcagcagttcctcgcacaaaccggcggcagcagcagcagcgcggcgacgtcaccgccggcgtcgccgcagccgcgtctcaggcagcaggcgcctaggaaggaaagggacccgcagaacaaggagaaggaggcgccgccgccc

SEQ ID NO: 2196 - DNA, 1048 bp, Zea mays
ttgccttcgcgccacgagtctcacgactagtccagtcctggtgcgggtcaaggtcaaatgcttgcttatttatagagtaatagtgcctactactactagcattctctctatatccttcgtgcagacaggtttattcagttttttctaaaataaccggacgcatgcatgttagggaatcaattcagattatgaaacagcctgaataaattaatgcaggtctatggcgtttatttgggagcgtttggtagcgctccgagaaggcgagaaccagcagcgcgcctcttcgaccactagcgtcacgtgccccgctctctgcagcaggaaaagaccgataaagcttcatcgatcagcaccattcgcccgaggccggtatgttcagaattaaggtgttcgctgcagcattaaggtgtagctgcagtttaattactagtacaaaagtaccgtacattgaaattaaaatgtcacagaccacactgcagtaaaaaaacgtttctacacgagagagatagaggacttaatcgtatgctgagtttaagggaaaaagtgaactccattgttttttcacgctaagcagaccacaattgctgcttggtacgaaaagaaaaccgaaccctttcacccacgcacaactccatctccattagcatggacagaacaccgtagattgaacgcgggaggcaacaggctaaatcgtccgttcagccaaaacggaatcatgggctgtttttccagaaggctccgtgtcgtgtggttgtggtccaaaaacgaaaaagaaagaaaaaagaaaacccttcccaagacgtgaagaaaagcaatgcgatgctgatgcacgttactactctactaccaggcacaccgcacacccaatacggaaagaccaccgcaaacgccaccacgcccacgcctcgccgcgcaccacatctgaaacctccagcccgacgccggcgccggcgccgctgctcgcctgctcgtcacatttcctggtgcccgccaagccccgcgacctgggctccccagctccatccatcaaccgcctgcagccgcggaa

SEQ ID NO: 2197 - DNA, 578 bp, Zea mays
tctcccccccagctctgctcttcggcgccctccactcttgtctcttgaagatagccgaagccgtgaagtttggtgggtggtgactaagcggcggcgccagtccgtaactccgtatacaacagatcggcgttctactgggtccttggcctcctggggaagaactggagaggacacgtacgcatgctttgccagcacgtgtccgtgcggagtgcggtatttactcgtggcactcttctggaccgtgcgcggcgacttcatggttctttgacacctgctgagacccgtgtagagatgtcaatggggacctgatacccgataacccgtggggaattcccctattagggtacgggtatgggacaaaaattatccccatgggtatggatatgggacaaaatctctacccattgggtaaacaggtatgggtttgggaagcaataatccgaacccgattacccatgggtatttcatacgtgtacacctgtcctgtttgtatgaatgagttgaggccgagtcaaccatcaaatccggaagactccatttcttatattggtcccaagtactgatttcttttctgatgg

SEQ ID NO: 2198 - DNA, 1500 bp, Zea mays
ctatttatacattattaatttctttctacataaaatcatcaaagtataattaaaattcataaatacactagttttgatccaaaattgcaaaaagcttaccaaaacaaataaacattctattcaaataaaacctcaagtcgccacatgaaaatgataagtgaaatattaattatgttgaaacttcgatacataaaatgatttcatatgtaactcacgcaataagtgggagtggaatggaagaaacaccaacatcttgtggattttatagtccaaatgtttttgagaactatatgtggatatatgttgtgtccccgtaaaaattcatgaattttttagactatttggtgtattattaatttcttgttgtagaaaatcatcaaaatacaattaaattcataaaaatattgtagcgtcgaccgaaaattgcaaataagttaccaatattaataaatagtttataaaaagataatcctaagttcccacatggatataatcttaagtccccacatgaaaatgataaagtctattattttgatataaatttagacattatttcaatgattttggcctaaagatatgtttaaacaaaaatgtgatgtactacaaagttatagatctcttcgagctctacaattttcatataaactttatcttcatccgatttcatatgtaaaagttatgattttataactatattattatgcagaaaaagaaaaaacgggtacccgaattccgggtacccgtatccgacccgaatatccgggtatttaccgggtagtactcgctccgtatccgacccgaatccgaagccatactatccgggtattacccgtatccgtcccgaatctaaaaaatacccgtatccgtatccgaaaaatggtcccgaatcagtatccgtatccggtacccgtttcgggtaccctacccgttttcacccctaggagcaaggcaccgttgttgccttgcctgtgccctgcccgagcgtgtatatggcgtgagccggaggcggaggggcacccaccaccaccaccaccaccccgcgtcctcctcctcctccgtctaggcccggttgagtctccctcacgccactgcaactgcgaccctcccacactccactctcctctcctcgccttccttcctcctcctcgtcgccgtctcctactataaatcgatccccgtcgtctccctcctcctcccccctcgaccacgcacgcaaatgaaagcgctcccctcgattgggcggcacgtaacccatcaccaccaccaccaacccggacccgtcaagcgctgcgtcgtcccgtgcaaagaccgcgcattccgtgcgtgccgtgtccacgcgcgcgcgcgcgcggtggcgttaagttgtcgagcgccagaggaggagcgccactagtcgtcggtcgatttgacccaggcgaggaggcgtaggcgtaggcgtaggcgcgtaggggagtctagctagctactggtgttgggtccattattcgctagcttccgacg

SEQ ID NO: 2199 - DNA, 1500 bp, Zea mays
catcaagcaactgcaacagtttaggacaaatcccccatcccaccttttcggtttgtttgaaaactcaaaggaaaggtgagattgagatggaaatatccgatatctaaattacttgagtttctaaactaacggtagctagacctctcctcgtcaccgcccaagtatgcctaatagtgagctaatcctaagtccaagctcaaacccacgcagccccccccgacaaaatgggttaagtttcctggctctcgctgctgctttggacctgttcaaatgttagatcggattgagtttggtggattaaggttaggcaatggaccgtttggcacgacccgcgcccgtccgtgcatagagggacacaggtcaggttggtccgtgtctctctattgatcagtttgagtccgttttttcctgttaagtcgagtttttttagctttcatttgagttatttttttttgctctggatcgggttgggtcgtcttttaagtctcacggcttrtacttgtctgtcgattgctattggcaaaaaaactatagttcatacccgattattgaaaaactatagttcatacccaattattgtattagttggatcgagtcaattttttcagtatggactgaatcggtcaggtaagatgactcatgcttagatcaaccactcgctctcatacaccacacttcctcacaacaaattgtttcccgtccatcggccacgcgaccgagccatgtagtctccgacgctagtggtgtaccgcgtaccggtatcacacgtgtggatgacgaccacggggatgctattctgcgctctaaatcattaatagtaggctatatctcatctatttcaatattcactctctaaatagtgatttttatagtgtaaaaccatgttttactccaccgccaatgaactaaaataactcccatgtcaaataaaaaaattgagcaccaaacgactgcccccacgggtaactttcatcctcgcggccccaatagcaggcctagagcctacggcccagcggcatcgcggcgggaaaacgaggtgcttttcccgccaaggcgcccctaagccccaccgccccagtcttcgctccggccgcccttccccttcctccccaacactctcatccccgcaacaaccgcctaccggcccgcgcgcgctgtagtctccggcagacaccaacaaggctcgtcactcccctacctccctcggtactcgctccgtctctcgtctctcgctcgcgcatcggctgggggcacggagaacgggaggcgcggaaggtcagaagcggcggccggcggcgcatcggcctcgcccaggcctagtcccgcacggtgctcggtccttctccgattctcccacagcctcgccccctcgcccctgcgcccctgcgcccctgcgcgtccagcgccccaaccccagcggcctgcggcactgatccacagtccacagacccggacaccggccgggcgaggatccgctgaccacgcagcctccaacgccgc

SEQ ID NO: 2200 - DNA, 1099 bp, Zea mays
ggtaaatttggcaagtgaaaaatgatcaatagctctagtaggtgaaggagaagtagaacccagtcagtcaaactaacattttttttgaataaggtgagacgattaaacttgcgtaaaaataccaaacaaattataaatcagctcagagaaagtattagttatgcccccacatcttctcggtccttcgatttagaaaaggatcccaaacttcagatacgttctcgattctacggtgtagggatgagtcctataatagatatgagtatatgacattcatttgctccctataacaaaaagatacatttgaattcgtatctaaattttacatctatcatttgagaagatacgaraagatataggacaagtttgagattttatattttatgctaaaaacaaaaaatatttacatagcatttttttcttttttaattcaaaaaagacaaaatatttaacctccaaataaatatccggattaatcgctactgctacggtttaacgattgccaaattccatgtagtcaatgtactcctcactgatatagaaaaatatatgtttattaaaaataaaaatgtccgctgcttgcttcgtcccgttctggcgttcacacctctggctgccttcatttcctgttgacgactgagcgggcgagcgccggcgccctttgccaggtccgtcggcccgttagccggcgactagcgcctccctttgccaggtcttcgacgtccccttcgccgtcgactggcgcccagcagccagcaggtccggtcgccccttctcgtccttcctgcagttcgaaagcgagcatcgaaaccctaaagcaagctacttgtatttgaatctggcacaattgcaagtgtacacatgtattgtgcctactaacttaaattttctatttttttgggatttccttaatccgttgcacaattcatgcgggttgcttcaatttaggtttgtattctgcagtctgctgcatacttgtagcagtagcaccattgaattgtttcatggtttacttttgaaaataatatggatagcttgttattgagcagcagatccttttctatctgtcgtgttctgtctgcctggtacatttggaaga

SEQ ID NO: 2201 - DNA, 636 bp, Zea mays
tgcagaattacctgtttatgatcaacggagtacgtgtggatgcatacagtctatctaaaataatcaagatggtctataatttaggaaagcggggcgggcgtaaatcgtacagcatgaattccatacagaatgttacaaaaaaaaaacgtatggtgccgaaggacctaaggttttgcatctttcatgtcataatcagtagcaggcatatatctatcttgttcctttcctaaggacaataaaattctgctgacttcgttttgaagggcgtgggccaagtcttcatttgtatgcatcaaccattgacggtgtcatagtacagtgtcacacatacatcaagtcatcaataattgcaccggcggattgtacggcgctctgtgctgctgcagggattttgcagtatcttgttggaagccttgtagtggccgcgrtggaaagaacaagacgatcaaacgcatggcgccaaacgagctgcttaggatggaaattttcttccatttgttgagcaccgaaggaagccccgatgttaattaatcgttataagtgcctcgcccacactcaccaaagtccaaggatcggtgcattcagaatttcagattcagttcttggttagccattgacagcatctgaggccatatc

SEQ ID NO: 2202 - DNA, 118 bp, Zea mays
aacctacggccgcccgttcgtcctggcgtccacgcctgttggagccagccttacacggctgcatcggcatcatgtaaagtttccgttgttgcttcgagacagccatggctagttcgtt

SEQ ID NO: 2203 - DNA, 92 bp, Zea mays
ggtgccgctcctgggtctccggcgacgcgcgccgcctcatcgcgcgcctgctcgtcgtcgaccccgccaagcgcgcctccatcgccgagatc

SEQ ID NO: 2204 - DNA, 1500 bp, Zea mays
cgcccgttcgtcctggcgtccacgcctgttggagccagccttacacggctgcatcggcatcatgtaaagtttccgttgttgcttcgagacagccatggctagttcgttatgagtcgtatgttgtacaggaagagaacaagtgcaaaactgaagagaggtttctgtcgacacgagagccgaatcgagccgggagtgttcgatcggcttgcaaagttttgtagatcatataatcgctattttgtggagatgcgcacatacacaattttgttttggtcgccatatgatttttgcccatctgaatgattgtgccattcgcaattaaatcaaattattactatgtggtttccagagcagctaaggggactgttaataagaatatgcagattcttttggtgtacgttttttttggtgggtggggttcttacttttaagactagtttgagagccacaaaacctaagtagattagagatgctataatcctcttcttaatcagctagaatctcttttttatttacatttgaataaggagaggattctagcttctttaatcctctctggttttgtggctcccaaacgagccttagtatctaggtacgccgatatacggtaagaaattaggaacgagatcctctgacgtgaggagagggcactgccgcgtggcccccgcgtgcgacagggcccgcgtgcagtgaccctactgcccctgcagtacgtcagaggaacctcctccaagaaattacgggacgatgattggatgattatgctggcatccagcggaaattaggagggtgctttcaagccttgttcactcatttccactctatttgaattggatgagataaaaaaaattaagacctcgttcggttacaaggaattaaatccatgtctcaatccatgccccaaaataatccatgactacttaattttttttattcggttaaacccatcatggaatataacccaaaggtttgggaattttttaaactatggaagacatggattctatccatagcccattaggtatggaacaaatccataagatattgcacaagtttacattagaatccatggatcaaaagaataactagctttgaaagtcacatggatttattgatggatttaatcccaccatgggattgagtgtgagatatggattcacccaatccatacccggattaaatccatggtgggattatatcccatgtaaccgaacaaggcctaacwagaaaagcacaaatccatacacccaaataatcatccatccttcatcaccggcgcttctcaaaagatgaactgtataaagcagcaccatggcaagttggcaaccacctgcagctctacatctacgcacacatctccgtgatctcttcagcctcgcgactgccaccaaatcggtcttggcaggttgctgcgccaaatcggccggtcttggcaggttgctgcgccaaatcggccggtcttggcaggttgcgctagctacccataggttggctggagag

SEQ ID NO: 2205 - DNA, 1500 bp, Zea mays
gataagtttaagtaccttttttccgtgtttcactctctggaattcctttttgatcgggccaaagcccatgtagcggtagcactgttccaagtcaatgccccagcgttcgtcgctgactcgctaattcgctatcatcgcggagtgcttatctattgtaaccttaacgttttgtcaggatcgcgtcttgtgcaagccattgaatccttcctctccattgctatccccataccgtgacaacgatcaatgatgtccattattaaataaagcatcaccagctaccaccactaacaaaataggctcacagtttacctggctccactgccgacgggcaagacaaacagccgtggacaagctccgctgctgccggtgacgcggtcgtcgcacgcgcaccgcacacacagggaggcctgctactgtctcactcgtgaaccgtgcagagcagagtgcaggtctcgggcctcgcggtctagactgtgcagcgcgcctgccgaaatcgacgacttgctcaggggaggcccgaggggacccaactgcaacggcgcgccgaggcgcagtcgagggaggtctggcgccgcaagacccgttagaaatcgatgggttctggagtgtccaccccatcatcccaaggtcgcctcgccctcgccgccgacgtcgtcgcggcgccagtcacgggacaagctttcggcgagcgcggccgggtgggtggttgctgcttttgcacgcctcgttctttgtgttcgggcgagcggcgactgcgactgcgatacgctaaactggacgcagtttctggttcgtacgcatttaggttcacgtggctgactgaattgccggccggcgcgctcgctgccacccaccgcggcggcgataagaacgctaggcgtttgaaactttcgcgtccgtggcggcgcgacgcgacaaggagctacgtgccagcgcgtccccccgtctccgtctccgtccctcggggcgttgttgtttattccccagccccccctgttattgaacgcatcgttgacaaaagatgtgacgctgcctgcaactgcaatcagtccccgttccgttttcactttcaccggaacaaaggaaaaagaaaagtgtgtgtgtgtgtgttattgcattattggctcctgcacctactaccgccacgaagcgaccccgacccgttcctcgtcgtcgtcctcttcggatcttcgcttcatccacacaacgtaagctctccgcccttcccagttcggcagttcctcttctcagtcatgctcttcgaccggttgtcgccggtgaccaggcggtgcggtcgatctcttatccaccgtcgttccgctagtatctccctgcttgaagccacgcaagccctgacgacgccgatgattctgcctgccatgtgcagatcgcatccctttttttctctctcaggggaggggcggcgcgtagaggcacgccgccgagcttcgggcatcccatctgacgcgaccggtcttcgggcacgccgccgatcgagct

SEQ ID NO: 2206 - DNA, 1500 bp, Zea mays
acagatatccttccatatacacatgtatttttttgagttagtgttaaatctattaacatcgtaacaagcttttataccaatttttgttacatctaggttaaggggcagttaggttgatgacaatggccttaagaactaatgtttttgttagatcttagtattactattttattttttttataactatgactatctagccaggacaaaaagcttttgtcttcaaattattatagggtgtccgaagggcatctaatattctagtgacctattattacaagtattgtaagcctatattacatatagcagtattattttcaaaaaaaaatctrgtggaaaggagaaaaaaatctcccaaactagccccacttggccaccggctaattagttctacatgtctatttatcggctttgggagccgttaatcagtaattctgactgatatatcgttttcttttttccgaacttatgtgatttttagtttaaaatccgttgcgtattttaaaacttagtttcagcagaaagttttcaaataacccattgtatttacataaaaaattgcatcaaaaagttttcaaaatttacaaatttactaaattcaaaatctaaaacaggtgtatcattgttatccgcctgcgccgattaccctgattaatcaacctgtttggtgacgcttgctgatgcatcgaaggcaccagccaacgctgtttcttcatcccaacgtcttcctcgcagcgccgccgctccatcttccgctctctcacttattactcgcgttcggcacgcgggcgacggcggcggcgcccaggctctcagcgacggcgcacaggctcgggctctcagtgacggcatcagcggtttcccctcccgcctctcgccagtcgcctcgctccctcgcctccggtcctccgcacaccgtccggtgaccctgcgtgcgtacctctctctctctctcctcccgcctccggtggatcgtcaacggcgcccggccccggcggctgcgccgtgcgcggtctgagggcaggagccagcagccgctgctccaccaaggcggtcgcgccgctttgggagcgcttatgcccccaaagcgaagcgttacccgtcctcttagcgcttcagcgcgctgaagcgtgcgcttagtgctgtttggtttaaaccgtgtgtagaggggctaaatgaccgttttggtgaacagtgactgtctcatgattttaagaatcttgttgctgtgatatgttgtcggggtgcccataaagtttacttaaggtctgagtctgagttaagctatgacatttcagaaacatagctttggtttagattttggttcagggtgcttgttaatctaatatctttgtagttgttaatgattctgttttacagtactagcggcagtattgttctctctctctctctttatttaactattgtcatgatttgacatttcaagtcctaacaatactcatatgtgccgtcagattacttgctaatctttcttgagggcag

SEQ ID NO: 2207 - DNA, 1500 bp, Zea mays
cgctgtcgtatactcgcaggctgagtcgctgatggactgaacgagtgaggcggcatgcctttgcatgggcggggccgtcagggttaaggccggcctcggttgcgtgtgtataattgtgccaatttcatgttttacggggtttttctttttctgtcgagctgatctagatccagctcatacgtgcgggctgtgtccggcctaacaggccaatatttaagattcggtctaggcctgtcttcgttcgtgttagcctggtctaaattactaagtgttaggctttgctttggctactgattttagatcgtggttgtgcttgtattaacccaaaaatagggctagatatcgagtcaggtcaacttggccaaacttaaactgtctcggctcgatatattaaggaaccgaataagagaaccaactcgtctcatttgtgagttcgagctctcccgagctaaaaaaacaatatgcatatatatacaacaatatgatcaattgcttattaattctagaccaaattaacacttaaaaagagtaataatactcaaattcacataacacatcaattcaacaccaaatgaacatagtttaacacttattagttcatccaaaacaagtgaaggctttgttttgctgataaatgctagctcgttcgagttaacgaacaggctcaaacttggctcgagctggctcattaacaaaaacaagttgagatactagctcagctcgtgacaaaatcaaaatgagctgagctgaattgagtcgagctaaccatgaaccgagcgatctcacgagccacgagtattttgtctagtcctaccaaaaagaccggtccattcttctagtactagtccgaaccccgaaaactttatgatttccatagcatttgtcaaggctgcctcattaatcattttgttgacgatctagagtactctagcgaaaacatgcaagcaaccaaaccgtagagaagtgtagtaggcaaggctggtcgctaatgcgtgcacctggacagtcgtaatcggactgtgcgtgaacgaactaaaaaggcgcaacaaactgtgggagtcgctagtcagtacaaaactgaagcggcctttgcccttttgtgactgtcagcacaagcaacaagtccaaactgttgagcacacgatccatccaagtcgacatcctactgctgatcgatcgcgagcttgtcaggttcttcccatccaacgtgcacagctcctatcacggcaaagcaaagcaccagcagcgtacgaggacaaggcctgaatttgttcccaggtgcaacaaacactttttgttctttttagctttgcatccttctcgttccacttacttaatggcacaccatcagcagtgcacaccacggcaacagcattcactgccaagagagtgagcgagcgagcagaggcagcgcagcaatggcggcggcaatagtactctccggccaggtgcggccgcatccctcgtcgctgcccctgtccctgctgctgctctctcctc

SEQ ID NO: 2208 - DNA, 1500 bp, Zea mays
tcttggattgctagctatgtcataaggaagggcataagtcttattaatgcaaggcaaagatcatgggagaaaagaagaaaagacaacaagcaatacctccaacacttacaccaataaggtggataaaacgatgactacactatatttgatcaagaagaagaagaatgaaaaggtgatagccatcaaggccaacaagcaagccaacaaaggaaagatggccgaacacatatgggtatcaaatgagattattcagacatgaagagcaccaagaaggtttgggtaccgagagggaagtgataagttcgaaggactttgaggaatttagagacttggtaaaattgggatgtatatcatgggatacatcatattggatctagtctattgccaagtgggttagtaaacattatggacctaaatttcccacccatgactaaggtaacttgatttattgcaattccttgtttatagatatgcatatatattttcttgtatctaatataccattcttcctagttttgctttcaattgtaatgctttttaattagtgttctccatgcctttatcttttcaattgttatttatttcaattgaattgcatgcatactaggtatatcttatggtaggaatgcttagtttaaattcttactttttgagcaaacatacatggtttaaaatgtttagtaaagcagggcacatagcttaattaaactcctagataaatgatacttgcttgcacctttcatttggtatcctttaaactagtatcattttgatctatatgtgccaaagttcggattatagatgatatgcctctacttgatcttaaaagtcaaattttatgtctcctacaagtattcaaaacttgtatattactctataatctaagtctttaagactaacacctcttttcaagcctattatgcgtgttgtagtctcactgaaggaaaatggagtcctcggagaaagacaataagcttccactgcaagaccttttcaacctacaagtggtttctttccacaaattggtatatcatttacatgtcttctcaaaaattttaatagactatgtcctttcacatattgtaccccccatgttggccacatatgcatatgttactaaatgcttcatatgatatcactagagtatcttctatcatttacctatgcataaggggagttagtctatttcaacaatgacttgtttcctcttgtttattcatgagattttcttaaatagaggatctccgacaggggggtatgccttctttcatacaaagggggagaatactctttcaaagggatagagctctctttttgtcacacccggctttaaggaacaaagctaggtgcatctcatacatgcgccaagaagacaacatatataataacagagtgtatagagataaatgtcataaaacatcagagtatttattacatagcggaagacttattacaaaataaaataataaagataaaacgaactaaggatcgtcggcgcca

SEQ ID NO: 2209 - DNA, 187 bp, Zea mays
ggtaattaagcacatactagcttacaattagtctgcaaaaagggttgtgctggcgaggctgctagctatatatctgctatgtatagtagtaattattttccggtggtgtaagtgttgctaattaatcaacctttaattgcagctaagcagagagtgttcagctcgtttaatttcttctgtaaacata

SEQ ID NO: 2210 - DNA, 262 bp, Zea mays
aatacatccattctatttcctgagtttttcctattcccgtgtttctgaaatcctgtgttccaaaggagcccctatcctgtactctctctcagtctctctctctccccccgttctccgttccacatcgcgtgcgcattgagacgacgagtttctagagcgccgtaccgcgcacggctcccgagccccaccgcaaagcgccggaatcgtgagcgcgtccggcctcgcctgctccgcggcgagaggcggccgaggaggacgggcg

SEQ ID NO: 2211 - DNA, 885 bp, Zea mays
cgtccaccaccctcgatgggcaacgagcatgccattttcgttgagctgttaatgggtaatctaagcggaggcccgagctttgtttgataggagtcagctagtggtccggagacgcaccccaaaagttcatgcgggtgattcgcctggtcccggtcccggtcccgttcgatggggttcgagggctcgattgcctccctccaatgggataccgttatgaatcactctcgggggtcttagacatgtctaagggtatctcaggatcgtagcccgagcctttggccatgcatggacatacccatagtcatccttgactatgttctggggtggtcgtgatacccttcagaggggccaaccttcgaacccctaaccagtaacagggtcggagcccatgtgttctagggcggtctcccgagcctcaccgagggctcgaccttcgaacccgtgagcaataggtgacgtctctcctcttctttcccgagggaggaagcccgaggtggaggcgctttcttctgctacatgtgaagtagtggaaaaaggaggcagagggagagagggagaggggaaacaccttttgatgcgtcatgtgaagcggcgttggctggctgacatcaggaagagtggacatttaatgtgccacgacgctttggcccgcatgccaaccattgcagcgcaagtgcgcatggaattcgaagcaacccagcccattcctggtttggactcaggacggctcagcccacgtcttggtgactttgtccgcccgtataaattcgcccgagaggggctctttggttctttacttccagctcttgcgttcctaccctagtcgcattctgccttagccacaaaaacacatgcactcttctcctgtcttcttccttagccccg

SEQ ID NO: 2212 - DNA, 761 bp, Zea mays
agatagccgtcgagcaacggatgacaacgtcggcgctttagagatagccaccgagcgacttggggacatcgtcggcgctttagagataaacgtcgagcgactgcgggcatcatcggcattttagaggtaaatgccaagcgactgaggacaacatcagtgttttagaaataacagccgagcgactgagggcatcgttggtgctttagagataaacgccgagcgactgagggcatcgtcgacactttagaggtaaatgccgagcaactgaggacaacatcgatgttttagaaataacggccgagttagagcgattgagggcatcatcggtactttagaggtaaataccgagcgactgaggacaacatcggcgttttagaaataacggctgagttagagtgattgagggcatcatcgacactttagaggtaaataccgagcgactgaggacaacatcggtgtttcagaaataacagccgagttagagcgggccgtgtcggccactttgagggtaacggccgagtgacgatgtggcacaccaggggttttagaagtaactgccgagtgatgacgtggcacgctggtgttttggaagcaactgccgggtgctgactgggcgcttttggaaacggtatctggctcgggaatatcccatatgtattgcgctttcagccgcctctgctttccgtgccctagttcttgctttcctgccttcagattctctctgcaattcatctcccactctgttcgccggtagaattgag

SEQ ID NO: 2213 - DNA, 1500 bp, Zea mays
tggcgattgctggcacctgtgttttcccgtcgcgtggcaggcaccgagccccacgagtaaaacatctgaatcacctcctgttgccagctgcaagcgccagcagcaggcggcctcggcaaacacgacagcgggccgggcgggcctcaatcgcgtgacgatttggcatcgtacgccagaatctttcaaaggcttgagaactgggttactgtttcccgaacgctcggagttgggcccagcccaaactggaaacaatgtgccgcgctccctaacgtggtttggcagcaaacgtcatcaggataattaaaggtgctactattgctgtactgcagttttcagttaggggtggtaatggatcacgattcaaatatttcttcacaataagttatgacccttaattaattttagttcaaaaattaataggaatagtgtccgatcataatccgattcgatccttgaaatgtatagtgtaaaatctagagcccattaccacccctagttgcagtcaagttaacaatctgttctatggaaaaaaaatgaaggtgacaagctagaaggggaaaaagccaatccagttatttcacttgtgacgcacgcatgcatcatcaggttgacaggttgagaaactgtagaactttttaaacactcttgtactgtaataacttgcagctccgctggtgattcagcagcaaccggagccccctttcaccccttcagacggtggatgcagctgcagctgctggtgcgtcaactgtcagtggccagaactgtgccacaacgtggtggccggctgcaggccagcagcagagccaggcacagggagtcgaggacggagctgctgctgctgctgctctgacgagcgtgcgtatccgacaacagcaggcagcggtgtgagcgctagcggcgccggcctgtctgtctggatgtcttgtatgtcttcacatgaaacggggattgattattcaaatgtatacggagaggaccatgtcagaaacatattgcgggttttggatttcggtcggagtatcatctttgagctgagcagttcgtgcgtcgctgttctaagcctttgtgcccttttgctgttatagatgagaggtcgggatcattggcagcggtggtgtgggccaatcctctgcccatggctccgcggacgccgcgccatgctggagcactttggttctgtggtagtgctacaccctaaacccttttagaaaaagcaaggcgcaaagcatacctacatacatacgcatggaatcatttcgatttgaaggcggcggttgacagccgttttcgtgcataagaccgtccgtccgcaaacaaagctagttgccacaccaaagaccaaacttggctcgtgtcgtgtctcagtgtctgccaccgagacaaaaatcgtcgtcagaaatttaacgacgcatattcgtctgactgacccgcccgtgcgccttcctcccgcctccccttccaccaccaagagtgacgacagagagacagacagagaga

SEQ ID NO: 2214 - DNA, 112 bp, Zea mays
acggccacgacccatgatgcatcttcctagctacacgtcgatcgcaggaaaaggacactaactagtacaataccatggatgagatgaattcacatatattactctagcttat

SEQ ID NO: 2215 - DNA, 1014 bp, Zea mays
ccagagccaaaaatcatccttttgtttctttatgttttccgaaaaagaaaaaagggggaaagctccttgtgtagtgtgcccaattcttttgtccctactctagaaaactgtgtagtcctgtatggatcaagttaacccaatctttggctataactatcgctatagtcagttctagctgttttagacactacaccactattttgtatacacattcattttagcccattttagcctgctatagctaggtatagtcttatggaaactctgcaactagtatggatcctcttatgcattatgttcggtatgcagaaaaggtagtatattgagttggagcaataatccttcatattatattattggcgtcttgcttaatcgatctgtccaaaaaattggattgtttgccacaactacaatacgcatcaaggtattgccttagaacaaaaagtaggtgttattattctggaagcttagggagataggtttatcaagatyaagcacatcttcacaatttgtaaattttctagaagctgaaatattttgagaatgtagatcaatgattcttggaataaaccagaatggatacaaattgatgtactgttctctgagtttggtcggttgttttacactgcatgcatgagatttatatttacagtgcatcatcattatcattgtactgagatccgcttatatgtgatttttttcaatctcaacttattgatgaaaggcctgtactcaaggtctccttttgatggtatgtggtgcatttatgctgctttcttcctatgacctttagttcactgcacacacaaaacttgattcttttttccagcttgactttcactgtccttgagcaagtaaagttgctttttcctattatacttcattaatttacattttttatattattaacctccaaatacagtcagtatgctctagcttaaattttttggttttcttcagcatgctttggtcatctaattgtgttgttttggtcagaatttgtctcaaacaagg

SEQ ID NO: 2216 - DNA, 1500 bp, Zea mays
cttagagatagagatttgagtttgatttgcaaaaacaaaccaagtggtggcaaaagatgatccatatatgccaaagttgaataaaactcaaagttagtttttatttgaagtgattttgcacttgttctagttgctttatgttgtgttggcataaatcaccaaaaagggggagattgaaagggaaatgtgcccttgggccatttctaagtattttggtgattgggtgcaaacacaagtgcttaaatgtgaaaatatgctcatgggtgaacaaagtgcaaatcacaagtaaaggtatgtttctaagccttagtacattagtttcgaatactaatattcttgtctaagtgttagaaacaggaaaaacaaaaagaagtggagagtggctgtgtacagccaaaggctgcttcgggctggggcaccggactgtccggtgtgcaccggaaagtgtccggtgcgccagaccagcacagagcaaaccagccgctctcgggttttttctccgacgacttcggctaaaattcaccggactgtccggtgtgcaccggactgtccggtgagccaactgtcggccgggccaacggtcggccgcgcgatcggcgcgcgacatcggcgcgcgacacgtggccgagccaacggtcgggaaggggcaccggactgtccggtgtgcaccggacatgtccggtgcgccaacggtgcgcagatctgcatcagacagcaacggtcggatgcgctttttatggaaacaaatcgggcaccggacagtgtccggtgtgcaccggactgtccggtgcgccacgagacagaaggcaaagatggccttccagatttgttcccaacggctcctagctgccttggggctataaaagggaccccttggcgcatggaggagaacaccaagcattcctacaacacttctaagcaccaagacgtcaatctcacgcgttcgtttcattgtaatagcatatagagctcttgtggagtttttgagttgtgttgcgagctctttgtgcgacttgtgtgcgtgttgttgctctgatcttttgaagtcttgtgtgcgttgctcatccccttccttactccgtgattctttgtgaacattaaaagtgtaagggcgagaggctccaagttgtggagattcctcgcaaacgggataagaaaagaaaagcataacactgtggtattcaagttgatcattggatcacttgagaggagttgagtgcaactctcgtccgttgggacgccacaacgtggagtaggcaagtatttgtgcttggccgaaccacgggataaaccactgtgtcttctctgtgtttgatcttttgtggttatcgtattgtgcaagaccttctctagccacttggcattattactctaactcttaacaagtttttgtagctataagttwaagttttacaggatcacctattcaccccccctctaggtgctctcaawtggtatcagagccgttctcttcaagaaagggactagccgcccgaagag

SEQ ID NO: 2217 - DNA, 1500 bp, Zea mays
ccaacctctattcctccccaatacataccccaccacttttcttctttctaacctagaaccaatgcaattttacatgtgcatttttatggtccattgacactagaaaaagttaagacctcttggatgtagcacaaaaaaaaaagattgttgttttaaaataataacgatgtaaaacatgtcatgcatrattatgaatctaagttatatactctccgcatcctaaaatagtatttgttttagctcttaatttttatgtctatataaatagacgataataaatctagacatatataaaacacatatatcaaatattgtataaacttattaattatctaaaacgaattttaaatttgggacagagagagtataaggtatagagaaggcgattatagatttttagaaagtaagaaggcaagataaagaaagagtttatgaaatagaaaaaatctgagttggaaggaaccttttcctttttaatactctatcggttctaaaatataatttgttttagactaaacatatatttattaattaacttatgaatctagtttgcatctatgtatacatttaaggtggaagaaaaagagctagaaagaactatattttaggacgaagggatattatgttgagattcagattgagatgaggtagataagatagagatatgtttgaatcagtcttaatcagcgcaaaagaaaagtatggatgagtttggtgcggcacaccacaaggaagagcacagaaaatcccaaattcccaccacgcaggtcgcaggcgcacccgtctctcccttcttcctcctctccctcttctacacccgacaggcacaggcacaggcacagcgcattgcccccctccttgtccagcgcccccaaccacaaggagtcaaggaacaggtcggggtccagccatccgaccccttgaatccgcttgccctcctgcttgatcccgccgccgccgtcgtcgtctcaaccgcccactccttcctctccctatagggttccctgccgctcctgcgaatcgagcaatcggagacccccgggccgccctccaatgcgagttcctctccttccccctactcaactttccccttttcggctcgattcactacaatctcatgggaattttgccgcaccgccctctcccttcctctccaatgttgttaataatattggacccgtgcgtgcgtgcgtgtatccccgtaggccgtagcagagcacaatccggtggtatttaggactgatatagatttctgccgatagatttaaagttggatggttgatttgttagaatcgggcaaggttcgatgccatctgtgactttcaatctctcatgtaacagtttttatcctgcctgtgctgttgcctcaaggatttattgattgataccttacctgttttgagtctaggtcgtcttcttattgttctgcatgcataatacttgggacttgggtggttgtttctcctcacgctagctgacttgcaatctaccaggacgacc

SEQ ID NO: 2218 - DNA, 263 bp, Zea mays
gaccaagggacacccaaccgtcacgcaaaggcaaggcgcaagcatacaagttcctgtttacctccgttttcgttctcctgagtttctgaccttctccccggcccccggcggcatttaaacctgtctcacccacctccccaaaataaaatgcgtccgttcccggagcaaaaataaaaaaaatcaaaaacacaaaagaattcgctacttcgccggcgacaggggcgaccgcgcgcgccccggccggtgctgatccggactctccc

SEQ ID NO: 2219 - DNA, 928 bp, Zea mays
aatttttcagtaatacttgttctatctacttgcactgccagatcttggttgtatattcaatagaagactataaataattttcaatatatttagcatatttgagctggtttgtttgtctgtaagtgtatatatggtcttgtacacattagtatcttgtggtctgcatgtctcgattatgtgtcgtctaatcatattcaagtattttgagtccatctaacattcaggtgtcagattagtattatattattgtgaaatgtctacatgttttgcgtatgcatctgaagcgcgtaacaataatggtgtgagattattaatcggctatgtgtttgtggtcgttgattgctcagcatcgttatctatagttcttttcatttactactgcagcctgcaggtgaggtgatgatgtgccattgaacaaaaggctatgtcccaatgcaataatcgtaaacttttattttcttgaataaaacacaaggggattttctttactgtaaaacggaggatgtataattcacaactcagtggtgaatgatggtgcaaagcagaggaggcgacggagctataagcggtaaaagtgggcgctcactaaactacactcgctcgtagccgttcacttgtcagcacggcagcgcagcacaccccatcttctcctcttcttcgtcacgccatttcgcatgctccattccgttccctgttcctcgtacgtagtgtagcaccaaggagccaaaggtttgcacctcgatcgatctataaaatcttctctttttactctgatgaagattaccgtgttgttgctagtactagcaggtagactgtaattaatgtactaccttacactactacagtaaataaagatggatccatgttttggtgtttaacattgatgcatgtggtacggtgtagcagccagcggggcagctgagcgagc

SEQ ID NO: 2220 - DNA, 1500 bp, Zea mays
caactctttggaataacaagcatgctttgcctaatgagtttatgccgtagccgttttattctacaagtggaaagcttcaatattcatagaaaatgattgtgcagtcgcagcgtagccattaccattagccattgacgttgactaccattgtttgctaggatctggtatgatccggtaaagcattggcattcagcgcaatcgagttctaatggcctccatgtcgtattaaggatgaggggacgcagccgcgcaggttaaatgcagattgacatcgagatcgaattccaatttcgagtccattcgagctagcaaatatcaattcccaattctatattatttacaaccaaacataaaaatgtgtcatgttatggtcaaaggtattaagagactagatcggttatcaaaccggcaagaacgtgaggttgctagtttatttgtctaactatatctataccactatataattcaccggtttaaatattttataaaactcattcaatcaagccacctcatacgtataatccccactaaatctataaaacaaattgcacatatacttaacatcatcaaaatcaaaattaatggttcaggttgctagataaacatctctcccttaaccacttaaacctaatagataatattatttagatgtattctttatcatcactcatcactctctcttctctcagtgacctagccactttttactcatgctgccgtcgacccctcgtatcgacccctcatatcctgtaagatcgtagtgttaataagaactacatgctaatagctttaggacagcaggtgcgggacaaccgggatgagatgaaagagtttttctttggtccagtaggtaagatctgtgtgccgctaactgcacggcggtggaagacgccctcttttttccaaagcgcacttaattgagaaagcgacggccataagccgtgagcccgtgaccgggagcatgttcgaccgcgctccgcggcgccatgcgccatccccagcgacgtgtcctggactcgagggggagagaagtgccggtgtcgctgtcagcgaagacttgggccgcggatctaagtcagtctcctgccgagtcatccaaaggaattgttgagttgtaggaggtaggagctgtgctgtagtaaatctcccccgcgccgcgcgcctgcatgcggctgtagaaccggccagcgcccggctgccggcgcgtccatggctgctagcatgctactgattcggccatatggcgcgctagcttgcttgcttagctgattagctctgctctttgctgttgcaaacgcgttgtgccattgtgctgtgtccacgtgagaattcttgacgtctcatacgtatcatgtaacgccatctgcttgtcggaccagtatatattaggttgatctcaagccagactcagtcagaggatcgagttacttattcctcatgccctgcatctgttgttgtttctgaggtcaaccgcatacagagttgcttgaatcctcggcc

SEQ ID NO: 2221 - DNA, 1500 bp, Zea mays
acagttatgttaatttaatttttttaaactttgatcgaatttctaaaagaatgtgttaagatttacgacattaaattagtatcattagatatactataaaatatatttactttatagtacatatgttgtttcttttttgtatagagttagttaaaattgaaattgtttgacttgcatgaattatagaaattggcgatgatagagtatgttagaacgaaggaagtaaatctataaaccaagcagccatttgcccattttaagatgtcaactgaccgaatatatatatacttcctccgtcaaatagttgtcgtgtggtacttttatttaaatatctcaagatttaattagatttgtaaaaaaacatattagctatatttgtatctttaaataaacttattataaaaatatattcaaaattcattagtaacaacaaatgtatactataactgttaatatttttatatatctgataaacgattaaaaacagtttattcaaatacatgtgtatggaattgttaatcatttcttacattgtcaaacatattattgtataaaaataaaattttgcataaatatttttatacagtatttgctgctacaataaaaaggtaaaaatatcataatatatatatatataatttaagagttatttttaattagattaatactgaaaaataaaaatacagtagaatctatatcatgttagtttgtaattaaagaaaaaggattaaaaaaaattattcgttttgcattcctgttcgcgagcacggtaattacaagatcttggatggacctcgagaactgcaagttggtcagcagaatactccaatgtccaatcccaaaagccggtgggcggtggcgcccaaactagaaccatcctgtcctttcggattggccagctcgtgcggtgggcaagctgcactcctgcgctttgcgcgcgcggggtgctcgcagctcccggggcacgccacgtacgcgccctccatccaccacctgtgcgcgcggccgacgacgcttgggcgcgtgcgctgcgctggcggtgcgcgcacacgcgtsgacgcctcacgcgcctccgcgcatgcaaagtcgaaggcgacctgctctgctgctcctctgcgccgcttcggcctcacgctagctcctcccccctgcgtcggcaggcaacggatagatacgcatcgaggcagagggcttggccgagatctccccactaccccagcagagtctttaaaaccaggacctgcttgtttgattgtttcatcgatcgtcaatgcaagcttgtccattcgcaatggtctgaacactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaaga

SEQ ID NO: 2222 - DNA, 354 bp, Zea mays
cgaagcatgacacgcacacgcgttaacatccgatgaactttttttacatccgcgcgcgcaactcaccggccgtatggcactggcagggccatttacattgtgcgcctagcattattgctcttattaggtagggccggctcctccaaacataggcgcccccccaaaacaaacccttgttccggtcctttctctctctttatatatagaccccacaccacctcccctcttctccctcctccctcattatctctctctcccaagctctttctaccgtttctcttctagtcgagcggggaaaacaaagaaacaaaaaagcaaggaagcagctgcacgcacgccgtcgcctggccggcc

SEQ ID NO: 2223 - DNA, 363 bp, Zea mays
gtagagaatatttttttactaaaagaattactattcttttttatttaatagaatacacaagtaaaaatgtaaaataatgacggatccgaccgtcccggccagcggcgacggcgagctgccttggggcctggcactccggcagagtcgcagagaacaaacggctgccacagtgccacggcttgctctgcggcgagccttgggcaccgaggcgcctcccatcctctaagctccaggtccgttcgcgcacacgtcattcgagatgagctcggtttccgttttgaagttgtttgcgtttctgcaggattctcaagttttcaagttgttgcgcagttccttcttctcggggaaatcgatccggagaga

SEQ ID NO: 2224 - DNA, 407 bp, Zea mays
tgcagcgagccatcactggctttggattcgaacggtggaaaagtgggatcgacgccaaaacgcagcgtctgctgcgccgcagccagttggctaagggcgctgagtgacaacagtaaggcataagaccaacgctttttcatgatgctctccggcaggctatctcacaggttttaaccttgtaataacacgatgccgctgacaccaccatcaaaagcgcgcaataatgcagagcaaattcttatatatgttaatgggttagcgaaatttgtcgcgccattaagttttacttaacgctctgtcatgattttgtcatcaggggctcatgccgctgtcagcctcggttttctatggtaacccgcgttatactgcccgccatcagcaagcggccgccactgccgggagatcgc

SEQ ID NO: 2225 - DNA, 1500 bp, Zea mays
tctagtgccaaaagcataataaccaacaaaaaatgaccaagatagtgcaaattattgttgatcctttgtttgtcaaggataagcaaacaaagttgcaatgatgagctgccttttggtgcaagttgacgagtatataatccgcacgacattccattatattaccaccaccagcagcagcaacaacaagtaataatccttgccgtgctcgctaaggtgttccgggctgttcgtttagctttgatccatatcggcttctactacttttacaatgtatgtttggcttctactatttttataatatttttatatttacggattgcagctgtagcagtctaaacaaccggttttaatccgaagtgttttttttgtctttaaggcgttcataatgcatgcagcatgcgacaaacatatggcggctactgatctgacattcatatatatatatatatatatatatatatatatatatatatatatatatatatatatatatatatatttgccgttctcctcagctcgcgctggcgcctctggcttctttcagttagccacaactgaatgaatgagctcacgatggatgcagcgtgcatgcgctggcggcgacggaaaggatgtcaataatcgccagacgaccaaacagcctatggttttgcagctttgttggtggtgatgttagcgcttagcgggaagaagggtacgtacgtggtggtttccaactcgacggccctagctagtaagattgcaaaaatgattgcaatcttactgatgagctcaccagccaagatcgaccagagaggagcgcgtacgtacgtgagggtgcagtgcaccaccaaaaactaaaaagatgacgtggggtgtgcatgcgtatatatgtgtgcaagaatgacgactcaatccaccatctatctatatttccacacacacagttttattacaagagagcaaaggtagtctccatcaagaggtcagtgaaaaatagtaccagcgttttaattaattagtatatactccactacccttgctgctagctctaggcggcacacatgcacaggcccccggcccttttaattaattagcctgcaacttgattaattggtgagtgcatgtttcgctgaacgcatgaactaaccacatctttccagcctggagaagctaataccaatcctcgcgtacgtctgaatcttgggcgcgccgcctgcctatatatatggttagcacacacatgcatggtgtgcctatactaatccacctctttgtctgatgatgggacgggcacccggcccagcccggcccgcttttttcgctttgctctagtcgtctgctccgcccctgggtgctcgacagtttaacaacctgcatttcttgagttagtatcgcccgccttgcgaagacggtgagcatgcacacagagagatatcctttgttccttctgtttttttattggtgttggaaaccatatggttgatgtgtatagagatcaaccttgcagcgcagagaatc

SEQ ID NO: 2226 - DNA, 1500 bp, Zea mays
taaaaaaaaattgtggcccacatgcagacttcggaacaaattgtgtaccgacgtacaaaaatcgctcccgttccactaatcaagatccccgtcctccaggtcccaactcccaaccaatagagcgtgagcttaccctccccgatccgcgtcacagcttagcgactatcatcaaccgtccgatcgtgggtagccaagcacaacgacgcccgatccgcacggttcgtttgaaccacaagctaaactgccccatatatagttccctacccctacccaaccgccgccatcaatagccagttctaatctcaggtttggggggaaaaggcctcgcgggtcgcaaaccgctctctgttgatttgggatttgggaggcgctcgaggtaaccatgctttccgacacagtattcgaattttcggttcctgcagttactgactcgttcgcggttttgttagtttacggaagcggcgctcgtcgccgattcgaatatctgtcgcgattagggttccatgattagggattagggtatggttggtcgctggaattttcggttcgctcatgcttaatctcgtgcacatgtggttgcctgtgcctacgtgctgcggggtcgttggcttttttttgtttggcaattactatcgtgatacgatgttgccaatcacatgatttcgcaagcatacatggcttcgttttaggcataaatcatctatcacgatgcggctaacccacaccgttagaactgatggttatagatgtggttttactgatactgttatgtcgtgcctgatcactggattcaatgcctggtcattggattcgacaaaccttgttctttcatagttaagcatccgattgtgacgatgttgtggcgggcctcgtcaatgttgtcatttaccattgatcaacaataattcaactgatgttcggtgcacttaaactagtgtacatggtgcaattttatatgtggctgtgtgttgttatatgaaagcaacaaccgttgatgtttaattgttctgttccttaagaaaaaaagtgcccaaacctgtctgtcgcctgttgatgtgacacaaatatatgttgatattttcacgtctggggtggttcacattatcattttatggacgaatyaatttgttgaaagacatgatcatgatattttgtatcattgtgtcattattcttgtgagaagatgggatagtgatcaggctacaatagctgtctattcagattgtttgttccttattcgcagttgtaatgatagtgttcttattagatcatctcatgtgttcttttggattaggatcagtctgaggtttataatttatactttccaagaaaattagtctttagctccattgtgccgtaaaactaatctgacacagttttaaacctatgcgtgatgaattatttatgtaattaatttgtcaggagtattctaaagattttggctaaccttttacttataatttttttgcagttttcaggtaaaccatagtttagtgaccc

SEQ ID NO: 2227 - DNA, 135 bp, Zea mays
gtttcttgctgtatttacgccgtaccatggcgctgatgaattggtttccatgtgattgtgccggctgtgggcgcagacgaaggctacgggcctacttgggacagcgacgacgaatacgacaacttcatacgcaag

SEQ ID NO: 2228 - DNA, 237 bp, Zea mays
cgtaaaagcctgttagaaaaaaaaaatcgatccaaacaggtccaacatcttctcaatcccatgtggatgtggccatcttcgtgtctcctgtccgtcctgacggcctgacccacccacccatctcgactggcagtggcaggagctcgccttttccatttccctcccaaacggcaagcgcggccccaaaaatcccctccctagggtttgccccctcctttccgtgagatccaaacccca

SEQ ID NO: 2229 - DNA, 177 bp, Zea mays
tgtaagtgttagcacgttccaatctgctcatgccctatatatatttccacaactatttggtcatccgcctgtaaaatttcaggttcgtcgagcattaaaattaaggacgacaaaacgggcgcaacatctactgttaattcacatgacttgtcctcaggatggaagttccactggcac

SEQ ID NO: 2230 - DNA, 268 bp, Zea mays
tttgggattatataattataatctcaaacaaacaccctcttatttcagtagattgttaatcaaagttcatttctgatatttggactctagcacaaattgaaatagcagtgctattagcatgcaaagttccattcccgagtgcataaaaagtacgtggtcatgactcttgtctctacatttttttttgttccttgagcagaatgacgtatactgcgtgggattccaaaatggtgcatcacagtcaaaggatggaaaggacattgtgctt

SEQ ID NO: 2231 - DNA, 177 bp, Zea mays; identical to SEQ ID NO: 2229

SEQ ID NO: 2232 - DNA, 340 bp, Zea mays
tccgccttcaggtctcgcccttgctggcgcgcgcctctgctcaccacccagcgccgcgtcttccttctccagtccggtcgctggccgaccgccagcgcggctccgggccctgctttccgcacgcccaagcctgcgcgctccggacgcacctctcctgctcttctgggcttgggaaagagaagaaaccagcataaaaacactagatctgtgaaggatttgaggaagaaaccaaaccgaaaccctagtgacgatgctagagttcggacctcgctctgagtcgaaacgaccagagaccgctgccttccctccccattttcctttcccatgaaccaagcagcgt

SEQ ID NO: 2233 - DNA, 64 bp, Zea mays
acacttgtgaagatgcctcttttttacatgtaaagagatcgaactcgagactgataggttgatt

SEQ ID NO: 2234 - DNA, 1500 bp, Zea mays
gcatgttagtgtcgtcgggtcgggcaatccaggcaaaaaaacagagtcatctaggaagagcggaggacggtggaggaactaggaagagcaaggtggcagatccaacccgtagacctaggatgatgcggggaacgaggaagaggcaggacagtggagaaacgagaaagagcatggcacaaagaatgacaaggatggcaccaaatcattttttcggatggaattgacattaatggatttcgggagctccctacaaggttgctgaatgtagaaaggttttagggaaatttatggtgtttataaatctagggtggcttttacataacagatgaagaagcatttaaaaaaaccttaattcaatattaagggagtgctttacataactattggaggtgctctaagagcacttatcctatcgtatccatttggtgtagttcctacaaatctaatgttgaacttgtcgttaaagtcaaaatcagagttgtatcaaacaacctctaacgttttgtttagaaatgcttcagctttagaaaatttgatagagttaataaagcagtttattagatgctttagaaaatcatagagctagagtcataaacctttagaagacatttagataaattatttaatttattgtttagattaaaaatatttttaaactatttaaagttatgagccacacgctgaagctagaacctagaactgtagcagttccaaacatccaccccgcaagagtgtttgtgcgagggtcacatattgccacacttcttgacaacctttgccaaatgtgtggttaacaatttgttcaccacaagtaagtcatatggtttggcaaaggaataggcctatgaaaatgtggtttagaagtgtagcaaggtgtgatagtattaaaaaaactacgacacatctaatctgtgacgtagcaattttgggttataaactaaatatcctaaaccatatggattctatttcttcaaagatattttattacaaatgcttaaccacgccgcccataacttttagggctagtatcccctccgagattgaaggggtttgaagaagtttgacgataagggaattaaagggaatttatggaggaggaaatccgtgttaggaatggctacctagtgggcctggacaacgggatacttctcaatgggctctgcaagtccggcaatgttggggacacgttcaaggtgctcgaccaaatctccagcccaggctcggatgtttgcctagatattgccatcttgaacaccatagtggatgggctacgcaagattgagaggttgcaagaggccattgtgttcgtggatgagcggatgaggcaagtgcatgggtgtgcgccgaacgcagttacatatcaccgcttgcatgatgcgtcacccagcgaatgcatcagaggtttagaggaagctgaaggccatgttcaatatcaagggactaacaaggatttgcttccaggtggtttgaaggcacaaatagtgcgcataccagaaggag

SEQ ID NO: 2235 - DNA, 1500 bp, Zea mays
gctggttttgggctgatccagtgagagcttgacgatttgctactcttatttttttggtgatcgttttagcttgtctacgccaagcgcttaatgtggaacgggaggcttacttgctttctgagataaggaacatctgttctttcaggtgtgcagtgctcgtattcgggtggactgattacttcgttaaagcctcagcatagtgatgtagccttcctccctctgctggctatatgcttgtatggttatttgcctctacgttagggttaaaaaaaagtccattctgtttatgtgtattttctttgctgtcccttggtatccatctgtggttaatttgggttcaggttgctatttttgttgttgtctttgtatctggctgactgacaagcgagggttcttttttttagcgcaccacattgtgatgagtgaaactgaagcctccgctatgatttctgttgtgttctagccatagtttatgcctgatgctcgatgttctcacttggcgtgaactctccaccttgattacaagtgcaagcatagagtaagcagttttatacactcaatgatgcaacactgcattgccaaaaaaaatcatgttccttaaatggttaccaaattgtttgatgttatcttaatggtgaccaatggtagcattcaagatatttgatgttatctcaaggcaatggtattgtattgaacagtgatggctagaaaaggtccctggctccctgctaaaataaactttagagagcccacataaggcaggccttttagcggtaggatactgatcattttgtgtgtagatgaagtgggtatcttctagcaactccttcagtgctgtgtgtttctcatccatacagggttttttgatatgctctttctcgcattttcctaactttctacttgtctattttttgtttaattagaaatttgcatccaaccgcagaagcggtgaaataatcgaaatgaaggaagtttaagttcaataaaatccttataataagtcttgtttcttaatacttgtgaaatcgcattccctttcttctatgcctacagggtttttctggttccctgtcttctgtactttgtctgttttctcacgggaataagtttctaccatgttgtcaacttgtatttcagaatttttctctttattattttagcaattccatgatgcagctgatattctatttgtcttacatcatttaccttttctacactccctaagctgtttcatttctcatacaagcttctgtttctattttaacaaatacacagttgttcatattaagttttgataagttatatttttgcaatctcagtattgatgtattcctgtcatagcagtgcccatcatggtgaggaagaagagaactggccctggtggctctggagaaacttctggagagtcttcaggagcctctggacaaggttcctcacagcagcctgagcgaactcaacaacctgggggaggacgtggctgggtgcctcaacagggtggcc

SEQ ID NO: 2236 - DNA, 88 bp, Zea mays
tggtaggctggagcccgcgcgacagcgatccctgcagttggaacggcgtgcgctgcgttgatggcagagctgtaacgttgtgagttgg

SEQ ID NO: 2237 - DNA, 630 bp, Zea mays
acgacactggcaagtggcatgagcggagccccaccaaacaactgcgacgtgtccgggcacgtgatccctgctgtgcttgcagggcaccattttttcagcgtgattattattgctagtactattaccagcagtacagaaacagctgctggtggctggtggcactggcagtcataaacaagagattagagacggcttcctgcactattacctgtaccacacgtttaacacaataggcagaaaatgataatgggatgacggttcgccgttggcatttgtattcaaggttgacagacacacacaccaggcgcggtatccactggtggtgttggtcttcgtcgccgtcaaggtcgtagcactcgcgtttcacatgacggcctggtgcgaccgcgaccgccttgagacacccgcgttctgtgccatttccgccccttcaccgtaccatttcgtcccgattccgcggataaatgcttgcccctatttgctcagcccgctctcggacgaacccattcacccgtccggccgtccgtgcgcggcgcacccacccggcaccggcaccagcatcaccgcccgcccggcgcccgtcacgctcgagaggaggaggaagaagaagggactgggcgacagcgcgcg

SEQ ID NO: 2238 - DNA, 1500 bp, Zea mays
cctagatctcgtcgtagtagtcctccttcgggggcacctgctcttcacctgtgtgtgtgtgggggggcattgcaagggggagctcacagatgttcatcgctgagcaagtgtgggaaataatgtgcatgagctcactaacgctgggggctcatatgtagtgtaaggttgaacaaataatggttaaggatgagcattgcttttaataagtttgtcaaaaatttattagcagttactaagtataagtgtataccatctcaataacgtaagagatcacaattgataataattcccacaatgcaatgcacatgacagactaagtttaattcaataagttaatcatgcgagagtcctgaggtgctcatgaccgtgagcacgactgatatatcagttttacactctatagatgtagtatcctttacccacaagtcgtcttcccttttcgcccggggttgtacggaccctcagacacttccaaggtgagttgacgagtgtacactacgagacctttataaagttccactggcatgagagaacacactacggttctgtcagaagggggcaatatgaatttcttgtgcgaaaagctatcacaaacaaatcgacccaagaacctccctataacgacagctcgtcacacccgcggttgcccttttcgggaaaggattaacccatgctagctttcctaattaattagccaagatcgtatcataccacccttgtggtaacattgttgtttcatgttaagctctatgttccaattaacaaaatgatcttatcatgaacaataaagaatccattgacaataataatagaacatgatcataattcatatataacattaatctcaaaaccaggtagatcaatagcaagactacccaatagttcatttgtttgcaaggtgtagggtaaacaaaactaggtaacctattatatcccatcagcttaacctaataatgtcataatgattatcaagatcattattaggtcaaagaaagtggtcaaagacataatttgccttttacttgtaatttcatgtacatcttcaagtatggcttcagattcttcgtgaccttgcttctacttatagaaatacatacaaataaacaaataatggatatgataacattataccaaaacatgagaacaaactatacaatatattatacattcttttcattttactctttcactatgaagacatgaattttaagcctcagaagaattttgcctaagttacacaaaatataattttggggtgtttgtatttggtccaaaaaagtgctaatattttggaacaggacctaccttacatagccgaatacattaatcaatgaaacacaaatagtagagcgggtgctcactcaccagatcggtgatctgacggcgtggacccgatgctgatcgaatgacccaaagagacggattgcaggcctgttccaccgcgcggcctcgatttccccttaacacaacacagaggaagcaggcggcggcgatcgggcg

SEQ ID NO: 2239 - DNA, 1247 bp, Zea mays
atttcctgcctgccacatctcagttccagggccctgctgctaacccaggatgtttctaggcatgtatgtaaaaaaaaaaacaagcgtattgtgtagccaatagtctgtactctgtagtcacattaattttgtcatgcttgtatcctattgctagacggccgatgtgctaacctagtgctgttgactcaaattttatgcgtaatctaaaaaaaattatttcttttcgtggatctctagcataccttcaaactgatgcacgggagtggaaggattcgcttcaacaatcgttagggcatgtacaactctaaatctttgaatcggtttttcaaggaaaaagagactagactataagatacaaccttgatatcttagattataaatgcagttaagatacaatatgtagagagttgtgtagtatgtctcttaatttttttttcatttagttactaaagaccctcaaaaatcactcctttaattagatggaacaattggatctataccattaaaagatccaaaccttagatatataccatggaccccacatgtcattgactcatgtggacccacatgtaagtgagatagtaatggtatggatccaaagtggtgatcttttaatggtatggatccaaatttccctatcttaaatcctgtagtgaaaattaaatagaagatgatttaatatacctttgatacagacgcaacgaaaaatgacaaaatgaacacatcatcagcgggttcgatatggggctcacaccagtcttccacagttccaccgcccgcagccagagccgaccaggtcactcgcgtcacatctgtgtcggtgctgggcgcgctccccgccggggacggacggttggtgcaactggaaagcgaggcgttttgttttctcccgtgctccccctcccggggaaggggcaacgagaaatcgaacccacacgcaacgcgacgcctccacccgctcgcctagtccagaatccagatccagcgcccgcatctctctctctcgcgcgcgcgcgcgagcgcgatgagctgccgcgacgggcgatcgtgctagcggtaacagcgagcggtgcgcgagggcggcggaggcgggagggcggatccggtgggcggcaaatctggcaggcgccgcggtggggctgcgggcgcgggggagggcggggggctgggcggacggcgcggagggcggggagggaggggaggactgcggcaggctcaggccctggcgcaggaggctgctcgcgtcc

SEQ ID NO: 2240 - DNA, 616 bp, Zea mays
cggagcacatgtgcagcttcgagccatactggacgctgcactgaaagttttggcattcatatagtaaacgtccgtggtcgacaggcacccacggccttgaacatagcgatgaacgtcatggatcgacgaagctgattgagtcagttacaccgaagtcgatcgacaaaggctatctacaacgacatcaaatcgcacaggaagacgtgatgaatagcaggtagagagagagggtaaaagatgtagcagattggttttttgatgattgaaagagtcgaccgtgttcatctgatatacgtagaggtggtggtcttatctgagcttccacatgctgcgatcgatttgttggtccccatcttgctctcccacacaggaatactattaaccatgttcaggcaagaaagtgatgcggtcgtgcacggcacatgccagctttgtgggagccgcccctaaccctcgctgaatcagtcagtagtgccaacttgctagagttttttttcttcttgttttggttcactcgacagatttttgtttggatgagatcgctgcaacattgttcttgatccacacttgcctgatcttaccgtctcgttcgtgttcgtgccagcaaccagcgaaa

SEQ ID NO: 2241 - DNA, 121 bp, Zea mays
cataccgccgaaccaaatccaacgtccacagaaaagaaaacacattcccgtcgactcccctagtttcatcctattcatttctccccccaaacactccagctactagttactcgaggaatcc

SEQ ID NO: 2242 - DNA, 797 bp, Zea mays
accaagcctccggcgacgggtatccgcttcgcttgtcaacacaaactcttatacagaatttggatcaccaactcaacagtaaacgagacacgataacagtgataacaatgtaatgtcaatcatctctgttattttgttgtcttttgtgaatttgattttagccttttctcgcttgttcgatacgttggatgggaagtaatatgcaacagatttctcaccaactattgctacctggatgatgttggagcaacgcatggttctagcacgtgaaaggtgaaatatttgacgaaattgatttgctaaagtacgggcaaccttctcggtagttcgcactaacaagaaagaaagcgagagttcttgaaggaaacatgcgcactgaattttctatagccaaaaccactgtccaatacctacagcgcttccttgctttctgttacattgttgaacaaaaactaccaaccccgcagttagattagtcactactagtacgtccactgaagtgagggaacattgcctattcttgttgggcagaatgggcaagaagtatgaacaagagcaacgcgttctatttgtcctcgatgaattcaaaatcttgcgagacatgggcacagaggaaagcctctcaacacggctcgcgtgcagaggatatatatacacaagggcgccaaatacatttcccaactccaacaagaacagcgccatttcttaatcgcagcgcctaaacccagcccctcctaattatatcaccgcacagctgctagcaccaggtgcgatttacaggcttaaaacgcaccggc

SEQ ID NO: 2243 - DNA, 1500 bp, Zea mays
ttaatttcggatatccaacgggtaacccgcgggtgaggtttaatattcaaatccatgcccactttacatcggatcggatacaggtctaacccgcgggtcaaaaaacatatccatatccggatccgtcgaatcgaatatccgacggatattaaatccacggattaaattgtcatcgacagaggacggtgatgccgtggtgtattttttccggcccatcaacagccctttccggcccacaaggtatccggaaaacaagccgattcatgaaccaatcatgcccccatcattaatccacgctgtctctggattccggagtcattctacgacgcctgcctctgcagactgcagtccgagtccaggggagccgcgtccggtccgcgggttgccttctcttgcttacttgctagctcctcgtcgcagtagcggcagcggacgagcagtcgagcgcaacgccgccaatcattccttcctctgccttcctctctccctccccctcccggcgccatctcgacgctcggccccccgcgggcgggatccgtcgccacagatccgctgcctcctccccgaggcctgcctgaccgcccctcatgctcgggtagcgcttttcagtttcccccgttccccgtgggccactcgacccgccgacggagcggaagggcggccccggccgtgaccgcggcgcgactcgcgaccctcccagtcccagaagcggcgtgcggcgaccgggaccggctgctggtggtgaattcgcgccggcgaactgaattcaagcggcgaatcccctcctctggtcctgtctcgagccctcggcgtccgcgcctcctccgtctcgccgccgttctcgacgcccgccgatccaacaccgggtctgcccaacagcccaaggtatggtggcaaggtgcaacgtgcaaaccctagcttgctggttgctattgtgctctactggacagcacgggttgggctaggagttatgcaattttttcctgttgtaattgatgattcatttgctaattgttgatttatttcatattttctttgtagaattatttgggtatgaagaggaacacagacattgcaagttttgaattttattttttcgcgttcaatatgttacgggttcttctaaatacattactgcatttttagctgtcttatacttgtatgcatgctggattgttctttggattatatccatttatctattggagcactggtttggcgtaccctaggtcctgctatggagccataagttaaagtcctgctatagccacagccaatgtatttttttttggtgttattcattttatggatcatagtaccacttggttcattcaatttccttttgttcattgtggatatggacatgaatctctgttttgctctttgaattcgaagcaactgcaactgttgcttcaagtctgtgtgtcttgcaatcatatatcaacatgccacctatgttaacgtagcaccttttaacttgtttgcagtgtttcactagtg

SEQ ID NO: 2244 - DNA, 1452 bp, Zea mays
acttatttatattgtttccaatttttttaaagtctagctggatttaaaaacttatcttcttagctttccatgcgtaaatggagtcattatgtgtcctatgcattaattccaatgtagtctagtcatggagtttgaagtagaatcaaagtcgaattgagtttgtactactctcacgtgatgcagacgtactagctagtcctcttcaactctccaacctttttcaagtccttattgatacactctaaggtttctaatcaataaaacatacgctctatcaatcataaggttagaaaaataattgactagataagaacatacctaaagattcatgacatgcttgcgcttttataactaggtcttgtaatatataaaaggtgatgacctcgttatcctctccttatagcgagttttctaaccactcgtccctgttcccttcaacaactcattcccaactatcaatgtttctgatcgctcttctcacttaccctacctcctatcatctgaggacatctccagcggagcatggaaatggacttgtattgtagactatattattaatatagagtagagtttgaaacaggaaataagatagagggtagagtaaggaggctggtggagatagtcggaatgtggcttgtttagtatctgtgtgtgactgctccataaatttcactgtggatctcgatccgacttctttcttccaaccgtatcttgtttagagtctgttcgtgactgctccacaaaatttactatgaagatgaagttcttggagcattccttcggatactctcgtacctctatttctagcataattcacgtgtttagcaaaaaaaaaggagcaaaggtaacaaaaatgtagagtagaggcgtcctaaatatggtattagtaaaggaagagatgggatgacgagtagattttttgtgtcattgtttgttggaatgaatttgagagctctaatatttgagagctgctgctgtagtaaaataaataaaatggtagtgcattacaaaagggccaagagtcagctgcaccggcctggcccactagaaactcgccccgcgagatggcgcagctgtcaccctctttggtttctgcgttgcgctttcggcgagtttcgtctagaaatcccgtcgggccctcggccgctttcctcctcccccgatccaatctgtcgtccagacatcagcgaaatgacgacctgcttgccgtctgccgctctgagaactccaatttggacgcgccgtttgaccgaatactgatctccgcattccaacgctcaaacaccacccgggcggctgcgcccccaactccccccgtccgcccaacgcccatcccccaaaaggctccgatctgattccgagccccgccaggcgccagccttctcccgccgcgtcgcacgtgcgccccaccccatactcacgctcgagccgcgatcccatccgggggttccg

SEQ ID NO: 2245 - DNA, 345 bp, Zea mays
tagtatacatgaatataaattataaatatatacactattttttgtaaaataaaaaatataatcacaccatcagaccagctcaaacactattaaattggcttattaaattgtccaatcaacccaccaaatacgggttatttgaacatttgtaccttaaacccacaataaacccaccgagccaaacccccaaccaccctcgcaaacaacgcaagaagcacggactcgggcactcggctcacggcggagcaaaccctctcggcctctcctcctgagtcctgcctccgtccctcatatattaaccgcaattttgtcttcgcttccgtcgccagattcctccgcaccgcc

SEQ ID NO: 2246 - DNA, 575 bp, Zea mays
cactgattgtactatttggttgagattacaaattttaggtaacgaatcttgttcatgatgctgaaccaaacaaaccttaaaacaaatatcaattatagaattttcagagtatgatattttggtaacatgaataacaataatatagaaaatctagggaattcatatatgtttagaaatctattgtaccgttgcatctgtttggttggagttctaaatttttaactgcaaatttggttcagaaagataaaccgaacatacctcaaatattacaatttctaacagaaatatattctcatggagataaattcctcaacgtgccggagatgagagaaaatactctcacgtgaccctcgcggcctcgcgcgaacagtgatccgaaccggaatttccgttgccatctctacccggggccggggctacggactcggagtcacgattcagaatataacccaaccggctcgtccctcgcttctcacctcaccccgtccggactgcggacctaacgcgcgagcacgaagccctagtttgcgccgccgccgccgatacatccggcctctcctcgcccgccggccgcg

SEQ ID NO: 2247 - DNA, 380 bp, Zea mays
tcggtacccctgcaactgttgcatttcacaacataattagagggcaaaatggagacgaaagatggcttgacaaccaaccagattacatctctccaagtcaatatgttgatgttccagagggagatatcaactatctcaatgacatagaatcaagtgatagaagtgctctaagagatcagatcgcacttcagatgtgggctgcctacaatagctagatgttataataggatgcctacaatagctagatgtgggctgcctactattattacttatgaagtctttatggtttgtagtttgtcatgtaggtagttgccaagttatgaacttaaagtttcttagttatgtactattatttccacaatttcagttttgaataaagg

SEQ ID NO: 2248 - DNA, 499 bp, Zea mays
ggtgagcgagggctcagctatactactacttgtacttggtagagacacgatgtacttccatgcaaatgttctgattgttacgacgactaatataacatgaaaaaggtagcaaaattcttccggatagtagctagattttccagctgtgtgacattggcaaacaaataaaataaaaggctaagtacagttctgaatcctgagggcatgtatagtggtgtttaatgtggaggctcttaaggtgtttaaggggtgtatttgtaaaaaaatcttagagccgtctctccgtgaagagacgcctctggctcgtaaaccaagtagtaatagacgcctcacttcctactgtacgaatttgtcgtctgttatatcgatctgctgctgtacaaatgcatttaattctgtatttattagtagactacatttatagacactccattgtataatagagtctcttagttgtctcttgtgcttggagaaccgttttggtgtctctccactgtac

SEQ ID NO: 2249 - DNA, 121 bp, Zea mays
tggggatgtaaaacaatcatgtcctgctatacacaacccgaatagagaaacatgtcagatgaagatgcacagccagtgctagctgctatcacattctttgcatgtctacttcttttgaaag

SEQ ID NO: 2250 - DNA, 143 bp, Zea mays
ggttcttccatccatccgtcagcgatctgaagagatgcatggcaaggcagcgtggcagtgatatacatcctttttgtttggtgtgacgaattaagcaggccctgttcaacgcgccggcggggagcgatccggtggccctggac

SEQ ID NO: 2251 - DNA, 701 bp, Zea mays
taaaaggatagcatcctactcaaagttataaattagtgtgcaatatagagataggaagtaaatgcaaggttaaaggttgtgagttcaagttcaagaaacttgcattgtttattttacttttgtaacatggtataatgtctcacggtccgtaggcagtcgtcagacatacgagcaccttatgttcgacgatccgcatgccgaccgtcggatataattatattatgttcgatggtttatatgcgagtctttggacataacatctgtggcctatggggtgcattggacgctgtcacggtcgttaccggatttaattaccgacggctcctggaggtcatagaaaataatttatgtctggcagcagaaataaattatatccgacgatatataaattatctacgacgggcttagagcatcggaaattcttgtttttgtggaggcgatatttcttcgtcaatgacgaggaaatgcagagctaggaggcgtcgtcgtatatcatcatcgaggtcaattgaaccaatccctctggttggaacctcacataatccgaccggaaggagtgtgtatatatatacatcctcgccctgcttccagtagctcacaacaatcctattagttgcttcgtggttcatgcacctcgatcgatcgaacttgtctgttagtcgggttctgtgcttccacatccagcagaggaacgacggacg

SEQ ID NO: 2252 - DNA, 729 bp, Zea mays
gctgagtgtcttcctgtgccgagagtcctgctctcggtaaacgtagtcgttatcgagagtggaactttaccgaatgtggcatctggcaaagagccgaattccagtaatacatcatcctattccttatccaccgtcaacgttttctttcacgttgtcatggttacggtcgacacctcccttccgcataatgcatggtagccttagccagagctagcatatagtaataacctagtgataacttgagctacgaagaccaagaaagacttttctcgccttgccctagcggtcccctgccactgccagcaaccgtgagagcgatgtggaaagggctctagcctgtaggccgtgcgtagctgaaggtggtggccccactggaaatcccgtcggagccaatcacaagcgcctgccccgcatcctgcgctacccttcgaccaatcacgttgcagataagacccgcaggtagtggtgcccttgcgcgacaccaaaagtgcaagcaaagtgcagccggcggggcccagaaagcgcgcaagatgggcccatcttctccttcggttctataaaaccgagcaccgcgatattttcagcacattttttccctaacatctacagtacatacaaaaactcagagtgtacgtcggcacatgtggatactataggtcccatcctactacattcagcgtagaagaagccatcactgagtagcacgccggcacaccgctttgaagggaa

SEQ ID NO: 2253 - DNA, 1500 bp, Zea mays
gatgggcgcgaagacgaaatctggatatgctcggcatgtgctgctgctacacaatcggaaccattccagggaagcttcttgctaattatttggatattcgacgaactgccgtcgctgctccggttcaatgaaaaagatatatagtatactccaagggagtgtagtacaacgatgctggacgcggtgtcatatgagcggaggatgcagagcagtacaagttgtactgatcttgcagggatggcgaattagtcctctggaccatgcccatgcatcatgctgaatcgcatcgcatctcgtcaaagggaaaaaagaagaagaaagaaacatgattgagcaagtgcgtgctggacattcgcatggatcttctccagcttgttacactgatctctctctctctctctctctctctctctctcatgccgccgggctattggggctcccaagggccgtttgcccgcctcatcccgagctcctgatcgttttctgtttttttcttcttctttttgcaccgcaataacgcaattgcagagcagtcaatttgttatcttgagctgcattcccagagtgaggccggccggccggactgaggcttctcgaccagaaaagccggcggcctttcgtcgcgtaacagacatgctgcacgaccagtctcgatcagaataaagcgccatggattccagtagcttgcttttgttggcacgtcgtagatgtatatatctttccgtttggtctctccggctgactgaccggcccttgctttaccgccgcggcgaaagggcggcgcatgtcctgccggatatgccgtttccggcatggtataagtaggcgacgcccaccgttcctcctatcaccaccatcccccgatccgacccaaaacggcaggcatgcatacgtgcactaaagcaagtagtaacgatgtatctattccatccttgatcatgcatgtgtttgtggagtgtggaggtccattgcagggcaaccccccgttggcaggtgcgacggcgacgtacccctaccctgccaaaggggatttgcccggcgatgcgcctgcacacacagtggttctttctactctacctctccggctcaaggtaggagaagacgatgctccatccggctggccggttacatccggcctttcttcagcccatcggataggagcccaatatctgatcgactgatccgtcttggattggacaaaagccctaaagcccaccacaggatcctcaacagcctaaataggcccatgaaaagcctctcacagctccgagctagacccccacctccccgcctagacctagggttgcttccttccttttaacctcgcgccgccatccgacgcccatctgctccaccctccacccagccgccgccgccgccgcctaaggagaagagggtccggccgtctccttgccccgatggtacactcccgcttccgtccccgtgttcccattcccatcttctcgtcctcctcttcctctccatcctccttcctgtgac

SEQ ID NO: 2254 - DNA, 1500 bp, Zea mays
tggcctgcccatgacaacggctaggcgccgggattcagaaatgcggatcgcggactagctagcgcccgccaggccaggcgtgatcctgtccccacgcgcctgcccgattccctcacgaaatctcatgaatggggggaacaaaattaaaacttggtagacaagcagaacaatgctgccgtcacggagcatacaaaggccccaaactcaggtggagcggcggaggtcccggcccggcagacagaaccgctccccggaatcgagagccgaagccagagaaagcttagaaacaagttcaaatccagcgggcgttagtaatccgcggcctagcagagagagagagagagagagagagagagagagagagagagagagagagagagagatccggcggaagcttccgttccgcggcgcagggctccaggctcctccacacataacataacacgagatagagagagagaaggcaagggagtggcgagaagcgaagagcagcggctcaccgtctccgcgtgggccggcttcagtcaccagcagcagaccacaccgagtcgccaaccgcagcgcgatccaatgcgggagcgagcagcagggcggcggcgcgggaggcgacgacgacgcccgcgaccggccggcgtgctccgggtcgcggcctgcctttggctgggggtctgcaacgccccgtgcggcgtgcggaggggagggagatcgtggtgggcgagcgggcgagtggttgctctcctctgcgctctgcttaaatccaaccgacgtcaggaaggcgagtgtgcgtctactgctgtctgggtgtatgtgtgtgcgcgcttttcttttcttctttttgggctcgggaattggccggatccggtcaccgcgtggtgaggtgcacgccggcaagtgggccttcctgtttgtttgtttttttgtttgaccyttttgattggcattgtccgaaattcatttctatatatgcattctttttagtttgggaacgtatcatatgcttatagagctcttgtgctcatatgagcactttaaatcttgtaccttcatttcttatcaagtgtgaatagacatttcctagtttcttctgtgtgccacccttgttgcgccgcgccgcctgtctcttctgtgtgccgctgctgccctcaccccctggatgagaaatgaaggcaccagatttaaagtgctcatatgagcacaagagctccatgaacacaggatacattcccttgagggaaagcctccttgcgctgattggcgaacgagatgagtctcggtgccaagccaccgaggcctcctcccaagctgactcacttgcaaaggatctagaggccgagcgatctgaggcccaaggcctgaaggcccaaatgggaggtacgcgttgttaccttcgctttgtctatatggtttttgtcgggccctgcttagtgtcttggttatcctccagagctccggtgggatttggacacctccatcgagacctcctagacgcgttcccaggcc

SEQ ID NO: 2255 - DNA, 1500 bp, Zea mays
acgcccgctggatttgaacttgtttctaagctttctctggcttcggctctcgattccggggagcggttctgtctgccgggccgggacctccgccgctccacctgagtttggggcctttgtatgctccgtgacggcagcattgttctgcttgtctaccaagttttaattttgttccccccattcatgagatttcgtgagggaatcgggcaggcgcgtggggacaggatcacgcctggcctggcgggcgctagctagtccgcgatccgcatttctgaatcccggcgcctagccgttgtcatgggcaggccaggtgcgtcggtgcttggttactgcttccggattcgttgccctgctattcccttctccggatccgctcccgcacgaccggcgaggtggttgcggatttattattagagtttcgtggcggcggtttggttggattggtccgcatttatgaaggaatgttctcccccttttaagctgttcgtgtgctcggagtattgaattgcctgttcctggccactacgggagggaggccctgggccaggcggccagcctacccccgctctgggttttgtgattggccatttccggcagctgttaccgtttcttgatttgtgtcatggagtggggaaaaggtttttggttcgcgagtggctcctgatgcatgtttggcaacctttccatgatgctgctactgtctttaccttgagtagagtgcagttcggtggtgcgtttccctatttatgtggtaatttagtcgttttatagttctctctaggtaaccgtcttgtaccgattctgattggtactcgtgttcaaggtaagcttttgagttgtcatgtctgagataagcttttgagttcaacgatcttgccattcattaactaccaccaaatttagtagggctgtttggatcaccaaagtgcagcttaaccttgatcaactacctaaaatagatgggatcccaataaaactctttaccggtcctgtccattggcagtcggcactttgatttcaatttcacatcacagagttaggtcctgtttggaattcacatcatagagttcagctggccaaattagctggctaaagtttagctgggttggatccatacagggccctaaaggttctaatggaagcgagagcaagcttgatctgagttcagataggttacyttcacgattaataaccacacttttaatgtgtgcatttcacttctttactttttagtgtgcccatcgccaatcttcttaactgattgggttggaagttggtcacatttttatttaatgaaggtttctccttttagcatgagcacttttctgggcctcctgtttcttctgaatcctgatccgagtgtcatcagtgttgtatttattttaacatgcttgcttttggaagcctgatcatttttgcagaagttgctagaacaacttaaccatctgtgcttattatttctccaggcatcaagtttctaacaatttgaagtatcccgaa

SEQ ID NO: 2256 - DNA, 1367 bp, Zea mays
attgtaatatttagtattgcggctatattttaccccgtggattttgcataacatagtgatgattgtcatttcatatctatgttttatattactaattttttactctcgtggcaacgcacgggcacgtacctagttcatatttaagatctttgtgagttgctacctagtacccaaaaacaatccatgatatctatatgtaacctatatatagatatgtaggcacaatatccttagaaagcagcatgaataaaagttggtttcgtaccattatgacataatacttctgacagtttagcagttttgaacttttatgttaagacttcaaggcgagaggccgaacgctctggggcataatttaaagtttgtttaatgatggatctaatggtaagtatggtaggtatagatatatttttttgtcatacaaacttcatcggagtacaaatatacttgagatatgaatcaatttacatatagttatttttcatgagtaaataactatatratatatatatatataagtagttatttttaatttaattaaatattaaagtacttataatatatgtcttcgtatatgttgataatattttggttaatcacaggacgggacgcagcacgcacggagtagagctgtcttgcccgttgagaagtggacgagcctagaatagggaaacggatcgggttcgtacgtaatcagatccggacattatcaatttttagttcgttttcgaatgcgcataccactgtatgcgccatatgtcctgcaagccgatggcggacgcacacgtgaccattggacaagtgaggcagtgactgaaggtctgcaacgcaaacagccaacaccaccgagcccagtggtcgcgattactgttttaacacgtactggtcgaacaaacaaacactcctgagcgaaatcagaagcaacaacttgtttgctgtccaatatatgtacgtactctctggtctcttatggtcttgttcggatggcatggtcgacactggatttgcattttagactcttctcccttgtattgtattgtattgtatgtggatggtggtggacgtctactcacgggtggcatgaagagtcatccaaagcaggagactggagacgggtcaaagctttttttgggcatccagatccagactcagagaaacagggcttcaaacagcactgataaaaaaaattgtccaggaaagagaaatgattgaccagtggaacctacatgtcaccctcgccgaaatgaagcagcactcctccagaacatcgctccaccatttagagacagagaccaaagtggccatcgcaccatgtcggccgccgaaactgctgtttctccgacgacgccgctgcagccgcagctgca

SEQ ID NO: 2257 - DNA, 923 bp, Zea mays
gctacttaatagcataatagccctctaagagagtagccatttaacttgctaagctatctgacgctctaaattwactcattcactagctaaatttggctagcaactctcgctagccaagctaaattgcattttggagagtctgttggaatgaaatgttatatatagagtttaatatttatggagagacaaataaagagtcaaatagagagtcaaaaataaagagtctcttcgagatgctctaactaatggctagctagattaccggttggatctattggagtctaaataagttatttattagcaactaaatattaacttaataaattcaaccacgatcaatttttttttacacgaactgttgaggagcacaatgaattcaatcagtaccagaacttttttacatgaactgttgaggttgaagggtggttttccttttgtatttttttggaacgtttttttttttgcattatgtaccattatgtttacatttcatatttaaaattatagagacaataatagtgacgaatataacgtgcagaatgaataaaaagtgagaaaagattacccacaaatctgacatcaaaacgcaacagtctgtgcttggacacgtcgtggcaagttactaacaccaatggcgtgccgccacgttgacaggtagcccgcgtggacaagccacggtagcaccaccgtatcacctttcggctttggcgcaccacaccaggcaccaccatcgtacatcaacggcttggataagccaacgtggcaacacaataaaacaacaaaagagttctcgtgattagagaagctcagagaacaaaagaacagctcgccgcggctccgaatggcaacttccccgaaccccgcgacgattcaccgagccggcgcccagtgacccttccagaagcttccagaaggtcaccgcc

SEQ ID NO: 2258 - DNA, 275 bp, Zea mays
aaagatgatgcgctctcctctgcctcaccattaaggtaaggaattacattgaccctgcctccgaattgagacctgaagatggtggttacacgaccattagcgagtccattgccaacatccctgacgacaacaccaaatgctacgtccttaccctcaaacctggtgttgtgttccgcgagaagctgttactcggtagaagcaagccattcctcaccataatatccgaggaccccatgaacccagctattatcgtctagaatgacactgccaccacc

SEQ ID NO: 2259 - DNA, 1221 bp, Zea mays
gttgttgttgcctgtgagctataaaaaaagcttatatggggtgtgatctattaaaaagttaaaaattatttggtggaatctctaaagccgctaaaagttcttacatttatattttctcagtttattcaaaagctactaaaagtaggtctagaggtgctttcatgtttgtcctacgaaaaagtcgtgttttagggctagattgggaaccctatttttcaaaaaaaaatttattttctaaaaaaaacagttcattttcgtttgtggaaatgaatccttaaaaatgttaatttctggttgcagtcctttagtttatttttggtttttaaaggacaaaaaccaaagaaaaagccaaaccaaacactcaattcggtctctaaaagcaaaaccgatccgcaccgcacaaaattgttgcagtcctcgctaaaagcataaaaaaggattccgattcgctattccgtaccgtgtagtagcattcagcaccgattctagcgtagtctacgagccaggccggcgtcccccaaaatcaccggcaggttttcctcggttcccgttacgtatgtggacacctgaactcaacgcaaagaccacgaactgccgtcagagaagacgctagtaaaccgcccgccgccccaactcacgaatcggcaccgccacccaacggggctggtagagtactactagtagtatccattcatacgcgcgtggccggtaggcgctgtaaccactttcttcttctcttccagaaggcccagccctccaccctccgggcaccagtgcgtgcgccgtcgacttcctctcaccttctcgctcctcgagaacgactccatagcgcaccacaccagcgcggcgacagacagcccgcgaggagaaaaggtagaagaggaggggcagggagagccatacatactcaccggttggattcggtccaatccaatccagccggccgcggcgtgaccagccgatccagagggcgccgaatcgatctgcgggggcggcgcggcgatgcggagggctaccgctggggatcccggtcgccgcgggggatgcgcatgagggcgtccggcccgcgaatcttctggtttggcgggagcccagggggcgcgcaccccggatcggcggcgcgcggcgcgggcaggatcgtgtcggtggggctgcggcagtgaccgcgggcgcgggggagggtgagaagcggcaactagcacttcgagtcgagcgggcgcg

SEQ ID NO: 2260 - DNA, 260 bp, Zea mays
tttggtggcgccagaattagtctggaagcaggttggattcttggaactctttggattgaggcgaacggtttccttcatctccttgctcctcgcccatttttttagacaatgaaatccttgtggttcttgtagggtggagtgctgtctgcgcagaaatctgctcaccgggtgccaggaaacaggtggctgtagagaattgcttggggattcgtcaagaaacgacccagtaggtggttgtgcacttgttatgctgagactga

SEQ ID NO: 2261 - DNA, 1500 bp, Zea mays
ttcaaggttttaatgctattagatgtcacatgcctgtgttgttgtggcatgctttaactaggtgccactatcttttgggtggccagcaaacaccaaatattgtcacctccctctttctgtcacatatatgccatttctctctagccaagttgtcctattcctgttccatattttgtgcaatcctatctcctctaccccgaccttagttgcagaatgaatggggcaatgctattaagacatgcctatttacttctcgctccttcctctatcctagaaccatacaacacataatagattaaataccggagagaagtgaacccgagaaatatgattgtactttaaaaaaatcaaaatgctggactttttgagtagacatcaccaattctctttttataaaaaaataaagtaggtcccaccgggattcgaacccaggttgccagattcaaagtctggagtgataaccactacaccatggaacccgtttatgtcataatgtggacaattaattattaaaccccagcatatggaaccaaatccatttcccactacctcgaaagtcgaaaccatttggtctagtcagaacaccgaagtatccaacgaatccattgtaattttgttgcacccgaaatggcgccgctacggaataagcggcctttatgcttggcgcgagagttcttccttcaaaatcgatcttcaacgttcaaattcaaaatgctacccccgtccattgtaaattgtatgtgttcagtattttatatataatgtttatgtttacagaaaaattaaaacgatatataatctggaatggagagagtagcaacatccaatccaatccatcgacccgaccgagagaaacgggagggcacgctgctatcagctacctgctccatagtgtcgcaaactcacagtcacagcagtcatcacatgcctcaaggctggaagggcagaacacttttttcttgacgcgtgtatctcagcgaccggcgccatcagtttgttttcgttccacgcccccacgcccaatgcgcccccaccgtccaggtccagccgtacacgtgcgtccggccggggatcgcagcagccgcacgcactggctgctgggctcggacggcgctgcccctgccgcagcgcagccatagattggaattgcggcgacgtggcctcctggcagcccaccctgaacaggcgcaccctatcctccgcctcgccgctcgccaatggacacctccactagtccacttggcgccactccagcttcacgctgcccgcgtctgtgattcccattcataagagctggccacgcagcctcggagcaacagacccccgcccacgaccacacgcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacat

SEQ ID NO: 2262 - DNA, 454 bp, Zea mays
ggtgtgctgctgaggccgaacaatgagaagtctaagtctattgaatggggagaaaatccaagacataactattcactaaagctcattttgttcctaataactaatttgaagagaagataaatagccattcacatcatcttgataccatggtaacacaaggagtggtactaacgtttgaaaataagcactaaccgatgtacaggaaatcatgtgcacaatgaacatttcataagcagtataatgggaaaattattgagaaatggtttattgtttaagcaaaacaagtacaagtcagcatgttgtgttgtgcgcactccacgccgtggtccacgtcgcgaagtcggtcgggccgtgccgagaccttcctactcacgaggctcaccctgatggctgatcctcctccgctaccttgggtacgcatcaactccgctgctctcctggtgaagatgcatca

SEQ ID NO: 2263 - DNA, 1500 bp, Zea mays
ctacagatccccctgtcgcacatcaaatgattagcgtgacgacgaattcgctgccttttgaagaaaacaaagtgggtgggattaggtcctacaggtccactgagggacgggtgttgaactggtagtggtagttgcatcgcatgctggaccacaccgtcgtgctgcctcaacggtgcgtggtagagcgggcctgttcgtttatccagaattcctccaaattcgttctagctgataaagctggagtatataaattagacaagcaatttgcttaagattcgttggaacatgccctaagagaagaaaaaagaaagaaaagccatcggcaactccagaaaatgacagctcaagcgatccgacagtacagtctgcttcccttgatctttcatgacgctctcgggtggttcaacagaaacagattacccaccaacgaaaatgttctccataattgggttagacaatgcatgcgtgctgaaaataaaatcgagccgcctgcatgcctctaaaaaaaagaacttgacggcagcaggagtatgtgtagcgccgagacttgtactgtataagtctatatagttctaaaacaaaacaaaagtagttattatatatatttgtgcccagtccaaagttataacacggttattgagagccgattctttttaatatactcgatagtttcagctttaaatttcatggagctaggctgggaacccgtgatgcctccctcagtggacctacattaacacgaaaacacgctgacctactcctccaaacatgccgatccactcctacaacctagattaccggaacgtccaataaaaatgaaaattttagttttgctaaggcaaaccgccttaattctaccagaaacaagtaaaaaagtatattaggatttttatagtacatatcgttaaatccgtaaatattgaatttggaggaattaagggcaggcgaaagagaatatatgccccccccccaaattaaaggaataaaatgggagggtatagtttaattaaaatatagtaaagagaaaaggcctcgggggaaaaaataaaaaggagagaagaaaagcgaaccgagcaagcaaaggcaaagccggaagcatttccctatattgattgatttatccaaagcagcagcggcaggagcactgcaccgtccagcacacaccagcattgtcctgaggcctgagcagcgctgcgccgcccaaccagaacgacgaagcggagccagcgccaacgaaccaactaaccaacggacggaagtggcgaggcaaggccgccgcgaagccgagcaatagcccccctcctctacccgttcctctcctgccttctcgggatctgcccgcccgccttgtgcccccgcggttggagctccggctgcacgacaccatgagcccccgcgcgtagaggctgggagagagggagcggggaacaaagttaggcaccaacaaagttaagtggggaggccagagctggccagctgggtcgctgttctaccagaggg

SEQ ID NO: 2264 - DNA, 203 bp, Zea mays; identical to SEQ ID NO: 1029

SEQ ID NO: 2265 - DNA, 389 bp, Zea mays
aaaggagtacacaggatgataaaagatgaaagaggaccaggtgatctgaaaaaacaaactggtccctgatgattaggacgtggtgcggtgaaacctgaaaggatactactgatgctgcactgcacacagcacagctgcacccgaaacgcacgcacgcacgcacgcgacaggcgacagcgccagcagaggcccgggcttacataaagggcagccactccggcgattcttcccccgaccgcttcttcgcaaacctccccctctcccatcgacttcctccgtcgtccgtcgcactgccacggatcaccctcttccttcgtcttcctccacaaaacctacagcgctggtgcgccgaggagctagctagctagcccggccggccggccggcgcc

SEQ ID NO: 2266 - DNA, 1500 bp, Zea mays
gatgaaagatagaaattgattttataaatttagatgctacatttttaatgtaaatttataacactctttacttgcttctctatagcataaatgtagtgtataactatctctctcgtgtggtttatgataatataaaatatattacatatataaatatattaacttaattagtctaaattataattattagaatgaaatttaaacccaacaaaacaacatacgtggtataaggatttcttttttcctagaaatcttttggaaaaatgatattcccaactaattcggcatattttcccccaccggtttgactagcctacatgagggaaatttccgtgagaaagaaaacaacaacgcgaccgaccctatggcctatgcagcacgtggtgagctgtagaattttcacggtatcctgcgccaggcaaccctagaaccgagaatacacacagtacaaagataccaacagcggcatgtgaccaataaaaaacagcgccacttgggtccctctgccccctgcaccaggatcaccggatccggtaatgttaacccctgggcaattggcgttgtcccgtgtcgtctcgccggttaaaaatgccgcgccggcagccaccgtcgtcgtcacgggtggcagcaagcgtcccactcccactccatccaccgaaaacgtctcgccaacgtgcctgccatactccacctccccacctaccctagccggccaatccaagccgtccaccccccacggctttccacgtcccgtcaatcccggccctccacgtgcgctcgccgcgtcccgcgtgtgcaccgcgccgctgtttttttagatttacgacacacgcagcggggcgccggggcgcgcattaacgccgctacgcgcacacgcacacgcaccaccaccatcactggccaaaccaccagcaccacctcaccgaggcgggcgcaggcagcgaggctggcaggcattcgcaaggcaaaccgaggcaccgacgcccaaaaataaactaggcgtccccacaaatcgctccaccttccttccctctcccctccccttctcgctccgcttgcgctagccccgagatccacgccgcctcctctccggcgcccccgccctcgcctacggcggctcacgctgcctcctggccatctctgcgcggccgcgaccgaccgccggttttgctaaccggtccagggagcactgggcaggaggaggaggaggtgggttccgtagaggcgcggtgccagcctgagcaagagggcgggcgggcggccgggcgccggtgacgttctcagcttcctgcaagctcgccgagttgccgggcggcgtcctgggcggggttgttggtggcgcagggaagcggggaggaggctcgccttgctcgtagctgcattggccgcgtgcgccgaggaggcggccgatttaatcccaggaggagcctccccagcttgtttcgcacgctcccggcgccctaggtgcttctcgctccgcttccgcttggtccatggtcc

SEQ ID NO: 2267 - DNA, 556 bp, Zea mays
cccaaattgatcttttctatgaaaagttatgtaggttaataccaaacgcatattaagaggctctgtataataaacctatattttttatattaagagaaaaagttatttttttattgttgttgtcatatctctctttaggtttacaccgttgcaagatcataaaagatctttagcatctttccgcggaatataatatgtacgataacgttgagtcaaggctaacacagacaacaaagttattaaggttagttctactaatcattatctaaataaactagctaacaataaatttgtatagtattttctaaattttatacggtcagctgatactcttgctgacactcgaagtttgaaatgagagagctcatggcgtgagcgaggggttgcaggcagcgctcgcctccgcccttctggtataaaagcctctcacgccgcacccacatttctcacatcacagtgcgggcggcgggcgccactctcacacctaccaggaaaccaatcaaaacttaaaaccaatcgaaattagaccggcgacgaggattagcgctcgccggcg

SEQ ID NO: 2268 - DNA, 1500 bp, Zea mays
cctccattcatatgatatatagaaaccgcagcaatacatgagcaactaactagtaaaatcttaaagttaatgtgtttgtgcatatctccttttattacgcatttatgtttctttataattttatattgtgaattgtaattaactaaaatcttctgactatattaagcaattatgatgttagggcctgtttgaaacaagttttttaaaacttggtatataaaagctaagatgattccaaatatatcagtttatgccctagtttataaaaactaaattatcagttttttaaaaaccaagaagctaaccttgcttagctaaaatcaatttatgaaaactaaggtggttccaaacaacattaatcagttttttgataaaccaaatttcagaaaatagagataaaaactagattcttaaaaccaatttacttccaaacagagccttaatattcgtgtaacgtccaaagtttgttaccttaatattgtactactgcaactgtgcgtccgctatccaccgtaaaaaccggctcgctttctgatatttataattcgtaataaataatccgacgccatcgtatgcaaacaccctatcctgtcacgatcggaaagcacgatcaaatgatgaatgtgttgctgcaacgatttcgtgtttgcatacgatttccgtccgctattcaaaagaagacggcgcctccgatttcgtgtgtgcctagcagcggaagaaagctacaccaacacagctcatgccacccggcgcaggcgggccccgcccccttcggtgcccacgagacctttccgcaccaatcccgcccgtctaattccaacgtcgcgcgaaattttttccactcgccaaactctccccttctcgctgtcaaaactggcccaccgatgccgtacgcgcctacgcccccataccacccgccaccgccaagtaggcccggcgccacacacgccaacctcgctttacaccaaacaccaggcagaaagggccaccgccatgtgggccccgcccatcacaccgcaatcacacgcacgggtcccctcttcctcacctttcggtctttcctacccgcacaccagaagcgaaggaaagcccacaactgactgaggcgcacaccatccccaccgccggcgcccgccccgcctcttcgccggcgacgagccgccgccgaggagctcagcgtggaggggcttcctcgcgtgtgggagaagctgccgttttttttcctgagcgggtcgtcgttgccgtgtgccgccgagattagagtttttcaaagggtgtctccttcgcggcactggcctcctcgagttagtttatttggagacagctcgaggctcgcttcggaagcgacccggtcgccgccgccgccgccgccatcggccgtctctccccgtagtcgccgtctcggggctggctgtggtgatgagctccgtcggatcctagggtttttgaattctgagtttctgacggcttcgtcgagctgcgcaaggcgtcaagaaggag

SEQ ID NO: 2269 - DNA, 496 bp, Zea mays
cctgccatgggcaaatccgcataaaaaaaaatcctccaaaaatataaaaatttgaaaaaaatagcggacgagttggattcggactgggggaggtaccaggaagtagtttggagcgaaattgtgagcgattttcccgaattttgtcggtcgttccggcttcgagttagggtttggagcggggagacgacgagcagacgcaggggagtaggagcggaggagtcagcgggatccgctgcggcaacagggtaggtggccctcgtgcggcagcgtccatcgtccgacgcgtgtactcgtgcggcctcagctggggccagacttgttcttctatgtttcactggcatgcggggtcaaggtggcccacctaccaggagccgcggattgaaaaaggaacagaagggagaaagaaaagcagtcgagcagcggtagccggtaggcgagagagtcaggattcaggacgcggcgaggccaccatgagcactctcaagttctgccggga

SEQ ID NO: 2270 - DNA, 1480 bp, Zea mays
tgtcgcaatataaatttatcattccagtaaattaatattgcgaggggctactattgggggccttcggcttccgaaggtcctcaaaaacatgatttaacaatgtttctggagtaaagtacatgaacaggtatcttcggactcggatcagagccacagtatgaaaaagcacaaaaaaacacgaaggttggcgcagagccgaagctgtgcgcaggagagcttcggagtaacggcggaaagggaaaccgacttaaagatgaaaaaccagattagaccttgaagaattatcatagagttattgataaatgtaaagggcattaatgtaattttgcatgagctgcgacccgtgcctataaataggtgaacagtattcccgtactgttcacgctgacttggcattcatttttgcgtcacgcctgtatttgctttccttcaagccgaaggtacatttgtaatttatctttatctacacaagtaatacaaataaaaatgtattaataataatgtttacagaaattatgttactttctgtattttgtttgaatgttctttattttttatcatgatcatgaaggtacgtctttcatgaccttcgtcctaaattcgttatatccgaggggaaataatgatttgaaggacgaagggctttcgatatttaacattttatgttgccttgttcttaattcatagcatttgagaacaagtcctcaacaggtacatcaatatcaaaacgacatattagcacacatgcagaaatcctatatcatgttaatcactctgcaaagccaatttcactcaaaaataatgtttcgtcacacacgatttcacattttcaaacttgagctaattgactccttgataaatatttctatttgcttatttaattttctacaaaaaaatgtggcacatgttggatgcgcacgtgcaactgaacagcctatttcagtaagactaagatggagccacactgatattgatgggcccacctcgtttaccttgaggcctcctcacagcctacccactaatataaaaactagtaagtatgctttgtcacctctgtgtatgtctatcgtgtctcactttctctctcatctcatctctctctctcataaaagtcttgtatcagttgttggtcaaaaggcgaggggggagaaggaaggagattttaggtgacatacaaacaaaaaggttgcagacttcctttaaggctttcgtttcgtgccaactatataaagagagagagagggcgcaaacagaaggcggttttgccattaatgagtggttttggatccttttgctggagatgtgcatagtgtgagcagagagagagagacgggtggaggatggtcagagccttcataagggcttcaggtggggctctgctggagacgacgaccgccgccgccgccgccaccaccatcgccaggcatctgagctcccccaaattctctgctggagcgcccctagcttcccaccgccgacg

SEQ ID NO: 2271 - DNA, 395 bp, Zea mays
tcttgtatgagtaatttgatgggtaatttttttaacgggtaatgaatatatgataatactagtggatagatatataccgttgccatctataaagcacgccgtgccgcgcgcgactcacgttgcgtcggctggcgcaggccacgatttcattggccgccaagcgtcccggagcgcgcctcgtgttgccttgtgcttatatagctgtccatgcacatctctctctgtagggcgctaatttcagccgtgttctcttctctctcgttcgagagatttatactacgtgtataaaaagcatcgtccaacagaggtacctttgctgcgcctctcgatctctagctatagcccgtagctagctagccctcccggcgaatcggccgatcagccggtcgggaacg

SEQ ID NO: 2272 - DNA, 407 bp, Zea mays
ctgtgtcactgtctttactgagtttagtatgacgtttatggagcagacttcctattgaaatggaagtgttggatcaatcccctaaaaaagactgaaattcacaccatcttgccacaagctcaaatttcctatgttgagtgaggattctccaaactgaatttcactgtgtgctttatttggagagtcagtactatgaatgtggtgacagcaagcagtggcctcttttacattagatgtcccctatgcagtttgattcctaacatgcaaatggtaggctatttacatgactgagaatataattttgattttttttgcagaatttaaagtgcaacgtgttgattctttttatatgtacttctgaatgcttggacctggtgtgactacatagcctggtattcatttcataa

SEQ ID NO: 2273 - DNA, 627 bp, Zea mays
ttgtttccccccattctgcttgctggacaggggacatatacaaaaacacgactttatgaaacacgcctgtgtgaccattttctattgatattaagacatttctttgtgctgccatttgtccctgtattgttattctattatgttgtgttatcttctgaacacgtggtcatggttgacaggtgctcggtctgcctagcagaatacgaaccggacgagaggcttcagaagatacctccctgtgggcataccttccacatcaactgtatcgaccactggctctccacaaacaccacctgccccctctgccgagtatcgctccttcccgcccccaaggcaaccagcaccggactggatctggaagcacagactgcggtagaagaggagtctccgaacgcacatcatcgccaggaggagggactcgttgatgccaacacaccacaggaaggtgaggcggccggaggtgacggatcaagtagcgtccaggttgaagaactgcacggcgatgcggccgagccattggcggtgacggtggtcgctgtcgctgygcctcaggctgacgctgaaggttcaccgagtacagcatgccaaactgttaaagggaagaaataaggatagcctagcccatcg

SEQ ID NO: 2274 - DNA, 1500 bp, Zea mays
ccgaaataaatacggtttaagctggtccaaaattcaaacggcttgggtctttttggccttgggccaatggtggcccgaaagtacaactatgaatgctgacaagtgataaacaccggaaatatcccctgtggaccacgcttccctcgtgcctttatactagcaggctagcagcacactgttatgttctctccggatgacgtagatattccattaccagcggggcccgccataattatacttctctgtggacccacccgcaagtgatcacgcaaacaaagaggggtacgcatagcagatgctcttgcccaggggcccactgtggcagtggcacacgtacggcggcgcaacggacacattggtagaaactctaacagcgatctcgcagtatgggcccacaacccagtgactcaccagtcgaaccgcattcacatgacccgccccggccccctcctcccgatgttgagcatcaattgctagtacgatttcttctctcctccaaaccggccaagccaccaaccagcgccccccaccgccgcctttttatttcatccacgctgctcgtgctcgctgcctgcttcttgcgcgatcgtctcggcctctcgggactctagagtggcggccggctctccgcctgttcttgtcgtcgctgctcctttccctggtatagtctctatcttggtagttcaaccggcgatgtggaatcttaagggattttctttttacctgctcctttttgtactgaaagatggacctggtgactttactgtacgctgtatctccttgtttttctttctggggggaggggggcatttaggtggttttggactttggtcatggtgcgatgaatgaggttttatgaagcaaatagatggagagctcaccgaggagttctgggcctgattctcccctggctggacaaatatattatcttgtttggtctgtttggcgacgaaccgccaaatcggtcagtgttggtccttgagtgctttgattattgaagggcgctgtttcggttaatgcttgtctactggaaatgttactgtttgaagcttcttctttttttttcctgctggggaatggatttggagctgtaaccggcttgtagcatatttaaacgtatgttgcagcaactaagttcaacagaaagttttgctagattatgtgcttcacagcttcagtagataatccaggtgtattaggttattgtcaagatttaggagaaggtgcagaactattccagtcaatcgattttaggaactgaggctactagtcgaaaaatgtctgaatatctagttccacttagttcttccagccaagtacaatgtctagcattttcttaaattcatatgtttgatcctgatccagtggcctttcttctcatgtgcccctgagccccttatggctgtattcgttctctccctttttcaatgttccagatatgatcgaccatattgtctaacatacattcatattttccagtgagcttaaaatatacacagg

SEQ ID NO: 2275 - DNA, 698 bp, Zea mays
acgcttttctttctcttcccgccgtgcgaacggagtaccacaaaacctaacgcgaggtatttgtatccgtatcttatgtcggttgggtcttatcatctgactcagttatatgtttacacacactaaattcaatttgttttgaaaaaaaaaatcatacgaacctgttcgctgcagtgcaggcactacagcagcagccgctgttttctacagtaacctgtgaggcggaactactctgtagttttttcggggggctccggattgctgttcgaaagcggcagcagccggcacgatagtaatcgagagtaggtgtatttcctgtactgccccccccccccgcatgtttgcttatcatagatatgaagttcctagtcgccgtcagtttgtctccagcgattgttgtgttcttgtttactcatattttactgccgggtacctttatctcctgtactctgtgataaaaatgttcaaaacaacatgagcaaagtcgcacaaactgtattctgcaagtatgtaatgcttgcgtcagattgtggctggaaactgcacaggtagcataactgaaaaaaaaaatttaaaactaaattttacaattgacttggcatgtggcaagttggtcttcgtgcttgttggtaactaataccattaaatgctgctgatgacatataaatcgatccaggttacttcgtggcagaggcacc

SEQ ID NO: 2276 - DNA, 455 bp, Zea mays
gaggatgaggagacttcccttcccgtcccatggagacggaggacttytactcggcgctccyttcggtttctcttctcgtcgactctgctctgttcattcgatttgagttctgctccttctctcggtttcgatcgacgggtacagtttgtgcgaaggagggcgcacgcacgaacatgaggagtggtctgcgattgaattggacgtttacatttgaagataaaattgttaaaattaaggcgtcttcttggattagttcgtgttcttgaaggtcctgcttcggatcgcgtggatactaactgctggatatgtgtgactcaactttttttttttgtttggggtctattttggtttcagcgaagaccgtcaacttgtactcttccggcgctcgctggcggtggaggggacgaaagtagatagcgtacggaagcatcggcattgggtcgcgcgcgtagggg

SEQ ID NO: 2277 - DNA, 1500 bp, Zea mays
gcagctgcagaaatcttcatgatgcattttcacccttcatcctggtgcaaatcctgtctagcttagtttgtgttcaattgatacaaatggatggaagagaactgaaggaagcagcagcaaagaaccccctgtacatacatttttgtttgctctattctttgcttttagaaaaaagatggagggcattctacatgctagcgactacttactacactatatgatacaggattacagggaagtgacatgtagttttggaagttagggttttgggatggtagcaggtcatcccctcccttgagttggccccctcaattccatcatgcccttctaaatctttttcgtttacatgtataacacagtgattatatcatttattgtaatccacatagtgtgcaatgggggagcttgcacattttattaacgtcaagtgaagcctgagtgctgaaagttcatgtcaggtctgatttggggagtgcgttgagccctggcgtatgctgtgaggcttcagcggttgttttgctactgttgccgccaaaaatcaaatgacgaaatattcttcaaaatttgttgggttatataatctggacagattataatctccaacaaacaccatcttaataaacacccccttaatggctaacactaaataaacaacagttactgctcacatacaagtcacgaagaaatcctaaacaacagttactgctcacatgcaaagcacgaaataagaaagaaatcagaaatcttattgctgttacattgctattcgtttcggattaaagtcgactgtttgaactgctgcacccacaatttaggctctatttgggaacaaagtttttgaaaaccacagtttttaaaatactacagtatactttagtcatgacaataccgcagtttacaataccacaattttgaaaactgaggtccaaacctaagtttaggatatcttaaaacaactatagtatttgcaatacttcagttttgaaaacagagattttagtcagcttgccaaacaccattctgtatataatactgcagtatttaagaatactgtattattcttccaaaactgtgaaaaaacttcactcccaaacgccccctaaaaaggatatttctgtcttcacacatgtcttagttacatgattgcatcaatattatagggttgcatctgatatattcctctcttggagagcaccgtcaatccgttgcgagtgctcttagagcctagaaaatggtattgtagggaatagatcaagtatcaggggtctaatgggaaaaggcacgagtatatgatgtgaaaccgaaagycaacgatgggctagagcattaaaaaaaattccctcaattaattgtcgaactcctcttccttttgcctcttcatttcaaattccagcttcttcctcgcggcgcactgcttgttcggtttgttcgaggcgacgaggccacaaatggtcatcgtgagtggcagcaacttccaaacggattcgtgacccttccgcg

SEQ ID NO: 2278 - DNA, 260 bp, Zea mays
gtgtcatgatgcctttgccttttccaggtttgaaaattgttggtagtaaacctacaatgaatctaaaggtttgaaaattatactgtcagcagcaaaaacatatagagggatactttgagttcccaaactgctatcctatttttggaggacagaattcccctgttaattttgcatacggtgttcagggctgccttgttggaaatccattcacagatcaatcaaactttgatgggccatcgaaaattccatttgctcatagg

SEQ ID NO: 2279 - DNA, 1500 bp, Zea mays
ctgtgtgtatgtatgtatatattacgtctaaacgttcgaccgttagtttatgtgagtcgtactgctccggttgtgataataatctgctctggatccactgcaaagcctggagcaggagcagctgacgggtactcttctgcggccggcctatgcaaatcaatgcatgtctcctgcctcttcatccatcactggagtggccggtgtggggcgaaaagaaaaatcattagaagcgaagaacaggtaggggcgctcgtcctttttcacacaaaagagatctctcgagtcatctccaagcttaaagcccaagagtccttagtgtagtagtactagtaccttactagatttgcacgcactcgccaatactgattgccctagctagacccagccagccagcccgcagtgcctttgtttcgccgcatgccgtggcccagatcagatgcacaataagaacatgctaaataaataaacttgaataatggcatgatgtaattatttggaactactgggacaaatttacatatatttgtcactgaataataatgactatacgcaactggtgaatgcaagcatggcagactaatgtgtcactgacatgtttttgctgctgctactcattgatgatggctcgaatggcaaatagtgtgagagctgtacggtgtgactttaccttcaagtatcatacgctgctagtgctactgctagcacggagcaggttaggtgaccaacagggcaacagcacagcttgcatgtaaagccctttttatttgccgttattattttactcccggaaaggtactcgatgctagccgcatgataatacatggtgagagagagagagcactgcataatcaccaactcaactgtagttcatgaccccattatatatatcaccaaggaggcgacgaaatgaagggtatatattcagcatcctttaatttaactcacccaacccactgatccaagccatcattccatcccattgctctcattgcatcaattcgcggctagagtgcatatgctaacgattcattagtacttgccaaatagattactctttagctactgctgactgccaagtagagtgcaagagttaccatgacagagagaacaagtgaccaagctagagatgaagctgcaggcaggctacacagattgacacagagagagagagagagagagagagagagagagagagagagagagagagagcagcaagattccaatggaagaaaccaacaggaggcaggcagcatggcagggataactagaggacagatcagaggttggtaccggcactaccaaccagccctacccatctgcctccgtagtggcgtgcactggctaccagtagatgcccgtacaaaactaacatttgtcccggctccttgcaccaccatatattcgcgcacatacatagcatctcaagctcccaatcccaagatgaatgctacgtaggtagacagtgttcttgtggtgacgtgacctccacagagtgcagag

SEQ ID NO: 2280 - DNA, 132 bp, Zea mays
tacctacagcctacaatggtcgttgccttccatccgaccttaccggcctacccttcctcttccaatttgctactgatctcccctgttatcgtcggatttctcgtgacggtgagtccgtgacacgccggcgcc

SEQ ID NO: 2281 - DNA, 1500 bp, Zea mays
gtcgacaaacgaagaagatgtagatcctgaagtttgggttgtcatgaaggaacagaaaaaaaaattgcagcagttcatatttacttttgagcaatgaggaacggttctctacgatgtgcgcatgtgctgttgagacttgttgagacaattttaggttacttcgtttacgaatttgtattatgcacaacagtatttgtttggtcgaaccagtgtatcttaagttgtttgctgttgtattagacaataatgagcttggatgtcataaatgtttgaacacgattattgctaatcgaatggtatgttataaattgtagaagaaaacatgaattcttatgttccgttgtgtgtggtacaataaaacttagtatgtgaactaaaatgtacaaggctgtttggcaaatttgygaaacgtagcttatttattcgaatacaaacttagacgagaacacataacaagtagtgatagtaagtacgaactcagctrctacgacactctagtattacawamttccacggcgactccataagtgctcgacaagatcattttgaagggagcacgatctatcttggcgacgtagatcgaagtggttaataacccattcggcacgtccttccgctattatttgagatgaatcaatccttgaagagttgtctccgaaatcaatgtttgcagcaaatgggccttcgtcttcaacgatcatgttatgcatgatgatgcaagccgtcattatctctgtcaaacgattacgatcccaaccataagctggtccacggagcaccgcccaccgggcttgaagtactccaaaagcacgctcaatatcctttcggcaactttcctgcatctgagtgaagtagactttcttttcctcgtatgggtgtcggattgctttcacaaaagtaggccagtttgggtaaataccatcagcgaggtaataaccgaagttgtacgcattaccattaactgtgtaattgacagggggcattcgaccagtagtgattgggtcaaatacgggggatcggtggagcacgttaacgtcattgtttgtcccaggcatgccaaaaaatgcatgccaaatccatagatcatacgwtgcaactgcttcaagtatcatcgatgccctaccatttcgaccacaaaattgacctcgccawgccgttggacagttcctccactcccagtgcatgcaatcgatggatcccaacatgccaggaaaaccccgcgactcactattatgcatgatgcgagtaatgtcatcttgagttggagtgcgtaaataccaggcactaaaacaggcaatgattgcgcgacaaaaatgatgaaggcattccctagccgttgattccccaatttgaatatactcgtctaccgcatcagaaggtaagccataagcaagtatccgcatggcctcacaaactttttgtaatggtcctagtccgggcataccagttgcgtcaactctttgtgtaaagtaaatatcgtgttgttgaagaccatgcaga

SEQ ID NO: 2282 - DNA, 1359 bp, Zea mays
tatattcaagtataatatatgtatttatatgaaaaaatagaaaaataaaatcggcccgtgtcgggcctagcccgtcgtgccacgtcttcggcctaggcacgacccggtgaccgggccggaccgacatgggcccggttcactacgtgtcgtgctgggttcgtgtcagaccaaacccttgccgggttttgggccgtctgacaagcccgatccgtttggacatctatactcggacgacatctggttccgaatcctgcttcaagcaaaaaaaaaaagaaaaaaagaaaaaaagaaagacctaaagtatggattacaatgggcacctcgatcgataaaaaccctattagaatacgggtataacaaatgttgatacccatatgtgttttattgggtcaattgttataccgatcgagtatggtgatcacgaatatgttctctgttgccttatatccgctactcgatagaaaacctgctaacatatgatatgtgtgttcgaattaaggagtttgttctctctcgtgcatgggctagtataatgttgacatttaatagtgaatgttgttgaccttatgatacatttatgttgggttcgatgaatttgtcatgctggcataaaacaatatgttattttagcatctttcaatattgataaggtatgagatttcaacattttatatttggagattacttttatgatttaagtgatcatgtgtaatgtaatattagtggatcgtggtgagaatgagtataacataattttgtatctatgatggacaatgggtatgtgtatgagacattttttttctagatgatataagtatgactttgcgtattagataccttacccactaccatcactagtcaaaatagaaataacgtcggagcaaaaacctgacctgacaccgtctctccataaaatgcaatccggtatttaaacttgtctgtctgtatcaatctagtttatgaaattttaaagtatgacttttagagttttatctctgtttgcatcctaatagattgttacgacccacatgtcatccgtcaaataagaagagagaaagatagacgggtctaaaagaccacgacactcatatgtgagttatagcagcccgttataacgtaatagagactaaaatagagattagacccttaaaaacatattttaaaagtgaacggattaatatagacaaataaatttaaagacaaataaatttaaaaacactgggagtgcactctactccatccttgctcctacaggttcagatctctcatcggcccccactccattagtccatttccattcccatcccgaccccgtcttgccaccggctacacgctctcggagtctcggacgccgcccaa

SEQ ID NO: 2283 - DNA, 1500 bp, Zea mays
tcaaacaacaaagctgaaaaacttttagccccgccctttgggtctactgcaagtaagccatattataggacaaaactatatataacgctggatccgtatgctgctagtttggaacagtagaaatcgatacgaattaaagtagaaatcgatacgaattaaactcaagcgaatatcttgaaactaagctatctgtattgtatcgatctccttattttggctgcacgagcacgatgcacacgcatgcatgcatggcggacagctgggtagggatatgtgtgctgagtcatgcatgcgtgtagtcctagcggagcactagaaaagtctagaacagatacagaaactgaagcttttgttaataaataaatacattgataatacagtgtgtggcaagaaagctaatgacttgatgatgcaccaagcctctcagagaaaaaaaaaggaaacacagaaaggcacttttgagtacgggccggggcgagcgaactagtagatgcgtcagcaaagctcctcggcctcgccctgggcgaagatgagatgagatacattgcaaaggcactttgagaaacgcacgtatatacttacatgccaagaaaccctctctctttccctctctttttgtttatttgtagatttgtgtcacccaacggatgctttgcttgcggcccgtgcatggcatggcactatggcagtgtgcaagttgaagtaaaaaaaatatatatatggtcaccaacgtacatcgtacaaacatgtagtaccaacaaatttaatttattattattactagtataattatagttgtagtaaatctggagtactgggtaaaaacacacagtaagtaataatttattattattacatcgtccaaaaaagaatcttttcttccctctcgttctccaagcagcaataaaaaggaacttacccacgcgcgcgcggcgcgctgcagtatgtttattcacagttagggcttttcggttattcccaatacacatggattggatgggattggaaaaaattgtgaagaagtttgacttgtttgggattcaaacccatccaatcccgctcaatccacatggattgagagctaaccgaacaagctcttagtgatttcttacagccaggtaggtgttcgtctcgtcggtgcctgctagtaatttccaagagagagagagagatggagtgagagggaggcaagggaggagagacgccggaatcatttccatgcggatctcgcaggccggcctcggttagcggcgcccacccattcccctccccgctcgctacatataggtgacccatcccattatacatacccaccggccggcgtcacagacacgcgagcagagcacagacacagagcacacagcacagaggcagccaccaccacaggcactcacccgcaccgctcggtcaccgaggagtggaggagctttgcagtcgcagcagcagcagtacagtgtgtgagtgtgaagggactagagcagggcacacagcgcaggccgc

SEQ ID NO: 2284 - DNA, 885 bp, Zea mays
cagggaatggccgaatactacctactaatctagatccaactatatcggcagctcttgtatctctaccctcctgcatgatccaatccccaatgcatgcaaatgcaagcgagcacggttggttgtttaagctgttcaacccaagaacagtagtcagacaacttccaggccggctaataactccccgcaccctgattactgtaccatctcttaattacttaggcatcggatgaaccaccgttcattcattattgcatgcaagttcagtaaattctttattactcggtcggatcactggagttcacttcaattcaaacgaagacagactagctggagctggatccagccaggtaataatattactgctgctgctgagatgacatcaatctttcttgctgcagggaagggaatccaactccatgcaaagcgtgtcaacgagcttttaattctctctgcctccaggcatcatctataggacatatacttattccataggtgccttatgtatacaatatttcgagagcatatacaaaaaaacaaaaaaaaaatgaatctttttcgtatcttctctgcagattaattgaacagtaccagtgtttaatttctgtttaagtggccctctccaactaccgtgagaagcaaagctcagctcagggagttagctgatgcatcaagctctgccttttaacttgccatcacttttaatttcacttggcggcatagatttttatttatactccatataatacaccatgcatgggcatgggcttcttcacctctcggtcggtcggcccccttcctgtgccttgccttgctttccgcaggaggatgcggagctgcttcttctgagttctgatcgctgacagagcagctagcagccgacttctg

SEQ ID NO: 2285 - DNA, 1500 bp, Zea mays
taggcaccgcacgaatgcggtgcgcctgcgctttagaacactccacctcgtcgcctcatcacatatgcatgtgtggatctgactgaagatctagagaactcgcggcctacttttttgacgcgtgacttgaggagctcttggaccatgttgatgtggcaattcacagcccacgattcaatcatggttgggaatttccttgatgactattttgtcgagcttggactttgaaattctgatacatccacacagataatggtcgcgactggatgatctaacaactgcattaatgagcatcgtttaggtgtgctgtgatgtccgtcgactttagatggtcggtataggttttcagctgtgtgaaattatggattgaacacctacgtaaattgactcccccccttttttttgaaaaaaaaaagaaagttgaattgatggctttgtgagatgtggttgttaactgaaaaagggattcgatttgacagcatgaatgtctttccttctcttgaacatttttatagtaaaaatgtacctgtcattcgtgcaacagaacttgaaatatcaactttttacaagttaactagaaccgccgagagtgcctagctagactctcttgagaacattgtatttccagtagttagtgtggttactggacttttgccaacagaagtcactaacacaatatttatgatggcctaaacataaaaactttgagaagtccagttcctttcccctgaatattcgcggagtatgtatcactggcacccgagggaaactgctgatgtgttttcgatagcgtaactgcctagctgcaactcgaaaagattgttgtcccaagttgtcaggttgactctgcatgtttcttctaccaaattaaatacagacttgtcatcagttgtcaactttgattttaattcgtatccctaaatcgcagctcattctttcagccgtgtcattgtttccagactctacgttgaatgtggtacattttccgctgaagattcatatagcttgctctcccgtcttggcagttggcccctattaattgaaaatagaggtttgaccttgatctctggctggagagccttcttgcatctccatctgcatctgcatatataatgggcagtccctagcttcttcacgacgcagcgcagcgaagcaggccttcttcacaagtacttctgctaataggcggcgatcgtcgcatcgttgtgtaggttttgtttcgacaatccttaattagcttgatgtttatagtttatacaccatgcatgatggagtaacaaccaaaacttagctttctaataaaacaactcatcagtttttatttgctgagatcagacatcagagtgcttgttttagtgtcgtacatccatgcatgtgttccttcatctctgatggttctgcagaaaaacagatttttggatctttctttcgttaggtcaggtgcgccatgcatgcaatgcagctgactgatgtgttttatgtgtgtgttctttcaggaaa

SEQ ID NO: 2286 - DNA, 1500 bp, Zea mays
gaggtggttacggcatgcatggtatttgttacggggaggaagacccgggtgacatgagtagcctataaactagttacccgcgcagagcttcgtacgtgattctatccaacagcatgtctgtgactagcgatgaagttgacatgagcatagaaatacagctgcatgtgttgcttgcttgatgtcacacttgtgtcatgctgacctcatgtgcggcaagaggattaaataaaagaaaagaagagatgtgggctacggaataccttgggctgggtgggaggtgatctggcccaagcgcaggattgctcctcttttttttctattttaaatttcttgttttagtttccttcacattttcagattcctatttcaaattcaaaattgattcaacttcaattttgccagtacaaaagctaatactaatgtgacctctaccattttcagtattattatttattttttttccttgttgtttatttagggaaggaataaatagcttcattaaattcccctttcttattttatatttatatcttcgtttatactttgaggtcaaaattatgtgtttaataaagtacctcccacaaagtcatcagtaagagatgcacttttcattatttatttattggttgcttaattaatttagtaccattaattgattatgagaagaaaatatccaaatgtattttccaagggattcaacaattctcaaaacactatgataaatatatttatttatttatttatttatttattttatacccaattttagggccttacaaatgggtggaagtatatgtctagcacattttgtttgggaagaactcatgttgttgacttgcataatgcattcatcatccattgcattgaagtttcgtcgcgatcttatggtccgaccgtaccggtacaatgagcatcatatattgcccgagaaggggtatgatgcagcttcatatccttagagatatgaaggcagaagtcattactgcatctgtagccatgtgcattcatgggagaggtgtggaatctgttatgtggatgtcgattgtgtggatctttacattgtgattcatcttggcattaagtaatcagttacttgcttacttgctgcaaattaatattcaagaaggaagttttgaactacatggttgtttaagcacggttggtttacattgtccaattgttgtttgctctacttacttgctgagatgtgtcatctcactcttgcattgtctgatgcaggcacctgatttctgctttgggaaagaagggatgtagcagcacggccactacacctttaataaaggaaccactgcttaataatgttgttaatcagggagggtcaagtctagggaattattatgttctagcctttcatggtagttgagctgattttttttggggtgggctgagttacccattttttttaattggtcatgaatgtgctttactacttttgcattttgattatactacgtgaattatctgtcttttatatcatgt

SEQ ID NO: 2287 - DNA, 1500 bp, Zea mays
catcacatacacttatatgtaaacactagagcagggacgtggtggtaggggtggataacgagccagctcggctaggttcgtccgagtttgagctggctcgttaagctcacgagcgagctcggctcggctcgtttatgagctcgagctggttcgtttagctcacgagccagaggagaaaaaataaaatatacataataattattttttagttaatttcaaactaatttaacaatagaaaatagtaattatactcatagtttcataaaccacgtcaatataacaccaaattagcacaattcatcactcattaattcacaattcacatacatgttcatcagtttaatccataattatatttgtatagaccaaattaacacatagacatagttcattaatcattagtttcattcataggtcatggacacctcacgtatatataacatgttaatcaattattctgtaaatgttatacatatagttttgttttgctggaatatggtagctcgtttagcgcgcgagctagctcattaacgaatcgaactggctcattaacgaaccaagctagatgtcagctcagctcgtgaaaaaaattcaaatgagccaatccgagtcgagctggccataaccgagcgagccagcaagccacgagcatttcgtccagccctacctggtggcggtttggactagttggtgctagtgagcaccacacaaaggaagagggcccggccattagatcaacggcgaggtggggaaggagcacgatctgtgaaccgaaggcgagtgcgcagtccgagaaagcgcgtgcgccagaggaagaggccaggatggcgagcgcttggaggagctgtgcggcggaaacctagcgtggggctcagagaacaatgccgggaatcaaaggtaggggacggcagtttgggaggagctcgcaaggaggaaggtggcgccacagttgaagatggtggtcaggatcattgagagttagggcaagcgacaagggtcacggacccagaacgcgatggagataaggatggggcactggaatagagagttgcacaagggataaggctaagcgagtcttcatgagaatttctagggcgttgacttgagatgaggttaagggaggtagagcggtggagatttttttagagaaacgaacgtggaggatatgggtcctagaagttgtacgcgataagaatgatagggaaactgtttgaataagtcctaaagatagaaggtagaaatcagccagcacaattagaggaagtgctcacggcatgacctagattgttgggatggcagcaatcagtcacgatcatgccgtgattggctcagttatttgtatccttatattactgcatgtacttagtttataaagcaatgaacactcaccaaaaaagccaccgcttggcagcaataagactctcatgtgtccactcgagtgtgtgtgcgttaatcatcctagaggccggattactaacattgtgctccgacctttctgca

SEQ ID NO: 2288 - DNA, 376 bp, Zea mays
tgtatttttccaagcatctacttgtttgagatttggctttacattttatctttttgtttgcttcccctatttctcttttgtgcgtatttttcttcccctaaaagctgttgtaaaattaagaagtacaattgtgtcatctttcttttgttgtaaattgtatttggaagatgtctaccttttaccaatatgaataaacttggaaaaaggctgagctacttgggaacaaagtgttcagaaatgtacgtctttgttgcagcaaactcagcagagcttcaacttctatatactggaacttgtggttgcttgcagcattggtatgctaacttttgcagtgaatatttgttgttgattacagatttatgtttttttgcagcta

SEQ ID NO: 2289 - DNA, 672 bp, Zea mays
ccttacatttgtcctatattctcttgagtgatatatataaaatttagatacggatttgaattcaaataatttttttactcttttcatgtaaggagcaaataatataaaaatttcgcaaaaatatattcttatttttttcataatatacttaacaacataactaaaaaattaacatcaaatttaatgtatatctattaaaaatattaaatttgtcctcgtgtatttctacctctagaaacaaagaagagggaagggaggtgcaatgggactttccaaatcctgtcactatctgcacgacacaacgaaactggcgcggccttgtctggctggtacaattgtactaccagctatcgcacgttcacctgcttcctgtaccgcgtcgttgcttctgtagctgcccacaacagcctaccctaccttgtcagtgtccaacgatgcaaacgatcgagtaaaaaaaaaaccccaactccgaggatccgtcccggctcctgctgtagtactacaaactacaaagccctccggccccacacgccagccatctccaagccctccggccccccgcctcgcctcgcatcgtaccgagaataaacccaaatccgccccgcgtccggcgtccgcctaccatttcccgggtcacgagtccacggcctcctcgctcgcggtccccgcgcc

SEQ ID NO: 2290 - DNA, 1500 bp, Zea mays
cggccctgctgtggtgacggttgcgtcatttatttatatatacacaccaacaaaaaaaaggagagagcatcattttgtcgtagtggtcgacaccactgaactccacgcatgcaaatttcccgcacacgagaggtaacgtagccctgctaatgcttcgaagctcgacgttccatggaacttggatgcagtcgcctctattcgtattctgctctttgctgagtgttaaaataacattctcggtgacgaccacgtttatcaaaagtaagacactcggcatatacagacactcagtaacgatagctttgccgagtgtcaaacacttaatgacgacgttcggcaagggccgtcagcagccatttatagctgatggctgttacctttgccgaacgccagcgttggcactcggcaaagaagctatcttgccaaatgtcgtacgactgacattcggcaaaaaatactcggcgacacgccgataaaaacttcgctgagtgttttacaggctttacgaatgcttcagaaactcggcaagtagatgttttcgatggtgtgatttaatttactcgaactgctttggcagcagactgttcatcattgttgatagataaaaccttcagctctctatgcatgtctggctagctaagtggtatctgcatgcgatcaatcattggcctaggaagaagtttggttgaatctgatgggactgatgatcgggtcctcctcgaacgctgacaacttcagaacagcatgaataattaatggtggtgtttcggccggcagatactgacatgtttgtagctagctatcttagcggtagccaccagttctactgagtttggcaaccacgatcgaagcaacatagctaggcaaagtggcaaacatgcacatatcggctatgagttttttttttttgaagatctgtagcataagagagatgagaccgttgacgattcgttccttgatgtgtctgccaaatgtgtacaataccactcaaatctgatagaagtttgatggcttcttgccacgcacgctggatctgctgtggctcgatcagatagatgatgctacagcgctagcggcctactgaagtcggtctcatccccatcgtcgtctgcttcagaaagaggtactatagccaccccgggccccacgatgcccactcgcggagaactgccgacgtctgcgcacgcacaaacggcttccagatgaccgagatgccactaccacgagcatatataaatagagcagtccccgagcacatttctcttcagctcgaggccttgtcttgagttctctagctcgtccacaggcctggccagctagctagctagcactgacactgaccgagaccctgcagctagcagctgatcgatccatccatggccatgggctgctgctacggtgatttcttcgacaaggccaagccttacctcgccatgatctccctgcagttcggctatgccggcatgaacgtcatcaccaagggtctccctcaaccacggc

SEQ ID NO: 2291 - DNA, 1500 bp, Zea mays
tgagaatctagttgtggaaataatctaaatatcgtggggattacatgcggaggaagataaagcggtgcaaagggttcaggatctagaaaccgacgagtctaagtttcttcactttctaaatcctaaatcctgtggatgttttcatcttcctccgcatataagcctcatgatatccagattctccgcataaccatattcttcgggaatccagattctcaggaaaacttgttcgaaaaaatgaaccaaatgtggcctctgtcttatccatattctcgaggaatctagattctcaaaaaaaaaaaaacttacaaacatgccctctgtctcatgttcgcgtcctataattgtaatcggcgaggaaaaataacactaggattcaatgacacaaggcgacatgcctgttcacctcgaggttcccattactttgagatrtgtcggattagactttttargcgattagcaaaaaaatagctaaattgattaatttagttattctctaaatgttttttaaaaagagtagattagttcaacatgctcgataaattcagaactctgtatgaaaagtaaaagtgtgtttggttggatgtagatgagggaaggaaggagacaactacatttttatgatgtttggatgagagtcacacggaaataaggtgaacacaagagcaatttttggtggcggcgtgttttccaaaatatcgagtggacgatgccgcccccgcctcatactactttgacatcaaaccaaacacatactaaatcaggctatccaaaaataaagaacaaatatatagggatagagagttattaaatttgaaagggccatttacaaagtatagtgaaaatattttttccttctaataatagccaaatttacttttacaaaatgatttagctagtctcttggagttgctgttaggctgtggctagaataccgtatatagtcatacaaatacaaacaatgacaaaccgtattgtttataaagttggatttgaaatagaagatgagataagtaatactactaaaaataccttagaagagtagcttagaatacgagtgagtttgtttataggtacgtgagaactgtgtctaaactatatttggaaaatatacttaaaattcaatatataaattaaagtaaggcataataatcaagaagaaagacaaaaacaattaaattcagtcaagacaaaaagcaaagaacctggtctgaaatggcaaaatatgttaaccaggcgaaaagcatacaatcatatgggtcgaaagaactaactgggccgtgtggtctgctgttagatacgagcatagactacaggctcaaagttccaattccaacccacccgacgtccgacgacagctggtccgggtctcctccatttcccggggacccgtccgatccgatcccagtcctcaacgccaacggtgggagatctagatcggagctagccagccagccggccgacgctgtccgccggccgccccggcgattctgacccgag

SEQ ID NO: 2292 - DNA, 528 bp, Zea mays
tgatcatttatattgcttattggtttagttcatagcacttactgtgaatgtcttaaaatatatcagcaaataggagtctttagtcaaatagagaacgacctagttatttgaattctctgtactgttaagtagcaatatgttgatataaagcctatgtttcttatcactcttctgtgttagttttggttgtccttggtggtctctatatgcaagtaacaatattggtatttattctgacgacattctttcagccatgtaatgcttagtactatgatgttcatattctttttatgtccttggtgacctcttagatctttttattttccaatgacagttttaccatattctttttatgtattattttaggctttcctatacttggagttgaatggcagaaaatggagaatccagatctccgcaaagcaatgggaatgaaaccagatcaaaagggtgttcgtgttagaagggtggagcccactgctctagaatctggatgcttacgaccatctgatattatccttagtttcg

SEQ ID NO: 2293 - DNA, 1500 bp, Zea mays
cctaggccttatatactcgaccgtggggcagtacacgtggatatgataacaacaagtagctgaaaggtagtgaacctcttgagtttatccctacgtaaccctcgccgacttatcctcgcatggctccattgcatgggggcttcagcgcgggaaagtcgggtctctgttgggatttactcgttcgtcgttgtgggccgctcgggtttgctccaatctggtcttacgtcttctctgctttgttgattgtctctccccaggcccacgaaagaacgaccttacgatttattgggcctttgggcctttcgggaggtcttttatttctttagtggacccgggggatatctatcccccacaagcccccgatctttggggtgatttggaggtaatcaacccaaagatccaaggtccaaaaaatgactccctgctgccttctcttgttccgatcactcatttgaccgaagcttggtttcgtgcctgtgccttagaggtcagcatttcgatttgtaggattctgaacttcattgagtgcgccggaggtgcacccaatgggtgtagcccccgacctttgagtagattttagaaaataatctatttgaaggtcttccccagaaattatctccatttgtgctcctgcatcttggttgagggttggtcttttaatcttgtccttcgccttagaagtcgacactatctcggcttggaatgataatccacggggtgcaccggaggtgcacccaatgggtgtagcccccgaccttcaaatggattttttaaggataatccattcgaaggtcttcctttcgtttgtaaaaatcggcatgaggctatttgcattatgctttggaggtcagcattatgtcatcaatattttgctgcagtggtcagcatgtattttgtctttagcagccgagtttgcaatccatccatatcttgctaggtaatgcaatttatttgcttctgcgactgattggacgtttgatggacgttctctgtctagtcttcacgtcgcttctgtcggccatatcttgtactttgctggctatatttggctttcctctgatccttactgatatctcatttttgtcttgaggtatttactgcgtgccctgcacggatgtgaccgttttgaaaaatattctgataattcctgggcgtcccccccaatgggtgtgggcaagggacggcttggtacgctgagtgttttatccggctgcttctgagtagtaatgtgatgggacggctagtgtaatcatatcctttgcgctgttgactggagtcccaatgggtgtagtgttgcatgaaacggcgtcagccgcctgacgtgtctccagacgggtggaagtgcttattgaatgctttgcgactgttcagtgaccacggttggaggtgagcggttgcctttcccttctattaaataacaccgttgcttccctctggttttttcacatctcttcgctgttctttactgcatccttctcttcccttctgtctgcttccgcc

SEQ ID NO: 2294 - DNA, 1138 bp, Zea mays
aacaccactggtctttagatattagtatagtgtagttagaataatgtagtagtaatgtagagtagtacagtgtagtatagtagtagtagtaatgtaatgtagtaatagtagggaagcatcaactcgcaaagagttgatttgtaagctttattgtcttcccttaatgaaagaatgacgttggcctcttcttgatgactcgctttccttgattatagaactgattcttttgagacagtagatgaataacttgtgcatcacactgacgcttccagaagtagctgccgagtaatcttgtagtcggtatcggcgttttagaagcaacgccgagcgattgagggtcgacgtcagcattttagaagtaattccgagcaatcgaacacgagatcagcgttttagaggcaacgccgagtgagtgaaggtcgacgtcggcatttttagaagtaatgccgagcgatcgaatgcgagatcagcgttttttagaggcaacgccgagtgattgaaggtcgacgtcggcattttagaagtaatgccgagcgatcgaatacgagatcagcgttttagaggcaacgccgagttatgaaggtcaacgtcggcattttagaagtaatgccgagcgattgaacacgagatcagcgttttagaggcaacgccgagtgattgaaggtcgccgtcggcattttagaagtaatgccgagcgattgaacacgagatcagcgttttagaggcaacgccgagtaattgaaggtcgccgtcggcattttagaagtaatgccgagcgattgaacacgagatcaacgttttagaggcaacgccgagtgactggaggtcgccgtcggcattttagaagtaatgccgagcgattgaacacgagatcagcgttttagaggcaacgccgagtgatgaggtggcgcatcggctttttggaaataactaccggatgaccacgtggcctgctggggttttggaaataaccgccgggtgatgactgggcactttttgaaacggtatctggctcgagaatatcccataagagctgcgcttttagccgcctttgctttccgtgccctagttcttgcattcccgcatctgaatcttctctgccactcgccccctactctgttcgccagtgagaagcaag

SEQ ID NO: 2295 - DNA, 125 bp, Zea mays
ggtaattttgttcaatctactattcacttcaatcacatgtaatggaatacaatcactggtgctatttttctttgaactttttattggttgcaggttagtggagaaacatctcggacaatttgttg

SEQ ID NO: 2296 - DNA, 944 bp, Zea mays
gattataatattgctaagatagtaattcgttctttatcccaattactagagtatcttcaacagtaccttaaattaaaatgtcctatcataaaatatagggcccaactaataatgtaatttactttttaacatacatgatttagttcttacctaatagagcttaatttgtttttaagtgtcctaaacactttaaatgatgtaatattttaatttttgtactttgttggaatactctctcatttagaactcacaaattttacatgaattacgcaacaaatttcatatgcagaaaaaggcactacgcaaaaaaaaaaacattccaatatcccaaaagtctcatagagcaaagatgattatttgctcgttccgtttttttcttagaacatttataaaacgcaaaaaaagggaccccagcacatttatgaaacggaccattgaatgtgctcaagtcttctttcctccagaatcccccatctgagcaagggcgccgccgccgtcggctagcgccgcagcattgacgtggacgccgaccctctccggcagccggttagttccgcgttcgccgcatttcgcactccccgtctttcgtgctaatccatcccgaacttcaccttcccaactcacagcttgcagcgcgtcccttccccgctcccgcggcatggactgcgcaaagaggagggcggtggcggacctccacgacgagctgatggtggagatcttctcgcgcgtgcccgtcaaagacctccgccgttgcacgtgcgtgtgcaaatcttggtgcaacatcatcaccgaccccctcaacgggcaagaagctgccccagaccctggaaggcttcttccaaggcgtcgtcggagggcctcacaactacggccaattcaccagcctgtcggggagcggagaacgcgtgcctccggtcgacccttccttctccttcatcacggca

SEQ ID NO: 2297 - DNA, 290 bp, Zea mays
tgctgctctgcacttccgcaaccgtgcggccagtctggcagtcccgctgtcctccaaacgtcgcctatcttcccgcgcccgctcgtgtatccgtctctaagccaactccagcaacaccgtcaccgtgtgtgtttagactgatacattgtttgtagagagaattttgaaatagaaagtttgataaagagtgaaatagagagtcgctggagataatagtcgcccgcaacccatttgaaaatcacgccgtgttggcgtgtaatcggcgattcggcggccgccgggcggtggcg

SEQ ID NO: 2298 - DNA, 1100 bp, Zea mays
tgcgcggatcctcgccaaccttccactattggagacgggcggagtagaggagggcgttcatggaaggttcgagtatggcggtctggagcggaatttccttggagcagcggcgcgggcgacggactggagcggtgggatggcgggatcagcgaggcgggggcgcagagagcacgggcgcgagagggagcgggctacaggcagaactgtgcaccaaaaaagtgtgtacgtctacactatggtcttatataatagtagagattatattactctattttaatgttaaattatactaaaaaataaatgcacagtctattataaaataacaaactaagatttaaataagatgtctcttatgattttaaacatagtttgttctatattgatttaatataattaacttaaatttatcactaaatattgtattttctaatagggacaaaatcttcatagggatgaattccttgaagggaacagagatgaaagaaaaagtctcccgtaaatatttgcaggaacagagatagataatttttcttacaacggaagtcattcccgttcccgatgagtaattttccattgtcatccctggttttgacccagcaattagcaagtcccggaaacctaaaaccccaggcaaaccatccgacggttcagcagcacggtccagctcagccaacggccagatgggccaccgcgacactttgtggctctgtcctctccgatatattactccagctgtccagccccaagccctttgcactagcagagctaaaacccttgcggcggctacctttccctcaccccctttctcgcctcgcggcggctacctttccccccttctcgcctctcgcctcgcggcggctacctttccccccttctcgcctctcgcctcgcggccgccgcaggcgaccccttgtcgcctcgtgctgtccaccgccgaatcttccccaggttggaaggtttctgccgcctcaacagctcgatccggttggcgcacgttttcctctgtctgatttggttccctgcgcgttcgttcgattcaggttagggagggtatctgttgtttcagctcagttttaccgggggactggttgtgggcggag

SEQ ID NO: 2299 - DNA, 998 bp, Zea mays
acttcatccgaggttagcattagaatgagtattaatgaaatcgggagtgcggaagagaagttcttgctatgagttgctcaatcaatacggataactttggtagccaactcaaaactatcacaagcaagagaactagagaggggagaggaaagaaacaaatcgtcgcagagtatgaacaatgcaaaagacgcggacgatttgtttcccgagattcggtttcaaggaacctactctccgctgaggagtccactaagaacgaatctcttttaactttttccctctttcaaactatcacgaagaccggttaagttttcttctcaatctcggggatatcaagtcccgcaaggacctcgacctccaaacaaagaatcggagcctcttgcttcacgtttacaagaaagagaatggggaagagagtgagaaacaatcaaagttcaaatgatcacaagaccttgcaactttcaaatacggtagctgctatatatcttaaaacacgaatcaatcaaatacggcgcgggaacgacagaaggtacacgcataaatcgatgaacccatagatactgtatcttctcatcaagctcttaatttgctaaacaagcacatgcttagcgcagcagtgtggattgtcatcatggctgttgctttcttgcttgatttcggtcgattcgtccttcgtttctcgactttctaactcccttctagatcttgacgatgagcctgtttttttgctggttggttccaataatgccggaatcgaacgggttaaacagacaaaaaaaactaattttacccataataaaaaataaagttgcgtgtattagatttgtatatatcacatacgtcaactgattggatatatatgatgggataaggactcttcagctattatctatttatctcgtagtatctcttcttaacagaacccctataaattccctacgatcgatcccttggctccacctatcacttttccttccgatcagatcctctcagttatc

SEQ ID NO: 2300 - DNA, 1500 bp, Zea mays
caatttgtaaagagtataatatatagtacaaaaattacaaaacaacactttgtatacacgcccttgccgggtagtccgcccaccaaaacaaacatttcagacagctttagaatatctccaacaataccataaattggtgctttaaattgaaatatagggctctacgcaggaaaaactactccagtatctcatttcataaaatttggtgaaaaaattatagagcaccatctctaatgcctcaaatatactacaccatattgagctgctctataatttagatttaatgttttactgttggaacgagatgttttgttagtgccctaaattatataaaatatatatttatttttaaattatagaatatttttataggtcacttccaacctggcgttatgcagaagcacaaatctgatccaaaatccaaacagtcttcccgatcaaaacacctatgggcttggacttgtttgtacacatataaatctaacttaatccatatagagaaagttaaactgaaatttataatttaatatgaataaattgaagtaaacacaggtgcgtcaaacaaacaacacctgacagattccgattcaagcgcctgctgccaatgtccccgtacgtgcgcagaccgcagaggcagagccgaataacccgatcagatcaaagcgaagcctgcccgtcccgtgcagcgtttcccccctcaccctcaccctcacctagtcacccccgtgcgccgcgccggttcccataaaaaccaaaccccccgacgcctcgccctctctttcgttcccgaccaattcgcctggcttgccctcgcccgcccaccgctcggagccgatacaagacgagggcaatcgatctgttccgaatccgcatgcgcccgcggccgccgccgcccgtcgccacctgaactcgaacccctggccggagcgtgcggcccgcgcccgcctatggacgagtaccagacgcgccggtcgccggcgggcgagcggttcatcggcatgttctcgtcgccgtctacgccctcgtcgtccccgaccgagccttcgttcgtcgctggggacgaactccacgaggacgacttcctcttctcgtcgccggacgccgcggcgccgcagcccgacgggcctaggagcccgggccggggagcgccgcaggggcatctcggtcttcttgccgccctggcgctacacgagggggacaggaggctcctggttcgcggtggccacggcgggggagtggcggccgcggccagcgcggggacgctgctccggcgcaaggcgaccatcgcggcggccgccgcatctgcctcggccacggtggcgtcggggaacgggggcgcgttgtcgcccacccagtccccgacctcctccgcgcgggccatcccggcgaccgcgaagccccagaacgccgggcccgcccggccgtaccaccagtcggcgcccgtgaaggtgcccgtgcgtccactccgaaagccagctacgggccggtgggacgaattcg

SEQ ID NO: 2301 - DNA, 393 bp, Zea mays
tcattacctttgataacaagccctcagcgaactccccctccctcctgactcccgttgcgcgggcgagcagcggaccattgattcgcacacgcatcctcagctcaggtagacgcggacctccaaaccaacccaagctagcgatccatctcagcaccagcgagcgagcttccttgtccgcctctgcggttcccttcgctcctcgacctcgatcaatcaatcattcgtgggctcgtggcccggccccggccctccttcgcgccgcgccaccttccatgctcgctcgctcgcacatggccgctcacccctcgcgcacatgacacggcgtaggtagtagaccgatcaattcctctttcttacacggaatgctataaatacagagccgccggccaccgg

SEQ ID NO: 2302 - DNA, 530 bp, Zea mays
agataaattacagtagagatacacttccctgcctatttcacgtaaaaaataatagaacaaagctgaaccagggccttaagtggctctcagcgctcgtattatgtggcccaaggttctatatggcccgaaaacaaacttagcactttaagggccgggcccagaatagaataataaccaggtccttaccagcccagtaaaagctcatccaaccaggccgaaccacctcaagctaaaatcacaccgtgacaccgagcccacccgtcgcgatctgtcacgtacacacctcgtacacgcgttgccttcagagccccattattctccgcctttgtgggccccacgtgccacgtttcgatccttcatactataacgcattccattgatccattccctactttccctccccatcgcgtgagcgcgacggccacacccacacgaaggatcccgaagccgaagagaaccctaccgaagaggcagaaaatccgtaggcgctcctcatacgattccgagatccgtgcctcttatcggcagcc

SEQ ID NO: 2303 - DNA, 390 bp, Zea mays
attcaatctccatctggatgcgtgtgtgtgaccggtgagcgagacagattccacagcaatttgctcctcttccacgcacaggcaagactgctccccagaaaagattgtagttttcatcgatttagccggtttctgcccggggggatcgctgctggagatctcagagaaccgggaggctccgagcttttgctccgtttgcgtcgaatctgcctcgggagcggagaaaggagcggccttccgagctcgtaggggccgtccctgagaaggcgagaggggacgcggcggcggcggagtcagctctagggcgctcgtggaagtcggtgatgccggtggtttgaggacgaggcggcctcggtggttttgaggaagccagcytctgccgcggcaagg

SEQ ID NO: 2304 - DNA, 1178 bp, Zea mays
aaaaaggctatcagaagaggatggtaaggcaaaagtgatcttgggcttgaacgacgaaatcatggcaaaaacgagacatctctggccgtaaaggaaaacgtgcaacatgcacaacgtgcctcagttcagtgacttagctccagttccctcgtctttgtcaagaactatcacgtcatgtgaaaaaacgaacatacccctattatctagctaggctgatttcaccggtccgtatatttgcaccatgcatttcaaactcttatatatctacattgtatatgtagtgcacatacggtgttttgtacatccaactacatatgctggtgagcttgacctttgcgagcaatggccgcatcactgatacaaatttaagcatgttcagttgcagtttaataaaaaaataataagttgctgataggaagctaataataatcagttgccgcataatgaacaacgaagtagatggtatcaggacttcgaaccactgacaagcagcagcataatagtgtgctgaaaggatgaatagtttcgatcgacgcgtacacggacggctggaagttggtctaaccatttcatttgacattccaacactaacaattttccacaccgaccactaagccgtacgaatatacattctataaaaaacatatatttcacaactaacattttcagttaatttagaacttaaaagtctattgctgtacaccacaggaaaactaatacagtacggcgaaatttgtcaaccctaattagcccttcagagagtagctacaaagaaaacatctggctagctcttgtctaaaactgcaatcaaaggctccgcaagaatggattgacctggcacaggggttacgaaatgtcggccccgtgagacgtacttcttccgacattcaaatacctatctacaaacagcatcactatgcctcaaatttacaatgaattacaacggatggtatttctcagtactgttatcaatctatagtgattccatagacccgctctttagcctctccattcgtgcttgtagcccagagagagctcgctcatccatgggtggaatattactttgttgctggggctcaccgtccaatcgtgttcccccatgcagcatattacttccgttcatacttgccaacggccgagcctgagctccgtcaaaatgacctatagctgcagcttga

SEQ ID NO: 2305 - DNA, 871 bp, Zea mays
tactctgatttgtcaattcagtaatttttggtagtataatttaggattgacccgtcgactaggcacacgcgcgcaraggccagagtcagccagtgcatgcgtcaatagcgcccatgccggctgcgggctgcctcgatctcatccagtcatcctgcactgcgtctcgtcttatcaggattcaggaagcacatctccctgttcggatccggcgggcagagcttatcttcccgtagcggaccggtttcacatgggccaggcccaagcagaacaactgtccatctgggccttgcttcaccagcttttattaattactcatctcgtcccatcaatctctctttgttcctgtcctttcctttctgagagtgagagagaggattcctttctgttctttcgattccattggcttgtgccagttcatggaagattcgccatgttattatcatcatccatgcaatgcagcgtgcaggacgggatttcttggcgggccagagagagatccgaagcaggagcagagaagatgccatcacgccgtacaaatacgaggggagacacaataaaaataaaataaaacaaaaaccgggcggcagccggcagggctacgcaggcgccgaggggaagacgacgcggactcacaaggcgaatatcccccgtccgggacccacccgacagcgacccaacacccccaatcatcatcccctccgcctctcctccactggagacgacgagtgccctcgtctccctctcccctcgccgtcgtcgtcctccctcctctcctccgctcccaccgaggaggggaccctctataagaaggcaggagcgacgaatccgatcgtctgtcgtgtgggagagccgcggccccatcctccgtgtg

SEQ ID NO: 2306 - DNA, 191 bp, Zea mays
ggtagttgccaagtttgttgggggcaaacacaagggctccaagacttgtgtttgggtacccaaagttcttgtgtctaatgccaaaggacccaaaaccgtttgggtacctaaagtcaagaactaaacttgttttgtaggtttatgcatccgggggctcaagttggatactcgacagcgggtgcacaaaccac

SEQ ID NO: 2307 - DNA, 585 bp, Zea mays
agtcatgaatggcagccaagcacttatctcccacacccatgtcctggcaaacatcatttacttggctctcacgaacctgaagcaactgaaatggaatcaaaacctcatactcctccatgtagccccaactgagaaacaatactctcttgcttgatactgccaaagagccaccaaattttttgacaaacagacagatgaattcaggatgaaaatcagaggacacagcagtgacaagattgcattgagcaacacattctgtcatgatatcaagctcttcacacttagccgcagtaccggcagaaggtatatcaaccataacctcaagcaagctgatggcatcctcccaccgcttgtctcttaacagacctgttatcaccaaattgaacccatgtgtgcttgacagcaatccctgctctatcatctgacgacatagctcatatgccttatctgtcatcccctctgcatcacaaccttttatcagaaccgcatatgtcacattggttgctgtcacaccatccctgacagcctcgttaaataaatccaacgctttcccaacttcaccgagcaagcaatacccatgcatca

SEQ ID NO: 2308 - DNA, 671 bp, Zea mays
aaaagggaaaaaatgctaaaccaaatagattctacttgttagtgttatatattcccttcatttcaaaacataaatcactttagatttgtatatatatatatatatatattttatttttttatttagacatatattaggtatatatataaataaaaaaatgtatgtaaaaactaacttgccttgtaatttggaacagagagagtaattgaattatctaaaattcgtttatagaaaaacaaattatcaaacttggctcttaaagtcgagtgacaagtgcattgataaatagccaaaattttgtactaattttgaaaatagaggttagccgtcacgagtaatgcaaaaatcattagccgtcgattctgatgatggaaggccgatggacactatggattagaaatcagatcgtggcgtgaccggtgtggacagccacgatcgccgtcctctagcacgggagctcagggacaaaactgtaaaatagtcggtctcgcgtctggagattttcagatcagaaccaaactcggctcgagagagatcgcatacgcctgcctgcccacccacctccccttttccttcctcttcgccccagcgacgcggccgcccggagaccgagcgaggcaggcaacccaccaccgagaggcagggacaggaacaggaagccggaggcgaag

SEQ ID NO: 2309 - DNA, 1038 bp, Zea mays
gttatactcctttctaccatctcgtacactgaagtaagaattgacagtgacctcaactctacatgcactagtcggatcaatcctgcaatagcaatggcaaacacatagaagggagaacaaatgtaagtagcaactgatgacaattccagtcctaaatgaatcaatttattctgtacaaatttattccccctcacaaacagtaacttttgtacaatttacaagaaattgcaaagattcaacaaagaggaaaaggatattatccttcaggaacctcagaagtatccatgcgcctcaatttcagatcgattcctgagcactacaagagagaagaaaatcctaggatttagaactcccaaagcaaggaaggaagatgagggagaacgggagaaaggtgcatactgcgtggggtggaggacgccgctgcagcaaaaacttgggtggccgcgggcgagcgcgccgcctggaaggccgcgagcagctcgtcgcctatcgggcctctgctyctttctcgcctcacgcgagggagtcgtattctggcctggggccaaggaacggaggggaaaaactaaagccaggggtaaaattggtatactctaattgttgatcgttccaaataaaaaaaaacccattgatccgattgacggaagggaacggaatgctataaatctctaacgtgcaatctttccatggtaaatatctaagtgtgaatcttttgctggtaaatttctatacatgtgatcttttaatggtatgtatcaaattttgccttaaacatataaaagggtacgtgagaactgaggcaaagatgtaagcccggttgacactccccatcagagagccctcttgacgccagcccactcccagctcaaccatttccagcctcaattagccgaggcccggcccattccttgcccacgtcatctttctgtctctccctctcatcgccgcgtcacgcacagccgccgccgtcgtgcgcgtgtgccggaacggccgcgtggatcctccgccccgtcccagcggcgacttgtccgtgcgaag

SEQ ID NO: 2310 - DNA, 1428 bp, Zea mays
gaccgggaaataatgatgcagaaataatgaaaacgtgtatatgaggcattctcgtggagactaaagagccctcacatgctctccaacgtacatcctcttgctaatatatttttgtagtatagatatttagtatagatatttagagatacaaatattgctaatatattatataatctagttaaatttgagaaagtttgactgtcacaaatactatacgataaacattttgggaagggagtagaaagtaggaacagggggctttgacaggggagcgttggaatcagcctcagatctcctgctgatgaacatcaatgcaacggaaacatagccattggaaaatgaaaaaaagaagaaatttggtagaatttgttggtgcacgcaccaatttttgcgggcgccagcgccacgcaggctagagtggggtcgaccgaggctggaggttcggcgcctaccgcgccgcaggacaactggagacagcctgtctcgcacacccctcctcttcgtctccgctctctctcctccccgcccccttggccccttctccctttctctctctcctcctctcccccctgtcttcccccattccccactcccccacctctccagctccgtcgctagggctccatttcccctgcacctccgccgccgccgccgyttcaacatcagaatcaccggattcggtggtgtttctcggctgcctcagcttccgccggcggaaggccccaggcggcgctccctgcagccctccggccttcactgaggtgatttgcactggagtttgagcagttgtccctaatctttttaggcagcctcttttggtgatctagtgcttactccggtcggttaacggtctgggtttgagccttttaggaggtgggaaagagcaagcaaatactatgttgcctactattggattatttaagagctaacaagtgctattcttgctagtatcatttccgaagtatttagggcttaaaaagtccctgtgttttagtgcagaaatggtaagctttttcttgttagctgattgcctgattcaagtaacctgccaacttaattgccctagatcaagcgcctattaattagatgatcaagtttcgtacttctgtacgatattagctgcacacgtaatctctaatggatttgtcctggtacgagcactggaggtttaggaagcgatcagcttaaatcaaacgaaaaattttcgattgaggtgtgtgtgttggggggtggggtgaagacaaaatactgtagttttttggttaagtcttggtaaatatgctccagtgttgtcattaatcttatacagttactttgttgaatgcagtcctctagacttgacaaggctgctgctgagtatatggtatctgcgggccattgtgctgtccatgcgagcggagagcatgcgtggcagctgtgcttcgggtg

SEQ ID NO: 2311 - DNA, 1500 bp, Zea mays
gagcgcatcacatgtgctccatcttaaagtctgttttatcgggtttatttctgaagctctgatttgccacttcgaggagcataacatcaccttctccatcggtcgagtatcgaataagtggttgtagataccgttgaataggggtgacctttgcggttgcttgctgaacaccgatctttcggctacttgggggtacagtggcgacaaggtttcatggtggagttatacgtaatggctatttggccccaaaaggcgaggaggtttctttattgttgttgccctcaacagggtccactgaatacagcaagacacgtgtgaacctataaatttatgaactcaaagaactattatcgatttaaaaattatctcgaattcataaaaacgtgtgtacttactagtctttcatcctctgtcttagcgtagtccttcgtcgttggaattgagtagcagtggagtacacatacacatactagtttgaggctgcatcactgtggcggcttgttgggggcactatcgttgctgcaagaggacaagcaccatatagagaggagaactatatgacctgtaaggaggaacatcatatagatattgtatgggtatggaggatggtacggataaccgaaaggatgagaaggaggagcgtcggtggtaggagcttcagtggtaggggaatgtgcgtcagtggtagaagatttcggaggaggaggatcatcgacgaatggttggtatgaatacacagaaggatgtgatatgaaaaatagagrttgtggactcgaaaatagggacgagcatgaacattctcttgttgatgatggacaggagaaagatcgtcaaagaagacatgtcccaaatcgatagaggtcttgcaacgttatagagttaataaacatataaaagtttaggctccaccttatattcatattgaaatagagagtgaaaagacgctaaatgaagaaggcgagtgaattagagagtgaggaggtaaatagacccaaacactatgttgttgttgttgttgccgttgctgctactttattttttcaccaaagatcatgtactccctctgttacaaattaaaattcgatttagtctttttaataaattcatataataattgatgtatgtattttatatatatgtagatttatcatcatccaattaaatacagatgtgatgatgaataatgcggttgattttagagtcgattgctcacgatggataaggtcgagacagattggaaccagactcttgagtcttgaccgcctcgcgcactgccgcacgtctgcaccgcatttgcccgcccacgcaggcctcaaataataaagccgctggagacgttataactgagcgagagagagctcacgagggcgctccggcctccactcttcgtctcttccagcccagcacgagagaaagcataggctgcgcggctctcctctgctttcgcgcaaccgagccggcaggaagcagtgaccgtcggggccccggcggccggctgcc

SEQ ID NO: 2312 - DNA, 367 bp, Zea mays
ggtatgccgtatcatatgttcggatgatagtctggttgacaagatcaagcggaaactagtcatgattgagatcattatccatgccatgatgtgccatcatatgcaacattcatccaaacagcctaaagctaagttttcatgtcaagcaggctagtctatcactgataactgataatgtaagtgtgctccaaaaaaacttgagcaagaccaatgtgattgtcgaaaaatagttcttaaaagcctgttctgtagggctagtgatctaggccttcttcaacccctctctgatgggcgttctattcagcggctctctctttatgcggatgatgtagtcctctttctcaagccatctgatggtgatctacaa

SEQ ID NO: 2313 - DNA, 592 bp, Zea mays
tgcatccaagttttccacttcccaaccacttacaagagctaggcattcaattctagacacatacaaagagatcaaatcctctccaattcatcacaaagccctagtgactagagagagtgatttgccgtgttcatttgagctcttgcgcttggattgcttcttttctttctcacttgttcttgagatcaaaactccattgtaatcaaggcaagaggcaccaattgtgtggtggcccttgcggggaagttttgttcccggctttgatttgagaagagaagctcactcgatccgtggatcgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctcttgtggactcgttccttattactaacgctaaccccggcttgtagttgtgtttatatttgtgaatttcagtttcgccctattcaccccccctctaggcgactatcaattggtatcagagcccggtgcttcattagagcctaaccgctcgaagtg

SEQ ID NO: 2314 - DNA, 1500 bp, Zea mays
aaggtgtcaattggagcatgcatatttaaagacacacggagggagtatacttttatcataacaatatagagattgcaggctatctatatgattattgtggcacgaaataactagtgggcaaactatacaaagtaaaagtaatatgtgttaattgtagacaataaacatacacaaaattctaatgatttggatttccgagattcttagaactcgtacgtgtagtgccaattattctcgtactgagtgaccaaaatggcatattccaacgcaagttcaacatggttatttagtaattttatcatggtattcaattagagtatcttaaagttgactagctatttataaaagatctcactatttatgacattaaataagtatggttagattcttatgagacatttcttaaatatacgtatctagtgtcataaatgtgaatatttgtatctatagaataggttaaactatagatattacaacaattaatacacctagaattgcatttattagaatggaggtaatgcacagagttgttgcaaatattgtgtatttattatctttgtatctgtatttaaattacatttatactcatatatgtatctatatctatcctatatctatatctatatctttaaatgtaaatgcatttttgtatttgcatatacatatctataaccataaccccactagaattctatcaccagatgcatgcaagtcatcgacgtgagcagagtgcattgaactatggtactacctatctatttatgcaagctatccacgtcatcatcaaactatattatctagtgccaaatattaatttgtccatatcagcacaccaaactatcaactaacactgtcaccagcaattttcttgaggagtaaaattgaacgcaaggagtatatcattaccttggggttgtaagaaagcacaaaggaaatttagtccaaataatcttcaaaataaatttatgttttcttgagtgctagcctaaactgccaaggtaatttcctatttctcattacaaaatcgctacggtaaccactcagttaattyctttggtatttggtcaaatgattttgtgagcagcagttttcaaggttcctctgaggggtacttgatcctagggatatatattcagttttctgctagtgacaaatataatattgttacaatccataatgctagtatcttcgatagctagctgccaagaagccgtgactttgtaaaatagtgcacgcagcatgagccgaaggccgaagcctctctattccgatcctcccatgatttgctccaaagccatgtgacccctacgaaagaaacgtcgggtgcaacggccgttgatggcgatcgcagccggccgctatgcgttccttcgattcacttcctgcctgcctataaataccacggcaaggttgctcttcctcggccatcgagacacacacagaacttctcctgtcggcctactaatacagctagctagctgccctcttaggtatactgtg

SEQ ID NO: 2315 - DNA, 522 bp, Zea mays
ggttttggagctccaaatttaaagggagaagggtgagagtgaggaacaaccaagaagagagtaacgagggatggacggagaagagaatgagagataggcagctccaaactctaaatgagattgatgtcgaaagggtctctagctgagttggttggtggtctaattagcactcctcaggttgttctgggttcgactccctatgagagcgaattttcaggttgtggttaaaaaaatcttcttgtctgtcccacgctaaagcacggggctaaggttcgatccgattgtggtcgttctagtgggaaaagggtttcagggttttctcgacctaagatcttcttaatgcaatgtctaggggctgtcttactccctgcacgttgagtttttttttactgcttgaactgcatcttgatagcagtactcagagttcatctacttgcagtgagtcaaggatgtgcatatcttgctagatattagtgaatgcaacctttggtttgacttagtttgaacgtctgtttgcaggtt

SEQ ID NO: 2316 - DNA, 582 bp, Zea mays
ggtgagaagcccatcaacttgggatcgaataagaaggatggaaagaagaagtgcatcaagaatgtcatctactacgagagtaacacatctacatcttcgacgacttcgcaaaaggacgactcttcttcttcttccaagcaaaaaaacagtcaataatacattcaaccacattccttttaattattcatgcatctctcattcctcaaatgtccagttgctttcgattcctgttagcaagcctcctcactttgatggggaggattactcttggtggagccacacaatgcgtagccatatttttttgctccatccttgcatttgggatattgtagaaaatggaataaatatatctgatgtagatgaatagaattataatgaggtagaagtagaggaactaatccatagaaatgcccaagctactaatgtcttattagcctctttatgcaaggaagagtataagaaggtaaatggattcgaaaatgccaaggaaatttgggatacgttgagaattgcactcgaggggaacttgatgaccaaaatctccaagtggaagtcattgagggtgaacttgggaggttcgca

SEQ ID NO: 2317 - DNA, 1500 bp, Zea mays
agaaggcccaccgtccggccgttcacttttttttatcgctggtccaaagtccaaacactatatccatgaagctaaaaaactcacgacccgctgaagcaacgtggggggagaccgggagagagagaggatgggtgctcaactgctcatggctcatgcacacgagtgcagtacctgattctgtcgtgatttgtggccgggccagctcgatcatgccgtccaccgtcccatatttcatggcacgatcggtcgcctcaatggatcgtgtggtggcctggggcagatgatcgaatgcatggtgggcatggtgccacccagcgtgccaagtggatcggtcgtaattagctccgcgaaaagttagggctaatacagccagggtgtggtcactggttaggcggcgttaatatatgctagatatcatggaaaggggggaattttttttaaagttagggccaatacagccagggtgtggtcatgtggatcgagcacgagtagaggcatgcccagcagcgagccgccttttgcctgggtgggtcggcgagacggcaaccgccgggcccccgccgacccgaacgcccctccaaactgcaactgccagaaacaacagaatcatgggcccggccgctgacgtctttccatgccgtcgttgtccccgtcgatcgatcccagggtccaccaacgccctcgtcgctgccgagacccccggcgccggataagggtcgcttgcggttgcggttgcgggcggccagccacgcgcccacgccatgtccgatgcggccgctgatccggccaaggaatcaattcgtccagtccatcctgatcctcgtgctacggtagtaggattagtcccaacacgatgattgttcaggctgtggcagattcacgtgctccaggctttggtaggactataagcagacgaggttgggttgggctagcttaccagccttcccggactttgcactcaagttagataaggccgcttacttacaattcggctctcgtcactcctctagttgcttcccagaaaaaaaaatatagatcctctggttgcatcttggtgcaaccgtgcagcggcgcgagccgggacgccggcgacgccatcacgtcaacgctttcgaaaccgtcgccgtcccaccctcccatgcatccatctccatggctccaggtccagtccaaggccaggcctccacggttcgctcaccttcccctccaaacccaaccaagccaagccaagccaagtctcgtccttcgcaatcccgcgccgtcctcgtatataaagtagccgcgttactaatcaattcgaattcccaacaccggcacgagcgccaaaacatttattgccttcaagtggagaggcttagcggcgcgaacgtcgaggagctttagcctccagggtaggctcctgctgatcggccaagcgcaaggttctcgttcttccaagcagacgtacagagagagagagagagagggtcgcgggggcggttgagggctcgtcgtcgaccc

SEQ ID NO: 2318 - DNA, 1078 bp, Zea mays
gatgattgcctttgaggtggactagatgatctactactctgtgggtctatttgttcccggtgtgaggagctatagcatgtttagagtcggtatgcagagatttcttttccgaacatacgagaaaagaagcgaaaatgcgaaaatgaaccgttattttttaactaccgatgcgagtaattattatggattttaataccacggtcgataaaaacagaaaggagctgcagtaaattttttgttcgctaaaattatttttagctgtggctgccaacctttttttacctggggtttgattttttaaaaggcaaagctgttggaaagcctatcaaccgccgccattgaccgtccgttccaaattccaacggccccgatgctcccctcccgagtgccgcccggtcagggccgccgcgtctccgtccctgctcataggggcccgcggcacgagcggtcccaccgacgcagtcacgggcgcggtcccgcttacatccgggccctggccaagtcccaaaggctcgcgagcggcacaccagcgaggagagaagccgcccgcgaagagagagagagagagagagggcgagaggggcggaggagagagaaacccctagtctccagccgcctcgcctccccccatcgccgcctcagcctccgcctcggcgcggggcgaggaggaggaggagagaggaagccctagaaggttcgcgccgcggacggcggcgcttgcgcctgcgccaggccacgagatctcgtggcagcgccgccggctggtgtatcggggtgcagcggctggcgggcgctgggcggtgctggttctcggtgagtccgctcgatcccctcgccgcgggagctttcgctcgagcttccccgccccctcgaatcgagggttctggttagggggtcgcctcctgctcccccggcgaccgcggaataagctagccccccctctcgtgtctcgcctcgggggggcttagggttaggttcttatccggaattgcgggcgaaattccacggccaaggcggcgcattgctacccgggaggaggaggctacgcagtgtgtctccgcagccgcagccagcaatg

SEQ ID NO: 2319 - DNA, 1090 bp, Zea mays
attaaaaagtatatttttagtccctgggttataattaactattggtggactacaggttcatttcaactaattcaagggtctcttatgcaaaaagactgctgttagcgtcgcgctggttgagcgcttactagtacagatggtagttggagttggattacacatcgggattaaaaaagggactgtgctgctggtgcgtgcatggcgatggcctccgtgacaactgacaacagatcggcgatgtgagttacgttagccaacatgaagctcgactggtgcatattggggctggaggattgccgggacggccggatgggagtgcatgatcggcagcaagggggtgctttcaacggcgatatgtactccggcgagcaatttgcatgtgctccatgtgtggcttgaccagggaacgggtgtgtggggttgggtacctgctcatgcacgtcctagtgtcgagcaggaaccgagaatatgagtgagggccaggtcaatggcggcgggtgcatggcggggtcgggttgacgtggtcctagcggtagacgctggcagagttccagggaagacttatcgtaggtcccacataggggtggatatcgagccagctcgactcgttatgcctcagcttgttatgtctcgttaacatgcctcagcttcttgaagacaaaggacctaacatgcaaaacactagaagattctatgcaatgttagaaaagacacacatgcgtctcccatggaatttgatgaatgataagaggttcgattatgattgcctggaattgatatgttgattcccaccatcgtctgtgtgcgatgcttaaaaccatggaagccaacgaacaaagtttgaaattcccacaaacaagtagagaagagcatatcattctgaaaggtgagcagataaaaatgtgccgaaactgtgttgaaaacgagaatcacatgtatgcacacagtttcctgagcatcttctaggacactataaaatagcccaagaccttgtgatttgctcaagccatattgatggcctgatagctttcgtaggtgctagctactaccatataccatatactctcacacaaagattagtacagctagc

SEQ ID NO: 2320 - DNA, 1100 bp, Zea mays
ggggttggcccataacgttgcatgtgcattgtgtggccaaactttagagtcgggtttgcatctcttcgttgagtatcgtttaattaggcggatttgggaagacgtggctgcatggacaacggtggagggtgttattccaagtaactgggaccacagtgagtatgtcctacaatagtggacgtcccagctacaactcaagattgcaacaggaagggcttgataagccttttaattctagtgaactagtctgtctggcgtgagagaaatgctaggatgtttgaccacaagtcctccacatgtgctcagattctcgcatctattagatatgaggcatcgacttggatacatgcaggatccaaacagctagctattctcctagcctctcgttagttttgcgtttgtgcttggcttttctccgagcctatttttagtttagttttgtgtgtttgtgcttggacttggtcctgctgtcgtgggatgttgctgttcattaaacctcgcccctctgggttttgtaaaaaataatctcaataagctccttttgaggagattatgagattatcataattttggcttcaaattatataatatataattgtttgtttgctacctagattatttacactagattatataatctacacggattataatccgaaactaaacatggcctaaattgctgctaaaactattttttgcaccatatttaatgtggcatcgattgctgctacagtgaatttacaacatactatatatttacaggggaagaaaatcattaacttctaacaaaaaaacgaatgcaccatattatatttatacccaaattattatttacaaaaatacaacagggttaatttgcatatctttatagcacaaataataaactaattaaagtcctctagctagggggcttggctagccgccccgcctctctataaatatcgaacgcatcagctctgttgttctataagcagccatccacacacacacactgacacacacaaagccattagccatgtcgttcaacaaaaacctagcagtggtcgttggcttcaccttggctctgctcatcgcgtcgaacggtgaagaaacttcctcgt

SEQ ID NO: 2321 - DNA, 76 bp, Zea mays
tcatgggcatgtgcatgcgcaggcgggtaggagcacggtggtcgtgaggagccggcgtcggcgtggcgggaggagg

SEQ ID NO: 2322 - DNA, 810 bp, Zea mays
ctgcagcttttctgtttcctctatttatacagagctgaatgttacattcaagtatggtatataataatctcctaattaatgcattcaatgtctttatgatctgtccgttattatgtataagctgaattctaggtagcactgatagcaaaaaacctagacacttggtgaacctggacgcgtccatgcatgaacaagattattgctaacagtattgtctgggccagccccatctcttctccttcacccttctctttttactactacaacaacaaagctattcagtcctaaacaagccatttgacttttctcctcattttctttctcctttctctttctcctttctcttcctcctccctgtttctgctttgctgtttcttatgatgtgtatggtgtcacgtaggcatttgttaccatttcttgccttgctaaccttaagaacattggtacttcattggtttgttacctttctagtagctcttaaatattcttcatgaaaacatattagtttctgcgttaatgtgatttgcaaacttatctgctgtttaaattgtagaccatataagttgctatcctatctgctgacgaggtcggtcatgcattgggctagcttccatgttcattttgatccttttcaagcatcatttgtaattcttaaaggttgaacctatgctgtgattttttatttcaaaagtatagtgatctattagcagtttgatttcatgtgattcatctttctaatgttcttgatagtgattttctcgatgaaataattggttcatgatgtttttggtcatatccaggtagctgcta

SEQ ID NO: 2323 - DNA, 151 bp, Zea mays
gatgtgttaatcttttctggctgcgcaaaaytgcaaacctgttggtacatgtttcccctcctgttccatgttgcaccagtccaataactgtctctctgtaatataaacatctacgtccggataaacatgtagtttcgtctgtattactgat

SEQ ID NO: 2324 - DNA, 47 bp, Zea mays
tttcctttgtacaactacgccaagaccacacggctgcgccaacgacc

SEQ ID NO: 2325 - DNA, 610 bp, Zea mays
gtggccagaagatgcgaaaagccgaaacaaacagggacactatcgagccgagccactcgtttccagccctagctgccaccaagacacaatcatggattctggtataagaatttgtttcattaagagtagtggagagacttagggtctgtttggttgggttgtggctgtgaaaaaagttattgtaggctgtgagctatggaaaaagctgttgtaggttgtaagccgttaaaaagctaaaaaactgtttgataaaaaccattaaaagtcgttaaaagttcttcgatacatgttttcacagttctatccgaaaagccactaaaagcaggttcaggggttgcaccgtgagaaactcatcttttagaaaaaactgcttttagatacaaccctttggttgacttttaacttttaagagacaaaagccaaaaccagaagtcaaaccaaacacactctaacatcaagtaaattgacatcaaggcaccctaggataacttcatcatcaagtcaattctgaactactgccgcgagctcgcaatcacatctgcctcgttctcacttcctacccgctggccgcttgccggtaccacacacgcggcacgccgccgcgccagcc

SEQ ID NO: 2326 - DNA, 1278 bp, Zea mays
atcaaaatcacctttaaaattgactcaagaaattatttagacgattttcaatagtttgaggtttttttcgacggttttataggtgggagtgaaatagacaaccatccatagtcgagggtgctaaatagatttttttttcttttttacatacatagtccaagaaaataaaagcaagaagggttggatgagaacagtgctgtgctgacactataattctcggaccacagagttgttgccctgctactgccctgaatctttggtaaagaatcaacataggtggagatatataatgcaaaacaaaaaaaaaaagaaaaacagcagagtttaatgaaggctcagtgttcaagggacatgatctgtaactggcagagtagatttgcaccagcagcaaaaatgtatacacggttttatcaaaatcctccaaccatcgagagacttgatatatctggatagccttcagtaaaccaggcatctggagtttagtacaagcacataactgatggcttaaacttcgtgcagctctggtggcaacactgcaagtctgcagactactgcagcattagatgaacagatctgctttatactaaaaaaaatatgcagcacattgctgaggcttgtcatcttgtatctgagctgttatcatgtaaggttttcataccatactagcttgagcctgcaagacatgctcacgccctgttaatagaactggaagaattttgtaggagtagaataaaaagcatctgttcgtcattttcttcttcagacaacaaaattctttactcttaacaagaaaacttacaatgtgcatggttcatactcttgaagcactccgcacattagaagcatcacttgctttagacctgttcatgatattatagtgttccggcattccaattagcagagtggtggtgacctgtggaaattatttcacatattgggtcctggttcgtatcggtggccttagagcacatctttagtagtcatttttgtagaggaaaacccagattttatagaaagcttgtaacaatacaattggtagtcattttaggtgctgttacttttcgtgcctgctttccatcactttttttttcatgaacttctcatgctgagttgctggctacacccaactactgcaggtacagagccgtgacaagtgcttattacagaggcgcactgggagctttgctggtctacgacatcaccagacggcagagcttcgatcacataccccgctggctagatgagctccgagcccatgctgacaagaacattgtgata

SEQ ID NO: 2327 - DNA, 276 bp, Zea mays
tgtgtggctgcctggctggcagccaaacgctgtttcttttgttgtcttctcccactgcccgtgtccccagctcccaagccagtcccagactcccagtcacaaaccccaaacccctcacttgtcatcgacctgcgctttgcatccgtttcttcctccgccttcccttccctttgcagtcttgcactccactacccctcgccgcaccgctctcctctcttgacgcaaacctttccacactgctaattaatcgccatttcctcggaggatccggaggca

SEQ ID NO: 2328 - DNA, 184 bp, Zea mays
ggtctgctttgtgcaaactggcccgtagaggagtaccaaattggcgttcattgctgcaaatgttcgttacttaatgcctctagctgataatataaaattctgtccatgttgtttgtttgtgagcaggcaacttttggggaactacacgtgtatggagttttattagtattccaggggcgtcaca

SEQ ID NO: 2329 - DNA, 909 bp, Zea mays
ggggggaggcggggagctcaaaaggtttccacatttcgctgtattgttgtgcgtttgcgcttggctaaactttttgaggctacagatcgattgagagaataagacgtcataagtacgcagtttttggttcacccggcttctttctaagtgcacttgggaagttgggattgggtccagacttttgatgagcttgccgtggatgcctttttttatgggctattggggacggcgtccctttcttgtttgtttctgtttgttgagagagagagagaggattgaaggagggcttcgaaagcaaagaacctttgcactggagagatctttgctgctatcagatgcacgcagcaatatgcttcgctatcctcaggaaacctcctctcctaggatcgaaatatcctcgctttctcttgagaactcctacgatcaccgggagcacataatagttccagagatcttgctgctccatctgcccagagatcttgctgctccatctgcccagatcccagcacgttcgatatcttcatgaccctcccatgatcttttttacccccactgaagaattcccatgacccaaccacgcctcgagcctcggcatctttcggttactaccattaccagacggccataagctggggccttgggggggccaagaacccgcaccagtgactgtcatcagtccacagccagcgtaactaaccaagcgcctccaaccaactcgccccggggaacaaggaccatcgccacccccagttgcgttcgagattcctcagccgccccgccctttataagccaccgcaaccgcgaaccccggacgcaaccgcagcagggcgttgggcgagtgagtgagtcagtgaggctgggatagcagcagcagtgcgccgcactcaacttctcttcttgccgtgcgga

SEQ ID NO: 2330 - DNA, 1500 bp, Zea mays
agggcaattttgtagatgtctcgagagtgtaaaaaacatgcactgtagttctctttttacctgtaarataagattgtatgcagtatgcactatttgagttgtaacgggataagttcacgaaagtatatttttttatttgatgtgtcttgattgggaaaaggttatgtctggtgcagtggtgagaactcactgagtcactaggtcgcgggttcgaagcagtctctcggcatttgcgggggaagaattgccttcccttttccagaccctactcatatgggcgccgagccatcagcaattggtctgcccttttgatgtgtcttgattgggaaataattgcaataagaaaagctgtgcataagaaatttctttgatgtctctttgttggactatatactctggtgaatgaaactgaattgtttgtgatgaaatatttggtttgcactttgccgtataaaaaatattcacgtgtccgctacattcagctgtctgctacattgatgccgttaaagaagatgcaaccagcagtcctaattaaagagagaaaatataataaaaaggacaaactgagtgccagtggctcccacatgagtctggtttaagtaagaaataaccgaggttacccctgtatttttgcagagaggctgcgtcgaatccaagacctttggctcagtgggaagacttctcaccactgcatcaggtctgtcctggaaaatacaataaaacaaaatacaatcaattaagcaacagaactaataaatgaaaatgcattgccaaaacaaatgtgtgtgcacatttgacatttgttccattttgcgcttggcactattacattgtgtatggctattgttgagtccgaacaaatgtccccatggattttgcatatccctgtttcctccaacctgatctactacagttactccattgcatggtagatggtctcctgattgtgctgggctgctggccatggtcctgacttagatactgcaccatctttttttccctgcatattctagtcttgcttagcagtatttaatcttgcctagcagtttcttaattggtaaagttcttctattaagggctagggtcattgtgtttgtagacaccggctggtttattttggtgcgtgaagaattttggaccccactgccaagtttttgaacaaccaacagttgccatgtggtagggagcatayctgtggagttggctagccacattctgccaatgggatgttcatagttgataatttttaaattagcttgaagtgttctctacctacaaacccctttacagttttgaaattttgtttgaatatttagaatctagggactttagagggtaagtttattgctgtagaactatgttctttgattaattataactacatacatattagtacttggctatttcagagattcagaagaacttttgcaagaagggaggtcttgtactttggaactactcgatagccatatttttagaggttagcaaaaggagatcaga

SEQ ID NO: 2331 - DNA, 776 bp, Zea mays
cctatttataggcacaggaattatgaattgattgtactcttttttccaatggagtgggggacctagaaaatttcaaaagcctaggcatttgctttgcgagctagaccttggcaatttttacccacatcaacctgtattttgctcttgaatacgtgtacttatacagaacatacaatcgaggagcccgaacarctgggcttgagtccgtcactgtttttttcctttctagagtttctcatgagtgagttttacctaataagattttaataagataatattgcacaaaacaacttatttatcatattttatcatatctgttgtgtattgaactatagttttaccataatttggaggtcttgaattttttgtcgggctaaagattgacctggcccttttttttttgccgtgcttagtgggccgatctggcgcgaaccagcctgtagagctgtgccagggacgaaggctggaccacgtaaggacgcctatgaagcactgcgtgccgtgtcggaccggcctgttggccatcaggcatttttgatagttttgagagtccgcgtcaccaccgagacggacacgacacgacacgacccacgcaaaaagcacccacacaggtagtcaggcacacagctcctctgcgttacctttccccgtcggccggtttcatttacctcctcaatcctggcttgaatctgtgacccgtcgaggcggcgaagggccgaatcgcaccgcagaccgcactgtagggagaagcttctgcaaggttttggagcgggctg

SEQ ID NO: 2332 - DNA, 79 bp, Zea mays
ttgctgctcctcctcaacaccttgacctttcccatgtccttgctggtcctctccaaggtacctaatcatcaaaacatcc

SEQ ID NO: 2333 - DNA, 820 bp, Zea mays
gttttgttagtttcatgttgattggacaataatttgtaccgagtaggaggacgtaagataggacggctccttcaatctctgttgcgtctagaggcttactatttgcaccacgaggaatccaagctaagggcgatgaaaaagtgaatatctcatttgtgtatctttacctccatgctcatatctcagttacctatcttttatgtaataccagaagttaaatcgatatatatgatagaacattctaacctgtatttgtgttgacctcttaggacactttttctatcgagtagttgggtgacccaacattacttgcgtcactactttatagtttatattctgaaaaaaaactgtcacgtcagtgacttcacttgtgcaagatgttaaaaggaaaccgaacattcaggcaaatatttatgatcttttatcccatacaaatatgctagacccagcggaatccgcaagggcatgctgcaacgttaacccatcaagggaaacctggtccgatgaagccaaaaaaaaccctggaatttaggcacgttacacatcttgtccaaaaacataattcatataacctggggtcaacacaataaagagccgaagattgaagttacccttcttcgccatcgctcacgccctctattgtgtagtctagtgcttaggctttactaacgctaagcagcatgaagctaaagcatcagatgcatcaagaataggtggaagcgtgaacgggggcagaacaccacatttctcatgcacggccatcgcggcagtccctccaagcgtgcgagccattgcagcctgctgcttattgagcccctcc

SEQ ID NO: 2334 - DNA, 186 bp, Zea mays
ggtgaagcaagactgcaagaattgagaaataaacaccgaccatctttatctcctcaatggaacagagagcaaaaggtcttcgtgtctggagggacacgaacaggcttgcatctaggctatataatttgaagcgtgacactaaatcattggtgtcgttatttcaagaacagtcaaatgatttgacag

SEQ ID NO: 2335 - DNA, 547 bp, Zea mays
ttgaataaagtttgagttaaacttataaatttttttattacaaataattattttattatttaattttggaacttaatgtttatatacactgatttaccttaacaaatacttttataaaaatataaatgtatcaagagtttatttgtattttatcaaataacatcgatcaaagttatatttagaagattgtgtcgttattctaaatgataactaataggataccagagagagtactattttaagacagagagactgtatgactaactttcagttgtttatgacagcatcttaaaattcaaaacacaaacaaacaaattagttcggtcggttcggtccaaatggccaagtcgcaacttggtggcatatggcaattggcaaggcccggttcggtcgggccctgcctccgtccgatttgataagccgcagagtttcccactgttcgagctccgcccgcccgttctaaaaccctagatctctctcccctcacccccgtccctcgacccgccgccgagtcgccggaggaggcgggggcctcgccgcagaagcc

SEQ ID NO: 2336 - DNA, 1376 bp, Zea mays
actattatttttcttcatactataaagtactccatcaatcaagtttcttttctcagaaagctgaaactgcaggatggtgtaatgattatggaatagtgagggttccaaggtcgatcgccgttgtcatcattattaaagcttgcttgctctccctccctctctctctgtgaataaagttctgccaaagtggaggtaactttatggagtagtagaacaatagactagcatttgagctgtgatagaaaattggctaatcggaagtgtgaagaaaagtgggaggacaagctaggcaaatggctgtaaggacaaagtaaactttcctaaagtactgctgataaagtgataaaaaggaatgctggctatcttgttggtcccaaaactgacatatcatttcagattgaactgatgattgctgaattactatggtcgtacctgcattttgtcgattttattttgatttggtccaaaggtgactatagtttggatggtccccttatcataacctcctacttttccaccccaacatttcctccagtttagaaacactatatacttatacaacgaaaccaggctgctaatagctgtttcccgttctcatgcttttttttatgtactccctccgtacataaatatatgacaccgttgacttttttaaaaaaaaactttgaccactcattttattttaaaaaaaatgagttatagtttattttgttatgatttgttttatcacttacggttgtttgagtgtgacttaaaattttacattttcaaataaatatgttcaataaaacgaatggtcaaagttttgaaaaaaaagtcaacagcatcatatatttatttgtgaactgaggtagtatattattttgtcctgtggtacgaatcgtcatttatgccatgcttggggcaataaaaaaaaactaccttaatttagcatgactgctagaactttttcagttatgaaccaatgataaatatgcgatttttcttgctgggctttatctgtgtcgctaatgctaaattcttccttgtttcctacaggttgccacgtatcaagatcctcgagatgcctgctcagcaatcgctgcagagtcatacaaactatggctggagcacgaaaataggacagatgatataacgataatcattgtgcatatctgagacatggaaagtgtaggtgcaccaaaattttaagttctgcaagcataaacagaagtaacttattcagtgactggctgaaaatttgttgttcttcccaaaatttactgtcaggccctgcagggagtgacaaagcggactacggtagcgtgggagcgtcaatagctgtgcacacaatacagtcagaggtacctgtatttgtagaatcagaagcaagtcac

SEQ ID NO: 2337 - DNA, 1500 bp, Zea mays
gccgagtcggaggcgttgaaagcggactggcaccccgcgggatgcgctgcggcgaacaaaaccgtgtggccgagctctgtggcttctcgctaccgcccgcaaattgagatagccgacggcgatttgaaatcaggccaccgagtgtactgatcgcgaaaaagaagaaccagtgggcgccggatatgatatgactatatgagaacagaacagaggaaaatcgcgtcaaaagggacagcgggggagcgcgtcccgatcgtgcggccacgctttccttttttttctgccgccgtccagcgctggtctggtcctctttgccgagtcgccgactattcaattcggacgcattttctccgcttcaaggtttggggttcgcttgctccgctttgattgacaccaacgatacgcaaccggacacttggtactcttttttttaatccctgaacctttttcttcttctttggttcaaatcgaaaagaattaaaatcgaagcaaggatcggttagttcggggattgaaacgcgttgagacgtcggcacagcacaagcacaatcacacgagctctcgcgcggggacgcagcatgtcggcgaagtagcggcggtcggcggcagcccgggcacgcgcgcgggcgcatggggcggacaccaagagctgctccgatccgaagcagggtatcagactagctccaacaagggaccctaaagagttctgtaccctaaatatagaggatcgaatggtcctctacgccctccagcagcgtcctctaaacggttctctaaatttagaggacgctgctggattctctatatatagagagtttctctatacgattatctatccatttgaatactttaaataaccggtttagcagaactaaaatatgtacaatacatttgagagtatgacaaatacgtatgtacaaaaaataaaaataaaaaatatttctaatatagatatttgagtatagaggacgtgatttagaggacgttgttggagaggaaggagatatagagggtggaatcttttagaggagactgtaaaggacggatatagaggatgaatatagaggacgttgctggagacagcctaatacatgagtaatttccctcaaagttgtatataaactatcgttagagttcattccaagataaaaatagaggtattaggatattcatgagctaaaattgagcgagatcggtcatggccacataaaaacagcatgaccttttcatctccactgatggtgtgcgtgatcatggtcacatgaaatttcactttgtaaccagtgtattctaaaataatatatgcacatatgataaatggttcagctttgaaaatatttttatgcactgttatttttagaaaatacttttaaaattaaagcgttgaaataaaaaaaaatcttcgagccaaaggccggcgtacagcgtacttgcgtacatagagccgagcgctgtgcgggtgcggctcgccgttcgccatccgagccaacgacgaacccg

SEQ ID NO: 2338 - DNA, 738 bp, Zea mays
gctcatggtgtttgttcggagttccaagtaagaaacatggattcatgcttggcgttggtttatgaaaatgactcacaggtctgatccatggaaaaaatattacgaagaaaaaatgtcacatatgcaaaaaagggaattttaagtataatacattattcaaacaaaagaaattgcatgcaaagctcttctttaaataatattacctccatctaaaaatctaattcaagaatcttggtgatacttatctactactacgcattgtgcaagggtagcaagtgagcttggtgagagatgtagtagatgtgttttctgtcatagatgtagacataaacacacatgtggtgtagctgtagctactcttggcctttgcttgagaggtcacgggttcaaatccccttgaggacatgtgtgtttttttaattttagctagacgtgggttgtacgggggaatgagaatgggaatggactttgcggggagggggaatgagaaagacagaccaaagaatgagaatgacagaacatagaatgatgactattaactctattgcattcaaacacactctaagtagtacacgggtattttttgcgaactatttagtatctacacgggttgtaaatttaacgtggagttctttgtgcagaattaatgtaaaataatgaagaaaaaagagagtggatagggcacgcgaggaggatcgctgcgatcgagcgcactaaatttcgaaggggcatacaaag

SEQ ID NO: 2339 - DNA, 1500 bp, Zea mays
gccgcgcgtggtagctgataggcgaggcgtttttcgatgggcaggacgggaacggttcgtaagtttcgaatcggatcccgggtggttttgatgcgggcaaccagggtcttgagtatcagtaagcaaccgtaagtaggatttaattagggtttctttggtagcaccacccagggtttgagtatccgcaggaatttaaccaggatttagttagggtttgcttggtaacaccacccagattcggtggtcatacgatattggtttgtgactggtttagtgaatttttgaactgtgcatctacaacagatttgctgtatatttgcgttcgagctctgtttgaataggtatttttggtgatcctaaacgttcacctatatgctaggttgtggtatcattttagtttacgtcagattaataattttttgaactgttggtatagatttgttgcttattcgagttttagctctgtctggataggtagtaacaatttggatcctgtaatatatatgtgcttgcctgctgctatttatgtgtggtttatattggtaggcatatttgcattctagctctgtttggatatggatttagtttattattgctgtctgggtttattatttctaatagcttatcttatcttaatatctggggcaatgatgctgtatagtttgccaaccagttgtagtcttaaggacaataatcgcctatttgctagttctgtttatatatgctggtatggttttctgtatttagtatttccttatgcacatgggatgcaatgacttggactgttggttgggaattgtttcccagctgttaatttattgtttcctttgctggtgagctatcaaactaaacatgcattcatccaggaaattcattattgtaaatcgatacaataatatgttgaatgatggatctccatgtatactttgaaccaaattttattctcttccaaagttttttggaagtatttggtagttacatggaagtttggttcttggtgacagaataatcatttgtgtttagtttcctgtcagtttacgtgattgaattgcacctcagttcacattactagctattctgtcatacaaccaatgcaatatgctgcccttcctacaagggaaccttcaggttggacaccattcacattggtactgtctgatcacttcctgacattcaattctctgtttgtgctgtatgtaccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttgattgtggactttgtcgcatctgatatcaacttcataaatctttatccaag

SEQ ID NO: 2340 - DNA, 322 bp, Zea mays
aggtagaagggagtgaaccttggagttaggtgtttgaataacagggatgaattccctgtgcttttgtgtagtaaggtcttagggaaacagggaatcagtttgttcttttggttaatgggctgctgtaaatgtgttccctgtccttttgtgtccagtaccagtttatttaaggttgtcgttgtgtaattaagcaaattggaatcttagtacttatggtattacctgaaggtaatatggctagtatattgttcatcttttatgctggttttaatccgagagcactactacgtatgttgaaaactatatacttgttatgcactag

SEQ ID NO: 2341 - DNA, 113 bp, Zea mays
aaaaaaaagagcagggatttctgatcagcccagccccgaaaaaatgctcaggtttacttttaattccctaacatgttgaccatgtgtttgtgttaatgtaaatatattaggtt

SEQ ID NO: 2342 - DNA, 468 bp, Zea mays
gtttactgtagtgtagaggcggtaatggactctatattttacactacaaaaattgaagcatcgaattggattaggaggatggtaacaaccaagaaatcacaaaaaaaatggtaatataattaatgacgcaaatcaatgagtgagcaggctgcgcgcgggacatatctagtgatctagctatatatatacaaatggagcaagcgaccgaagcaagagatcgaggctcctatctggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctgcaaggccgaggactcagcgtgggagctgaagaagaagttcggcaacggcgtgagcacc

SEQ ID NO: 2343 - DNA, 117 bp, Zea mays
cgtcaagggcgccgctgactgggcgcgcgctacgacgtcgcgcttggcgtcgcgcacgccgtggcgtacctccaccacgactgcctgccggccatcctgcacggcgacatcaaggcc

SEQ ID NO: 2344 - DNA, 775 bp, Zea mays
caggcctatgaaaagaatcagatgcttctcatgattgttgaacagaaaatcgaccactctggaaataggctaagattctccttcccctcgtttgctctttacgtcattatctgcatccagtttgcactggctactctttagctccagtttgcccaagattctttttctctaaaaaaaggtggtttagcttagtaattcagcaagcatatattttgtttccctactgacacatgacaaagtattactcaatggacaacctctagtgcatatggacaaacatgggccatcttgaggatcacttaagctgcaaggaattttagccaaaataatcatttgcgacaacatcctttttatcccatcttgaaataatcagtttgtcattggtttatctgaagctagtcataaactgttgatcaccaatctgcacaccagtaggcaaaccaatgagtgcaactgcgacttaaaccactgggatcccccctccaagttttgtgcatgaacacatctcataaagttgcttttctctacccttgaacacaaagcatgtttcatatcttcatcatggatccatgcatcggtgttcctgccttacctaacctgccatgttcacagaagagtcgtgattacatatttggatcagggcatcttattcttattagaggcattcacacacaagtgcttactagaatgagctggcgtgttgtctgcatgcaggtacggtgagacagcagagaaatcaagtgacgggtgaaaagattgttgccatcagtcaggg

SEQ ID NO: 2345 - DNA, 157 bp, Zea mays
aaggtaaggtcgtcgctactcagggtcgattctgtgacacatgcgagggcgaggattcactttggtttgccggaattgtggcctaattgttggatttgttttctattattacgtttcccttcttctgggatacctgttttaggcggctcaggatgcg

SEQ ID NO: 2346 - DNA, 267 bp, Zea mays
cctagtgattgcgaggatataaacgcgctagaattcagctgcggacacttcttgtcagatgtctggcggcagattggtagttcagtcttattaataaaataaaacaaaaaagagatgagtcatggctgcaatccataaacacaaactgagaatgtactctaatgtttatctagagaaagcctgaaactttttctgcgaacatttctgcttgaattggtttgagttctatactgaactttcctcatgagctgcagattcagagacacg

SEQ ID NO: 2347 - DNA, 1500 bp, Zea mays
ttctctctccaaacattaatatttttagctttaattgaatgaacttagagtcatctaagaataggcttattatatgacaagagcatagaaccgttagttagttcttctattaaccttgctctaaaaaacaacatggtacaatgaggtgtctttaaaatcagttacaccataaatgtagttaagagacaaaatatatgaaaagtcgtgcaaggacagtcttttcacgaagtgtgtgtctcttgtatttttttttatttatcctatagagaaccttcaagagatgtgattttaaatagggctatacatgcccttacatggtgacgtaagcaagctggacggaagttaagacgatagaggggatgtgaactagtagtttgtagcgggctgaaacatgggcttcatgaagctttttgagagaaataagtgggtcaaatattcattgcacattatatactaacactaatttattatatgagtgctatatatgacatgattgttggggcgaaggcaaagacgccacccttcgctcgaagccttcgctgcagccgctggtccgacagagacaaagcgggcagggacacccttcgcaggactcggcactttgacgaaggcctgcggcgacgtcctcccacggcgcgtcctcgttcagtcccaaggcccacgtgtgatctggcccattgtaacgggccccgcgtggccgcctctgtattacgggcctaacttgtaaaggaatacttgtaattacagtttgtaaccctgctttatgggaatattctggggataaaataggtgtctgagggcacatgcgtccttaacacaagacgctgggcactcagatacctataaatacccccgcacagtgcccgtgagaggctagatcaacagagctattgcccccgtgcacgtaaccctgttgtcaccaccgttcacccttgttggctttcttgctgctgagagcgagttccaacactcgtttatatttctaacgctaacccggcttgtagttgtgtttaagtttataaatttcagattcgccctattcacccccctctaggcgactttcacctataaatagatgaacagtaacaccgactgttcacgctaacttgtaatcactcgcacgtcactcttggattcttaccttctgtcaagctgaagatacaaatgtaattcaatatctttaatgtttgttcatgatcatatattgagagtattgataatctgatgatttgatattatcattcgtgttttttatatgtcccacatgttcccgctttctattattacatattgagatgatgaaggtttgtccttcaaaaccttcgtttgaagatcattatatccaaagggagataatgctccgaaggacaaaggtcttttaaccattaacatttgtgttgccttgttcttaactcatagcatttgagaacaagtaaccaacattagcgcccacctccggtgaactcatttgaccatctttggcaagctgtgaccttcgtc

SEQ ID NO: 2348 - DNA, 106 bp, Zea mays
gcttctctctctgttttttaatcttttctttctaacttgtatgcctgatatgtttccactgctcccgtatttcctccaaataggattttcggcctagaggttcccc

SEQ ID NO: 2349 - DNA, 341 bp, Zea mays
agtagtagctggtcaaatccttggatgccaagaagaagaagaagagtagccttgtctagcaagaagaagatagagggatgatgtgattatacgcaaaatactaaaacctagggtggtagtacaagcagtagttatgagcaggcctcttctctctctttcctgttccgttctttttctttttccctgcggaattccccgtcttccctagtgcctcgcttcgatatttcgattggattggattaccaagggacagagggagggaatcccacacacacctctggccctcgcgaggccaagggaagggaagcactcagcactcagcagcagaaggaccgccgtaa

SEQ ID NO: 2350 - DNA, 1241 bp, Zea mays
gaaagcaaaagtcaaggtgttaattctatcatgaagcccttttcagaataattatactagggaccttgagttctttggatttcaaaattgggttaattctattgctctaaccaccttgtcttatttttcagtctttttaacctgtcctcgaagaaaacattgacttccaacgttagagatgaccaaggtcttgaaatgttcaaaaagccaaacaaggaggtgagaagtttttttccttttgtgctgctggtccactacatgtgagtcttcagtggctaacaatattatttgttttgtcactatcctaaatgtttctatatacattactggtaaactgagtttaactgtataaaatagctttatcttttcacagaaaagccctataacaaaggttgaactgatgacattacatatttacattatacaaagagtagtctcatgctgaaaactggtgtacacctaattatgggttatggaattgtcatttccagctttgccctcaagtctagaaccttccatgcatgggatctcttgatagtactagacatggttatatgacggctgcaagtaactggctggtaaacatgaactgtctagttatgcctctcaaaactctgacctttgttagaaaataaacaatgacatgtagtgtccatggtgtgtgtatctgtgtaccactctgtgtgcatggctgcatgcagacaagctggtctaggctgattggtgatagtttggaaagagtccaggctgataggtgctagttagaaagtagtccaagctgattggatggagtggtgtgcatagcgccaattcacatggtggaagccatgtcctctggatgagcaagtggatcacgatgattgttgcatgcatcccccggatcatggcgcgaaggccagcatgaaggcgagctccgtgtctataagtagccttatactccatgttttctttgcaagtccagtaaataaaatagccaagatataggcgagtttgttgttgcagcgttcgccgtcgaaaaatagtgtggctattgtgcttctacatcttgccaagagcattggcgtgtgtgtgtttgagtggttcctgggcgaagccatcaattggtatcaagttggagaagatgttgtcttcatcgaaaaagggcccgggctctgttgatgacgattcattgcgtcacgtcgttgtggagcacgccatttccaacatcggtagcaagaaaaaaagttctgaagctatcgaag

SEQ ID NO: 2351 - DNA, 323 bp, Zea mays
cctaccccctactccccttgtagagtagagtagcgtagcgtagcttgcccgacgccgcgacctccgggggcttggctttgggaaatggaccagccgctcactgcccccagtcagtggccgcgcgccgcaccaagtgagctagctactctctaggcggagtgaagcgaagctagcttagctgcctcgagcttgagctgagcttgctcactcttctcccctcttcttctagtaccggcacacacaccgcagctgcgaaaaaggaagctctctctctctggtggtgccggtgcgccgtgcttgcttgcttgcttgcggctgcatcc

SEQ ID NO: 2352 - DNA, 143 bp, Zea mays
cggtacccctgctgcaagtaggagtacgtagtaagcagccgtacataggtgataggttcagtcaatagttcagagagagggtagaggtacgtaggcatatatagaactatacaagaacggtagagacagacagggcaggggag

SEQ ID NO: 2353 - DNA, 1192 bp, Zea mays
agaaatgatctattttaaaatatgaaatttatcttaacaatttggatacctatttaatccatagcacaacatctttcagccaagtatatcttctatatatacaattttttctggaacagcaagctatagtatctaagaaagagaacatattctatatcgtgtcatgatcaaacttagtacacgcctgaaaagctgggtaggtgtgctgggtgcgcctaccacaaacccgcctcgttcaaaaattgaaaccggtgatgcgccagaaagcgatggagagagggaggaaaaccgggcaagagaaaggagttattttaatgggtacgaggaagggtgacgtggcagcagggaaaacttacagtatccggctcccaaaatgaccgttctacccctcaccgtccccacgatcatcgtgggccccgcagccacccccagatgctccgcttcccatgcgccgaatgacggaaacaaccctccctggctggcaagcgaccgcgcgaccgccgctttcccgcttctgccctccccgagaaaaatcacgaggttgcccttggagacctgatgcgacagtggtagacgcgtaaatatagtggctgctaggagggcgtcaccgtaattgctcgggttgtctgggttgctatatatgcagagactgctcgagggggctataaaacgcggtccgaaaaaccccgaaacgggtgaggagaaaacagagagcgagagaagttctcggagagagaaactaagcgagcgagataaaagaagcgaaacgcgggcagctgttgctgaggcgtggagacggaggcggcggcgcggccgaaccctagccgacggcggcgcgtttgaggcgggaccctctgcaggcgacgcctggcggccggattcgagctgccggcgtcggcagcttcagatcggcggtcgcgccgacggaatcggcggggatcccggcgggatgggcgcggcgaggcccgtgctctggtcgtgagtttgcttggttcgtgggttctggctctgggctcccgagcaaggttttgagctcggtgtagccgcttgcttgcttgctgagttgctgctgtcgctttttgggcggtttggagcgggtttttgcggggggtttgggagggatctgccgggaaggcccgaggtttaggccggtttttgagagctggaggctccggccgggatcgggggagcc

SEQ ID NO: 2354 - DNA, 60 bp, Zea mays
cgtttcctgccgctcctggctcctgcaccgagcggcaaacccgcgccgccgccgccgccg

SEQ ID NO: 2355 - DNA, 51 bp, Zea mays
gctgcttatctacaagcgggcatcctctgcaaagttgcaatggtctaaggg

SEQ ID NO: 2356 - DNA, 1216 bp, Zea mays
tacatgttctacaggtgcaaaaaagttcaactcaaaccaataaatattcaagttagggatcaaatacaaagcagaaaaagaaaccaaagtgtgctgagggacgacgcaccggactgtccgttatgccaccggacaatgttcggtgcgccaccggacagtgtatggtgtgccaggaccgtacagctcaaaccagccactctccggtttctccaggcgccctccgctacaattcaccggcctgtccggtgtgccaccggactgtccggtgtgccaccgaaatgtccggtgcaccagcgagcaacggctatccagcgcaacggtcgactgcaacggctatccagcgcaatggtcgactgcaacggcgccctgacagcactacagtgaagaatagtgcgcgacagaatcagagcgcagagtcagaggcgcaccggacagtgaataggacctgtccggtgccgcatgaggacaatgcctccaacggttgactaagtcaaaaacctaacggttgggtgacgtggcggcgcaccggacagtgtccggtggcacaccgaaccgacaacagccttccccaacgacttgttggtggttaagggctataaataccccccaaccaccacaactccaagcatccaagttttctgaagttcccattcaatacaagagctagtgcattcactcctagacacaaatcaaaagatcaaagcctctccaagtcccccaaatcattccaaccacctagtgacttgagagagtgtttgttcgtgttctttgtgctcttgttgcttggatcgctttcttccttcctcattcttgtttccaagagacttgtaatcaaagcaagagacaccaagtgtgtggtggtccttgcggggtctaagtgacccgtttgattaaggagaaagctcactcggtataagtgactgtttgagagagggaaagggttgaaagagacccagtctttgtgaccacctcaacggggactaggttctttataaccgaacctcggtaaaacaaatcaccgtgttcttccgctttattttttggttgatttattttcccctctctaccggactcggatttaattctaacgctaaccccggctcgtagcttgtgttttaagttgtaaatttcagattacgcctattcaccccccattaggcgactttcaattggtatcagagcctggtgcttcattagagtctaacaactcgaagtg

SEQ ID NO: 2357 - DNA, 103 bp, Zea mays
aaccccttagatttgcgtctgttattctgtttcttttgctgttatcttgttaacttttctttgttttcatttctctggttgttggtttctatgtttaccgtta

SEQ ID NO: 2358 - DNA, 1500 bp, Zea mays
tttgcaaactttagagatactctaacgatggatgagttttctaaggctttgtagactaagaaaaagatgaaacatacgatatttttgaagattctacttctaatagagaggcattgtttcttcatggatggatataaaataaatcaaacaataacaatagatgtaaaagttctaatggctataaagggcgtacaaaatctcgaagcaagggagataaattatataagtattgccacaaacaatcattttatatataagtgttataaattaaagaacaaagagaaaagagctaacayatatagagagagaaaggtaaatccaatgataaaggtaatgcttgtgttcatgtttctgatgcagataattctgacggtgagacacttgttgcttttgctggataagggttcttgatcgcaccgattcgttctatatttcatctccatctatttyaaacatttttattgattacatagatgcaaatrtttaatcgatatggtagcctataaatgtgaaactttgtatggcgatcatatgcagaggtggacccaaaagggtattatgggtaggccccccgactatccctgtaatttgctcaaaaaacaaacttctaaaattataaatatatgtaatttgcaacctagcttgataaattaaatacattataacacattttagttattttctatcataatcatataacgaattgatagaaattatatatatgcagtaccaaattatgtatggtattatttttgttctcgactaccctagggttcaatactattcggccattgatcatatgttttattattttattttatttatttgtgtggtgtgaacccgaaacacctttgcttccaccgagccgaggctggccgggctgttgttcgggttttcaccgcgcgcagccaatctgctagcagcccacgcggttggtttggtggggatgcgccgcatgactcgccttacgctacgcacgacgtaaccgcacgaagcggcggtaattgtcagtgcagcccaccatccagcgaccattacgggctactctcttcccacacgtcccaccccgcgcggcgagaaggagctagatgtcagccaacctgccttgactgttgcttcgcggcgcggcccccagcccgccagacaggcaccaccaccagtcggcgcgcgtctccagtccagaaccatcccttccctcccatagccccgttcagaccgcccgattcccgttcccgcatcaccttcctccaccaccgcctcccacattcttcgcatccccttacttttttgtccttctatcgtcgtcgatccgggctcctgttttgcccgcacccgcacgcaggctggttgccaagaaagacagggcgagtgcgcggcgcccagctccgaccgtgcttcatagctcatctggccggggacggggatattcgcgttgctcgcttgcccggcgggtagctgtagcctgtaggcgagaatcgggaacgggggtgtttacaggcc

SEQ ID NO: 2359 - DNA, 846 bp, Zea mays
gtcgtaattttatacccatgataagtagtgagtatgaattaaaatttttctctagcggatatgagtataattttgtatgctcaatggatatgttaccagagggctggtcccggtcctctcctcattgtcatccttgaagcttgttcagttataagtcaatcggagatttgaaagggattagatcacctgctaattaaaatcgaatagacatcgattcaatatttcaatccggtttcctgttatccgtgtgcaaccgacgttgtcggtacctactaccggccaagccacggcgtgatgcactgatgctgagggcggcggatagataaatacagatcggcccaggggctgcggcgggggacgagtggcaccgccgtatgctgccgatgtggacgcgcgagtcgtgactcgtccgtcgccatcagaattcgcacaaaatctcatgccatagcttatgttttgggtgggccggtggcgtcacgagtctgcgtgaacagaaagcccgccaacactaagaatgaaccaacttatgacagcccacatcggtgtggatcagccagcttccggtcacaactcamaaccggcaggcaggcggtggcgccgcggcgacaccgttycacggttccactccacgtctccacccctgacgcgcggaactggcggtggcgagcgaagctaatggccatccatgccccgctccgcctctgcctccgcctccatgcgaggaaggtagccagacgcgtataaagggcagccagaaattcggatccacctgtatgcgtctccgttcgttcacgccacaggcaaggcacaggggcttgtgagggagagcgaggagcggaggaggac

SEQ ID NO: 2360 - DNA, 257 bp, Zea mays
ggatccgtggtttcaagttcaacaagtctgagcagctagaggtgaactacaccgagccaggaaagcatagcttgagtgcgtgaaaagaaaacattcttgacctgactagcttcgtaccaaaatggaaatagctcacatctgggtcgcctcccagattctgggagggaggccaatgccagcgtagctgaaaccgttcttctccttcccccacgtacaaccaaggagcaaagtgcttcaccaagcactcaacattcttt

SEQ ID NO: 2361 - DNA, 1275 bp, Zea mays
gatccccctgcagatgttacgggttcagcttccagcgctgagcttctcttcaacctcctgcacagcgtcaacgaccacctattagcccattccaagcatcaagcaggggcttccacctgagctcctcccacgcgctgcgcctcgcctcggcctgcgcctccgtctccgcctcgcggtccgcgtcccctgcaaccaagtttctgaagctcgttcgcgcgaaccaaggaaagctaaggacagatattctggttcactttaccgtcgaggcccccggagggctgatcccgttccagctcctcccgcttcttctccctctccagtctcctggcgaagttcttcgccgccgcaaacacgttcccgggccgctcccacccgccgccgaatacgccgtggccttccttcggctgcggccgggacaggaactccagcacgggcaggtcgtggctctcgacccagtggatgcagtccacggggcaggactccacagccagaatcactgtccaggcgcgagcgtgggtatttccatctcgtaactctgcgcgcacagaggagcgagagggcaggtgcctccgaagcccttgtcgttcgagaccctgcacgggggatcagcaattaggtttttggggagcgtctacgagactgcccaacatccgtcgttgtcttcatcactgatgaacatcttcttcttcctggcgttttcatctcgtaaggatgacaagagaagttggacaaggatcaggatcctcggggcgcatgggatggtatgatcaattcagttccttactgttttacgttctgcatattatatatgtttcacatgttcatctctgttgtttcatatatagccatagatttatccaaactgttctgtcatatcatatcatgacatatttgatgtctgttcatgctagtaatatgtcatatctgtttgttttaattttacaatcatgttgtttatgttgctatctgtttattttcaattgttctgtcagttcacatgtttattatatttatatgatttatatgattcatatgctttatgttctcatgatccatattgttatggatatatttgagatcacgatttctatgggtaattatcttttatatgtcatcatcataatattaatttatggaattaaaatgatatggaaaatgcctataattctaacaatccaaaaacctaatgttaggcatttttctgtcagaggttttgctgctgtgctaaagcctgatccttttgatggtaaaaacttcttgatatggaaagctaag

SEQ ID NO: 2362 - DNA, 100 bp, Zea mays
ttttccatatcattttaattccataaattaatattatgatgatgacatataaaagataattacccatagaaatcgtgatctcaaatatatccataacaat

SEQ ID NO: 2363 - DNA, 1344 bp, Zea mays
tagcgattagggttgcagatgtctaataccaagaggctcgctggatctgggcctctggggcaccgctgtggctaccagcacatgaaagatttatagtggcatgacactagagactaggagggccctgggtaccaaaagggcctcgatacctggccggccggccctctggccttgagggcaccggaggctagaagggccccaggaccaggtcccctggcttggagggctccagacttagtcgaagctgggcatggccccttggggcacagggtctagggttatgaggttgatatgagtcggaactactttgggttttcttttgctggtgggatcttcagaagacatattgctggtattcagaagtatgacctttcttggacgttgacaatctattttgccatagaaattttttaacatgggatactgagctcaaatgacattccctccaatccattttattaagcgatacaacatcatgattccatttttattaggtttgtaagtgtgttgctttgatctttatgtgcattaactcaactggagaagctaaagcgtccatcactgctgcatgcgtgtgtttccttgagctaggttggccaggcttgcggcatgcatgcatacatgcaggagtcctagcgcggcacccgacattagtcattgtgtaaaggggtgtttggtttctagggactaatttttagtccctttattttattccattttagtccctaaattgccaaatacggaaactaaaactctattttaatttatgtatttggaaatttagggactaaaatgaaaaaaatggagggactaaaaattagttcttagaaatgaaacacccacttaggtcctgtttggaagcacccaatttttaagaaactggtttatagaaattggggtggttccaaacatacccatttataaccaagtttatagatattaaattctcaggtttttaaaaaccaaaaagctcttctaactaaaagataaaaactgtttttttaaaaactgtgttgcttccaaacaggattttagtcacttgtttgtttctttagtagctaaacttgagtaataagtgcggtgctaaagtctagcaaggaaacgggaaaacgacctcacctgggccctccaccacggctgctccggctcaaacattggcgcatgggctgggccttcctagagcgctcggcccatgtttaggagtgccgggcgtgcgcgcagcgtgcctcttcctaatccatcgcagagcgccgccggcgggtagcgctactgctagaggagaggaagcggaaagggcggcggcggcgcttgtggtcagtcaaagatccaacctccggactcgcg

SEQ ID NO: 2364 - DNA, 1500 bp, Zea mays
agtactgtttctgagtcaattaaaatcttataagtactgtttctgggagagagagagagggtgtgtatagtgctaatcatcgtctaggataatggatctcatggtctatcacctagactaaataccatgcaaatgcttaagagaaacttccggttttccagtaactgtgctgtttttatttgaaaaaaaagaagccagggtaaggcgtctacttcaagtttgtttagatgctgttagctagcaagagcatgtacaaaaagtggcctcgatcagcatttgggtgtggaaaagctatgttccttgagtcttgagctccgagctgaatccatgacgaccggctgctttagccaaagccagccagcaagagagcaaccaccgtaccaagcaggaaaaagaaactgcgttaaagaaattcctcacttgctcactaaggaatacatcagctgcttggcattaatttggtgtgcattgggagcacgaaacaggcgtcttgtatgcgtcttttttgacaatgtataccgaccgatcttagagtgacgacaatatgcttatgaaatcgtgtacaatgaatgcttcacacgcaccacatgaacaagaaaccaaagcagctgtgatcttttggccatcccagactcccagttcatcaacagtcaatcagacaagaatagacctatgttttgcaccactcaaacaaagttcgctgaccatgaatatccttggggaaaaaacaaagaatataagtaaaaatttaattaatttgatcgtttctttcttttttttttcgacctagctagtctacatcaccttcgaacgaacttccaccaactttgtcgcggtgatttatatgttttttttttctttcctttccaaagtgatccttttggacttgacttataagggctttagaaaaattatctccaccaaccgcctcattctgatttattgtttcgacttcacacatgccaccggaataaaaggagcaacctttagctgttcatacttattaccggcaatcggcgtcacccctgccaacaattcaacacacagagctaactcgacaccagagtagtagtagttaacttgtatgtagcatttgtattagaaattgcataatactgttccagcgttgagatattgagaacatgaattagtactagttagtaagaaaccccacaaattaaataggttcaaagcaggaaataagtaaataactaccgctaattaagtaacccttccttccaaattaagttgtgtttttgtgggaccgatccttgccacctttccctccgttaaatacctctcccgctcctcccaaaccatcccatcccttccctggctaagatcatgcatcaccaaagaacaactggcagctcctcccagtgatctcttcctgcctgccagattgcattgatctctccaactgtgcaggcacatcgttgatccttgcaagctagtgttttgccacacagacttgcgctagcttccagcagcttgctagcc

SEQ ID NO: 2365 - DNA, 838 bp, Zea mays
agtaataaacatgctaacagaatgatctgcatcttgaggcaattgttcctgtactcggaaaagaaatttgtatccgttctgaaaaactaaatgttcattgatattggtataccacacaaacatggaagtggaatgtggatgattaatttattgtgctaatcatagcttaaccaccctcgtggctctggtctggaatgcttagtgtacgctgagcaagatccacaaaataagggatcgcaataaaaagtatactggcagcagaggaccacatcgggaaacatgaaatggatcaaacttatatgcctttcttcctttctgatttttttcctgtacatgtatttgtactatatacatattacaaaattgatcagctaatccccaaaaacacggatgccaatcacaggatgtcaaaaggcaacaaaggagtatctatgagctaaggatgtttaggagagaaaccctgctctggaccaatatcctgaacaggtgtcctgctccgctctcaagatctccaatgctggactctaacacctgtaactggtcctcctcgcaaacagctgcttttctcttggaaaatgccttcgagacaagcgactgcttaggcatttcgatttgcttcgacaagagctgcagcgtcgactcaagtagagagatggtgatctccctagccttggtcagtagcctgataattgcacaatctgtgctggcaggagtgaccttcttgcatgccttcttgaatgattgtttagccttcttcaccaagcggctataagactggatcttggcttgaacggtggcatcatctccttttcttagagccacttgcagatcttggata

SEQ ID NO: 2366 - DNA, 456 bp, Zea mays
attttttaatgttcgaaaccagcttatttttctctgtctattcttgttcctcagatcaacatttgaatacttactattttaggtgttttaggttgtttgtgttgacccaatggcgtagagtgcttcttgattcaagcattctaaaaatagtcaagcccaaaaatatacgatgattaagaagataccttttatgaatctcaccatcttcctgtgcatgtgcccctcggttgaaaaactaatgtactttaaggttcaaatatcagcaaaatatgttgatacatatggttgcgaaatcatcgatctgtgcattatattatttcataacattaataactgcatgcatggagaccttatgcaatcggcaacccttatatttgcatacaaattgcttattgcttatgaccattccctttttcaacagaaacttgtatttgtaatttgagatcaagcttgtgg

SEQ ID NO: 2367 - DNA, 530 bp, Zea mays
taaactgcaatttaaaactggaggaaatagtaaaaaaaaggtgaagaagggaggaagaggaaatcagaagcaaaaaatgggcaactttaggcccattatctcgatggtctcgtcggagtccagatatgtgattgacggattggattgggccgtacatcttgcatgagagttcgccaagatttcattgtttaacaagaagcgcgtgacaacaaaaccaagcctatctcatccactctttttttcccttcccacaatggcaagtggcagctcctgattcgctctggccattcctacgtggcacacaccaggattcttgtgtgataggccactgggtcccacccaccaggtgccacatcagacgccaagccatcccggcagaaccaatcccagcccagcaacagatggtctgctatccagttccaactgtataaaagcagctgctgtgttctgttaatggcacagccatcacacgcacgcatacacagcacagagtgaggtaagcatccgaaaaaagctgtgatctgatcgac

SEQ ID NO: 2368 - DNA, 802 bp, Zea mays
ccacacccacacgcatgtgcgccgcatcgaggcgtggcaatctgatacttgattgacgtgtctatgcttggcgtcataaagttttaccattttcatttggcggtaacggatgaacaatgatgtctttaaccaacaacaacgactgatttactcagatgtttactaggtaactgcagaattcaatgtttcagctgactagtggagcgtcccgtccatctgataaaatgtgctggcctccctccactccacgagatacaccagacatagacacttcttccactattgcactgctcatcgattctactcggtgtaggcgcccgatcaggttcttgggaccgtttgacacaactgcttcaccactttcccggcgatgtttgtggattgcactgcaccatcctaattgactatatcggacggttgcacggtgatcatgtcaactaatctgcagaacaatataatatctccagttccctcggtactggcctcactacatgcacaatataccttcatctttaccttatctctctctttcctcattcttgcttgtgtgttcttccttgtgaccaaccataaaatagttacaagtaaattaatactaataaaactgatcacacatgtcgtggtttcctatattactttgcgaattattttatatctaaaattcctactaagtttaacaatccaaaaacctgatatgtgtaggaattataatgttactagcttttgcgcttaacctcaaattatgtttgatggttcaaactacaagagatggcgtgcaaagacgagtttatgactgacaacc

SEQ ID NO: 2369 - DNA, 1500 bp, Zea mays
gtgctggtgtttggtttggtttcgtcgtttgcacttttgcagcatgatcgatcaaatcggcaaccgctgaggatcctatgcagcggagaaggacggtgaaaatttaactgtcctcttgatcctgaagacagttagcgggttttttcggtcaagtcctactgtcaaagacgatattttgaagaagcaaaaaagtgaaggagagaataccagattagagtacacaggactggaaaatagtggaagtaacgaagatggtatttccaagaggcggcaggttgttctcgacagtgacaaccgatgcgagcactggttctgagctcgttcagaaggcctgcgccagtccgcagcagagcggagctgcaaactgctgcagcaggcacgctgaagtaaagtatacagagtggttaggataactccgtattttgtaatgcgtccttagcaaatccacaactgctcactgctcagcatttgaattcggtcgctgagtcggcgacgaccctgccaattgaaaactgctcagctgctccagcgccgtcggtaacatatgcaagtggcggcaatggcatgacagcgcccccctagacccacggtaaaattgagtacggttttgtcctggttgcctcgtttctgcttggtacgagctgcagtagatgtcaacttatacgaagtccggcgagaggacgtcgacgccgccaaaatatccgtccgtccctgcaatacaatacgatagcgtcccccccccccccccccccttccctgtcctccatattctagaatttgttcgtcacccgctacagcgcagcgtcatgacctcgacgtcgcgctttatcccgcgcatagtgtacacacttgccgattgataaaccattaaacccccaaattattttacctgcgctgcagacacaaataacatttgtttttattcgcgatcacgggggcgatgacgcgaattcctgtccttagtaagagcaagtatgtaggcatgcgagttcatgcttcatatacacccccgtcgtccagtggcagcccgacaacgtgttccgagagattaataaactagctgggacgaaaccggaaattaattcattttgagcagagaagagatagatgatccctggccgattagggagacgtacgctgcgcgcgcctctgtcgatccgacaagtaggcctaatgaaaaggcgttgtgcaccggccacatctgctagcagctagctcacttctcggggacctgcctcgttcttctcccctataaatacctcctagaagagcgaacaaacaagcaagcaagcaagagactgagagaggcaggtaatacatacctgcgactgcgacgagtgagtaaagcttcatcttcttcctccttcctccggcctcttcctgagtgctgcacgcagtgcgtaggaaggaactcgcgtacgtacgtgtgctagctagctagctcgaccacgcgcagcacgcaggcgcgtagtagctcgatcgatcgaccgccggccggaa

SEQ ID NO: 2370 - DNA, 1500 bp, Zea mays
ctaccaaataatagcttcaccttcgcttcttgcctgcttctgctttgcagttcgcacggaacctcgaccttctacaggaactcatcgatggaggcgcgtaacctcttgcaaccgtcttctgatgttgagccgagaagctgctgttggctcaagtgcaggacctcgctgaatcgctgatctactcgcgtcgcgtgaacgcggtcacgtcacgcgggcacccggcttggcggatggctgctggatcctaaagggaggaggagcgaatcggggttgttcacgcggtttagggcatgccagaaagtgatgggcctattcgctggttgggccacaaccggggttgcagcccaggcagccccgaacgcagatccgcccctacgcgacggcaccaaaaacttcccatacagatcgtgcaccaccgacacaataggtagcagtgtttagttcattgtggaggtgtaaactaatttaagttacatctcaatctatcttaatacacgtgaattgagctaaatatgagattatcggaacaatccctgaggcttgctcggactgctggattcatgtcctcagatcgtggtcatgtcctccttccaccctcctacctcgttcaaaacagatatgcgccacacaccagcggttcctgttccagaagatattttgaatggtaataagaacagcgatgctcaaaaccagttcttgtcctgtactcctgtctagtgtgctagtatttattcagtaaccagaagaattatagtgttactgaaccgtacttgtcttcttgttctctacgtcaccgtgcgatatgctgtattgagcctatggatcgatattgtactatatgatgcttacaatttcatgtggctttgagatgtggcacatgacccctttgtttttccttattgaaagactagaaaacatagtgtctcatcgcgaagaaactgaaaacacgtggtagaaaaaggaaaagaccgaggaacaaagtcatggaaacgagaaaggacacacatatgacacgtatatgcttatctacttcagatgtttaaggatcttgatgctcttctaggctggacaagatgcgctacggaggacggaggtcggggcttggatacatgcaatcgtgcgtccgggtcctacgtgatatattgccatgcatgttgcatgcatcggacgttgtccttcacgcatgcacacgcgcgtggtcagcaccacactgcccgacgccgagttagacgttcagatttatagactgagtacagagtgacggagcaacggtatgcagtggcagtgaagctcacgaaggagtcaaagcaaggagatgtctcatagcgttgctgcatgctttctatcctcccgtcatactcgttcatagcagaaacggtcttcctcataggacgcacaacaaataaagattcagcaacggcaatggcaacaggatacctagccaccctatataaatatatacagccacgttgaaccataccagcaattggcatccaagcc

SEQ ID NO: 2371 - DNA, 1500 bp, Zea mays
attggcatggatcgctactttaccagagaatattcgaaggaagtattttagatatttcactcacaaatgtaagtgtaccttttaaatgacttgtcttgatcagggtggccaaaagcatcacaggtatcagcagttccattggccacattaccattcataccgctggaggcatcgatgctcaagtactgcaaggggttgctgggtacattctcaagcacagcatttaccatggaactctctgaagttgtcagcctactcttctgtcttggtgaattcggaccataaacacagctagcctcgaccacagaaccgctttcaccaccttcgccagcatccaacaagtcatcagcttcaccaccagagatttgattgccttcctcaattcgacaaattgggctttcaaatgttgacagagcatccaagatggcatcagaatcgctacaggcccttctgagaggaggaagcttgggagctttcccggaatctgcaaggagatcatcgagccagcacggtggctcactaaagaacgtatccccagatggaaacctgcagctctgcgtgaacatgctgtcatcccttcgagtgatctgaggacccaggggtgggcagcggggtgggaggtgtggcgaccgagacatggcgagaaaaagccctcgtatctttgatggccttcctcttttggttctgctaagtaactagagccaatcgagcatcccttgcgttgttcctttcatatggaaaaacagcagctttgggtcagatccgaatgtaaaatagcctgcattagggtttgggaagggtttggtgtgctcgatttcgcacagcaggaagaggagttgctggcatacctggtggatgcttgtttccagccaaagggccgacgaagacctggcgaaggtcgacgcgggtgcccagtcggcgccgccaaaagtgaggggtgtgagtagtgagggaggagaaaggaaagggaggcgtgattcgggtgaacgcaatcgtcgaggacgcggttgatcaacgcaaatgggccttgcggccttgaagctggcggcggaacgaaatgggccttgcgttgcagtcctgggctcctggctcatgggcaacggccttgcgttgccaacccccggacggtccccgctcacttcccgaccgcacgtatgcccacgtcaccgtagcaccgttccaccccaccacaaagctggattccacatctgccctgcggatccaattctccaatcactctcactgccatgccgaccccacagcaagagccagccacggattgacggatgggatacctccaagtcggaacgcggcttccttcctccggcggtccggcccgaatcaacgcgtggcgtcggagctccgtggcgtcgtcgtcctctcccctctctttcccaacacctcgcgtgttgtctagcactctagctgcttctctcggttctcgcgactcccaaacggcaaaacgccaaaaccctagccgcggccattccggaattggcc

SEQ ID NO: 2372 - DNA, 863 bp, Zea mays
tggccaattccggaatggccgcggctagggttttggcgttttgccgtttgggagtcgcgagaaccgagagaagcagctagagtgctagacaacacgcgaggtgttgggaaagagaggggagaggacgacgacgccacggagctccgacgccacgcgttgattcgggccggaccgccggaggaaggaagccgcgttccgacttggaggtatcccatccgtcaatccgtggctggctcttgctgtggggtcggcatggcagtgagagtgattggagaattggatccgcagggcagatgtggaatccagctttgtggtggggtggaacggtgctacggtgacgtgggcatacgtgcggtcgggaagtgagcggggaccgtccgggggttggcaacgcaaggccgttgcccatgagccaggagcccaggactgcaacgcaaggcccatttcgttccgccgccagcttcaaggccgcaaggcccatttgcgttgatcaaccgcgtcctcgacgattgcgttcacccgaatcacgcctccctttcctttctcctccctcactactcacacccctcacttttggcggcgccgactgggcacccgcgtcgaccttcgccaggtcttcgtcggccctttggctggaaacaagcatccaccaggtatgccagcaactcctcttcctgctgtgcgaaatcgagcacaccaaacccttcccaaaccctaatgcaggctattttacattcggatctgacccaaagctgctgtttttccatatgaaaggaacaacgcaagggatgctcgattggctctagttacttagcagaaccaaaagaggaaggccatcaaagatacgagggctttttctcgcc

SEQ ID NO: 2373 - DNA, 1500 bp, Zea mays
gaagttggcaccaagcattcgtatggcagccggtcgacggacgcatgcggccggccgcacgcacgcgtcacgcgtgtacgctgctccagccttatcacctatcagttccccatggcaaacgatgccgattagcgaccccgtgccgtcgtgatccatccagcggagaagaagaacaagccacttgcggcggacctgcctgcattctccccttccagagcgccacctgcccggcccttgctggccaccctgaacgagcacaagcgtctcgctgtccggaaccgatcgttccaggcctcggcgctagctagctggtggcgttggcatcagaacccctggcgggcctcgtcgctagtctgcagccctgcagatgattgatgcgaaacgcgcgcgacatctcctctctgtgtgtcgacaacgacgcggccagtgaagttttagaatctaccccgtgcaatcagaggcgtctcgctttcgtgctagctcttcttttccgtgacgagatcttgattggtttggtttgggcccttctggttgcaaaagggcagctagatttgctgtggaaggaaagtgcagccgatgagttgttgatcctggcagacatgccgaccggcgtggacacctgcttctgatacgctgttgctttcggtctggccctgcctgccaggaattttcactgctatcgaatcgaattacagtgttgtggcatgcccatctgtggttgtaaggattatccatgatatttttaaggattatccatggtacttggctacttgccaccgcactacgggcactactgtacatacgaagcacttcatgtagccgagatacagataccagagccacaatgacagcaaatccaggcgacgccgaactgattgtcccccaactccctccatcgccacgcacctcgctgctactgatgatctttagccaaaacagcggacgacatggccatgatctcccacagcgacaatatccacttgagccagtttccttgtccagagaggcagaacccatctgatctacctaaaaagcgcgctatttttatacggccaccaccaggtcagagtcagcaaggcatccggcgcatacagcatacttctctcctccgtcgcaactcgcaactcccgtcccacaaagaccctttttttccaagtctcacctccacacctccgcctctctttctcttgagtcgccttcctcttgttctccacccacacgcgtggcaacgggagagcagcccatgcatggtcttggtctcttgcgcttgccccttgctccttggggagcaagtaggttgaattgaagaagaagcggccgaccgacggttatcaaactgtcgctaaccgcatagagaagaaaggcatccatcctacacagctcctctcgcattgcgcgcgtcgaaatcttgcagttccgatgggggtgggcgcgtcgagcgtgggggcggcggaggggtgcggccgggggtgggggccgcggcacacgtcgctgggcgac

SEQ ID NO: 2374 - DNA, 1268 bp, Zea mays
ccctatttatatgatctatgaatttgtagggtaaagttgtcctttctcctttctatcgagccggtctatattaaggattcttctttttctcatctgtttcgtgcatcgatgccactgatctgagctctttccttcaatcactttcttgtatcagcccttcagagctgaagctcttctgcttcgcctccgcttttggtacgctagtttggacaaagtctagcttcaccattctttggtagtacctgaaacataataaaacacttcgaggaccttcaacaatagaggctcttcaacaaatactattttagagaagttagatttaaggataatagaagagagaagacagtttaactgaatgctataataacaaaaaaaaaactcctcaaattatacatgcatcgttcatatggtgttatcattctgtgtacaatcaaattcaaagatgccaacgttttcgttgacctttcccttggtagctacacttctcagactcctttcacgccccggaactcgagaaccttcctagaagcgagcaagcagcagctgtgttccacggcggcaattggtttcccacgccagaattggattccgccgtccggccactgacagataggccacgaggaatcaatcagcctgtcccaatcagaggaatctgtgggcgagcgcagagcggagcttctggctggtgagtggatcagggacagtccggcgtcaaccttgcacgtcggctacacgcctactccgccaattttttttttattttgttatgagaggcgaaaatcgaagagaataattctctgcgacgagtagctagtggatagcaattgatgccgggcgctttcatagtcagccatggtaatggtatcgcatcgtagccactaaagtaagggagggccccaggaaagaagcgctggttcgatgaagctgcataaataaagccagcacgcaaaccagcagcgttcagaggaaacccatttacgtatatgcccttgtcccggttcctttccccatccccaactccattatttgcttgatcctttgacgaagcgggagagagagagagaggaagacgagaggcagcgaaggagaaaagcagttcttcagctaggcaggtatgtttctctcctttttttttattttcgccccaaagaaataggaggggcgtctctgatatgccctgagcttagcttttcatggcaaatcctgattactagtttcttttatcttgctcttttttttcgaaaataggagggcacaggaggaggaag

SEQ ID NO: 2375 - DNA, 213 bp, Zea mays
tgcagctgaagcaacattgttgcttcttcctcgagttaatccaggctcgtgcatgtctttatatatataaagacgacctagcttaataatgctcgctctgcttttcagtactacctccacgatatcgtgttccttgtcaagttctcataaactcataatccacaagtgcatcatatatacatagcttgctttgtgtgccatcggaatcgcgaa

SEQ ID NO: 2376 - DNA, 750 bp, Zea mays
tattgaaaccttgaatatcgtcaaatagcacgaaactacataaaacacgaactttatcttagattcttcattaatatatagatagatagatgtgacaagtgaaccatgtacttacggaggaaagggacgcaagtctgcaactatcctattttggttaagtgtaactgatgtcattgatcctataggatcgatcatgacatcattgcaaagatacaaaatatcatgaaaaggattagatgagataacagaaaaacaatagtagtgtaacacatgtaagatttttattgtaaaaattgcacatgtcgtatgttgatttaacttgaccgttatttatgttttgcagttaaactacattgttttttgttatcatacaaattagaacggcattggactacaagaatttagcaaaatgctgaagagcattgttacatatataagatattgtagtaatgctactctgcactgacttttgaaatgttagttatgaccacctagtaaactatttgtgaagtatacttcagttgcccatgtagaaagacacacgtactatgtgtctacgtggtccgaatatccgacccaggcatgaacggtcggttacaccggccaatcctcctctcgagcctggacgcagcacggcctcagagcacggcgcgccggcgcgggacgacggcatgacgccgccgtccatcttccaccacccttgacgacattgatgagttttttagaagtagggaatatgttgaggatgag

SEQ ID NO: 2377 - DNA, 1242 bp, Zea mays
atgtggttgtgcaaatgctagctgcttcagtgggacacatgtctcaatattcgtgcgtcgtgcgcgcacgctttactgatgtgcgaccgtttatatgatctactaaaaacaatatattttgtgtgacgctctaaccgcacccgcttcaacagttccctttgagactaaccgaccgatcctccgcctccacacctctggagtttgtacgccactcagatccaattccagttccaaatggagagttttgactccgtgcatgtacggatacacataacacatggcctatctagcggctcccccactaaccaaatttgcttatttgggtccctatacatggccgctcaccaaaatacctcactgatattgccaatatctaaaataccccacaatacatgtgtctctagctagattactccactataagtccaattctattaaactaagttacaccataatccagatcaatacatatggattaaggtaaataatagagtattaaaactaggctttaaagtgttagattttacccctattaaacacttctcgtaaactaattcagtaaatgcagtttgcctttacaacatcacgtacacatcatccctgtcgcttccccttcccttcaggcaagaaagagaaattagttcatattacacttcaatacaccttataccacttcaatccacctcaatccaagattagccaatcaagcccttaatcgttgacagcgtcgtcatcgtccatcaccacagtccacaggggcgtcaccgccgcccctccctattgctgccccttcccacatcccaatcgttgtgcacgccgccgccacccatccctgctatcgcaagaacggcagctcttttctcaccgctaggtacggtagtgctaaataaatgacagtgaggtaatcaagcaagaagcatatgtattgtgaggtatttttagctattgacaatttctcattaaaatattttagcgaacgaagatatatggtacccagaataagcatttgtcccaccaacggcgtccaagccctagcctaacgatacttgcttcagcccagggctttcctccgaatccccttctcgtccaggcagttgttgcaaaaatcccgcctccctgattgcggttgttgcaaaaatcccgctacgctagtcgctaggctttcctcagcagcacttccgcgcttcgactcctggcagattggattgggtcgctgcttccaccagcaatccaattccggag

SEQ ID NO: 2378 - DNA, 510 bp, Zea mays
tttcatgaccaatcctttgttttatatttagtaaaattttagattttaggagaccatatattgaaataattatcgcaatcaacatatggtgtgattccggaaaaaaaatatactcactctttcttaaattaaaactcgttttagataattaatgtattcatataatatttgatgtatatattttatatgtgtgtctagatttatcatcattcattttaatatagacaaaaaaatcaaggctaaaatgaagggacgaagagagtattaattttgtttttactaaccaacttacaaaattgtaataaagcccttcagttcctccctgccggccacccggttcaagaactttctatctgaagttcagtaattctctcggcaactcagctcccgccagacaatagccaccacctccgacgccgcgtcctcgtcctctttcgcttgaaccctagcctcgcatcggccaccgccaccgctcttcgtcggcagcttcggtgcggctgaacggccgcg

SEQ ID NO: 2379 - DNA, 105 bp, Zea mays
gcttcctcgcaccggctccggtcctcctcccatcaccatcaccaccgtcgttcctctcacgagtcccgacacacgcaaaccgcacgaaccctggctggcggcggg

SEQ ID NO: 2380 - DNA, 498 bp, Zea mays
agaattcttcagaaaagaaagattaacctcctaatctccgctgtattctacagcctaccgagattagttaaccattcgccttgatgctccctgccgtgtctgaaactctagagtctcgactgggtttggagtttggactttggaggactccctccactcctccagtgaggcagcagaagccggcaggcaataattacgacacgccatacgctgcacgcccgtaccgtaccgccggcgcacaacccgcccgatttccttgcacgaaacgccgctgcttcgggcttgcgctgcggtgcgggtaaggcgctcacctcaccttcacctacatctcgcactctgtccgtctgtctccaccagctaccgagccagccagcaaacaagcaagcaaccgactgcccccttgcccgtacgcagtacacctcgcgccggtgagcgagcgaatgccgcgggagctctagccctcggctcctcgcccgggccggcgtgtcgttccgatcc

SEQ ID NO: 2381 - DNA, 1500 bp, Zea mays
tgatttgtattttggatcggaacaagaagtatataaactgaaggtggcgctactactccggaaaagacgacagggaatcggacgcacgggcaggcacacgacagagattctgctccatgtcgatcgtccgtcgtcgtcgactttacgatccaagccaagccaagccctcatgcatgcaataaaaaagaaccccatgtgcattaaaaagactacttcatgttctccccctgtgtgctgctccactcgatcggcagcggcgcgagaaccagaattgcggacgctggtttggtttccacttccgtccgctcacccgcaatcagctagctacaccgaacctgcccccgatgcttgcttgccaaattggagggcaactctcacctcacctctaatctaagctaaagttattggctaaaccgcgtagctaatcctagtttatgcagcggtggttgccgatttcagccgcgctgacgaaccccagccgcggtttctttcttccttcctttccccctttgcgccactggtagccaataacacaggcgttgcctggtgtggtaatggcacgcatgcagctactgcatgctggaacaactgggggattactcaaaacgccactaggttcgaggtgcttggtttatgctaggggcgcatcgcgctgacgacagtgaaagctgaggccaccgctggttcgtcccctgcatgcgctgcaacatgggattttaaaaattgatgggccgagtgatctcgtccgtgcatgtagcccggtaataatcataaaagcacatgtttagtgggtgtttggtttctagggactaatgtttagtccctacattttattccattttagttctaaaattaccaaatatagaaactaaaactttattttagtttctatatttagcaattcatacactaaaaatgaataaaatgaagagactaaacattagtccctataaaccaaacaccccttgagtcgtgactcgtgactccgttgacatatccttcacccttcagcaccctgccctgactgactcacgccttccgccttcagcactctgcagccacgtccgcgtccggattggatactacctgaacgtcacgtcgcctccaacacgcaggacgaaggcgccactccaagtccaaaaagtgacggtgtcagcatcgcaaagtccaaacgaaaaggcgagaggtcgccggcacaatgtgctgccatcctgcaggcgatatgtttactccaccgctagtactttttactacccgtgrccccgtgacgaggattatggacgagccgatggtgacgagctctgaatggtttctttccaatttgttaatcgaaagcgaacgacgagtgagcgaagagccgaagactgcgttcttgttgtcctgcactcctgcgcagtcgacggcagctcgctcgctaagtcgctagtaagttgacgccgccgacactcggctccacttccactggtctacactccactcaccagctcccatccgtcgtcc

SEQ ID NO: 2382 - DNA, 486 bp, Zea mays
cctttgcttggttttaatctatatcagctttagcattttgtctctataaactagaggtacaactaactttaatctaaagcgaacaattatcaatgatggaaccactgtaacatcctttggaacgtaagaattttatagaaattatataaaaatttcacaaaatcagtttattttctcatgaaaacataggaacaggaaaaaaaatcccacgttctaaaaggaggcctatactatgtcgtaaacacaattgccatttctcacccttcaccttgattcatcattcacgccagtacgccacgcctccgcgttccacgttccttctcgtctctacgtcaccgtaacctcctccacccatccccgttctcacgcggctcgctcagggctcgagcgtctccccatcggaaccctaatcctctctttccctactcgcggaagccaactccaccggcaggggaagcggaagggaagcacctcggccccggcaag

SEQ ID NO: 2383 - DNA, 378 bp, Zea mays
gaggaagtggcctgaacagtctaacaaccctagagattgtgtggtgtggagatctgagggcagttttccctttggacactgatgcccagagctaccaccaaggtcggcgaaaccaggcaatcaccgtggaatttccttcccttcagcgtattcacttgcacgagtcaccgaagctgcatggcttatgtggccgtggaaggatgtacgcaccaaagcttgagagcatggtgatcaggggctgctggaacctcgcacgcataccatccgttggcgatggcggcgaccgcattaccaagaaggtgaagtgcgactgtgagaaggagtggtgggacaggctcgagtgggacgggcttgaagaaaaccaccatccgtccctat

SEQ ID NO: 2384 - DNA, 339 bp, Zea mays
ctttttgctccatgagctaggatcctctaaatgtgcagttatacctttctgattaatcatgtgctgcccgagataagcctatcaagtagtctgaatctgtctcactttctggctatctttttgctcaatcataggcaatctcctgcggtcgggtgacatcagaggctatcaatcaatggcccgcatgtatacaaggctggctgccatgccaaagaaaggttagatgtagaacatgtgccaagccaagagcctatgtcagtccatatgttgtcaggtttgctgtgtgctgtctgtctgtgaacttggtggttcttgtttcctaataagtcctaaccattc

SEQ ID NO: 2385 - DNA, 370 bp, Zea mays
catcttagaaggagtgaggtcggaagatcaattagcggatattttcactaagccacttgataagacccgtttttgcatgttgaggaatgaattaaatattcttgatctcagaaactttatgtgaaatgtcaaatggtgttgtcaagcttgcattgcatatttaaattccttgtattgcatctaggacttgtctaacctagttgagataaccgccaacaaagcgagtgaaaaagcttaactcgggtcaaacctgacaagtcttagttttaagcttttagcacttaaattcttactttttatgcaattattggttcttgaaatatgcatgaggtactgcacttagggggagtattcaaaactcaaatcactc

SEQ ID NO: 2386 - DNA, 1500 bp, Zea mays
tctataaatgggttagtgaaatctaaaaccaagtttcaattaagaatagaaagatgatttcttcacttaattgttcttgcaagatgcgtattgaaattagagcagtaatgaaattgaagtggagggctcagaagaacaaaatcgtaattaaagaaatgtagacaatgagataagatgatttatctcgtggtttggccagaggcctacctccatgttgtggtgtcccaatgaacgagggctgcactcaacccctccctagtgatccagagatcaaacttgagtacgacgattgtcttccttatagtatattttcgtttgtgaggaatctccacaagttggagtctctcacaccttacacagtatgatcacaatcaagaacaagagaagatagggattagcaacacacacaagaacacaaatgcagcaagaccacacacacaagtgaagaaaagagcgcatgaatgaaaaccaacagagtctcaactcaaagcatgctcagatctctttcacgaaccaaggcgtgatcgaagtctcggagtatgttgtatgctcttgtgtttgtctcgatgtgttgcatggggtaccgctctatggcgtcaagggggtccttttatagccctagggagcctagcagccattggttcttcattagggaagcaatctggcttctttgtctatgtgcataggattgaacaatcaacgatttgtttccttcatcagctgagccgacttttgtgagccttcggttgcatgacacaccggacatgactcacccgaggccacaacacgtccaaggccacaaagcattcaaggccacaacaagcccgaggcattaatgcgcccgaggccatagcacaccccgaggcagtcacgactcgcccgagccagtcatgactcaccaggaccagacctgattcgcccgagcgcagtcctcgattcgctcgaccgcatttccaactcgccggagcacatctcgggtgactgttcggtgaggccaagactggcccaagttcggccatactataggactttgaaacacatggatcatactacgtcgtaatactccatttgttcggcaacagcgagcacaaaaattgaaggactgaaagagccggactgggtggtgaggtggtggaccggtggtgatgcatctcaatatatcttatcgttacatattgactccgtagcaacgcacatgcataagcctagagcttgtttggatccatggggccagtggcggacctatgatttttacatagggtgtaccgcaacaaaattttcatgtagaattctatctaatgtacatataatttcatagtaaatttggtaaacaatttgatatatagatataaagtttgatactcaacaaataagcatgaaaattgcatacattaaacataaagattgcaataatactacttatctggcctgcgcttcctcaacgccataaaagtttcaattatatcttcttcattcacttctaagaaaatatccctctcg

SEQ ID NO: 2387 - DNA, 1500 bp, Zea mays
tttgttcttctgagccctccacttcaatttcattactgctctaatttcaatacgcatcttgcaagaacaattaagtgaagaaatcatctttctattcttaattgaaacttggttttagatttcactaacccatttatagaccaagtttgttgtttttagttaaagttttaagaggatcacatattcaacccctctaagtgctctcccaaactacacggtggcacttgagttattaaattttcaatatcaaggtattatgtttgtagtactcttattttaggaagaacataaaggcattgaaattcagttaccaatattgacatctgtatgtttcagtcaaaatgtgtaacctgatatcttgtaacaacttaaaaaatattgcaacgagtgtcaatgtaacttaaagtatgtgatttgtttacaaaatattgtttccatgtgcgtattcacttggtatgctatataacattagtgctacttttgatttaacggtataatatatactgattacttttttttaagactttgtatgtgtattctgagatagagaggagggatattttagtttattttccatgatggtagttttggacaatttagatacaaatgaargttgttactttatattatctttcctawtgtcatatattcaattttgagtattccacaagtgaataatttatacagaaatttaggagttattttaaactatctttggtaatggcataagtgagttgtaagcaaacatagggattacttgaaattgtattttataattgcacaagtaaatactatagaagtaaatttaggagttgctttatgtattttacatatataataccagaggtggtaattttttttagaaaatataataaatcaaatacagctattattggtcatgcttggagtctatatcaaattaatggacatatgtactattttttgctaaaaaatctatggtttaactttttttgttgcgttatggcatgggaattaacatgaaggctccgctagagccatctaataattagtaacactaagattaaggtactaggaacagagacatgagttgccaatcacctgattttgtttgatggaaccgtctgtgtcgaacccggtaaacaatggaactgagcgccatgatctgcctctggcagcacaaggtcacggttcttgacagcaacaaccaccaccttcagtaagccaacccacatgctcttctgcggcttcaccttcacgtagaacgacgccgccgcgcagttcacgagcgtgacggacgccatgatggcggccgacaccatgaacccgaccttccagcccatcttgtcctggaagtacacgagcacggtgacggccacgatctgcgagaaccccacggacgcgtagtaccagctgaacagagcccggagcgcacggtccttcttcgcggtgtcccagtgcgcgatctggtcctcggcgaacgccaggcagcaggggcggacgccgctcgcgccgagcgcc

SEQ ID NO: 2388 - DNA, 315 bp, Zea mays
gtgttttaatatttaaattcatattataaaataagtgaataatgttatttattcttgttattctataatattttatattttatatttcattttgcattgttttatctcttatcacgaaggtgtgaccttcgtgatatattacccaagacctttgtccgaagctcattaaatcctttggggagataatgcttcagcggacgaagggcattaacatttaacattctgtgttgccttgttcttaatttatagcatttgagaacaagtccccaacattggcgcccaccgtgggtgaactcacttctactttttgagttg

SEQ ID NO: 2389 - DNA, 269 bp, Zea mays
gtgaatggtccttttgtgtagaaactactttgcgaggtcatggttttgcctttcatttgcttgattatccacctgagcccactgtaaatccaagtaatgcttctgaaatcaagatttggaaattaatgatggaaaagtgatggctgctattgttaacagtgtcaagccatccatgattatgagtctttcttcattcaagactgcaaaagttgtgatcttatttacagaagcgttatgttcaagatagtgatgctcttcttcatactctt

SEQ ID NO: 2390 - DNA, 472 bp, Zea mays
ttcattgaaaaattcttcacatacagatttgttatgggtctcaggacatattttgaggctattcgtaccagattgcttcatgggtctgccagtctgactatgacaaaggctttatctgatttgcttgctaaggaaactcacctctcctctatgtctgtctctcatattcatgtgtcccataatgtgttggcagcttctcacaagtctggtgggaaaggtggttactttgagccttgcaagcattgcaacaaaactacacatcggtctgatcaatgttttcttaagtatccagagaagttagctgagtttcgctctcgccgtactgcccaagggcgtgggccatctaagggttcagtgtcagttgctgcagcctctagtagtgcttctcagtccacatgggttcttaattctggtgcctcatttcatgtaacttcagatcagtataagttggatacatgtgcaccagtcacta

SEQ ID NO: 2391 - DNA, 1500 bp, Zea mays
caatacgtgtatctccacgcatgattctcgaagctgcacgaaacggcgacacgatcgatctgacgctgaaacacacgggcgaagcgaggtttctttgggtccagactaggatggggcagcacgcggtaactgacacgactcctatcttctcgacccgcaccgttttttttcctccgcccgtgcacgacatttctcggtgctgagcgcggccgcgcaaaattttatcgtttcctcgatagaaaacgcgcctcgtcagtgccagcgacagcttttctatgcgtttctcaatgattgatgtggaagtgcagtgacttttgggagttttctgcaccgacgtatctgtcagtcagtcagtcagtaatgcttgctttcacgatggcttcccggacgaaggaatcggcgccgtgccgtgtggcgtgcgcaggtcgttcgtaagctttccttcaatttgttgacgatcaggtgcgggtgtgcgacacaggaagccgtcgaatcgtcgatctctggaaagtacgtactacgtaggtagagtatcattaatcatgggaatgggtcgggccgatttttgttaattagtttaactggcccacataaaagtaagatcaatgggccacaacgatctgtctcaaaatctaaaatagggtgataagatcaaaccccgttgatctaatgagtacatgggtcgacctactgatcacgtactccatctgttctaaaatatagttctttctaacctatttttttctgccacgttcattaaaatgataatgaacatatgcatacataaaaactgtgttcatatgttacttaatggatattaatggatatataattagtctaaaacgaattatattttgggatgaatagagtaacatttttatttagtttattagtcttttttactttttaaaataaacattgtcatccataacttaaaatatagctattttaaaaaaaatacatgaacatatattatattttaaaagtgcaaacagttaaaatcaaaattgcagtcatgaaagtacgtacgtgtatcctagtgagccaaccatgctatgttataaaaaatagtaaggtatatgtatatatctaactagcttcttgtcgggtgtggtaattaggggtacccggatgtctatagctcgggttgtgacctgagatacactgggtgcgtttggttgcgagacaccaaggacagraccatcccttggcgacctctatcgtccctccaattttgagggacaactagggacaacactaggataatcctgtcccaacccttgatcctaaaccaaacaaccttatttgagggatcgtcccatcccatcccgtcctgtcattgcaaccaaacgcaccctaagacatatccgagaccccgagagcgattcgtgacgatatccaaaggaatattgaagataaaaaaaccctggtttttctttctggaaagacaatattttttcatccttttgcattgaaataacgaatggaaatcaaaataat

SEQ ID NO: 2392 - DNA, 532 bp, Zea mays
ctactccaaccaggtattagctaatttgataaaaatagataatagctaaattattagctagaatgtttaaatgtctttagctaatttttaacaactaactattaagtctattatatttaaacatcccctgaatcttagacctgtatatgattctcccaggcttgacatattgggacgactagctaggcatgcaggtagtactagtgctacgtataaattagtaatttcaattgatgacgaatgaaaaagagagagagaatcttcatcagtttcgtaggagtcacgttcgctatttgtagatttcgttttgtttagtggtcgaagtagcctaattatctcctgtttttttaatcaatttctccgcacatgcatatataaaaattgtttcgcggcgggcaagtcacctcctcgtgtccatataaagaggggagggagagcacaggtccttccgtaccacactaccacccaccccacgaaaccgtaagaagcgcagagtgtgagagagaggggcatcaaggacgacgtgggcaag

SEQ ID NO: 2393 - DNA, 276 bp, Zea mays
ggtaaccttttctctcccttgcatatcaagccttgagatcagacctcgcctttctgttctgatccctgcctgccccataaacacaaactcccttagtcgtcgtagtcctctcgtttatcggttggtggacagtgtggatactgcgagagatcgatcaaaggacgacggagctagctagggggtgcaacagaagaagaagaagaggaagtggaagaggaagagatctgtctcatcagtacgacgtacttgttgttggatacatacaaagatatatat

SEQ ID NO: 2394 - DNA, 659 bp, Zea mays
tgatcaagcagacaatgattacagcaataccaacagtcatcatgccaaggaaaccggagacagagaggtgatggctccaagcaaggacacagtgctgaagagtgcagtgatcatgccaaaagtcaaaatacttaatgacaatcagagccactatccagttaagtgaaaattttattcgaataaatgtctgaaggtagcatctatacctttacacattattaatatctcaagaaaacctaatgcaaattactgaaatggtctgagtggagagcacacctcgagacaaggtaaagtaaaatattagagtcactcaatgttcgatcacctgtacaaaacaagatatgcattttctttggagcaattcttttaaaatatatggggcaatgaagagcttcatattgtgttgaacctcagtctgtaatattaagttggaagtgagagttttatacttacgacatgctacattttgttatccttatagttggttagcctattgcagaaggtggttgaacttgtactttgagaccaaatatatattgcatacttgatattatactattatttgagcttgtctttcttattgtactcttatatgttcttatgaagattataggaatgtgtttggggtgagtaatttttttgtgttgtttcctttatcc

SEQ ID NO: 2395 - DNA, 1058 bp, Zea mays
ctgcagcttataactcaatttttttcagcctgtgtatggaagcagtatggcagcaagatcacatgaatgaacgcaccaaacatctcccataaattattcgtaggacgccagcccccacctccctccatgcccggcatgacgcatggtctctctctcgcttcgctctcccctcctcttgccatggtccatggacatggggcatatttggttcagtttttttctgaccagcttttctgaaaatatggctgtgaggagaatctagctgtggggagaatctgagtatcattacgattacgtatggagaaagataaagttgtttatagggcttaggatctagaaagtgacggatttctactattacaacgactcaaccgattatgtgtttatgttgattttggatgatttttgccccaacgaattttatagaagctgcctgaaaagctgagcgtttggcagtctgtagcagcttttgttggccagaagctgccagaagccgaaacaaaaaggcccatggcccagaggtcctcactcctccatcatacgcatagcattacctcaaaaaagaataacttataggcatagcacgctggcagctggtactacaaaaacaaaagcaggcgtcatttttctttgcctccctctccaccttgtttggctgccttcttcttctccctccctccctccctgtacgagctgagcagcaacgtgactagttttaatgtagaacaaacatcacagcgagggaaaaaaaaactcttccctcactcagagattcgccacaagaccacaacattttttagttgtttcacttactactgagcaaacatcacagtttttttttttgttgctattttccttcgcatcttgtagacagcccttccttcagtgtgctacagacaattagtaggttcatccagcagaaaaacggaatcctcgttttgttctggtcactctcggttcaatctcccaaaacgatcccgccttcagtagcagcaagcttcccatctttcaagcaaggtgaagattcagcagcggggaaaaaggttaggtctccagcg

SEQ ID NO: 2396 - DNA, 1500 bp, Zea mays
agcaagacggggagcggccgggagcagtgcatggtgtggtggtggtggtaaaaggacggggattggacagcgacgctgatcatttatgccgccgtgtaaatacccaccacaagcagctagcttcgcaggtcggcttccacatctctctcattctcgtctccccccactgctagctgctgcagctctcaagctagctggcagctagggtttacaccgatccggggtccggtcgccgccggccggcggaagcgggcaatcgagctccgcgacgtcgagatctgcttaattgctaggtggtcgccgcgccggcagccccggcacagagaaagtcaattgctctttgcaggggttgctgctcgttttaaaagagatcctgtaagtccctccttaccagtccgtttattcggttgcttgatttgttagtttttttttatgttttcttctgcgggtttgaaaattgcaaaagttttaggcctttctcttggtttactcgtttttgaaaccttttgatggtcgttttttaattatgaatatctcagatctaacaaagatatgtccgctcatctttcttgctatgcatattgcatactgattagttttcgaattttcgaagtactctgcctgcttgatatattgtttctcttcttcccacaaccaaaaaaaaagaagaagaagctttccctaaaacaagttgcagatgatcatctttgtttctctttctactgtcttttctcttctttgtggaaacaacctgcgacggtctggatctgaaccttattatttcgatctagaagggccactgaacgcttcttttgctaaccacagttgaaaaaaaatatcctaaccataatactataatcatgattgtccccgcaaaaaatggtgcagtgttttccttgtattatagtactaataagtaagtatttttctaaaactgatctggccctcgatcttaccatcttctctttaatttcaaagagagagcagaagaaagaaaccaatccgtgtacggtgtattcatagttttgcctgcaaaagctagcagagatgtggaggctgctcaatcatggaatcatcccttgcacagcggcgcagcgcatcatgtgtatgtgcatctagtgccgctgccagccgctgccagccaccgatccagagctcgctggcgctcacctgcactgtttcataccgctatcttgctgttccatggagagcgaataaagctgcagcgctttccctattccccaatggaacagttgcacacatgaaccggtagaccctctgccgtgcttgcatgcacagtgtgctctcaatcatggcgccccaccccatttcatgcgaatctgttatgtttgcattcattactgcgtacgatgctacaattagcatgcatgccgttaataatctgagagaggctgaccagttgcagtggatgatacaccgacacgcagctagccagcagggacaccgcgagatggcgggcgccgtcgggctaacaagacg

SEQ ID NO: 2397 - DNA, 339 bp, Zea mays
gctggtatgttgtgggaattgttgaccggataccattttcacacagaaaccagctatgccaatgattacgaatcgaggctgggtaccctgtcctgtcctgcacacgcccaacggcctaatatttgcgtagccgctacaacctacaggattctcgatccgtcatccatccggtccggatcttgattcttgccaaggcgtgcaagattcctgcttcgccgaggttaaattttagccgccggctgagcttctgcggagaaccggcaggtttgcttggtgcccccgatttgcctgctactcgtggcgcgccgctcctaggcgaagggaaggatccgactcaac

SEQ ID NO: 2398 - DNA, 777 bp, Zea mays
cttcattagttacatttatggtatacacatttgacgttataaatctttatatttgttctatattttttcggtgaaactttagttgctttgattttctttaaaaaattagaatagcttataacttgaaaagccaaagctttacaagtttaataaaaaaatataaacagaattataaatatttatgatattaaatagatatattataaaaatataattgtttaaaaatctaataacacttattgataccataaatattattttaattcaactaaagttaatatattttggctctcctgaccaaaggaacttctgattttaatttcgcgcatagcagaaatgaaaacggcaagcactagtagcagcagcaggagaccattgctggatcgctgacgatactactgtctgcaccgttgatccgcgtggcgtggaccatccaagacgacctcgtagctcgaacgccgtgcgtgtcgagcagcgcgcggtggcgttgcattctctccactacggcacaaccgcagccggccaacaccacaagcacgcgccaccgatccaaccccactaactgcaccgtgctgtcgtgtcctgtcgtctgcccgagccccgagccctataaatacatgctggctcgtaatctcgccatctactcatctgctcatcgatcgatcgaccaagaattgcctgatcacgcaggtggacgcaagacggcaagagaagctcgccggtggcggccaccgggaagagaagttagatacctcaccagcctgcgcgcacggaaca

SEQ ID NO: 2399 - DNA, 1500 bp, Zea mays
gacgtaactttctttggtgaaggcctttatctgttactatcttctacattctttgccatttttctgagagaaagagcaccgaaatgaaccatactgagcacatgtttcagtctacaagtaaagttcaatgagctcttaaaggagcaaaaatgttagaatggcatttcttggaattgtattcttgccactttttgtttcttgttagcaccatttttttctgccctacaaattccttctgctttgaatacctcttggcttcattcctcattttgttccagcaatgaatttatcgaaataacttgttctctttgtctttgccatcatataaacataatgcataacctatctgcacatgcaagaataaatatagttaatatgactatcggtgctcaagataaagttcataaaaaatggcacaacaatgaccttatatatcgtgaacagttcatccactttaattcctaaacacaatctggtcctacacccgtagaacatttttacttatgctaaaatagtaaaccgacacaatcaattcatccctggagcttacaattttattttatttttcctttttcattggttcagcccattcattagtttcaactcaacaaattgactagcaaagttatcctcagcaacatctcctatcacatctttatttcacgtctcctatctcatcttatatttcaatttcaatctccactttatgtctacaacgcagatatcttgcacggctatatacgcgatctgctgtaaacggcctaaggattcttcgacattagttgagacggcaacctttcgatatacatataataaattaaacggtggatacgctaatatagttgtattacatttataaatgctaacatatcttatcccccgatatttatatcgccataaataatatgatatcttaccattaaaaatccaagaataatagccagtctttttcctataaataggagcacttatgcaggaatccaccacaatcgagcagtaacaaagtttgagctgttgtaccttcacccaatccacatatagcactacaaaatggtcactgggaaagtagcagtcgtcctcctagcctgctggacgctagttctctaccaaccagtgcttggccgtttaccgtgtaacaatgatcagaagagagagatcctgcgcgagtgtgatccactgaactcaacacctgactatactccatcccggcacggtgcgtgctgcgtggcggtgagaaaggtgccaggaaccaacatgctttgcattgcctccatactctcacttgctgacaaggccaaatacagtgtaaggaagattctaggatttagagatgcatgcgccccttcacatccacaccatcaggtagttaatactcgttctatcacttgacagtccttagactacagtggagtgtccttgtaataagctaacaagtattaatcttgttttgtgaggcaggtcatggcctaaaagagcgtagctgccagcctgccatcgctt

SEQ ID NO: 2400 - DNA, 1142 bp, Zea mays
cagtctttggttgaaacaatcctttcctcgcttgagaattgcatttccgcttcagcttccttacatccaatccaaaccccacaaattaatctgacgtaactttctttggtgaaggcctttatctgttactatcttctacattctttgccatttttctgagagaaagagcaccgaaatgaaccatactgagcacatgtttcagtctacaagtaaagttcaatgagctcttaaaggagcaaaaatgttagaatggcatttcttggaattgtattcttgccactttttgtttcttgttagcaccatttttttctgccctacaaattccttctgctttgaatacctcttggcttcattcctcattttgttccagcaatgaatttatcgaaataacttgttctctttgtctttgccatcatataaacataatgcataacctatctgcacatgcaagaataaatatagttaatatgactatcggtgctcaagataaagttcataaaaaatggcacaacaatgaccttatatatcgtgaacagttcatccactttaattcctaaacacaatctggtcctacacccgtagaacatttttacttatgctaaaatagtaaaccgacacaatcaattcatccctggagcttacaattttattttatttttcctttttcattggttcagcccattcattagtttcaactcaacaaattgactagcaaagttatcctcagcaacatctcctatcacatctttatttcacgtctcctatctcatcttatatttcaatttcaatctccactttatgtctacaacgcagatatcttgcacggctatatacgcgatctgctgtaaacggcctaaggattcttcgacattagttgagacggcaacctttcgatatacatataataaattaaacggtggatacgctaatatagttgtattacatttataaatgctaacatatcttatcccccgatatttatatcgccataaataatatgatatcttaccattaaaaatccaagaataatagccagtctttttcctataaataggagcacttatgcaggaatccaccacaatcgagcagtaacaaagtttgagctgttgtaccttcacccaatccacatatagcactacaaa

SEQ ID NO: 2401 - DNA, 612 bp, Zea mays
ggacattcaagtgtctcaaggcaaaaggcgtaaaactcaatcccgagaagtgtgtcttcggagtcccccgaggcatgctcctggggttcatcgtctccgagcggggcatcgaggccaacccggattaaggaagaccgagcgcttcacttggacccccgaggccgaggaagccctcgggaacttaaaggcgctccttacaagcgcgcccatcctggtgccccccgctgccggagaagccctcttgatctacatagccgcaaccactcaggtggtcagcgccacggtcgtagtcgagagacgagaagaagggcatgcattgctcgtccagaggccggtctacttcatcagtgaggtactgtccgagaccaaaatctgctacccgcaaattcagaagctactgtacacggtaattccgacgcggtgaaagttgcgacactacttcgagtctcatctggtgactgtggtgtcatccttccccctgggggagatcatccagtgctgagaggcctcgagtaggattgcaaagtgggcggtggagatcatgggcaagacaatctcgttcgccccttggaaggccatcaagtcccaagtcttggcggacttcgtggctga

SEQ ID NO: 2402 - DNA, 395 bp, Zea mays
attttattatggagataatacaaatgcttttgtgaaatctgcgaggattgagcaaataatacaaaaaattgtgttcaaagtttataattatscagggataatacaaatgcagggataatacaaaagcatttccatccgctgcattttaccagtcattcttcagctctgcatcgaggtcgccttcccctcctctagttgtccccagaaaccgtgtcccctactctctctctctctctctatctctcttctcccctcgatcaacagcaacagcggcggtcagaagcttccgtcgcgacagctcccgacctcctgccggtcttcccctctcctagtcggcgcgaatcccgaggcggaggaggaagaggggagcggagtgggggtgggccccatcagcc

SEQ ID NO: 2403 - DNA, 142 bp, Zea mays
agatgaagcgaaactttatatatatgtatgtatagtcaaagaaagaaactgtacattcgaaaacgaaaggaggttattatatgtgtaaaggcggtcaagaacagcgcgtggaaataatctgcaggatcgaagtcgctggtca

SEQ ID NO: 2404 - DNA, 465 bp, Zea mays
actgtggtccataattatttccttattgatgtaaatgtggcaacacttgtcagtttcatgcttttattaatggaggtcctgtactgttcaaatttagagaaatattacatttatgtttttgagcacatattgctccagcttagatgtctgccaacacaagtattgacgtgcggatgtttacttgtttagatcattgaaggatctggcaaggttgctattagagggtgattaattatcttacattattccagttccttaggagcacttaagtttttaataactaatcaggtattcacaaggtatggactccaaaagttgtttggcctagactgcttggcactcacctcagaccaaaccctaatttaccctgatcttccatctaaatatggtatgcataatcgtttttaacaagtttgagtcaaggaatttaagagaaaccagtgtggattttatatgtactaactc

SEQ ID NO: 2405 - DNA, 1500 bp, Zea mays
actgcatttcccagggactaggtaaattgttttgtaatttcgttcggcatagaaagcgatcgcataatgtgtttatcactgggcgtgatcgatgagacctactacgtactcgcggaccaggcggctcgactacagtgctctagtttttgttttgggttacctattaattttagagaatagctaattgttagggttgagaagcttttatggaactggtcacggccgaatggtccgtgtcgtggacagtccacaattatatcagatcaggtggattaattcgtattttcttgcgagtttatccctctagaattgtgagagtgttgttggaggacatcggagaacggattcatatctctcattatatatttgaagggttacgaccaattgaaacacccaacgacccaaccaaatcaatatattttccgttatttacattttgccctagtagtagacagtaacatatttttgttcacgtcaatcttcacctctcttcaactctacgtcgtctggagacgtctttgggtggcctaccgatacaaatcacagtgattggcacgcagatcgacaccaagagttagactttgttttttacatagtgtctcctggtgtaagatgctcccacatgtgatattggtgtcgagccagaagagatagatataacaaaaggaggtaactaaccgtgggtgtgtgtgtgctttacatttgacccacatcacaaggggctgcatcatttgcaaaaaagccagcctgccatgcatggagagtgtcatgcatgtcgtcaaaaagggacagggcaagcaaagcacactatgaggctagctgagggggtgcatatatatatgcatgcacggaacatggacgcatcatgtgcttaatccctttccgcgatatccatgtcgctcgcccgcgaccgcgccgccccgccctgacctgcctccatcgagcttatctcaaatcaaagcgcctcaaagttgccgcgacaaattatttacctttgggggtggggtcctttctgcgaagggaaagttttttttgtttgcccccctcctgcccctgtgcatgtgcacatgtctgcagcgtgcctttagaaaagggagccagaaacggcactggtactggtagtgctggcacataaaaaaaaactcatctccgccaaaataaataaataaatactagccgtgtgcccgtgcgttgccacgaaagttaaaaattagtataaaacattaatataaaacaacaaatatcactataatatataaaaatctgtgtggcaaaatgttagtgtgttgtccgagatgtcgatgagcctgtagcatcctcgatgggcacctgaaagcgagatacattgattgaatcactattacaaccaattggctatttggtaataagtttctatctctaatcctgattattctagcccatggaccatggtagcctataaatactttgaaccatggtagcctataaatactttgatttactatccattacagacctacc

SEQ ID NO: 2406 - DNA, 56 bp, Zea mays
ggttcgcttcaaatttctgagctgaacgcagctggagagaccgcgcagtcctgaat

SEQ ID NO: 2407 - DNA, 1206 bp, Zea mays
ctttgtaatcatagcaagagacaccaagttgtggtggtccttgtaggggactaagtgtcccatttgattgaggagaaaagctcactcggtctaggtgaccgtctgagagagggaaagggttgaaagagacccggtctttgtgaccacctcaacagggagtaggtttgcaagaaccgaacctcggtaaatcaaaccaccgtgtcactctctttatttgcttgtgatttgttttcaccctctctttcgaactcgactttatttctaacgctaacctggcttgtagtgtgtgcttaagtttataattttcagattccacctattcaacccccctctaggcgacttttagaaaccaccatttggattaaagcatatttgtttaaaatcatcctggggatgccacatcaattccattatcatgtatatggattccaaaaacacgatgaacactatatatgaatgtttcgttttaagagtatgatccccacaccttttggatgatttgcaaaatacacgagtcactaacaaatggataaaactatggcaaccaaatctgtcggtgtttcgaaacccggggggtccctggaccgacgagtgaattgtcgccgcgtgccccagcctagatgggtcgacgcgaggcggaacgcgaaggggggaaaggaggcagccgaagggaggcaggcgtgagagagtggatccagcggccttcgtgttagccccgcgcctgagtcgggtgcgcttgcagtagggggatacaagcgtccacgcgggagggggagcgagcggccttgcgtgagcgtcgtctcgtccttctccgcgcgggccaaccctctgtaagagggccctggtcctcccttttataggcgtaaggagaggatccaggtgtacaatggggagcgtagcaatgtgctaacgtgtctagcggtggagagctagcgccctaagtacatgccatcgtggcagccggagaggtcttggcacccagttcgcgtggtgtcgtggccgtcggaggagtgctggagcctggcgggaggacaactgttggggctgtcgagtccttgctgacgtcctcttgcttccgtaagggggctgagagccgccgtcgtcacagggcatgcggggcgccatcattactcgcatggtggagcgagccagatgggacgccggtctggttccccgtagcccgagtcagctcggggtagggtaatg

SEQ ID NO: 2408 - DNA, 1381 bp, Zea mays
agtaccactgataaatttagtactgatacataattataattgttcgtaatagtcttccaggttatcaaagtagagacatgcatgtaactacatagagttcaagccagaaacagacataaaaatggcaccatggaatgcgtcaaattggaatacagtatcagtaactttgacacttcatgtggtgcctcttcaaatgtcctgtacactcaacctagcatcaatgaacactatcattaattatcacaaaagtaaatataggaactgtcgaactgcaaatactaatgttaatagaaaataatacactgcacacaatatcatagccagcatcagactaccaaaccgagagaatcaaatttgcttactaataggctagagtgtttctcaaccaagatcgttgtatagaatatcacataagattgcttactaatactctctgtacagtttgattattgttaatatagttcaaggcatatgtgaacaggcatcacacaatataaacctataatttatgacttcatctatcccattgaagtattaataaagccatatgtcccatcatattttgctattttaatgatgcaaggttgcagaaactattaatgacgcagttgaatttgttcatcagaatttcatagaaatgaataaactctaggtccgaatgtagcatctggtatgtcgcaggcttgaaacataagttagaatctgcctttgttccttaattctttaccatgccacgtgaatgagactgtgattaaatccattctcaggttcgccatcctatatgatactgaaagcaatattggaattgcgtgatccggtaactcagcgtcatctggataatctactcaaatgtatttcttaagtcatgcaaattggaattgtttttttaatcttcttatatgtaggtaataaccttcatctcctaagtcaaattgaaggcgttgaccttgatacatacaaagaaattgtttttcttaagtaagatgattatgataaattagattgttcaatgtattgcaagaaaattaatgtatttaaactgtataaagcgatcacgactcgcgcaagccgcgagcacgacactagtgacacatgagctggggacgggagcgagagattatacctaccttgtaagctccagcctattgctcgacaggcttcccagttaagagatacctttctcctgcgattaccgaaccactcgcttcttgtctaatgcccgtcgctgtcaccaattcagcataatgccagtgctgccgttgctgtccgcaaagccatcccctccctgcacgccccctcggcccggtggtgagtggtaggcggccgaagaattccagggtgggtggggagcgcccggaccggagacaaggaagatcgaggc

SEQ ID NO: 2409 - DNA, 132 bp, Zea mays
ccccccaaatctgttggtcttattttccgctctcccacaatcgcttttccttagatccccggaactggatcgatctgccgccaactctgaaaatccatccgatccatctctgtcgtccaagtctactccccg

SEQ ID NO: 2410 - DNA, 767 bp, Zea mays
cctctaggcgactatcaatggttctcaacacttagaaccgagaccgttgtgggccggcctttgtaagtgtctataagtacgactgcattcgtatggagaaagggagaaatgaattggtaacagaaatactcaccgtgttcgcgtgtgattgtttttctacagcgacgagacgaccgcagcgatgtccttgtcgtgctcacgtcccggcgtagaccagcagcgacggccacggacaggaagcgacggaccaaatttctgcaaccgttggattaggcctgccagcgcctcttcggcagtggttgggctatcgtccttcaagtgctgatcgtgggccattcggtctcggcccatgagtccggaacgcacagcgctccgaaggaaaaacactccgcccgccgaaaagagaacccaaccaaagccgcccccaccccgaccaaaccgcccgagccggcgccagcctagcccacgctgttggcctccagcctccttcctctgcctctcccagtcgcccccgtccctttcccccctcgacgtcgtcaacccactacccaccgcaccccacctctaccctcacgcgctgctggtagcccgcagctacctgcctcccttcttgcacccaccgctgccgtcctgcccagatcccgctcgccggtggtgctcccctccccccgcgccgctggcgccgccggagcgagggggactgcccaaaccctagtgggagttggagactaggaggaagggcgcgagatccggcggcggccaccccg

SEQ ID NO: 2411 - DNA, 1500 bp, Zea mays
tctgtttggatcttaggaactaaaacaaaagtgacttagggagtaaaattcaaacaaaaagaactaaaagttatcaaaatagtaaaaaaatgtattctttttagtcacttttagcttatacgaagaagctaagggtgtgtttggttgagaagcgaagggaatgaaatggctccattcttatttttttatgtttggtttctatggaggagagcagagcagttcttggagtctataaatagcaaatatttgggatgctctcgctgcaccaaaacgaccagatgcgagcgctctcatccctctcatccactcaatagtcacatgtctctccaaccaaacaataaacggagtggattcactctattatactcttcaaccaaacaaaaactgtaaggttctgtttgtcaaacacagaatgaaatgattcaattattagaaaccggaatgaagccgttccatgctatttggctccctaccaaacgcaccctaaaggtcgcaaagccaacgccattggtgtattttaattttataagaaattacacgtgttctgaaaagatgtagccgtctgtcatggtttgctgcatctaataagccagtatacgacacacttctgccgttgtccaattaggaaatcttaataagagcatttcgtctgtctgtctacgggagtaccggacgattcatcctggttgttctgggtaatgctttgtctcggggacaaatggccgatagcaaggatacaaatagtgaaaaggaaggtctgctgcaagttgctcatggcagcacctgggacaaaaacaatacgctccccaagaaatacgcacatcccccggccgggcggagccggaggtcgcccggagccggccgagctgtgagcacggtggcatctgcatctgcgcctcccagctttctgataaagatcgtgggcgctactaacgaaaggggaaagatacgtcgcccgccccgcccacggtggtgatgattaacataattattagtggccgctgctgccgctggcccatgctgctgccgccactgctgcgactgcgacgctgcgcaccagtgctgtgctgcatctgcatgcccgtccgccgtgccgtgccatccgaaaaagaragcagcaccagcacggccacggcccacggagcgcagcgctcctcccatgcggccatgccatcggccatcgccatgcggtttttttaatcctgccctcatgattcgatgctcccctgcctgctcccttttgccgggccactcacgtgcgctcgtcaaaccgccgtccccaagggtcaaaaccaagcccgggtcctcgcagcttgctccgtcactcgcctggctgagctctcccactcccacgccgttgccacgctctctcctcagctcctgctccacaacgcacgcagctcgatctgccggcgctataaaccttcgctcccttcgctgtactacggccggctgctgctactgctgcttgtcggggttgagttgtttcttggtgctggg

SEQ ID NO: 2412 - DNA, 933 bp, Zea mays
cagctggactaggtagtggggccgttcgtcagcgacagacgaaggtgcaaggaactgaccagtgggccatggctgtctgtgccatgccaggcagcagcggggttggccgcgtggaggaaaaaggccaggtgggctgaattgaggatggcggcccacttaggttagttttgttttcttcttttcttttctgttttcttttttttttattttgaattcgaaattttaaatttcaaattttgtggcaaatttgtactcaatttttggaggtatgattcaaacatgccatggtgagatgaatttatttatttataaatttattttgtattggctaaaatttctctctcccttttctattttccattttttttctaaatttaaggagtatttggttccrgactaaagttacttatttaaggagtatttggttccggactaaagtttaatttgaatatcaattataaatataaaatataggattagttagatttaataaaaacgtcttatattttagtcttatctatataattaatattataatcaaaccacatttagtacccgtaattatgttgacagaggagcagcggcggcgggagacatgtttttgatttggatctaggcggggggaggggagagcaactcagaaagagagagcgggacggcaactttggttggcgccaagacgaagaagcctcgaccgtccgatctgtggattggctgccaggtgctatggatttccaattctacaattttttggctggcttccctcctcctccccccgccgcctgcaatttgggctgccgcctcccgccgaatccttcgtcgcctcccctccgtctttattactccgatctcctctccctgcctggacatccatcaatcctcatcgccacccaacccgccgagtccccaagcaagttgagcatccatccatcc

SEQ ID NO: 2413 - DNA, 118 bp, Zea mays
tcgttcactacttcactctcgtcgttctccccgatcggttccggcctcgcgttcgtcgtctccttccccctcgccggccgcgtgatctgcctgccgcgcggacgccgcgggcgcgacg

SEQ ID NO: 2414 - DNA, 198 bp, Zea mays
cgtacgcaacacgcgggttgagatgcggggaccaccggcaggctgcgagaaatcccagaaaggaatcacacggcacgccgtctcgtgtgcttcctaggtcattcggtcattccacttccaccaatctgtctcccaatctttcttgctgctccaattcgctctctttactcggccagcggaaggggagaggagggcgag

SEQ ID NO: 2415 - DNA, 404 bp, Zea mays
agtgcgatgaattataagatagcatacatgtgtgttcatgtaacaaagtgatattgttcgaatttccaagattcatctcgatgcacttgaattcaatatgttaacctaatggcttgttatttttattgtatggtaggagtaaggaattcaacacactaaaaattagtttttctcatcttaatttgaagtttgtgttttcttttacttctgagtttaaatattgcttttttgcatgcttgttttcatgcctttgtgaatgtatagatgttatcctattttgtcagacgaaggtataattatttacttatgcagatcggagatcaaatttgagatgttcctgaagtgataaattacactaaatggttgcaggagcatgaatcactgacttgtgaaccattaccttt

SEQ ID NO: 2416 - DNA, 1500 bp, Zea mays
caagctataaatggagtgatttttggagccgcagctctgtcgaaacgggtcctatagtcctactccctctatataattcggacgtgacttatctccagcagcgtactcatccttatacctatatttaaacactactttgtagaacagtgcgaaaccaatggggtatgcaaggaaattacattgtagaacagtgcagtctacattatagaacattgcagtctacattgtagaaccgtgcgactaatttagataaagaaaacttcgtgggatgggtatgcaaggaatgacctatcccccgtcctcgcaaacccgacgggaacaaagttttctctgtttccatatgtatgggcactaaattaccctcattttgaccttcaatggaggaattcaattcgggaatcgggtctcattgccatctctaatcttgttacgtgagattgaccttaactgtggttaggagtgacaatgggatctaaattttacaccgtaagatttaaggatcatatcgggctctgtttttattgatttttgaactaaaatttatttagagtcctgtcattttataaagaagcaaatccattactagcactaactgtggtacgtgagttttatttaaacacgaccagtgggtgagtattattgaagtaattaatgtcgagccttaagtgccacacaaggaggaccaaaggattatgcacgggggggcgactgctaaacaatggttgcacctgaagtgttacgttacggcgcggtgatttggcaagtctaacatggracacggctgacggcacacgtcgcccgacattctttcagcgaaaacgtcgctacctgatacatatatacacaataggccatacgagaaccgcttgattgactcgttggtgttgacatggccattttcacacagagactgagctgagctctgatctctcatacgcttttgtcccaatataaaacgcctaacatgacaactggcgccggtgcacgtcaatattcttttgctcagctacatgtattttggtctgtcacgttctcacacgtcatttcgttaaaaaagcgtgttaatctctgacgggcggcacctatctcttatctctgcagattaattaagcaggtgacggtttattatataccatgggaaaaatattcgtggcaagggtcttaagcaaagcccagccaccgtggccgtcgctgacgaaccggaagagtccacaaacattcaggaaaccggctgttttcaactattgcccgccaagaacaaatgcaggctaagtctgatggaaacatcatcttctagatttcgttcaagggaattacacatcagtacatcacagttcgagtactagtgggtgaaagcaacgcatacacaaagcggcagatgtataaataagcagccagatgcagatcagatcgctcagctctcacgtgtagatttttacttccaatcaaacgctaggtacagtacaggtagttgcttcaatcacttgactaagctcgatc

SEQ ID NO: 2417 - DNA, 361 bp, Zea mays
attagctggtctaagtagcactccttaggtttttagtttgactccccgtataaaaaaatttaggctgggttaaaaaatctcctgatttgtcccatgacaaaccattgttctaagcctcgacaccggtaatgtcttggtcattctcaaatgggctacgatgtcgctgttacgccaaagcataggtctaagactcgaccctggtgcggtattttagcatcccctttttagtttcaatagtgtattgttgttgtccctcaagtgttgtttattatttactttgtttgttgcagctgtcggccttccagttgttcaaaagcaacaccagcttcatgtcaccctattgttgtgtaatgttgctgcc

SEQ ID NO: 2418 - DNA, 1230 bp, Zea mays
aaacatgtgtgcagaaactgcctaggataggggagtgtataaaggttgccccgatatgatactggtgctgatttcatctatcttctcctaaaatatttgggggagaagaatcggctattagtttttttgtcttattcctctataaaggaaccacatgtgctatgcttcacactttttactaggcaactgcacgaagtttggggatttcaggaaaaattatatatctgcaaagttgtccggaaacttacagctactggttctcgcctttaccaatgttctgcagtgttgtttcgagtgctaaaatggtaggggtgctgagtaacgtttacttggaatggttagtggaaagtgatcctctaccaataaacagcatgttctaaaaaactaattaataggccagatgtgtaggatttgtcaacgtttctttttgctacctgagcagaggatttgtgggaatttgtttttttacactctatagtaaattggagggtccagtttgtgtttactatgctccatgatgttgcttcgtgttccctctgttccaaatacattgcttttgctatgcacctagattttcgctaagctagtaagctatgtaactagaaaggtcaaaatgatttagaatttggagcggagggagtagatactacttttgcatcctgcaacatgtactgggagaataatttgagcggttgttttcttcctagaatctggttacaaaatttgatattcttgtgctgatttggtgtcgaggcttggtagattcttcttgccccaaaagcacaaatgcggaggctagtgctgtatgagtggatcagaaatgccaaacttttgccagtgggacttagttgacttagttgactctgcgtgacgaatctctcaacctgaaattgttgtggtcttgttatgtgccaacaaatatgccctttttgtggttgtttagtagcctagaacctttttattgtcttttgttgcttgagacaatagaaaagatttgaacaaagcatttttgcccaaaaggagtacagtgtttgcttgcatccccggtgtccaactgttgatcaacaaatcgcttagttatttctgtatctaaacattctattgcccttttataggagtacgtcagtcttgttggaccatgcagttcatttggttatgaggattgtcatttttgccttagccattttgtgcgtatctaacatttgtattgtccgctgcagatcaaagaag

SEQ ID NO: 2419 - DNA, 630 bp, Zea mays
agtaataacacatatccaaaacatgtgttatccaaaacaggtgttcgctcaaacaaaaaatccgataaaaaaggttactgattgtattgtgttatccaaaacatgtgaatttgtgtttttgtgatatttgtaaactttgttgtattgtgatattttcatattgatatggttaccgattgtattttagattccgaccgataccgatgttttttttaccgaacttccgttttcgatgattccaaaataccgatgtcgtttccgtttccggaattaccgtttccaatttcgtttccgataaaaaatatgaaaacggtaacagttttaatgttttccgatcgtttccgaccgtttttatccctattacaggccactcacgcacacagactaggcctatgaccccacattgtccttagggcttatgcccataacaaatggccagccatcaatgccrccgcttgccgagcaagaaggcagactagatggagtattgggccgcaagtaaaaatgggcctgcaagtccagcgtgctgcacggttagacgaggagcagcctatgccggccctaaacccgtgtccccctcgtttccgctcttctgctcctcgcgccgccgcagcgacccgacgacaggta

SEQ ID NO: 2420 - DNA, 1500 bp, Zea mays
gagatatatatggcctgattggttgtctgtccttcgggcgcctggttggtgcgggcctggtcccctagcgaaggccattttcagcttctcctcgcatgcaagctgaacagtgaaaaaggcactaaatggcctgattggttgtctgtccttcgggcgcctggttggtgcgggcctggtcccctagcgaaggccattttcagcttctcctcgcatgcaagctgaacagtgaaaaaggcactaaatggcctgattggttgtctgtccttcgggcgcctggttggtgcgggcctggtcccctagcgaaggccattttcagcttctcctcgcatgcaagctgaacagtgaaaaaggcactaaagtgcatccgcgcgtgcagtccgagggacgtgaggcacgacaaccaaacacgcgctcgcactcggtcaacgcatgccacgagcctgggcgggtaggatctggcaaccaatcatgcggaaagtgcatgcgcgcgtgcagttcgggagacgtggggcacgacaaccaaacacccgctcgcacctggtcaacgcatgccacgagcctgaacggttaggatctggcaaccaatcatgcggcatatgtccacgtcgactcgtgctaggaatgctgactgccgtgtctgcctcagaatggctcaaccatccgctccgtccattatctctactactctatcttttactactttataacgctctacaatgacacaatataaagagtttatctaggatttactactctatctttggagaatattgaatatgagaatataattgaggaattcatgttaagaaacactagaagaatgatgttgttcaaataaaagagtttaataaacatgtgtgtttcgtgatatatccaaagcattacaatattttaaaacaattattgcattattaacattaagagctagtttgagaactctatttttttctaggaactttatttttccaagaaaaaaatgaactaatttttctcttaaaaatgaaaattccttaaaaaatatagtttctaaactaaccctaacagtatattgttctatctaaagaaaggcctcattttagttttttttaccgggccgccctgccgacgtggacagggacacagatggaaccagcaggaggcacgtggctgtagccacaagatactgacatatgggcccagaaaaccccactgtctgtgcagaaagagcacccaaggtacagtgactctattttattccggactcttccggaatcccaacaacacagggcagggacgcctccgcctcgccgcgccaggcagcccgagcacactccaccacctttcagaaccttccatcgccttccagaagcccatccctcaccacccatataaaccgccccctccggcctcgtcactccccacaccaagaaagaatcacacaacagcagctcaaaaacctaacacacctcaacaagcagagcaaagacccgggattcgccggcgcggtagcgagagcgagag

SEQ ID NO: 2421 - DNA, 189 bp, Zea mays
ggttgggactgttgcagctggagaggcgtctcatgtagcaaccggaccggccacgtcctcaagcttcatcttgcgaatccagatccagacatcgactccagaacaaaccatgctgagtcatatattctggctggtgagataagtccctctctgctttccctgcagcatcttgagtacctagacctcagc

SEQ ID NO: 2422 - DNA, 879 bp, Zea mays
ttattgccatgaatcttcatgcaatcatgctcgtactacaaaaccgataaaattttataatatttaactaagataaacctagcaattagtttattctagatggaggtagtagcttcctaagtcatgttaatttgagtttaaatctcagggcatgtttagacaaagatttaattagctaacaaaaaatagcctaaagtagctctagtgcatctaaatagaagtgttaatagttgaactattctttttcataattttcayctagttgctagccaactagctaaccaaccataaccaatgatacaattagatacacatggccaattactagttatgctaaaaaacaacctaaattagttatagttagctaacaactattagaaactcatctaagatattagttcatctatcagctctcttatttatacgtaatataagtaatttagattatttttagctagctactaaggtcatgtttagaagcacccaatttttaataaactgacttatagaaattgatgtggttccaaacataacaatttatacgtcagtttatataaattggattcctagttttttaaaacccaagaagtcaccttcttctaactaaaatataaaaatcagtttcttaaaaactgtcttgcatccaaacaggatctaagtagttttttttatctaaacagctctttattcacactaatctttagtcccaacgagtactaactacatacatgtgtaccaatcgggcccttgatccggttcttgaaaatctcccataggtttccgcctcgatggccctattgcgtaaaacaataaacccgccttccccaccactggtcatcagtctccactccacgcccgacagagcaggaggactcagaa

SEQ ID NO: 2423 - DNA, 1500 bp, Zea mays
ccaaccaacttttctgcatccagccatctaggaccaggcaggagcccaactttcttgtgacgacggtccttgctcgatggattgcccaagtctgtcagtctgtccgcgcataagctctacctctacgagattttggccttgcatacgcggcctgtctttcggatttgctttgcgccttgtcgaattttatttggccgtatagaccgatcagtgtgggcacggttcattgtagctggactgcctccgcccgccctccactgtgagttccggctttgtttttcacgtgagctcgccatgaaaggctgtggaacgatctgtgctgcttactccacgcagtacagtacttatggcgacatccgtcgtaatcgtcgaaccggattcgtcttactcatacgcttcaggattcaagagccacgaaagcaagagtcgtcgtcgtggataaagtaaattacctgacaattcttttttttcccttgttcgcacgtggtgcaagctaaactttgcccaccaatgtatgtttttatatatttatcctgaacaattggttgcgaccgggatttaaaatgtttttattcaactctacagttgaatgctcgtgcattagacgacgggcgggcccatgagctacgtcaccgacgaatacaaccagatatcgaaaatagcgaaagggggaaaagaatccacgcttgagaacgaactgcatgcgcgcgaagtgaaacattcggctgtacgttcgtagtggaaaataaaactgggccagagcaatacctgaagatttggatgacagatttgaaacacgctggggggatatttttaggggttgcttggtttctagtgactaatttttagtctttctattttattctctaaattaccaaattcggaaactaaaaccccccttaattggactttctagcctactttagcttccaatgtttgcgttctaaaattatcccgcccaccttgtggatttgataggcagagctcctgccgttttcgttcaaaaaaaaatccaatcatttgtttttttagtatcataaatatcaatcgcttttttgtgaaagacaaatacaaaagcttaatagtcttacaaatgtctttaaatcaataaaccaaaaaaattgtcttaaaaaattttatgcagtacatttgtctttgtggcggcgatggtcacctacacgcttgtgctcccataactgtctagtactactgatagagcacaacactgtcatgcattcccattcctttatttatctggacgtgcgccgtcagcaagatggcaactactccggcgctgtcacgcgaccctgcttcccgtcccgagctcgacgctggcctgatatatagcattggagtttgttggacctttggtggctagtcccgtccaaaagaatcgcaactcgcaaggcagcagagagcgaaggaggccaaggccatcgctctcctagcctcggagacttgcctttgcatacacatccccccggagggcggtgtgagggc

SEQ ID NO: 2424 - DNA, 52 bp, Zea mays
ccctggctccggccttcagccgcctcgccagcgacgaccacggctgcgtcac

SEQ ID NO: 2425 - DNA, 1013 bp, Zea mays
tttaacgggcatgtaaatatttttgtttttcttgtgcatgtttttttgcctctacatgaatggaacccccaaaccccaaactccaaaccccggggtacaataattgtaagcggagaatgaaaaaaaaaacagtgggcagcacattggccctattcgttttcgattttttcagctaccattagaagctgctgtagaataccaaatacttagtttttcgacctttttttataatcattttgacgaaaactatctaaaattaatgtgaatatagaatcgaccgagtcatcgtgatagtagacactgtcaccatctagatcataaaagcctatataatccttcgtcttcatctgtatatgtcggcgtttcgagaccggggggtccctaagccgacgagtgagtgtgccgcgtgccccagcccagatgggtcgagcgcgtgggcgagcgcgaaggggggaaaggagcgaggaggccggagtccggcgagagagaggtgggaatcccgcggccttcgtgttcgtcccgcgcccaggtcgggtgcgcttgcagtagggggttacaagcgtccacgcgggtgagggaagcgagcggccccaagagagcgcttgtccccgtcctcgtccccgcgcggccaaccttctctaagaaggccctggtccttccttttataggcgtaaggagaggatccaggtgtataatgggggtgtagcggagtgctacgtgtctagcggggggagagctagtgccctaggtacatgccaatgtggcagccggagagatcttggcaccctgctggcgtgatgtcgtggctgtcggaggagccacggagcctggcggagggacagctgttggaacggttgtgtccttgctgacgtcgccctgcttcccgtagagagttgagagccgccgtcgtcacggggctagcggggcgccatcattgcctatctggcggagccagccagatgggacacaggtcttgttctctgcgacccgagtcggctcggggcagggtgatg

SEQ ID NO: 2426 - DNA, 1500 bp, Zea mays
atatataggagggggatgctaattaactggcattatatattggtattcttcttcttttttgtatagattgcttcagaatatataatataacatttttggtttgaaactttccaaaaccatacgataaataattacatgttccaaaatatataggtacatatatactgtctatttgttgaatgtaataaaaaaagtaaaagaatcaaactgtgtgggtaattatgtcggcacactcttggtctccagctgtacgtatgttttgttttttttctcggtttccaccttaaaaaaactgagccatttctttgtctatatttattctcttcgtctaataaaaatcacaacaaagctctttaccgtttcttcgaaggaaaaaaaactgcttgcaaaatcagatatatatcatagatgattgatccatcagatgatcatgcatacgcgctgaaccgtccaagtcagcgacgacggctcaagccaaggtagtgggtacgtagttgctgcaggcccggctttattagggccttgagccagaagattatactactgcaagtgccatcatattttagggcaatatatatataggagggaagggggatgctaattaactggcaatatatattggagggggtattcttcttcttcttctttgttgtatagattgcttgagaataatataatatttttggtttgaaactttccgaaccatacaataaataattacatgttccaaaatatataggtatatactgtctatttgttgaatgtaataaaaaaagaaaaaagaatcaaactgtgtgtgggtaattatatcggcacactctcttgatctccagctgtatgttttgtttttgttttatcggtttccatcttacaaaactgagccatttcttttgtctaattttattctcttcgtctaataaaaatcacaacaaagctctttaccgtttcttagaaggaaacaaaaactgcttgcaaaatcatatatatatatcatagatgatgattgatccagcaaatctgtagatatatgcatcatatatatactcatcacttggcacgaacgaatttgttatggctattatattagttttaaggtgacttgctcgatgcatatttgactttatttaggatcagtttggactacagtttacacattcgtacgttgagcagcctctgtccagggttagtgaagtgctgttgtctgacagacgaataacatataaaaaccactcctcattttccttttttccccccttgcaccacccggaaaaaaggtaattattagcgagtaaacgattgtaaaccatgcaaaacacgcccatatacaatgacgtatatatggtcaacgatagttgcattgcacccccctcccctccgccttccagctataaatatcgtctcgctcctcacttgagcagcaactcgatcatctcccatcacttcctagtccttcttactcaacacattattcgatcttgagtggaagcaagcaggctagac

SEQ ID NO: 2427 - DNA, 800 bp, Zea mays
ctgagcgaaggcctgagctccatttggtaggagtcagctaatggtccagagacgtgctccataaaagtacctctgggcgatttgcctggtctcagtcccattctatgggatttgagggctcgattgcctcccttcgatgggataccatcacgaatcgcatccgagggtctcggatatgacttagggtacctcaggtcgtagcccgagtcttggccatgtatgggcgtacccatagtcatccttggctctatgatctgaggcaattatgaagcccttccgaggggccaacctttgaaccccttatcaataacgggctcggagcccatatgtcctgaggcagtttcccgaaccccgtcgagggcccgaacatcgaacccctaaacagtactctgctttccttctcctttccaaaggaggatgcctgaggcaggggacgctctcttctcgttatctgcaaggagatggaaaggaaaggagagagggagagaaaggcataccttttgaggcgaaagctgactgtgttatttccatcggaagcacatgtatttaatgtgatgggatgtctttgcctgcaagccgaccattgtggcgcgcatgcgcgtgggattcgaagcaacctagcctactttgactcggaacggattggccaacgtctcggtgactacgcatgtccctataaattcacccgagaggagatcttcggttctttactttctcgcttcgccttcctactctagacgccttctgcctcagctgcaaaagtgcacattgcctccttctcgtctccctccttaaccccg

SEQ ID NO: 2428 - DNA, 1500 bp, Zea mays
gaccgttcacgcatgcacaaaatcagttatggttccggatttcttgcgggatttgttagttcaacctgcgagattatctcgagaaccgacttgtaacgggtccagacctcccttttatatagataaagggctacaaccgattgaaccccccacaatcgatcccaatcaactctacttatcgtttttaccttatgcattagaagtaaccctagtttagccttcctccacctagaatcttcacatctcttcgtctctacttcgactagatacgtcttgggtggtctgccgacgccaagacacactctaagatctcttcttgccgacatggtccctcttgagagacgagatctaggtctgctgcgaaaaaaacgatcctctgcgccatcatggaccgtccgagccacagacgcggaccatccggacgtacgcagagaatgagtcgctgctgcggccagatcccgaaccgtccagtcatgtatcgtggaccatctgcatctctgcagagaggcggagagcgtcatcagatagttcatcctatgtttggtattcagatcgccccagcaaagtagaaggggaggggcatccagagatacccctcacacaatgccatgaaggccaccttgggatccttctcccaccgcgcatgtcatgccaactgccgccggcgccgcggtgttcggtcggtgtcccgcgtacgctttacagcatgtgcgccactgctccgtgcgcctcctgtggcaggccgtatgcgttgggccctgcatccacaaaaccgcagcaggaccccaaccgtcatccaactgatacgacacagcggcacaaaaaatacggcgcccgctccggcctcagtcacggaactcccgctggcatgtggacccagcggtcccggaggcccacgtgccatacagcaacgcaggctgataggaacaacgcagcaaggcattcttctctcgcggaaatgacactgttacccctcgtggacttcagcttgcctggaccaagtccacacgccgtgttgcctagggtggcgacccgaccttctcgacaagtcttgcgactccagagccactggcccatgcaccgaggccacccaacctcccctcgttggccgtccacctcctgtccacagggccccgagattcccacttcccaccgcgctccttgcaccctccccaccacccgaggccggtcccgccgtccgtctgcctcgggatacgtgtcccggctgaaccgcctccgtgaaccgagaccacgcggaggctaccggcgaggcgccctccccggctcccagcttcctccctctttctactcctcaagtcctgactcctggagtcctcacacgtatgagacgccccccacctgcacgaagccaccatcccgacattcgccgctctttctccacgcgccggtcgccgcagacgcaagcccgcccgccgcagctgacgccgcgatctgcgagggtgcaagctagctctggccccgctgccggtgccgactgag

SEQ ID NO: 2429 - DNA, 867 bp, Zea mays
gatgtttatttttgaactaggctagtctagccgttgatgtttatttttgatcacacggccggcgagctgagctgtatatataaatagaatgcaactgttagctgtaagcgtgcattgagatgcatatatgggtacagctcaatcgatgctatgaaacagtacgtgtgtttaaccaatcacttatatatctcatagtcaaattgactagctaagcaacagataaatgacgtggcgtactgcacactactggcgagtacgtacggtcggtcatatccctgggcacagacactgttgcgatgaagatgacccggcgagttgaaagatacagcggctagcgcgtggaacaagacgcgcgcgacatgcgacgacgcacacacccggctgccagcagcttctagctcacgagacccccctggcccctagctagtaggtaaaagcttctccgaggcgtctctctcgccaagccctcatggcccgcccccctatatctctgcccgcgcgcttgcgtgaaaactgaaaagaacaccgtaccgcccccaagtgcttcagagaggccggccggccggcaaagaagttaatttagctgagcgagctctcgacctctcgtgccgtgtgtgcagtgtgttcttcttcctcctcctgtcgtcgcctagagctagctctttatcaaattaaacactttttgtcaaatcagttcgttctggaatccgttatagttgcctgctgccgtcctcttcaagtagtgcaacaagaaacagggagctttctttatcttttctagcagttggatagggttagggttttccgttctggccttatagatcatcggtcccgattgatctgggtaagtgatcgagtagtagtagt

SEQ ID NO: 2430 - DNA, 517 bp, Zea mays
aggcctaggcgctcgcccacggcccaccctagctgccgaagcgaycccacgccacgcgggtcccgtacaatagcgaatgcgattgcgatgccactccaactccgatccgagcccacgcacgcccttcagaggaacaccgctgactcctccacgtgtcgcgcatcagcccctcgtcccgccgtcccgccgcgtcgcgccgagcagctccttgctccgcactcccgcgccacgtcacccctgtcatcgccgatctcgcgtcgcttggcctccaagtccaggtccatgtccaacagacaaaaaaaaaaccccgcccccggttcgtcacttcgtcgctttctcgtcgagccgcgactgccgactgcgaccgagagaattctctatccggtccccgtccggtttggttagagttcgcactcgtgattgggttggtcgcttggttcttccctgccggaagatacctttcgttcggtgtcgccaactcgccattcttgggaggtcttggtcgggaccggtgctg

SEQ ID NO: 2431 - DNA, 1500 bp, Zea mays
atgcttctcaaaatcttattcatttacctttgactatttgcaaaaggactttgaaaagaatttgcaaaaacaaaacatgtggtgcaagcgtggtccaaaatattgagaatataaagaaacaatccatgcatatcttatgaaaatatttattggtctcaattctaagtaacctttgcacttacattatgcaaacttgttcaattatgcacttctatatttgctttggtttgtgttggtatcaatcaccaaaaagggggagattgaaagggaattaggcttacacctatttcctaattgattttggtggttgaattgcccaacacaaataattggactaactagtttgctctagtctataagttgtacaggtgccaaagattcacaacaagccaataaaaagaccaaagatgggttcacataaagagagctaaagacatcccaaaggcaccctggtctggcgcaccggacagtgtccggtgcaccagggaactcgacgctgaactcctcaccttcgggaaaatgggaggccactccgctataattcactggactgtccggtgaggcaccggacagtgtccggtgtgccagcggagcaacggctacttcccacgcaatggtcgactgcaacgcatttaatgcgcgcctgcgcgcgcaaaagacagagcacgcgcagaaggcgcaccggacagtctacaggacctgtccggtgcaccaccggacagcccagaggccccaccagtcagagcttcaacggttagaacccaacggccgactgacgtggctggcgcaccggacagtgtccggtggcgcaccggactgtctggtgcgccatgcgacagacagcctcccaacggccacttttggtggttggggctataaatatcccaaccaccccacattcaatggcatccaagttttccatcttcaacacattacaagagctatagcattcaattctagacacaaccaaagagatcaaatcctctcccaagtccggaatacaactccaaatcaatagtggatagtgagagagtgatatttgtgttcatttgagctcttgcgcttggattgcttcttttctttctcattcttcttgtgatcaaactcaattgtaaccgaggcaagagacaccaattgtgtggtggtccttgcgggaactttgtgttccgtttgattgagaagagaagctcactcggtctaagtgaccgtttgagagagggaaagggttgaaagagacccggtctttgtgaccacctcaacggggagtaggtttgcaagaaccgaacctcggtaaaacaaatcatcgtgtctcgctctttatttgctcacgatttgttttgcgccctctctctcggactcgtttatatttctaacgctaacccggcttgtagttgtgcttaagtttataaatttcagattcgccctattcaccccccctctaggcgactttcaattggtatcagaacccggtgcttcattagagcctaaccgctcgaagtg

SEQ ID NO: 2432 - DNA, 285 bp, Zea mays
agtaagtattgtcttgtaatagtggatgattattctcgcttcacttgggtgttctttttgcaggaaaaatctcaaacccaagaaaccttaaagggattcttgagacgagctcaaaacgagttcggcttaaggatcaagaaaattagaagcgacaacgggacggagttcaagaactctcaaatcgaaggcttccttgaggaggagggcatcaggcatgagttctcttctccctacacgccacaataaaatggtgtagtggagaggaagaatcgaactctattggac

SEQ ID NO: 2433 - DNA, 1500 bp, Zea mays
aatgaactaattttccttaagaaaaagaaaatcccgtgggaaaacgaggttcccaaactagccctaaaagaaaaaagaaaatgtgcctgtcaccgattgcgtgttgtatgcctcctttgttctagttgatattatcaaacgcaactatattatcttttaatcctagttatctaattgacaccaaaggacggcatgtaccgtactgattagaaaactaagattaagggttagtttggaaactccattttatatgaaatttttatttttctaaaaaaattagttcatttttctttgaaaaataagaatttcgagggaaaataaagtttccaaactagccataaaaagaattttcaacaagaactataactcctttgtgcacttggtggttgttttcctttgaaccgttttaacttttaatactatcgggtttgatacatttagtaggaggaaatgtctagctagttgtacaacaaatgcacttgcacacgacaccacctacgatccaaagacgagcaacatctagctagcgcccctgctgtggcctgcctatagatcgaagcgatcggccggcccaatcgaaatcaaggggccacgggagaaactgccgtcacgcaagtcggcgacggcgagtgtctagcacgtgggcaaggagcgtctagtcatagaggatgcaggcattcagctatgtatgcactgttgtcccatgttggaacttgtaccatcagtggacccgacaatgtaaggaactcgtagcaaacctttcctaaagtgcccttcattatacgttcaatccaaccctaaatatcataatgagcttacaagagattgtcaaagcacggttgaacctagtgagaggtcaactaataagagatcaaaagggaaagacatcagtttagaaagagatcgtggttctatgagtcgcacgtatgtttaaaaccaatatgttttttttgttacatgtgtaacgtaagccgacgtatccgcgtgcgtgtaacgcttcgactactacaaacgtaatgtttataggataggaaattctccgatcacctacacaagaatatacgaatccatatggtaattaggttctggaaaacgcatacgaaacagtgaaatttggggcgcaaactatgaacgccctcctacgtagagcacaaatggctcatttaaccatgagctaaaaaccggtcacatgtaccagcccgaccggcggggcactatggtaaaagggcaggcaggccacgcgctggaagaagaaaaaaaaaatacaaacatacatcccccaaacagcacggaacaagcacacagcccttggccggaggcggcggcagggcgaatctccgcagcctgagattaatcacaggcttcccaccaggccaccaccctttccccactcgacgtcctccctcgccccctcctcctcctgttaggccgagtggcaaacccctagctactacctcgctccagaagctttctttcccctagatctcccatcccatcccc

SEQ ID NO: 2434 - DNA, 1500 bp, Zea mays
atgttaaagaaagaaacaatccatgcatatcctataagaatttatattggctcaattctaagtaacctttgcacttacaattatgcaaactagttcaattatgcacttctatatttgctttggtttgtgttggcatcaatcaccaaaaagggggagattgaaagggaattaggcttacacctatttcctaattgattttggtggttgaattgcccaacacaaataattggactaactagtttgctctagtctataagttctacaggtaccaaaggttcacaataagccaataaaataaccaagaaaagggttcaacaaaaaggagcaagggataaccgaagtgctccctggtctggcgcaccggactgtccggtgtgccaccggacagtgtccggtgcaccagggaactccaaactgaactcaacaccttcgggaattctcagaggcgcttcgctataattcaccagactgtccggtgcaccaccggacagtgtccggtgccccaaggaagagcagctctgaactcgccagcttcgggaatccgctccgctataattcaccggacatgtccggtgcacaccggactgtccggtgagccagcggagcaacgactacttcgcgccaacggtcgactgcaacgcattaaatgcatgcctgcgcgcgcagaggagcagagcacgccgcgggtggcacaccggacagtctacaggacttgtccggtgcgccaccggacagctaggcgggcccacacgtcagagctccaacggtcggaacccaacgtcctggtggcgtggctggcgcaccggacactgtccgatggcgcaccggactgtccggtgcgccatgtgacagcagcctccaccaaacggctagtttggtggttggggttataaatacccccaaccaccccacattcaagtcatccaagttttccaccttccaactacttacaagagctctagcattcaattctagacacacccaagtgatcaaatcctctcccaattccacacaaggctttagtgattagtgagagagatttgttgtgttcttttgagctcttgcgcttggattgctttctttctcattctttcttgagatcaaactcacttgtaattgaggcaagagacaccaatcgtgtggtggtccttgtgggaactttgtgttccaattgattgagaagaaaagctcactcggtccgagggaccgtttgagagagggaaagggttgaaagagacccggtctttgtgaccacctcaacggggagtaggtttgcaagaaccgaacctcggtaaaacaaatccgtgtgtcacactctttattcgcttgcgatttgttttgcgccctctctctcggactcattattatttctaacgctaacccggcttgtagttgtgattaagtttgtaaatttcagtttcgccctattcacccccctctaggcgactttcaattggtatcagagcccggtgcttcattagagcctaaccgctcgaagtg

SEQ ID NO: 2435 - DNA, 216 bp, Zea mays
cagcaggtaggcgtcgcgtgtcccccgacccaaacccgacctcgactagcccctttctgggattccaacgaattttacattccgctctttgcgcgattttggtggggagcggttcgttkggttttctccacgaactcatcctagggtttcgtcagtgcgagcttcctgatcgctcgtggctctactgcgaactctaatggcgattgcgttgtggtg

SEQ ID NO: 2436 - DNA, 55 bp, Zea mays
aatttgccttgcaggtttatgcatccgggggttcaagctggattatcgacagcgg

SEQ ID NO: 2437 - DNA, 722 bp, Zea mays
atggcggatgtcatatcttgccacactgagagctctgcctttttccaggtgaagctttaccctaggtgacaaatagcgttggtatatatataatgtggaggcttagagctgtatagctttgctatcttttatatttgaaaaatctatacaagtgtagcgttatttggatttttaaaatgggccaataaccaaacgctctcacatcaaattcctgaaagacatgtgctctgacagtctgactgcggccagcccacgcccgcggtcctgcgtccgccggtcgacaggttcaaatttgaacgtgcgccgcaccacaccacacacacaacagcagtctgcctgcagaccgtcataaaaaacccacccgaaaaaggcaccacgacagtacgccacgccgcgtgctgggtacccccaccgcatcatgcccccaccaccacccgccgcaaccgccgaccccacacacattcctccctcagtccctcttccccccgtttcatcccttcacacccacagcccacctggtctgtcatcccctttgctacgctccccttgccctgtcccctcgccgcccgcgcccgtggagttcttcgatcgagtcctcggagcccggagcacctggtgcaacaatccggacccgcgcgaggaagggcggagagagagccgaatctgagcctcggcacaagttgggcacccgtcaagattctcggcccgatctgctgcggaac

SEQ ID NO: 2438 - DNA, 627 bp, Zea mays
ctgagcataaaaaataacttcaccgatgaagctgttttgaagaaaaaaaacaagcgtttggcaaaaaaaaggtcatgaaactgttagtgaagctgtgctaaacagatacttattcagtttagcaggatgcaggaatccttgttctgatgacccgtagcaatagctacttttatatttcgtacagtgtatatgtactacaattttgtatattgatttatacagactactattattatatattatgtacttatgtaaatcggtctaaaaatataaaaccaattactaaaaatgtaacaagaataaatgttgatgttaaaataaagattacgcacccaaaagttgaaggacattccttgacatatctcattgctatgcaatacgccttcctaaatttcgctggatgattcaagtttttttaaaaaaattattcattcgctgtccattttatgctcattaatggtatttttgtttgttacatttatcgtatgtcatgacactagaccagtgagtgtagcttggtggattgcctaaagtacttcgctgtggtggagcatcttgacagctatcgttgtgaccgttgttggcacatcattgctgccaaatatctttctcttagatcaaaagttg

SEQ ID NO: 2439 - DNA, 921 bp, Zea mays
ctggtcgcccgacttgaaatcagtgatcaaggctacaagttcaaataaatgcactatcaagaagttccatggagaatttaatgaaaataatttgatgttgtagctgtttgtgcattttccaacaaccgtggtcgcagttagagaagtccgacttaggacagagctaaagtgaactataatttggaatggatagagtacattctaaccttagtttttactccctcagtccccaaaaaatgacatcctagtattaaatttcaaagattgtccaaaaaaacttggtctagcccactatacataatgagtctatccactttaattgaggggtctaattagatccaagcatgctaactaatctgcatgcttccttatgaatagtactagaatgctggccgagtaaacaaaatgagtatcagacaagaatagcggggagaaggggggattgggttgattattgatactcctttttgaattgtaaaatattatgctaagcttttttagaacaaaagtttaattccagctggctgactacaatcagcagtgtgctaatcttcttctactggaatgaaagcacacatgcactctgcagtgcagcctaacctatttatctaggtgggcgtaacagtctcattgctattcatgttagcttttaaaaagtttgatgagtgcaatgtggtaaattgagctagcatcggggagctgcgccataaagataagtgaaactgcatttcatgaaaagggcatagttaatgtggtttgacttctggtggaatgtagaccaacttattgacatgtgcttccatgaaaagccaaaagggcatgagtgcaggaggctcccacatgagtggggtctggggggagggataaactgaggcaagccttctacctgcaaatgcggagaggctgcttcaaatccatgac

SEQ ID NO: 2440 - DNA, 1105 bp, Zea mays
agtcaatctgggatgtattagaggagggcgtggccgtagctatagctaaagctcgtgtactccttcctctactggcatgcagtgcagtgcactgcttcttcctgctcgtccactgatacgaattatcgctactactaatagtatcgaggtggtttggtttggtttagctgttggtttgttgcgagttgtgatcggtcgtgatcacgtacgtgatgactgatgagatcatttatgcatgtgtgtctgtaaatttggtgtctgccagtgccagtgccagactgatcaataatagcagaggagaggagatgaataaagagaaatttagatatgtactattaaaagattacaattttagatatataacatttctaaagttcacagacttgcactagtacgtatgttccacgtatcacaatgactgagactattacgtttgggatactgactgctctccgtcaataagcatctccggccaatccatcgccgtgccatgcttttccgccagcaactgctccgcactgctctgctctgctctgctctgaactccggtcgccgatcggattatcgcttgctaaccgtacgtcgccgccggtggatagtggatactatactacgagttgcagtcgcaggcttgcagcatgatatgcgctaaaacggaaacaaaaggagtgacacgtgccggagccgaactgctcattttcgccgttcatggctgactttggtgctccaaagctatcatcaagcccccgcttattataagagcccaactctcttcgggccatatccgatcgcctctatctaggccttggcatttggcccattcacccaacatctttctgccaacggtatcatggagacgtggtgccagccaggccgttcgtgctcgctttccacggcccagattgtgtaaacggaggaacaggacccggcccacaaaagtgaacgaaacagccgctccgcacgtgcccaagtcctcccaactccctactcccaacacctcgccgtctactcgtctcccactcccccctgcaccaacaccaccaatcgggtcccccaccacttccgtcgccctcgcccgctccgccgcgccccgtacagcggcgac

SEQ ID NO: 2441 - DNA, 1500 bp, Zea mays
gcagatcgaatttactcgtattttarctgttggcacgtatgttttattcatacctataggcccttagttttttttacgcttttatgccattaatggggggactcggggagagggtaaggtcatcgctagcaggccaataaacggccgtgcaaagtactattttttaccgtagattgcactgtttgtaaggtaacttttgaaatagtgaatgagtgaagatagtctaaaagtatgcaagacatagaatgagattgataaggtgagtgagaggcaatgaggtgagttgccatatttttcgtatgcacttttcgtacgtttttcatgcattattctacatacttcatgtcttgcgtttgtcacttatttcatatactccccccagtcgagttagaacatgtacttgggcctaacaattaatcttcaaatttacatgttgcgatatattgatttatatgaatttaatttagcattatcgttataatgctacaagtcaatcgccttgaaacctcccgccgtgcatgaaaataaaaaaaaacccagaggtgaagcactgtctgacgggtgaggtaatgccaaccaggcaaccacaccgcacacgcaccaggggggagcgtgcgcgcccgccggcgccggggacgacgaaggggtgggtgcgctgcgccggcgaaacaggccggcacgcgggcagaggcagggcggcatgggcactgcacggtgcagggtcttgttttggactcccgagaggctgcagactgccaaggtcggcggccccggccggagcccaccgtacaacaaatagtactcgcgggcgccccgcgcccgcggcacactcgccgacgacgatggcccccgcccacagttcgccattaaagacgagcgccgtgcagcgccgcgaactccgagacgttgagaggagtactggagtacagtaatacagtatgcacggtcatggtgaagctggataggtcgtcctggctaattaacccagctgcagctaatagtcaagcttgcaatttgcagggcaaacaaaggcgtagcagcccgtggctccgttccgggacacgtgccctgtcagctgtcaaccgttaatttgtgctacacctagaccgcactctgatggaagattatggtggctgaagccgatcgagatgaccaacgcgttcgactccggagcagctgctgagctgcaggaagcaggatttgcactagcaccgccccacccccttccagttagttatccactttccccacaaagtcttctccgaatccaccacttccacttgcgttgcccccgcccgcctctgtcgtctcccgtcgcgccgcgcgcaggctgtccagcatgataagtagctgccgcgccgcgccgtaatcgatccctcctcacaacacaggacgcaacgcatccaacccgccccgcccgccccgttggattcgattcctcccagacttgtcgtcaccaagcagcagcagcctttccctccctcccacactccctttccc

SEQ ID NO: 2442 - DNA, 212 bp, Zea mays
agtcaatctgggatgtattagaggagggcgtggccgtagctatagctaaagctcgtgtactccttcctctactggcatgcagtgcagtgcactgcttcttcctgctcgtccactgatacgaattatcgctactactaatagtatcgaggtggtttggtttggtttagctgttggtttgttgcgagttgtgatcggtcgtgatcacgtacgtg

SEQ ID NO: 2443 - DNA, 723 bp, Zea mays
aggaaaacagaaatacccaaaataggttgtaaaactagcactatttgcaaactcaaacttaatgggtgtttggtttctagggactaatgtttagtcccttcattttatttctttttagtatataaattgcataaatatagaaactaaaataaagttttagtttttatatttacaattttagaactaaaatataataaaatgtagggactaaacattagtccctacaaaccaaacacgcccttgtaattttccatcggtatgtcctccgtcttcccgaaagccttcattcggctcgctgtcttctttctatcgctcacaaccaacaaccatagcccacaggccgccggcggccgccagccgacgtcctcccatttcgctccccctcctccgctgcggtcgagcaaaagttccggccatccggcaatcccccggcacccggcggttcaaatcgtatctttctgacctgacgcggctacgacgtcgctcctccggtcccttcgatccggtgggrtccgtttctttcaagcgcggcctcgctggccgcctcgtggcagtgaccgtcgaaccctctataaatcccgtgccccgagcacccttcctcgatcacacaacccaaagcagccacagcagcctccttcctcctctcactctcgctcgtgctgcgctcgctacctcgcttcgcattccattcgaggagagcggtgagaggggaggaaaggcaag

SEQ ID NO: 2444 - DNA, 168 bp, Zea mays
tacccctgtttctgtctgatctggtcttgtatctgctcattctgctccatagcctcgttgagttgtggcatctgtgttgctgaatagtgcctgattcatatcgttggtgctatgtctagggcaaggtgacaatcaccgccaagtctggagtgaagttggaggttccag

SEQ ID NO: 2445 - DNA, 948 bp, Zea mays
attatgtaatcagtgtgtacgtgagtttctgattcataattcacattcagttttttcatttttaaaacgagtgtgacatgaatgctctagatttagcacacctagtacttgtttgagcacgtcgcctaataaaattccccattccaatacacagatctcgcacccgtaagtggcgacgaatctcgcggtgcggaggcgcgacagaggcggtgtcgactccgacggactcgcagctaccggtggagacgccccaccggcgcactcctccaacgtatgatcttgcctgtctcccttttctctttgcttaaccattttattgctcgacttcgatcaccaacagtccaatccattagagcactggtttacagttccatttagcttatctgaaaggattcgccgagtgtccgtcgggccctttgccggcgacgagcataaaactggcaaggccgccccgtatctccctttaatgcgcaaccgagcacgccaattctggccagatccaggcgtccttccgccgctctgttatgaataatcattttttcgaccaccgcacgtcatggttagctgtgatcctctagatctggaccgcctctgccaattttcttggtgtactctcctagatccgggctgcttttgtcaaatttcctgtaggttcagatgcaatgcgtgttcacacgtttttctggcccatttacaatgtgttaccctgaatctgaatgatgtaaggggcaaataggttgcttggttcatgtgttttatagctactgttgattgctgaaatcaattactttaagtgactactcctttatttttcccagttcttacaatcagtagtcatgtgtattcttgttatgattactttgctgatcgtgtaattggtttgatgtgacaggttcatagtttaagggcttgatttggataattagtcatcaacagaagtgataaaaa

SEQ ID NO: 2446 - DNA, 1500 bp, Zea mays
ccaaaaggaccctctccctgcacagagcacaacacatgggcaggcgctgttgggccgcctcacctcgagcgacgtcgacgtaccttcttgctgcggttgggacctacctagcttctctcccgagtccggacggttgaaaccctcgcaagctgtctgcccatcaccgtcggccggctactttaccagctctcccgagaccccgccggtgccggtggaaaaacaaaaaaactgctagctcggtcgcatctagcttggtacgttgattgcaaagtgacatcgcaaccgccgtgccgctcgctctgtcttggtggggccccccgagcgtacgtcacgcttgcacttggcatctcgcgcgcgctctggccgaagcagtcgccatgacggacaaggaatgcgtttccgtgcgtccaaggaggccacgacagatcgataaaaaaccttcctgctggttccagttccagccagcgtcgtgtcgtgtggtgccaccgggcgtaaacctaaaccgtagggctcactcttgtcttgtgtataaatataaagtcgctctcgagcacgacgaatgcgcgtcatgcggtgccacaggacgcgcgcagcccgctctcctccgtctgcgcgcgcacgagcggagcggccactgtcgtgctcgcgatggcgttgttgcttgctgctcccgccacaggacgggacggcggtgcccactatagcttatagctatatacgcgggagcttccgatctgtactcctacataagcacagtcgacaggtcgatcggtatccgcggtcctgcgccattaacaagtcacacggggccggacgggtggtgggcgcgccccggcacctacctgatgatgtcgtcccgtccctcccctcccgcgccgccgtcggtccccgaggcagcaagcgaagccgatcagatgcgccgtcgccgttccgccctcgcgcgcgcgcgtcgcgcatccagcctttattactccaaatgcttggagtatatcgcaaaaaccatcatcaacagaccccgccaccccaccaaccgcccttgactccaagcatggcgccatagatgccagcggagggtcctgatcgattcataaacacgcgcgttaatgcatcgcctttctccgcgcgcttggccttttccttttccttttcttttctccccaccaccattgttgtattgtatcgctccgtcggttcgtcgtcgtgcgacgtctcgtcatctcccgacaacgaggagatgctatgctgctactactacggtactacctactgtgggaaaaaaggctgaggccacacctcaacctctcaacctcaactgctgcatgccgcctatacatactacgcacgcagtcgcgcccggccctgcactgcactgcacgggcgcggcgggagatcgagaggagactttgctcgcttttggtgggcatccgcgcggagcgtgaccacagacggtgtagagactagatagatcggaaggggatctaggcatagagagcgaggagg

SEQ ID NO: 2447 - DNA, 1500 bp, Zea mays
atatctccaattgtgccctgccattcacgccgccgccaatagcaggttgtagagcaggtggtggttagggaggagtcgaatataggtgagtttgtgttggttcgtgcgcactgcatttgtgaaataatatggatttatccatagaggtttgatcgatttgattgttctccaaccaaataactcaccagctcaaatctatatcatgtggagttgtacataatataggagcttttagcaatgtggtgtattttgacagttttgttagattaacagcagcccagtgggagcatgaactatagatcccagtttaaacaatagttggagagttcaatgaaattttaccttatcaggtggattaaaacaacattgatgaaactaaataaagttggataaaattagttttgcagtatttgtttcatctttacagtactgtataacataaagttgttggtatacaatatagtagatggccaatcggtacataaatattggtgggcttccttcttattggttccattttcccactttcagtaaggggtggtgtttgtgctttaagagtttgtgaacttgagaaagttcagataagtaatgtttgcactgaagaaatgaattggccacaagaatccaaaagttcaccttcttgcactaactgtaagtctttctgtgattatgtgcactaactgtaagtctgtctgtatttcttcaggtgacccgttcatctttgagacgtagcgccacaatggcataagggagctttgccctgcgaatggaggagcacaagataatccgtgcccgtgctctcacccccctgcataaacccaattctgttacgatgaggttcattttcgagctcaaaggtactctaattacttatctgaactttctcaagttcacaattcgaaaattggaaattgtaggctgtttcctgtatttttccctttctaagtcaaatcatccaatttgaggatcactcaatctttcttgtcgatgcttgtctaggctcatgggtcttatgtccagaaacttagctggtctccaaaactcccatctaaccgaccatttgcaggtttctgtcctgataatgcaatggttgttgacagatacactacaatccttggggctccatttaaatttgaaattccactttttattgtacagaaagtaccacctaataatgtccacagttttgtacatcccattttttctactatggtccaaggtggtaatataaaattattcagaaatctgcttcaaaaacaactaatcacttctgttttcagagattcacaatctcagacttagccattttttctgttagactgcagatagttcagaaatatgtttttgaacccctgaattaaattgtttcttttgttatcattaatcgacaatatgcccaaaagattccccagacttcaaacctcaagtctgggccaaatatttgcaatgttctagaaggaatgtggctccagctctaacggtgagtccgacgaggttgcg

SEQ ID NO: 2448 - DNA, 856 bp, Zea mays
gtgggctgtttgctggatgaccatgacgccgcctgccagcgaatgggacatgacgcatttaatgctgagagggcacgttgcccgtcaacgcagtggcaggcggcgcgtttttcctcaataaatgcaggggccgcacgacttttcgtcagggtcggcccggtatcttatgtcatggggccacaagcagcgggtctcctcctgagcgggaagcggaggcgaggcccgcacacgtgtcagcgccggacccctgcacacaccagggtccttctcgctccgggaccctgctggagttcggacttacccgaaggctccagactcgtgtgtaggggtccggtgtctttctgtgggggtccggccttactggggtgaggtgtctttccctgatctgtgggttatttgtcgttcttgttgcttggcttttgcaatcgtgctttcttcttttcccattcttattctcaagtgacttataattaaagcaagagacaccaagtgtgttttggtccttgcggggtctaagtgacccgtttgattaaggagaaagctcactcggtctaagtgaccgtttgagagagggaaagggttgaaagagacctggtctttgtgaccacctcaatggggactaggttctttggaaccgaatctcgataaaacaaatcaccgtgttcatccactttatttcttgattaatttgttttcccctctctctcccggacttggattttattctaacgctaaccccggtttgaagtgtgcttaaagtttgtaaatttcagtttccgcctatccaccctcctctaggcgactttcaattggtatcagagcccggtgcttcattagagtctaaccactcgaagtg

SEQ ID NO: 2449 - DNA, 382 bp, Zea mays
ccttgctcggccggccgtacaagagaaaccaagaagtagaggggctcagattttacagctgtgacggggtgactggacacaggactcgaccgccgccgccacgtcacgggcacatgcatcccccatggcacaacccgttccgttcagaccacccacccccacagactgttcatacaggtgggctccacgcctccacccggcacccacccaccggtccctctcctctctctccccctctcgcgaaacgcctcgtatttatataccccttctctctcccacccagcgtccaaccaagcagagcaaagagagagagtcgcggagccaccgcgttccctagagagacgcggagagccagggcaaggcagctgtcgccgcagcgacg

SEQ ID NO: 2450 - DNA, 699 bp, Zea mays
tctcttactccctccattcgtttgaccttttacctcaaatttgaccgatttatcttattcaaaaaatcataattattattaatttttagtatgatatcatctattctataatatactttaagtatggctctgaatttttattttttcgtaaaaaatttgaataagacaaaccggccaaacttaacgcaaaaaaaagtcaaatgaaatataaattagtacatagagagcaccatttaattttgaatagtaaacgattttagttctctcaatgccctccactacccttagtcccaaacgagcacttaaaagttttgttatgcgtaacagagtgttgagccagattcaaaccgtagctgttcagcaagaacctaaatgtcgctgcatcaacttttaatttttatgtttatgtttaaatagatgataataaatctaaacacatataaaataaatatatggtatgaatcaattataaaggtaaagcaaattttattttgaaagggagaaaatgcaaaaggataaatataaatatatgtactaacaattttttaaaaaataatatacttaaataaatatcttatataaacaatgtctaaccatatgtgtatagaaactgtagcaaggtgaaatagacctggcgctcggcgactgacgtccgagcctccgtgatcctgattttctatctccgtacctcgtggcgga

SEQ ID NO: 2451 - DNA, 190 bp, Zea mays
tgtaattgtcaagttttactgatggatctggctagcactgtaacttacttcaccgaccgacatattatgggtcccacatgcagaatacgacgacctctcctgctcctccgaatcctgaaaccaaccagatcacacgaaccaaaccaccgcctcctcccccgaccggagaggagcctcaccgccggcgccc

SEQ ID NO: 2452 - DNA, 97 bp, Zea mays
gactgactgtctggagtgatctgatgtttagcaggaccttgataccagtatgcggtgatgcgtaggctgtagatgggtcgaatgtgcttgtgtgtgt

SEQ ID NO: 2453 - DNA, 879 bp, Zea mays
aaacaagtgctttaatatagtagagaaatgtaaattagccttaaagtcatttctatgttttgtttaggtgcttgataaccatcacaaccatatgagatatactacacaaaatcgaaaacttcctaccatctagtaacttcatacagttttggctagaaccttaggaagtaaataaacttccgatggctatactattacctctaagaagttagccaatttggttaatgtcgtcaaccgttcccgcccgcaaacccccccacacaaaacctatccgccccgcaaccccccctccccttgaaatgacagatataaaattccatatggatttagtacaaattcgattatttccccattttaaaagttaatgacgcgtaaaaaattatataaattttattcttatctataataaggtgcttgcataataaaaaacagcatacaaattatatatatatattttaaatatcaaatctttataagaatgatgatccactgtccactgctgcccacttcccacgcccaaaacaagttcacctccgtggcgcgtgttccgaaaagtcctcttgttgtgggcgggagaatggaggcgtaatatttcggcgtccccgaaatttgcttgcaccttattggccgagccacccctcccacggatcgtgccctgctggcaacattgcagccatcggtgcccctctagatccaaccatccactgtcctcgcacgcggatccacgggcccaccagcctcggcagccgagttgtttaaactttataaatacccgtcgccgcctgctactttcccatcaactcgcaattccgcattcgttccaactcctgagcactttctcctcgtccccgacaagccaatcgaagccgagatacggcc

SEQ ID NO: 2454 - DNA, 699 bp, Zea mays
ggatccgaccacgtcgacgatggagctgagaggataatgatgatgacgacgacaacgacagatggttgtgtcatctgctctctttttttagcgccaagaaaactggaaatgaaaaagggaaatcaatccgaaaggagaatagaaattaggaagtataggtagaatatctctcttgccagtgactatgtatttgttgtgcgatgaattaagcatacctcgtgctatttatgatgaaaaagggaaatgaaaaagggaaatcaatccgaaaggatttttttatatataagaacttccccgtggaatcactagaaacggtgactgttatgacagggaagacggagtcctatcacaggactaaacaacctggcaaccagacaactgtgcactcatcgctctcgttcgctcaagcctcgctcgaaaataccacagccgtatcagtgccaaacacacagggcaatgaaccatagagaatcgattcctaaacattagatcttgtttcttctataatttgatttcatagaaccatgggaaacacacactcacgccgtgccagacaacaggagactataatcgacactcctccatagcatgaaaatgataaccacagcaacatgtcatacgcacacgctaacagctctatagattgcgccgttcccgactcccaagccaaatccaactcgctaccttacataattgtat

SEQ ID NO: 2455 - DNA, 128 bp, Zea mays
ggtgaaccttctgccatcctattcatcttccttctttctcccttatcttggtctcaattgattatgagatgctgtgctatggcctgcaggtaaccggctcacgcctgtctcggtggccgtgggcaatc

SEQ ID NO: 2456 - DNA, 270 bp, Zea mays
ccccccccccccccattgtggaacatgtttgatattcttttttttaactccttattacccgatatactgcgcttatatcgttaaacgacaaatataatttcagccaatatgtggcgctttatgctatctgtaaccttgatgatgaggcacacaagctgctaaaaatgctgttggtggtgtaaatcttttctccatcgcaaatcccccactccccctccgatcccccctgcgaccctgcccaccctcctctcctcctgcatccaccgcgcc

SEQ ID NO: 2457 - DNA, 291 bp, Zea mays
ggtagtgggtaccttgccgttgccggcctggccggctggccctcgtgtgcgttcctcgctcgatctccctccttcggtcaaaagccaacatgacaacacacgagtctgggtagctgtcccccgcgcggctcgccccctcgctcctcggcgccgctgccggcccgcgcctgcgcctgcggctcgcgccctctatacctccgcccgcccgtccccctcgtgccgctctgcctgccccccgcattccgcgccgcctcgccaccgaactgggaggaatctgcggggaagggggat

SEQ ID NO: 2458 - DNA, 71 bp, Zea mays
gctggccaccaagcattgctcggctgctgccatgcctgcccaggctgaggctgctgggtccggagataggc

SEQ ID NO: 2459 - DNA, 574 bp, Zea mays
gcaggcaaaaggatctctagaaatgactaactaaatttttctaggtaacaacaagcttcccagttcctcattagttctgtattttttacccattctgcctcatgcaaatatttatatctttgattactgattttattaggatatgtaacaaagattagagggggatagtattagagtttttctggttatagttcaaaggctatacttggtactgcactctgcacctcgcaaaatgtaaatatgttctctttttgtggggctgtgtttgttacattataaaacagaatttgaaaaaaaggaatagcattgttgaaagttggctaagttgagcttcagccaaactcacagaaggttcgatctttacacatggtatctaaaatgtttattgaatccggggcaagggggcagaggatctggaggtggcgattgtgcggcttcgcctgcctgtcttcctgatgcctacttctactcgcgctcgcaccaaccaaaggagcaagcccgcaactgatgccccccctataaagggaccagagggaaggcgacgccgagagacggggaaggagacgcggtgacc

SEQ ID NO: 2460 - DNA, 279 bp, Zea mays
ggaggacacaagttcgaggagaggtcgccttcttcgttcttccaccactcacttgatggtcggtaacggaaaacctacggtgatcccacgagcatgtttttcccttgattttcggtactatgtatgcatgcggaagagccaccactttcactccaacacggttccacatgggcctctgtgcaggaaaactcctactgcttctgcagatctcccctacaactctgcaagccaatgctagcggcgggccgacatcagagcgtcgcattgtggatgccctaa

SEQ ID NO: 2461 - DNA, 171 bp, Zea mays
tgatgagcttcttaagaagtctgagaatttagacagacataaagaaagcattcataaagaggcgagtgattttacctctgacgttgataattattctaagtggggttctggggtgcattatggctctaattctgaatccagcccaacgaaaagggatttttttatgacgaa

SEQ ID NO: 2462 - DNA, 101 bp, Zea mays
agtatgtcccttttattgccttcatcatctatattatacagaaatttaagtttgccttccttatttttgacattctttttagtggaaataacattaaaata

SEQ ID NO: 2463 - DNA, 555 bp, Zea mays
gaagcttctcttactgcaaatcgtagataacgatggtgagattactccagagaatttgattactggaacagaacactacaaaccattgggaacctgatctctctctctgaaaaaaatgttaccttaaactgaagccgccagcgacttctctaatcgaatcatacactccgggcccgtagtctgacactgacctgacgtgctggatgatgctgtacctatactacgcagcacaccagcataagtacaagtcgaccagatccgaagccacgcttccagcctcttgttgtcacttattagctatctctcagctaacctccctaggaagaataataagctgcaaaaggcacaagggcgacgccgataccgatgcaaataccatagcgttgatgtaaagtggcgccagaggagagagagagaaaaaaaaggtaaccacctcactttcccctgttctgctgttcaggccatgcgtgctccaccgaagcagattgcgaaggcatagcaggatcttagcttgattcatgatagcacatgtaggaagcgagcgagccgagaaac

SEQ ID NO: 2464 - DNA, 61 bp, Zea mays
tcccagagcaggcctaatgtgtgcatattacacatattatccgatgaactgaaggtgaaac

SEQ ID NO: 2465 - DNA, 1500 bp, Zea mays
tatgtgaatgtatcatagttcggtctatatgatcttacatttgggagttagtatatgctgctaggtaccactattgacttatggttcgaaaatagtttcagttcaatgactatctgcacaagaatctattggatcacacactgggatagaatattagaacttgtgtatataattgtctctagtacaagtggaagattattggagatatacccaagtgataattataaataattcggattatagtcctactaagtctttttctgctgtgctacgtgtctagatagatgtgtcatgccactgaaagactggcctcatattggtttgctacatgaattcctctctggcatgtggcttgccggctcgctcactacctgctctgcgaacacagagcagacgctccgcattccgcagcttctccagagcagagcgctgggcaacggagacgatcaatgcgggaagcaatcggcggtcctcaacggtcggtcagtacagctaacagtggtccgtacgccaactgtggcgcgcaaggaacacgtgcttgctttggttccgctacctgtttgtgcagttatgctatgccacagccgcgacggtgaatcgaatgaatgagccctcctgagtcctgacattccaatcgaaacaatggtagccatgccctgacgctcaagtcatacctcaacctgaacccgaagctgtttcgataggacggcgtgctggttggtggttgccctgcgcctgtcactaagaacagctatccgagggttgcataaatcgcgccgtcacattctcgccatctatttaactgcaataagacatgccattagatgtgctaacaaaaacactttggcagcttcagtctgttactgacagctgatccacatgtagccatcctgctcagcgtcaatgaacatagtcatctgcgttctttagccgccagcacgcatgtacgattttaaacataccgaccccgaaactgcattttttcttgttcatgacacagcaacacgaacttactgaaatgaaagagctcacatccttgattattccagaatgagaaaggatggcgtctccttttgatcatccatccctcacaaaggggcaacatcaaagtacatacaaaaccgaaagagggagaacataaaaaaagagagagaaaaggacagagaaaaagatgtgtggggaagtgagatcaacaggacctcttgttatggagcctaccacaactcacatagcagatacatcaaggtctacaggtaggacggaaacagagaagaagacgatcaatggagtgattaggttggcactaatcatccacccctatcagaagatcacacaatcccgagataggccccctccttccctatctcagactggtgtgagaaacatgtacgatttggactggaatcgttggatggtgactgtgcaaggtgtggggtggggaagcctgtgtgtgtatgtacatcgttgatttggtgttgcagggttcctagccatgtagca

SEQ ID NO: 2466 - DNA, 742 bp, Zea mays
gaagcgaaatagtatatgtgtttgataggattctcgtttattttcatctataaacggattataaaccaaaccaaacacacttaatatcgagaaacgaccggacgtacaagctcagctctagtccaaggaaacaagaggcctcagcagccatgagccagcatgcacacgccggtggacgtggagccctgcctggggcctggcctgttgggttgtttcaggcggccacctaaactaactgccacctaaactaaccacccgagcagaggaaggcgtttctcgggcgccaaatctcagcgaccctgctgactcacgtccctctgctttgcttgcgtagacacggatacacgactagctacaaagacatggacggaggaagtgaaagctgttggtttagctaccctcaatctagctgactgactgactgacttgcttagatgttactagaccacaaccaccgtcagacgagacgatcgttggcgaccaaacacctgcaccccaacactccctcagtctcccctcccatatgaaaccatatgctagccaactcttatttccatggagacctcgacctcgatctcggactgacggcagcagcagcagcaccagctataggaggtcatcgttgtctgcctgctatatataattatatatactcacataccgcgctcagcacaagcagtaccctgctgggctgcctgcaagcagctagtgtccaccgccagaaactagctagctagctagc

SEQ ID NO: 2467 - DNA, 1500 bp, Zea mays
ttactggacaagacaatcgtccgccacttcacctgccgtagttagtaccgatggctaggagtgccacaccagcggtcggtactgactacctctagcaccaacctaatgagactgctgatctcatcaaattggattcttaatccctcactatgcattggctccttatcacactatatggattactttggttattaaatgggacatggttaactatgttggcattggtggggtatttataatcttcaacagaataagtagtcgttactaccaacacatgctatattcttgaccatcatactgtttgatgaccactgtcgaaccgtagcacagcaccgacgagacagaacactaactcttgtactactctaatagaactagatgtttgaaaagcttccttggacatatagtctggcgcccactatcaaactagcccaacgtccaccagaaattctttagtcactgcccgacattcgttggacccattgactttggtccatgggggcaactgttcatagggtctaattaccctgtagctaaaaccttagctaaaatagtgttgtcgtatggtatgatgtatgtcagcatacaaattcgatgccccttggaactcttagatctgatcaaatagactgtaagacccaatagattggttagacgaggtattgttcactggatccaatgattgagcgtttcggggctacctatgtggaggcgttagaccaatgctctatggtcctacaaccctagaacataggttccaacacctcgaaaacccttataacttgacaaaatttgaaactttgtgattgggttttaatccttacaagttttaaacatatcttacgtcacctagagctaaagataactaccatgtaccatactaaacttcttagacttattgatgatgctaatagtttatatccctttacaatatgatgaaagaaaaaacaaagtgctaaactactctaagtgtctcctcaacttcaatcgacacttagacctagtcagtttttaacattatctttcatccttacaaaaaaccccccaacaaaatatataactagggatagaaagcatcatttccaaaatcattcttaattggtgaccactcaaatttatctatgcaaaacacacattagtcacactaattttatgttatcattattcataaaaacttcaaggggctagatgcttcaatatcacattcaaaatgtaaattatgaatctattttaaatataaactaattatgctaatttgatctgttctttctacgctgttggttatactttgaacagttttgacatatccgcaaaatgagggagtatgtgatacaatacaaccgcgtacaaacagtaaatacaacattggtcgtcaacacgtcatgacgacggagtagaagtgaacatcgtccatcacagtcacagcatgacctcggcgtcggacggcaaccgccggaagaagctcatcagcgccgacggttccttccgcctcagcaacgg

SEQ ID NO: 2468 - DNA, 404 bp, Zea mays
aaggggaagagaaaaagggatatgaatttgaacgacgtggcgtacctttttgacgcggtcatcatggcggaggtgaagcgtcgcctgcttcgcctgccaaaggtaccgcctgtcctgccgcagagttaatgcgacgggacgagtggttcgcggggctgccgttgtgcgtgcgcgagtcgttcgaggaacgggcgtttcgcctccgagttttgaatttcgcggcgggttcgggcgaagtgttgaacgggtctcgcctgggcctttatatattcgggagagggaccggcgacggttctttactctgctgctcgtctcccgctttggtttccgcaacatgagggaatagccagagaagagaaaaccgcgcacctcatccctttcgcctccaccgcttccgttcggcg

SEQ ID NO: 2469 - DNA, 966 bp, Zea mays
atgtgacaaagactaaattttagtaattgcatcccagcaccccctatgtttaaccttagactataatctgacattcatatcttatctacataaataggcattgagactatgaccaatatattctacatatcattatacaaaacacgatttttattgtagattgtattatttatagggtgtagtttgaattgaaagatggagatgagtaagttattggagatagtatgaggcatacacattttaagcatttctccttgagctatgccaattgtcgtgtctaaataaagaagaaaaagattatctatttttctagccttgtttcttaattatttttattaaatacatgaagacaaataaatatttaaaaaaacttgcgtgaaaaaacggttatctaatcaaagtttataacacaatgatcgaaattaaacttgtaaaattcatgaaaaaaatctgaaaaactatagatatatttcattatttatcctatcaatatatataatttcaaattctagttaatactatattaatagatataataacaataaattttatcattttcaaacttttatattagtttttaatatactttttaatatgtaataaattagaatttaaaaattatgtagtattagaatatataactaactatatttataatttaaaaaacaaagacaattttattgtagggaaaacttgataacctttaccattgtcgtagctccacatgcgcagaccatgaccatcgttgccacgaatcgaaacagctgcaacaacccgaccggactcgacccaacccaacccaacccgtccataaccccaccggcccctccgcctcgcctgtcccaggctccccagctcaggtcctcacgccacgcacgcacgagccggagccgagggcgcgcccatccggacccagacagagctcgccggcgcctgcgcctccaccgttcggcaagcgggagggag

SEQ ID NO: 2470 - DNA, 939 bp, Zea mays
ttgcatgcctgcagtccaaataagatctcatgtttaataaaataaatcagaaaatgattttaatatagaaattaaaccctaaaacttaataaatccataacttattttttgtaactctaaatggctgatagtgcaatataggggggaaattttagggaagagccgtgtagatagtcttagcaggcgagcacgatccaagggctaacggtgagtcctatgccttcgcacgaatcacaatggattacggaagctagtgacagtgtaaagccagggtaccagatcgagtactgccaaaatggttcgtactgtaatgaaaactaacgcgttctggttccaatggtagcaactggcaactgccaccgttgtatggagtataacattaccttcgtttcactatcttaaaatgccctaattccgataaacaatttcccttgaaatcaatatgatggagttgaccaaacttctcaactaccttaaaatgggctaattccgatttggaacgacacatcctagcaaagtcaaatccacgcatcccattccaatacaaaaaggcgcccccggcattctttaccgttgatttgatgcgtgacgggtcctgatccaccccagtctccacctcacccctctccactcgacggctcgatccttgctgcccgaccttttttttgatctgctatgctgtagactaatcgcgattaaggaaataagggggaaaaggaggaaggtccaagcggcggcagcagcaaaaacccgctccgaaaggcagaaaaccacaataaacaaggcacgcaacgaatccgatcccgatttaattcgcccaaatccgtcgattaatccccacgccggccgcgtcatgctccggccattcctctcccctcccctcaccgctctgccgccgccgcccgtgccgccaccgcagcagccgcgggcgccgcggtt

SEQ ID NO: 2471 - DNA, 282 bp, Zea mays
cgagccgagcggagcagcaaccgccggttcgcaccaaacctacgcgcaggcaggctgcaggggtagaaagagaaagagcagtgggtgtgggttggctttggcttggctggtcgcagtcgcagcatatataccacctcggcattagagcggagcggttgctctctccacctcctctctctctttctctttcggtatcgcagtcgtcgtcgccgctccccggccgggctcgctcgcgtgcgcgacccacccagccagcacaccagccagtcggcgcagcaaagc

SEQ ID NO: 2472 - DNA, 713 bp, Zea mays
tcttcatcctcaagtttttgattttatagacatatttgtctatgcatcagcacagaacatttggggcttatttgtatgctttagttctaaaattccatttatttttcttggaacacaggagagctgcgtacctttgtactagtcagatgcacgtgcattattacggtttttatgtagtaaacatatctcgtgcaactaagtcaattggtgcaaccgtgcaaccaaaacacaaggatagaggtgggaggacctttttaaaaacatcgtttttcaaaacaaccctcccacctcgtcctggaatttttcaaaaaggtccagcatagaggtttgaccttgtgtctttctaaaacctaagtatttctctaaaataactacatatcttttttttcattttccctttaacacagttttcaaaaccagactagaccgcaattgaacctagaaaaaataaaaggagtatcagaactcaattttggctggcttgttaaattggaagatgttccatgcaatgaggcatgaactctcaatcattggatttggaaaatcagtgttgtgtgcgtgctaaagttgcatttcctgtactgacgtaccacattttcgttttcttttctgtattttggttttacattatggcctagttttttttttcttcttttttatggatgctgaagttttgaatatctagttaaattgtcaacaaatattgtccagat

SEQ ID NO: 2473 - DNA, 77 bp, Zea mays
cgcaacgcgccgggtcgaagccggtgtcatcaatgcacgcgatgcagcgcatcgcgacaacggagtgggagcaacga

SEQ ID NO: 2474 - DNA, 1190 bp, Zea mays
cctgcagtaataatagcattacccacttagaacaatagagatcatactgtcatcaaggaaagaagaaacccagtggaggaatcagaaagatatcgaacttcgcagtctggctagtgacggtcaggttgacactctgacactaacaaaccgcatgctagttctgcatcgtcgcatcgacatgttaataacacacacaatggatgatcattgtccttatttggcttgatgtaaccatatttgccatgcctaacttcatccctcaaaaagaaaattcaatagaagaattcaatcgaagaatcagaaagatatcttctgtaggctaagacagtgatggcgatcaacaaagtacatgctaattctgcattcaaatgttaataacacagagagagagagaatgaccattgcccttactttggatcgatgtataatatcaattccaagtccaaaaaaagagaactgtttcagcagacagcaggcatacaaatgaatgctagtccttgaagagtacatgaacagaatgagtatccgattattcttatatggaaatgaacttatagccaggtccctaatcctaggtaatctagcattcacattttcacctaaaaccacaagaattaattaggttttgtcctgttttggaacaatgtataaacctacatccaaacaaaaaggagatgacatgatatgttctaagttataacatgcaagtaaacaagcccagtggatatctcaaggcacgcagtgcagggttgacacataggaacaccattggaacatatagaccagtcaccagtcgccgccaatatcattaaattcaggcctaaggccgtgcccagcagatcgtgtatatgggcgtgcaaaatactattttgcagtgtagactacactgtttgcagagtgaagttttaaattggggatgagatagaatagctgctggagactgccttatacggcacccgtcaatgccaactcattaagatcttaactgcaaacttttattctgttaccatgtgttttgccatacgtatgtagctacttttggcatagcactgaactctcgggaagaataaaggctaaatccagatgtctgcaattgactgcctcagctttcaattccttaattctttatcattatctgctttgattcacaatgatttgctactaatgtgcagggtaatccgtactggaca

SEQ ID NO: 2475 - DNA, 613 bp, Zea mays
agtctttctgctcctattcgatcttctgcaggtaggatttgaaccttcatttgctgtttccttttatttatgtacagacttgcctgtgcattgttgttaactagattataccccgtgcgttgctgtggaaattctatagattatttatataagagaatatatagtgagaaataataaaattatgaaaatattatatatctaaatgatgaccctccattatattagacttctcgtttgaccaatcacgcatgacacatgtacatagctcttataaggtatggttgtatggaatatgcctctgttagacatgttaacatggaaatgcagatggtacatactcctacttagtgtagcatttggatgcatagttttgggagaagaatattccattctaaactagaacatttcatggttacgacttacaccaatatacacacraaccctaaagtgtctagtgtgttggaccatagaaggcccataacacaactagacctgagcatgggctacacgacctgacccacctgaaaaaacctagacccgacccgaccaatgcgacgagcggacacgtgccatattttttgacccgcaacaagtcacgagtcgggcacgagcc

SEQ ID NO: 2476 - DNA, 1115 bp, Zea mays
ccgctgtaaacaagtcgtatattgtttatttacactttgtttaactatatttattgatcaatatatctaattaaaaaactgattttacacttatattcctaatattttttacaaatatataattgtttaatttcatttgaaattatttattataacgcttaattattttaatcatatttttagtttcaatttattgtatctgtttattaatataacgaacttcgataaacagcaaaagtagcatcaaactgcttttaaaatttgtactatagaaaaactgttttttctaaattagctacgaaaacagaattaaacatatccttagtctactatgtaaaatagtgttttgtatgaattttttgtatgtatacatgctcatgctcggctgaagataattgtagagcaaaaggcccgtatccagcccaaggcctttttttttctccggctcaaggcagtccgacccgaggcactaccgcactaggccgccgagacagtcagaccggcgtagcctgcgatctcctcagaccggcaagcaccaagcacagaggatagccgcgctcacctcctcagtccccacacgccctaggcgctggcgctgcaagctcgggcagtcgagccgagcgctccctgctcggcggacgctggccgtggctcgccctcgctgtgccgacacgccggcaaccatctcccctccaggtatccctctcccgcctcctgcctccggtgcttctattcgacagcttcctccccgaccgtcgccctcccttttctgcgtggccgcgcgcggctggcgggcagcagcagcagcccagycgtcgagcctaattggggatttttgggtgattgtgtgtgtgtgtgttttatggttgttcgatttgggatttttagatgactgcctaacattacattatcgcttactgaayttactgaatcgtggggcaacttgtaccaaattgctaaatgattttttttgccaaattgcttatgaaaattttgatgttcatacccctatgctaaaatcctagatccgccactgatggttggctcaaacttatgaaaagagctagctaaggaaacagggccaaagtgagctccagggaaaaaaaaagagcacc

SEQ ID NO: 2477 - DNA, 318 bp, Zea mays
tgtacgtgactactgggacctccaccaagctcttcaagttccaggatcagttcctctgtattgggcaatctctagacctctgtagattatcagcctgattcacaacttgttgcaggtgcaagaattcgactgcagattttaatcgtgattgacacgattcctggtttgagggcatctgttggtgtttcgagctaacaggctcctttctccctgctcgaagtttcacttacttcaacatgtggtttctatggatccagacttccaaagttggaatctgatcactcgcgtcagtgcttctcagctcccttgtttgccgtt

SEQ ID NO: 2478 - DNA, 128 bp, Zea mays
cgtgagtccattctcttgctacttgggcaagcaaggtgggtgttcgatggtttgcctgaccaagtttgtctggttctcctcctgtttgtgtcctgcagggcgacaggttcatcccccacaggtcggcg

SEQ ID NO: 2479 - DNA, 1047 bp, Zea mays
caatttcacatcatcggaacactggcatatacaattatagcatatatctatttaatctaggtcacccactaacatgtgcattaatatttttacacatatctctcaaggagggaggatagagtcttttatagatggacgagactaatagtcaactcaaacagacgaattaatctacaaataaattatattattatcctagtgccgaatgaaattaatagttactagtaattaacaatggcatagactttacatcgttgatcatatatacatcacatatcatattatatcagatcggcacgacacgcctcgcgtgaccgacgcgtggcatgtggctccaccttctttattttcaatctcaatataccactgaaaatattatttagattgattatcctttctttcggttagcaatgtaggattaatgtctcaatgacactagtatctcccatgggcattagagttcattagacctaaaagtctttatattacaacatctatatgaatatgatttatatctatatgatctatattctttatatcttataattctaaaccttggatttatattgatagataggacattcatatcagcggaacacttgcgtatacaattataacacatatctatctacgtcatccactagcacatgcatttatttatatttatacacgtgtacaatccatgtcactagaatttactcatgatccatgctgcagcgcgcgtgatatgcttccggtaataaaatagacgaaacatattctccaagaaaaaaaaattaggagagtcctcctggcatatgtagattttaatcccaacaaccagcaccttgaagacaactgaggttctatttaaccccctcgtctcccccgctcattccagcctaaaaacttgcccagagcgcctgaacctgcctccgctccactcttgccccccccctggcaccacactagcctagtgagtagtgcagcagtcttgctcggttgctcctacctgtcctgcacagcacaggagcagagcccaggaccgtcggcaaaaggggagcggcc

SEQ ID NO: 2480 - DNA, 1364 bp, Zea mays
acgatttcttttccttttgagcgggcggctttggcgtttccgcgcgaaaaggaaaaaatgcctccggcgtagaatccggaaaaaaagggcggatttttcgatggaaaggctgggattttaaaccgggtccgagtgatctcgttgtgttgcgccgtttgctggctgggttagcctcggtctgagcccagagcccaggcccgaacgcttccctttttttcttgtcgtttcggctgtgcaacaagcgctgttggggggcaaaggaagcagcattttcgggatgccgcggagctgtctgggcggggtgtgcgatggccgcgtggcaacccctcgtctgaatgcgcttggttgcttgttcgtggccggcccgagataaaatgcgctctttggtccaactgccaaacgaacgttttccctgctgcaatggctgatattattcctcactcaaaacggccttgaaatgaaattccttgaaccaaatatactgtcaaatgagagattcagattcctactgtcaagtctgttcgaagcttttgctcttcctgttttgagagtgcaggaaacttttgctcattgctgttgttttagccctgtagccttggccttgttactcctgtacatatatgagctttagcgtgcagtgagatccaattttacgtcaaaaaagaaaaaaaaacagtgagccgtgacaccatgttttcggtggttaagagtttgttctgttggatgcttttgtctgttcttttggcaaatcaagtgtttaacaacattcggagtctcaactaggtgtcacgatcctagttccttcaaagagacggaatccccagtggtttaggtcaattttgtcaccccaaccattaaatctcttttgacgtacgtttcctgaaggaatagtacccattttgctccatttgatgagtgtgcaagtacggatttccaaagtggttgggagtttttttttgctcggtcctagttggttcaagaacttagttgtaagggttctgtctgtactgaaagttggtgaagggtttaagaaacaatttaggcactgtttggaagcaaccagttttttaagaaactggtttataaaaattgatatatagtttcaaacataccagtttatgactcagtttatagaaacaagattatcaaaaaattttaaaattaaagaaactggcctcttctagctaaaagataaaaactggtctgagttgcttctaaatagagcctaaatttagctacgatttatagctagactaataggagttgctcttacccctccaacgtgtcggcgaggacggtcggaaaaaagacttggtggatagctagtgttgtgcagtcggataagccttcaagcactcctacac

SEQ ID NO: 2481 - DNA, 199 bp, Zea mays
gtactgcctcgtctcgcctcgcctcggctcgtgtcctgcgtgtgcatagccgcagcggatcagtaaaacatgcatgcatgcgttaccgaatatttggcagtaccagcaagttaatggattaaataatatgtaatggaacaaagcctgttttgaacgtggaactgctgagtgctagcagcgctcgtgtttattggcatat

SEQ ID NO: 2482 - DNA, 523 bp, Zea mays
ttaatcattagacaaaattaataaactagaaaagatcgatatcaagataaaacttgcacattttccattctgaaatgttccatagtaggtgaatcactttaactaattaaaaattctcaaaattagtggacttcctcttcggaatagaaattggctatttccacatagggaaagtcgtgtgcaatgaaaaatgcaagcacgatttggggaggggttttttctattgtaacaaggaagaattatctactccatccgactagttccgggttcgagtcccgggcaacccatatggaaaatagaaaagagcaatctgagtttttcatttttactaacttaatttcccaaatttttggatttggtaaatgaagttatacgaaaatccaatcgttggggctggcttggttgacattggtatatagactatgttatactgttaaataacaagccttctattatctattttctttctagttaatacgtgtgcttgggagtccttgcaatttgaataaaccaagatcttacc

SEQ ID NO: 2483 - DNA, 243 bp, Zea mays
cttttgccccttagggtactaggctaagtagagtcgagtctttttgggaccattgatgtaaccgtgataaactcttttggatgcatggttgatgatgctgttagttttaaatttggaaggaaagttatgcctcttgaaatcctttttgtttatgtcggaatctataaattgcttttgactccttcaccgcgattaaaccttgaacttgaagatatggtattaagaatatatgtgattttttag

SEQ ID NO: 2484 - DNA, 319 bp, Zea mays
ctagccattagatgaaaatgcaaagctttagttgatccatgaaagaaaattgagtgtttagagaaaggatgaagaggagagttgggccggccttaggttctcttctgctgcatatcatagcccaagacccaactctgaaataccttttgggcttagagctcaccgctgacgctgagggaagggagcccgtcgtctctcgtctcggctggccgccgccggaggttgagacacaagaggcgccgggagcattctccattcttgaccttcgcctcyactagtccactccctcgttgatcaagtagggaggagtgcagtggat

SEQ ID NO: 2485 - DNA, 1036 bp, Zea mays
tgttttaggtctttaggtggtggaagtgagtagctgtccagaagtgcatttgcatccgcgatgtagtgaaatttttttttctagagaacgtggggttcgaccgggcaactggcatcgacctcagacctgtacgaaactgcgacgacgactttgcctatctatcggataaatctcggcgaggaagatcaacatcctgcttttaccagcaatcctgcgctgacaacggtcaccgatgcgacgaccggcgtatgattattactaccaccggcaggtgctcagcatcaaccctattgctgaacagatttgcagtagatatagtttacaagagtagatagaggagtaacctgtaaccactcgtatctatgcatggtcgttgaaaagaccgtatcgatgttctaaaagaagtggccaaagaaaccgaaacatcagaaataactgatgagccagcggtggcacagattaaaggcagctgtttggactgctccagctgcaatttatagagacaaaaaayactgtagaagctatagaaaccaaacaaacaggcccgatccaacaaagacatagcaactgataatctatctgaatactgaatagcgtcatgaccatgtcgcaaacagctgcagctccaccaaagctagaaaagaataggccaacactagcatgaaaaaaaaacgtgacggtgcattcagctaatgtcactactacaactactccacaaacgaaaacactcctcgcattgtacacacacacacacacacagagagagagagagagagagcttcaagacagaagctgttggatggccgccttctggtcgcctgttaggctagtggggaacttgatctggaacttgatcctcaggctccccttcctagacggctccctcgtgatcggcatgccttcgcccggcacgacttcttcgtatgtagggctgacgaccgacttcaccggaacggtcagggtccgcccgtccagagtcgtcacttggactgtgcagcctgtcaatgcctccaccagagagatcttatgagtgtag

SEQ ID NO: 2486 - DNA, 772 bp, Zea mays
cgcctaaggccctttttgctaggttctttcagggctctgtcagcagctcctccacataatctattaggacatgtacagtggtagtatttaatatatagagacttttgaagtgtttaaagtggtatttgcaaaaaaaaaatcgtggtgttgtctctctataaagagatgtctctggctcgtaacccaaatagcaacagaagtattatttataattgtacgaattcgtcttctgttctgtcgatctgatgttgtatgaaagcatttaattctgtatttattaattcactatttttatatacactctattgtataataaagtcttttaattgtcttttatgtttgaagaactattttagtgtctctccattatatatgtctggtaggcttttttattgacttctccataaaaataggaagaagatgtgcctagaaactaagcgaagccgaaagcctaaaaagatgctttttcggttcttcatgtcattccctctgctataaaaataggagttatgtttataataaaatagggtgatcctttaaaagctctttttgaacataagaaaatatttatttagaagagctagaacagagctgaagctcatgatacaagagccctgttgtgagtgctacgtagcatgtgtagatggactaggactatttgtggcggtaccaaacgagcaaaaccccagaggtaggagcacgagtcatgaagtagcactgtcgcatcaggccgacagccgttcgtacaacctaaaagaagggaagcagagca

SEQ ID NO: 2487 - DNA, 373 bp, Zea mays
atgagttgaggtcgtgctacttcagactccataggcctgcgttatgtgcgctctcgtctccgcgaactacctacccaccgtcggtgcgctgtcgtctccgcttatattattatttgacgcgcaagagctgcagcagcacaaggacgtccagtagcactgcactgcactggagagtggagacgaccgacacttccgcccaacggctacgggcggcaggcggtgccgcgtccctctcgttgacgcggctggagctgggtgcgcgtcacaattactggcacacacacagtttctccaagcagctcgtatcgttaatcccgattattaaactgtcgcacaccgcaccttgccatgccaccgcgattatataaaatta

SEQ ID NO: 2488 - DNA, 1370 bp, Zea mays
aagttaacctaattgctctgcatatactgagcagacaaaacatacattgttgttgctcataatttccatttatccgtaatactttaaagagaaaccttataagggcttgttcggttattcccaatacacatagattggatgggattggaaaaaattgtgaagaagtttgacttgtttgggattcaaacccatccaatcccgctcaatccacatggattgagagctaaccgaacaagcccttagctggatctatctgatcaggattgcgacaaccatgttggttgcagcctcccttcacgacgtgtaaaataaatagggaatagaggcacgaagcaacgtttgccgtgtctcctctcccgcaccaacctaacataacccaatctatctctacgcagctagtaaggagaaggccgttgtggccgccaacttgtcttcgacaccgatctcaccaagtcttaccttacctatggtgatctccttccaactctacaaatatgtacttaagtttcattcattctgttcattttagtgattaaaattgtggggctgagatcctatagagttaacacttctccaaagaagcatttctacggagaggcaagagctcatgcatccctagctcatcatcatccagttccctgcctgaacatccaactatccaaggcgccccaacaacagataaaaaaaaactcgcagcgccatgcctagccagcaccctacacggcagatctagatgctacccctctcgtgccttcacgcgcgtccatccaaactgctacatccggcgaggcccgtccgtccatgatcatgcattcgcggcttcgcccgcggttgcccatccggccatccccgcccacgcttgctcgcttccctcgtactctaccggtcggcctcccaggctctcccactatatatcgtgccccgtccccggaccaaacgagagataagcttgctccacgctccatcactctcctcactagtcacaagtacacccactggccagtggctacacgagctgagctatctccgctagcagctcgctcacaagtcacacccacgcccagagtgttctagctacaccctagctccggtcttcttctttttcttttttgaaaggcgccaccttggcgcggccttcctcctagatcgagtccaggcgcgcggtgcgagagggttccagcacccgcaggctgcttcccacaaccccattccacccttggaggtggccactgggccggccggccgcacctaactccggtcttgatctcatagcttgataagtaacaacgacgggcgtaagagctcagagaggtgggagctagggagaggaacaaaagaaaccagcgcgcttgtgcgtcgtgtggcgatgc

SEQ ID NO: 2489 - DNA, 1333 bp, Zea mays
ccttcacctctccctactccacatttaaatggtaaaaaactaaaattatatataaataagaatttgaacaatggttgttggctctaaacctacattcacatctatcagaccaacataatacatatatttttatgtttttatatcctacactcaagaataaataaaaactatagcaatgtacgtgcacttaagtagtaaggatatggagctatcctaaacgcatagacaaattatagttgtactagtggacctgctctaggaccaatatgggtgaatgataggtacaaattttttttaaggttacaaagctgtcataataagggctagtttgaaaactcgaattctcttaggtttagaggagattgaggagaaaatttgttcattccccactcacgttctatttggttgtggaatttgaacgataatgtaaaggtcatctgataacgttgtaaatagaaaagaagttagccattctcatattgtttggtctagcttaactgatattctatcgtggggaggtgtattagataacgtttcattttttatacatctgtattccattagaaggtagcagattacattgggctcaaacaaacacaacgcagcataagtagttgtcgttgtaatcaaatcaggtcacattccactaaaccaaacaccacctcaatccccttcaatcttgaagaggatttgagtttttcaaactagcctagattgacagggctccggggacaatgttatggcctaaccgacggaatcctccgtcgtaacaaggcctaaccgatggaatcctccagctcagtcacggtggagtgtcaaacgaagcaagcaataggtaggtctgttcccggcgacctgttccatgctcgcatgcgtctccatcctggggacgccatctccatcgccaagccaaccaagccctgttgcgagattgaaataaggtgccgtacgtgatgccaaaagtcgagtaaaagatggacgagtcctactgtcaatctaacatggaattaggtaagcaatccgaattattgggcatcggttgtggacaagtcaaacagagggagggaagggcgacgaagccgcctcctcgtttgtcttggtcgtagtactcgcgccatcagcaccaacccacgccacggcacaccccaaccccaacgaacaacgaggtatacaattcatttcccaacagatcaatcatcctctacatgttacagcgactcggcctgccgcgatttttataatgcgccgcggtggccgtcgctagtggtacatatcagcaccgcccctgcctcgaggttgcgtgttttgttctctgtgagcgtcgtgggtgttg

SEQ ID NO: 2490 - DNA, 159 bp, Zea mays
gggcggtctctccaccaagcttttcgtggtcctcctcctgctcgtttgttacaccggtacgccttcgccatgatatataaatatacatgcaaaaaaaacattgtgtagattacacatgtttgtttgcgttttgcagggacgcaaggcgggccggtgact

SEQ ID NO: 2491 - DNA, 338 bp, Zea mays
ggtgtctatgtcttatattaatttttaacttccgtggcaacgcacgatcatatacttagtataattataattatacgctctgtcctccttaattaatataatatacactttaagctttttttcatctagatatgtaataatacgctggtcttaaaaaaattcagcgtgatatggactgtatgagtacagtgcatgtaacgtatcacatgtgtgggtcccacagctggagaggctcgctgacctgtgggtcctagcgggccggctattgtcctccctgcgttcccccaccaccacggcggcagccactggttggcagcggttgtccttctccggtgtcc

SEQ ID NO: 2492 - DNA, 1406 bp, Zea mays
atctgctttgatgtaaaacacccgttgtccctgtgattttttttatcatcttatgacctattattaatagtggtaataagtaatttctttgttttaatctgtatctttaaacattgtttaatgtttatagcggtaataagtattttctttgttttaatctgtatctttaaacattgtttaatgtttatagcggtaataagtattttctttgttttaatctgtatctttaaacattattttatcctgtagattgtactgttcgcagagttgagtttgaatatggtctatatggatatgttgttgagtaagrtgctagagatagccttagaagttatgtcgttgagaaggcattatgaatcataatggaaagtatttcttgtcgaatgacctcttaccaggaaagctctctcattgctgtcatcatacaaactttattattagttggttgtctggttatgtttagagatagtaataagctctaaattttacactataaaatttaagtataagatcatatttagattgagctctatttatctttatttttcaactaagattaattaaaggatcaaacaaacgttgaaaaaattatttaaatcgtaattcattaccgctccagctgtgctaaaatctagtctaatgctagctgacactycttccataaacacgacattggcctaaggagggggggggggggggggcacaataactactcgtgacctaccaaaaagaaatatctggaggattgtagctgctctcacactcgcatttttcaccgtttgtcacatcgaacaccaaccaatcttgctaggagtaggagaggagtagtatagtgtgcccaactggagcccagaaattaaggttgagttcgaataaaggagcctccaaaatattgttctgtcacaataaacacgccgtagacgttgtgaaaattaaaataaaaaatagaataagcgtccacagatgactccgtgtaaacacatctccagaaatggcaccaatactgctatagtgatgtgataccaaaaaaagcatccagcagatggcatcgaaatactactctgctgaaaaaagacaattaattaatgcacagcgcaacgcagtccactcccaactcccaagatctcatctcttccccttccgtcctgcgccctgcccctgcggcctccctctcctacccggcaggcagccaggcacccatcccttccacgagctattagtacccgccacgccatcgtccccgcttcgccgcctgcctctccggactcccactctccaagccacctaccttcctacacccaagtaggagtacctacctgcgcagagcccacgacggctcggactccgccgtgtcgacaccgctcctgtcggagcatcgaggctacattaccaagtagtaggaaacc

SEQ ID NO: 2493 - DNA, 935 bp, Zea mays
gtgcatatatttacagaaggaggtgttttaccatattgagatagttttgcaaggaccagggaagcatatttctaatgttaacccttgtagaagattcgatgaaatccagatctagaagatcgaaatctgtcctgatgacagttgttgtactatttttttccttagtgagttttatccgaagtttctcacataaagtttttaacgaggcaacaaattgcaaaagcaatatgcgtcaccatgtgctctttcttcacatttttctcgctgggtttttggaagttttaacgagtcatgtgttggtcacgatatttgtctaaggagaagtattgaaaaacgctaataaagggttatgtgggcaaataccgaatatgcatctgaggggtatcacgtctctatatatagaacatgtaactctcatataaaatacagaagagaaagaaaaccgaggtccaaacatacatcatgtgtctaagtgtgttctttatcgtggttttgagaagaaagataggtcttcaacatattctcccgcctaaattgctgaccgcagggatgggagccgttcgcagtaacgcagttattcaacacagttaacgggcaccaccacgtctagccacggtcgttgctgtacacgtggcacgtgtggtcgtcgcccgtcggcgcttgttgcatgctagctgctgcaggcctccgttccgatggcacgtgcacggcgcccgtccgtcgattgatgatgtggttttgcagctccttcgagaactagaagggggcgagtctcgttgtaatctcaggcaggactggcgtcagaggaaccagtataattccatgctcgaccgcctcgacgtgtctccgcgaggtttaatccggggaaagcaaagctctgcacatcagccacattcacgcacagaggtactagagctcgggcagcagcaaaagac

SEQ ID NO: 2494 - DNA, 1035 bp, Zea mays
tgccgacgagctctgaagatactatatctaatgccaagcttcggcaccctttttccttataaaggggataaggttttttaacgggtccgaagatgtaataattaggcaaagaacacctaaaggcaataatgatgctattccccaaaaaaaaacaagttatatcaaagtcagcaagtgatccgatttccaaaaacctccaatacgaaggtaagttttatcaccaagtaaaggtgagaaagctccgaagtcgttcctaaaggaatgcagagctaaagttgaatcaccaagtaaaggtgagaaatctccgaagtcttttttaagtgaatttagagctaaagttttaacaccaagtaaatgtgagaaagctccaaagttattattaaggaaacgtggagctaaagttttatcaccaagtaaagatgagaaagctacgaaatcgtttctaagtgaatgcagagcttaaattttattaccaagtaaaggtgaaaaatctctaaagtcgtttttaataaaatgcagaactaaaatccgatgaaaaaaactccgaagtgaagtttatcactaagacgatgctcatgttaaatttgatggtcttcaagatggccttgaccactaagaccaggtacccctcgctcgtccatagcagtgaggagtgccatcaagctgccactagggcagagtggaggtggctcctccatgcccctacgacacgtgacggcggcgacggtaggcgaggagtcgccggcgtacaagagaagcagaaacgtatagagcaagatggcgtgcgggtctgtttttgcaaaaaagaaaggagagcttagaagttgagcacggggttctttgaaataaatacttggtgccattggttgccggatgagtggactcgataggtattgtgcatctgtgcacgggccgtcgtttgtagagccgatatagagctaaacacttcagaagcagtacatctgaaacaagaagctttcgcaagctggccagctagctccctaccgactagataccgaggagtgacggatcagg

SEQ ID NO: 2495 - DNA, 1195 bp, Zea mays
ctagcagtcgaccctgcaggtcctgtccatgcgataattccccgctacgcccgctctcccccgcctcccccacgcttcctccgttccctaccgtgcagtccactgccgttcccctgataagctcggtgacaaaaaccgccatcccgcgccgcatcccttcccgccctgccggcgagagcgtggtccgattccacccgacctgttttacgcggcccatcctgcctgggctcgccatcgccgaacacacacacgtcggtccaaacacgcgccgtccgctcgcggcttctccaaccaaagccgtgcagccaaatccgaagggtagcgtagcacggggacgacgccatgagccgcgcgctcctctcccacgtcctccaccgtccgccgcacttcgcgtacacctggtacggcacgctctgctcaaaccttagccgcttatatatctttttactcgccgttgacgctgcatcttctgtttttcccccgccgtttggcgacgtagcttaaggagtggcgttggtgcccgaggaggagtgctcgcttctggcatccacccactccgtcgtctcaattgcagcgcggttgaagccgttcccggccccacccgaggaggtgcctgctcctcaggcaaggaagtaagttcagcgcctccctgtcagtgtggtgttcgacgtaatgctttcttgcgtattttcgggtttgtgtggcagtttggcttttagcacgtcacctttgggaaaatcgctcgtggacctgcattttagtgtggctaattcactatagaggacattttaatgcaatggcgtaagggctctgagtttgcccaggatgttgatgcttttcgggtataccttcgttggatatatagggtttgtgatgttttggaattctgcaattgatcaatgttagattttttttttgatagcgatcaatgctagaattgaattgctgtagaatgcattctacttgctgcttgcagtcgtggttggttagaggaaactgtttggatggggaggatttctctaggaacttttagttgtctctgctatctattaagaacatattgtagactgcccccgcctctacgcctgcccgcccgcaatcgcacctcggccgcccgcaagactgcccccgcctctacgcccgcaatcccgcgaaccacccgcacgccgcataacctcgccgcaggacgctgccg

SEQ ID NO: 2496 - DNA, 436 bp, Zea mays
tgtgtacacccatgtcctttactgggccctctcctgtggccggttgctgttccatgaaaggaacacggaaattaattaacttaaattcgaatctctgtgtgatgtgtgttratgcctgaaaactgaatctttattattgtcttattggcctgtgttgatgccaaaatgaatcttgtggacaccagtcacaccactgcactatgttgatgttgaaaataacaaattaaactgatagactaaacacggcagttcaatggttcaagtagaataatagtgtccttgaataattgttagacaacattactgttaggttctttgtgttttttcacttatcttgctgctgacttttctgtttgtagatttggacagcgcaattacttaagctatttgtattcggatctgatccaaccctggtggtcagctggactcatcgccc

SEQ ID NO: 2497 - DNA, 635 bp, Zea mays
tctgctttaggaactctaacaatgagccacaccataagagtcgttagaatctcataacacctcccttgccgccatctctggcaggcgagaatgcattggtgggtctgcacgacgtggttcccataggtttggcttcgacgcgtgcaccaattggagtgtgtaatgctttcggggcattacatgtttacaatgtatgcctccatatgctttgaaggagcatgacccatctatgtgtctcaccccagccatgcgtcaggaccgtggcgaggctacctcaaagcatgaatgttcctcctagcactgaccatcctggcggcctcgcctgatgaggacatgacacctaacaatactatcattagttataaggtgagcttgtttctgcatttgtacaattataaaaccaagaattggttgctacctagcattggtgctgatgataaagaatatatgcaccgtaccatacaatgaaatgataatatctttacctagtctgacataaaagcccacggattacacaaaagattcaattgtgaaagcccaaggcccataaaattttaatacctttatcgacgtttatcttcaagctcagacctgagctctgctatccttgcacagggctccgaacacgcgtttcc

SEQ ID NO: 2498 - DNA, 168 bp, Zea mays
ctgcagatggcccagccgctcttattctacattttagcagtccagaagctattccttctgttgatgacatcaatagcatattccgtattcatggaccgatcgtggagcgtgagactgtgatcactaagaagtcaaagattgcaaaagtagttttctctaagagcgctg

SEQ ID NO: 2499 - DNA, 178 bp, Zea mays
ggtctagggaggaggcggcttacccgcttcttcacttttagtagtaggctcatccttcattcccctgatctacttcgttttgttggagtagcaaaactgccgcacgtcacgtttactgtttattttttaatatcttatatagaaaaataatatcaacatttattctttaaataagttt

SEQ ID NO: 2500 - DNA, 756 bp, Zea mays
aaaaaggtgaggccacgaccctctttgcccaccccgtggctccgcccctagatgtgattgacaccgtgagaagaaaaaaaaaacctatgtagcgagctgactgctgtacgtgggaaagtgctaaaaaaaactgtcgccaagtctcatgcagataatgacgtgattatatgactcactattggagtaaaccaaacttgttaggtcctaaataaaataaatccgatcctattttgtaatttaagacctattttaagactctcttggagatgttaaccccctcaattcatccctaatcgaacaatatgaacggatttagggggtttgtcgcgtttaacaataaaatttataaatcctttagaaaaacactgttaaaattttaaaaaattataatatagtaaagttgacgttgctgacttgacaatatttttggctagattctctactgcggaacaagccctaaagaggaggattccttgaacggtttggcagttaagaacttaagacatgaggatatgagctctgcacgaggttgtatatttaggatttctccgttggagtcttatataaatttgatcaaaatttataataagatctttgttggaagctgtttttgtctctaaaccctttaatttaagataagacctaatttatcatttttattggagttgctataaagcacagaaaaaaaaaccatcttggacttctcactcttccgtagttccaacgctctgcgcggcatttcgccgagcatacacc

SEQ ID NO: 2501 - DNA, 723 bp, Zea mays
tgttgatgtacaggggcggaccgtccggaccaggggcgcgaaccgtctgcggtttgcagaaaaggagcaacggctaggaagtggttgggggctataaatacaaccccaaccactccattcacttcacccaagcactccaatctttcacattcaatacaagagctagcaatccattccaagacaaaatcaaagcttccaatctctccaagtttcacaattgagacaagtgatcattagtgattagtgacttgagagagagagatctgtgtgttatttgtcgcttggcttttgcaatcgtgctttcttcttctcccattcttattctcaagtgacttctaatcaaagcaagagacaccaagtgtgtggtggtccttgcggggtctaagtgacccgtttgattaaggagaaagctcactcggtctaagtgaccgtttgagagagggaaatggttgaaagagatccggtctttgtgaccacctcaacggggactaggttctttggaaccgaaccttggtaaaacaaatcactgtgttcatctgctttatttcttggttgatttgttttccctctcttccggactcggatttaattctaacgctaaccccggcttgtagtgtgtggttaagtttgtaaatttcagattccgcctatccacccccctctaggcaaccttcaattggtatcagagctcgatacttcattagagtctaaccactcgaagtg

SEQ ID NO: 2502 - DNA, 1500 bp, Zea mays
gtcgacacggtccaagtccggcccatttgggactgtgtcggaggtccgatagaccagaatttgaggtccaacacacgactgcctttgagttgtgctagtttagtatattcatttcgtgctaatctttgttttgagcttttttttggaccgtgctagtgttggtgctggtcataaaagtcggcccatatttcgagcgatgacgcatggttgtccgtgagagggcacatatttctgttttattgttgctgctagatagacttgggtattattattattattattattattattattattattattattattattattaaagttgtagatatagaggtagtcagtttgaaaactaaagttttttatattttaaaagggttttaccaagcaatgtttctccttgacttttatggatgtggtcggagagatgcttcatgccgaccagtcgaaccctatagagccccacgccatgccatcctctcatctcaaaaaggaagaaaataaaaagaaagaggacagaaaaaatcgtagcatcgcaaacgcctacgcggccgcatgcatgcccccgacgcggccgattgggcatttggggcgaacggttgtttcggcaaggaagccgcgcctacgcccgcccgcgctcgcgcctctccaccgccgccggcgtgaacctcaaccaagcaccgcgcccgcgccggcgactgtccataaggccgtgtcctgccgtcgcgcacccctgcgtcgtacgatcgtccacgataccaaggtattaatccaatcccacattgttctctgacgacctccgtccgtcaatgccggtcccatctcgtgcgcgcgtacgtgttctcggcttcgccgggattgtttagggacgtgcagaaccggctgggttttgacgcggaggtggtgcgtttgttgtccgccggtctgaatttatgatccgttttccattatgatttcctgtgcattttagctgttgtcagatatcaaaccaaatcggagacgagggaattaatcaacattcttttcatctgcatttgaggtgttacatttgctaagaattgggcatctgtacccttttttcatcaagaaagaaaaaaaaaggaaaacaaaatttggcttcaagtttgcaattttatgtgtttattggtaaccgaagggacctgggagagtgggagaggggtgtcatcgctacatgcagcctatctatatatcataagctgccttgtctgatcgtcagcaactcagcatcacacttggattgcgtgattatatataattggttgttggttttgttacgtagtcaggtatcagcacagactgcagcatcagacttatttggctggagaaatcagggatcatcagagtcaaaggcaacaagattctgctaccatatcagtgcaagcgaatggctgactgtttaaagacatgcctggatcttctattgtgaattcgcagttctttcatgggtggattgtcaggatcccaaactggtagaggtggggg

SEQ ID NO: 2503 - DNA, 1500 bp, Zea mays
acaacaccactgtcatcaacttcatcacgctgccacgtttcctgctcctcctcgcaatcgcatcgccgtcgtgccccgcctccacggcgcaacatctagatccaggcgccccagcggaattcaggggacagaggccgctggtgcgggtgtcgcccaccgccgccaagatatacaccgagaagatggaggatgtgcgggccgccgcggctgccagggagaccgaggaaggaagaaggagctaaggagagaggccgcatcaggaacaacaccgccattctcgtccaccccctcaacgtcgctaaggtacaaaaagaggatgaagcacacaccttattcccctggtcctactgcatccccactagctagatctctcgcaccaccgtcgctgccaaacgacaccacatgctctcccctttcgccgcatctcagcacctcaacacccccgcctacgttgtgtgcgggatacgagggcacaagcaagaggatccggtacgctgcatgcgcgaacgtcctagagattggttaatcgctcatttttttgtggtgcggatatgctcatagctcctatatttaactgtatagatcagtgtgaaggatagggcccgcgtgatgtacgcgaaggacaaggaggagtgggtgctgattcactccacgacgatctccggctcggtgggaggacaaggtaggctagcatgctattcttcaaacaaattggggttactaggtgtgcatttttattccgtagcaaaaaaatgcacaaggattttcgtagaaatattacgtgcctactaacagtagaatgtaaaggaaatcctcacaaaaggttatttttatattgctcttccgcacataagcaactgctacttttgcttcctgtagtactaaatcacgactgcttgtttaaaaatataatttaggttccattttccatagtggatatgttttcactctctgttgaatgctattggaatgatgtttcccttatatattaattccttaacttgtaatgtacgtgatgttttctttatgtattaattccttaacttttaaagcatatgatgaaggctggttgttgggtaagttctcttaaactttggtaagcttacgtacttttgctatggatcttttgaatcaattacaaggtaattcatttaaaaagtgtagtaacacacgtgtacctaaatatcatatataaaagtctgcatggcgctgatggttgcaatgtagtggtgaaacaattagattaaaataataaaatttatgtatggataggattacaaatgtattaagaatacttttctcataacagtctcgtggtattatgtgtttccgttacaacgcacgggcactcacctagtaatggaagatagatggtccgaagcgtttcggttcgcgtagcagaactgctcgtgcaacaagcaaacaacccaagagccgggagagttggtgactgcgaggccgagacaggggatagattgagagagccagagaggtgggcag

SEQ ID NO: 2504 - DNA, 163 bp, Zea mays
accaacaccaactattatattacctgctggctgtggctgctgtacgcctgtactgtactaggcgtcgtcggcgccttacgtgtatgtcctgtacgactgttatcttgctttggttggtggctgcatgtctgcatgctaagtttaagtacccacgcacgccacg

SEQ ID NO: 2505 - DNA, 667 bp, Zea mays
tagcaaaatagcattacaacactgcaacaatcgattttctcgagatagtaacacaacagagggtagtggcaaggggctgacttagcagctccgttgtttttcaggagaataaaatgcaccagcgccataattggagatcgaagggattcagagttgattagaagcgggagacatcggccccaagcaagtagggttactcaccgagggaagaataatactatacacgcccagattgggtgtcgaattcacgcccctagaccagggtcgcagcgacgccgcttccgcagaggcggcggactgaggagcggcgccgcggcaaggctgcgccggcgtcgagctgggccccgccggagaactgtgtgcgcgcgacctatcatgaaacgaggcgtcctattcgcagttgggctgattatgttgccagataggcccggcccagcatggccctgatagaaaagatagaaaaagcgacgacaatcattaaccaaatggcccatttaagctggcgaccgtccgctggaggctggactctgcgagacgatcgaggccgttcgttcttctctccgcctgcggccgtctcgttgtcttcccccaatgtgcacgagctctctctctctccgtatccggcggcggaagcggaagcggaagcggaaggaagtaggcggccacc

SEQ ID NO: 2506 - DNA, 1500 bp, Zea mays
ccctcgccgggaccggcacgccgcccgtccctcgccgtcgcccggtgcggggagcgtgtcatcgcggtgctagctgtccgacgcatgcggtgcagattgcaacgcaaaccccaccctcccggccgcgtggccgagggctccacctttattactgctttttatttactgctgctgctggggctgggctgctttcgccgccccggtcaatctttagtcgctccggctgggtgcctaccacccggaccatgacaacgtaaaaaggttttttgacctgtgattagtgggtgacacgccacctgattctggataagctggagcccttgcgatccactcaaacgcaacaaagcatgctgtcaacactccagcctcaacaaggagccgtgagaaaaacttcatcagttcaaaacaagtactagtgctagtactgcagtactgctataggaaaataattatgccagtgcaaaactaaaactagtactggaaatactacttccagcaccatcaactacaacaagaagaagggcatttgcaaaaataaaaaaaagctgcttttttttgttgcggtgggtgcgtgcattcaatgtggaggaaactgattttagggacggagcaaaggccctaccgccctacacaccaccaccacccacacaaattagaggattggtgccttgctccctcccccttcttgtcgttgctccaccctctcttcttttattattgggttctttttttctctctctccccttggatttgcgcttgtgctcgtctggccgcatactagtatccgcaccagagaggagacacctccgactccgacctgctcttgcatatagattgggcagagagtgagagagcgcgcgcgcgctcaaggggtgccaaaaggagattttttttttaatccagcttcttagcctcactgtctttgatcccggagagcagccgccagcccaactaatccttgctgctggcgcgccggggctccgattgcgctccagatctgaggcacctgctcggtggattccaggaatccgagcaccaactcgacaggggagttctcagggtaaaggtgagctcccttttccttctccccctcctcatccgtccaccgttgccaagactctggcccgtccgccgttggactggagtagtggggctcgtgctcgcgctcgcgcctgggcctgtcttaagctccgattgctaatcttcggatgtttgcctctcggtctgtttctgccgcctacactggaggacgacgcttgatgcacacgggacaacgagttggccgcaagttttgtttgcacacgcacacgacccaccagttcacgcgtttttttttttttgcttcttaactcgctttgattgcatctgttgtttcggaaggaagaggctgagagcgcgttggagatttggactataagagcgagcgagcgagctgggtgccttgctgccttgaggacgccgtcaagaaaccgcgtggaggggagggcgatgagatgaggg

SEQ ID NO: 2507 - DNA, 1500 bp, Zea mays
ttcatttatttttttggatactcacacccgaacagcccttgttccgcgacctctctcagacaacatgtattgcacaaacaaatatgatttactccacaatacaaaacatggatccatgcaggttcgcttgccattggctttgcattcatttcataaagattgggagctgctggtgtggctcatttaatcttaacttataccagataaccagaaaggcaaatttatagtagttcgagtccagcactacagcacggtagtatgttactcatctgtgcatattctaagaggcactgaacacatttaaaaaggtggctcattgggaacatttgaatacagaactacagccatcagccaaatcaatgcaacagcctaagatgctcccatggcataatttgacaaatgtttcgatgaaatctcatccagacctgcccaacacgattgcattccgtcaagtgataggacctcagtgaaagaagataggcgattaggtggaacgaattcttctattgtgtaggctgtacttatacatgcaaaggctggatttatgcgaaggactgtacatgcaaaggaaagaatcaaagctatcctcctaatgtcctctaatctagcctaattgatacagtctataaaagtacatgcagatatgatctgctattagtgccagcaatgacagagataggaagaccagtaatggtataaacgaggaactgtagcaacacactgccctgaacagccattcaatctctactactctatactagtgtttagcgcgcgcccagcgcgcgtgagcacatatgtcttaagagtttggtgtaagtacccagccatgtaaaacaaatttaaatataatatgattatataatatgtaggcaggaaacaaaatgtaagcatataacgttatttttatgtaatatagttgataccagttgcatagtgaatttagactacaaaacattctaagtagcattcaaccaccatatatcaacactttgcaacatgtaatagctgataccagttatagagtgaatttagactacaatgcgtactaaggccctgtttcaatctcgcgagataaactttagcagytattttttagctacttttagccatttgtaatctaaacaggagagctaatggtggtaattgaagctaaactttagcacttcaattcatatagctaaagtttagcaggaagctaaattttatcccatgagattgaaacggggcctaaacctgctcaagaagaaattcgaaattcagtttttaaggagaagaatatttccgtgtggcatccaaaggcaattattaggggagaataaaatgatggcccgtcttggaactgggaaagcttatccaaacttcctgccgaaaaaggcccaaaattttcccgtcaggagagggccttgaaaaaaaaaatcactcgcgacggcagaaaccgacgcgcaggcacacgcacgccagactagcggctctccacgcaagcggagccgaagagaaata

SEQ ID NO: 2508 - DNA, 1500 bp, Zea mays
catcttatgttagaaataaaaaggagaaaattctatccaatatgaaagattaaaaaataatagtacttcctctttattatatctcttaacatagcatgaattaggagttaaaatttgatacacacacagctagagtaaataataaagtacatttacaaaattttgatgattttttgtgacttttggtaatttgattacacaatgattgcgcagaaagcttgatttcacaacagttcttgccttgattgaaagttgaagcagttataaatgttattagagatgatgaatgaaacatgcatcatttgccttgtttaaggcataaaaatgcacacagcattctaaggaacagattttaaacataagggagacactattgtaaacataatggagacaatattgtatatggcaattaactttgacatgttaatgaaattaaaaaaaaacttccataacactgatatgaatcagcataaaaaaacttccattattttgagagttgtagcatcaaaagacagcataagaatcagcatacgcttggatgttacagaggtcgactaagaaacagcagaagtttgggtgttacacagaggttgactggaggcccaaagctacataatatgcactatcccttgtaatgaaaaattgtagtcgaaagaaaacaaaatgaacaaatcatctacttcattagcaaaatgaaacattccatttgcaccataaatattcatacaacatgtggcacaaatggctacaaacgtaaaagctataaaatagcagcttcatgttcacacaggcacaagagcatgccgcgagtaaactaatagcgagataatcacccatcgtagaagttcggagacacgaagccgagcgacacagaccaaaaaggtccacctcgcagggatccaggcaagccgtaagcaccgagctgtgcacgagagcgaacaaccattggcggtcgacgtccaaactaccaatacacaaaatcataaaccctataacactctactccccaattgccacccaacgagtcaacgacgcaagtacaccgacaaagacacggatcaccaacgctagcggcatgggaggcgcaccaacccgatggaaaacaagcggcgaaaaaaatcaaaaagttagctgctaggggttaagcgcgcacctgaggagaggaatggagaatggtttaggggctgggacgaaaggcggcggcgggggcggacgcgagtgaagcgaaggaggtggggggcgaggatggggatatagggctcctgggatcctcgcgaccgtccgataggatcaagcgccgctggatcagccgtccattcaatacttgctattcaactgccgagggcggtgagcgacggatatttttggggcccacagtggagatgatcggtgatcgcagtgtctgggtcaccgaggctgtgttccctgtctgcaatttcgggcaagcctaggggcccaagcggaaaaggtaagccgactccgtcggcggcggcggcgatc

SEQ ID NO: 2509 - DNA, 293 bp, Zea mays
aaactttgtgatgttacctcaaatgtatctattatatcaccaatccttgtgactcttctctactaaatgatactacacagaatgagtgtttttcgtcacatgaattcaagttatcttttaagttcttcaaaaatacgtgaaacttactttactgtaacttaccttagataatcaaacatttgaactttcttaattttgcaggtgatggtagaacaaagacaccactgagccctactgttgctgggtcagatcctcatccatttgcaggactaggaggcagcagtgtcgagctt

SEQ ID NO: 2510 - DNA, 1500 bp, Zea mays
aggtctcacacgaagaagcagcttcggctgaagacgtctccaagagatggccgaaggtcccttttcatggagcttcggcgttttaaaccgacatagagatagaatgacctttttatacatataggtctgagtcaatgctataaactttcgcaaggggcataattgtaatttgtcacaggctgcgacctgtgcctataaatggatgaacagtacctctgtacgattcacgtgaatctgtcatttgctttcgcatcacgcttgtacttttgccttccgcaggaccgaaggtacatttgtaattcaaagtcatttatattcattaatacaagtagagataattccatgacaatacttaaatgtttatttcatattctataatttatgtgaatgcatcattcttcgttgttatgcttacgaaggtttgtccttcgtaaccttcgtccgagatgctttatatcccgaagggatatatcgttatggaggacgaaggatcttaacacttaacattttttgtgttgccttgttcttaattcttagcatttgagaacaagtccccaacactaggcaaccaagaaatttccccttcttcactccgaaaacacatttttctggattcagctttaaaccagcctgtctgaaattagcgaaggtctcctgcagatcagcaatgtgattatcttgcttcattctttttacaatgatatcatcaacataagttagcacattcctgcctatctgagaatggaggaccttcgctgtcattctgctaaagcttcctccagcattcttaagcccctcaggcatccgaaggtaacaatatgttccactaggggttatgaagctggttttcggttcatcctccttcttcatccagatttggtgatagcctgaatagcaatctagtagactcataagctctgatgaagctgctgcatcgattaaggaatctatccttggcaatggaaactcgtccttcggacaggccttattgagatcagtaaaatcgatacacattctccatttaccattggccttctttaccataacagtgttagccaaccattctgggtattttacctctctgataactccggcactgaggagtcttttcacttcattccgagcaccttcggccttgtcatcagacatcttctgaagcctttgctttcttggtctgaaggatggatcaacattgagcgagtgctcaataacatccctgtttactccgcaaagatcattagctgaccaagcaaaaacatctttgttgttgaacaaaaaccttatcaaggttttctcctgctcttcggacagttgagatcccaatagcaccttctgctctgctatgtcctcacataagagcatgggcttcggctgatcagccgaagcagctttttcccttctgaacttgtattgctcacaagcttcagctccatctatgttatggattgcttttgagtctgtccaatttccttcggcccttctggcagcttcctgacttcc

SEQ ID NO: 2511 - DNA, 920 bp, Zea mays
ctccggtacgacgctactggtaaaacttatttcaccctcctataggaaagggatgagacaacattctttcgtataaagttctgaaccaatagctatgaactataaaaattgacttgctaatttgcatacggatatatattatattaagatgtgaaaacaatttgcaagtatgtgtgatatgttgctttactaaacggcttgaccaatctatatttttctgtccaaaacgactaaaaattagttgtcatagttataactgatattaaatgcaaagaaaattgttgggatcatgcttcgtcgccgaaggtcctgcagaaagaaacaacytaggctgaagctgctcgtacgtgatgccgaaggtgccatttcgtgaagcttcggaattacaaaccgacttaaagatagaatgaccttttagtccatgagagtccgagtcattgttgtaaacttttatgaagggtatgattgtaattcctcatgggttgtgtcctgtgcctataaatagtgaacaatattcctttactgttcacacattcctgcaattgcagttgcatcactcggaaattatcctttgtcaaggcagaggtataaatgtatctaaatgttacatttgaacatcttaaatttatatatagtaaataaatgatgttattcatttccaattcacttgtttttcatgcttgatgtcttacgttatttcacattatctttgtgaattcgactacgaaggtataaccttcgtagttctgccattataaccttcgtccgaagtatatccttggggaaatgatgcttcaaaggacgaagggtattgatatttaacattttatgttgccttgttcttgattcatagcatttgagaacaagtccccaacattggcgcccacctccggtgaactcacttccacttttttgagctg

SEQ ID NO: 2512 - DNA, 138 bp, Zea mays
agttagcacattcacaagtgaaaataggcctgtcagtaaagaatctacaaattccagattacatttattgttggaaaaagcaaagaaaaatatactgcggccgttgattcttcatcatcttcaccctctacaccagat

SEQ ID NO: 2513 - DNA, 317 bp, Zea mays
gatgagagcgccgggaccttccgctggctgtaccagccgccgccaccgggagggttttaatcgtttgcggacacacagaggcagagagggggccgaagcctagctgggtatatgttgggctttgctaattttgtcggctcaacacacgcggatttgggcctgttgggcctattctgtatgcggctcgactgaacaaccttcggcctttgacacgcagtggaagagaggagactggagacctagctggataacccaactttttccacccgccggaacactggtaaccctcacgccggcgcagccgcagccgaggcgcc

SEQ ID NO: 2514 - DNA, 699 bp, Zea mays
aaactttaagctggctaccaccattgccgaagtaattctaaatagattataatattgctaagatagtaattcgttctttatcccaattactagagtatcttcaaccgtaccttaaattaaaatgtcctatcataaaatatagggcccaactaataatgtaatttactttttaacatacatgatttagttcttacctaatagagcttaatttgttttttaagtgtcctaaactctttaaatgatgtaatattttaatttttgtactttgttggaatactctctcatttagaactcacaaattttacatgaattacgcaacaaatttcatatgcagaaaaaggcactacgcaaaaaaaaataaacattccaatatcccaaaagtctcatagagcaaagatgattatttgctcgttccgtttttttcttagaacatttataaaacgcaaaaaaagggaccccagcacatttatgaaacggaccattgaatgtgctcaaggcttctttcctccagaatcccccatctgagcaagggcgccgtcggctagcgccgcagcattgacgtggacgccgaccctctccggcagccggttagttccgcgttcgccgcatttcgcactccccgtctttcgtgttcatccatcccgaacttcaccttcccaactcacagcttgcagcgcgtcccttccccgctcccgcggc

SEQ ID NO: 2515 - DNA, 731 bp, Zea mays
gatgttctatgattgagtatttttacaaaagtttcaaattgcgagaattttccgtgcttaatgaaatatatagaaaaatgttccatatatttattcgcaatgcgctaaaaatactgttgtttcacttatttgaaaccaatgcttccaaagatggtgtccatggagaataagtaccaaattagggcagtgagtaaaaggtgagagaaaaaaaaaagaaactaaaaaaacgtggaaaaactctcctattaggcccgttaacccgtcacatgcgtacagggacagggctacagaccgggccggcgcgtctcaaagaaggcccgttaaaggcccaaccacaaccaacgaggcggaaatatatactgcaaagtaaccctaaaccctcctccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagtattccctcccacgccctcctctcccctgtctgcgttgcgaaaccgagttcccacactctaacctcaagctatttggctgtcttatgtctactaaacccctagcttcttcgcgaggagatatggactttactagatccgcaacctgggctggacgatctgacgccatgtatgctgtttcgaccgtttcaggctccggccaagggcgtg

SEQ ID NO: 2516 - DNA, 1074 bp, Zea mays
tgtcctttagagacaactactgcagttttagaatgctactaaatctttagggacacccagcaaatagtctaaggccctgtttagttcctggttactaaattttagtcacatcacatcaaaatatttagatgatagctagaagtattaaatataggggtgtttgaatgcactatagctaatagttagtggttaaaattagttgagacatccaaacatcttagctaatagttcaactattagctatttttggtaaattagttaatagtcaggtaactatttgtttgctagctaattccattaccaatttgtaaccaactaattattagttctagtgcattcaaacaccccaataatctaattacataactaattatacagataaagaataaacgtcaatacagatctattaaactaattagtatataattcacctatgcgatgttataataataatttgctaattatatattaattaggtttaatatatttatcattcaaacaccgtaactaataattcagctattaactatttttggtaaattagttaatagttaggtagctatttgttagctagctaattacactaataatttttagccaactaactattagttctagtgcattcaaacaccccatatatataataatcgtaattgacatttaagaggtgtttggtttgtaaggattaatttttaatctctccattctactttagtatctaaattactaaatacagaaacaaactctattttagtttccgcattttataatttagagaataaaataaaataaaattttgggaataaaaattagtacctagaagcagacacctccttaaatatccgatatcacaccatcaatggcccggttcacgtaaacagagcgcgtcaggtgggcacaattggtacaacccaacccaacgagcagcagaagccggcgccagatcccgcataaaccacccgctctacctctccacgcggccagcctgactcctccagaccagtcctcacccctgctcgccgcgaacgaagcacagctccttgcctccgtcaccgctctccgtggccggcgaac

SEQ ID NO: 2517 - DNA, 129 bp, Zea mays
cggatgaatctctagcgcgcgacctgctcctcctccgtctcccccgcgccgcgtgccctagagacgaaattctctctctcctagagccgccgccgcagccaaaaaaaaaacccctaaaccccccaatcc

SEQ ID NO: 2518 - DNA, 106 bp, Zea mays
agcatcaaattgaggatttgtgaatatgctgattttgtttccatgatatttacatacagtcatccttttaatgtttgtatttgtctgaatgagcccagtcatgtaa

SEQ ID NO: 2519 - DNA, 1500 bp, Zea mays
cactactgtactctactgtgtttttcagatgaatgtaccctacttgcttcctacttcgtctcatgtttggtctgttatgaacttatgttccttctgtttggtgtcaagtttaaaaatttcagtatgttgcagaagcttgcaatctgtggttctcaagacagtactgatgtgctgaaatgtgattgattaaactgccaattttactgattattatattctgagctattgcctgtgaatgattttatggtagctatgttcgtgcctgaaccttgacttgtggcttcggttgggtttcaactctagcctactccaacttgcttgggactaaaaggctttgtcgttgttgtacgtttgttctgaaaattttcagaaaccctgcccttgtgtccaaagagagagattatttctgcttcagtgcaattccctcgagatttgagcaatgcaagtccttcaaatttacgtattcatcaatattatatatcaacttatcaaggcattgtatattcacctctctggagttgtataaatgcttcttagacttagtgcactaaggctccatttctgctcttttaaatccgagggcggtgtttattttggttgatgtaagatctacatgtratgtttataggttagtagtttaaagttgaatttcaattgattggcatgactcccragccaacttgtcacagcttacaatgtcttttctgttctgtatttagaaaatcaactccttcaatttgtgtgaggaattgagtttactgctaccgcttcctgcaaagttttatgcagttgtcagttatatgtttagtatatagtacagggtatactccgttgctgttacaattagcataaactcaagagaattcattgtttttgaccatgatttccagtctgataaatatttctgcactctgttttattgcttatgctaggaagaaggccagggctgaggtgacagttgggcatctatgtggccattcattttttttctttgtctagagacttggtattaaaccgaaaagtcatgtgcagtcatatggttgtcttgtcatttgcaaaccagaattgtcttcctgacttacaatccattgttgtcttgtcagaacacaagatcaatcaattttggtatcactatttttgtgaactataggaaccagagttgtcttgtgacaagtctaagcatcatagaagttttgaatctttctaattggttgttgatctgtccccaggtaatcatacacatgatttgtttgccactactttttagatgcacaagatcctatgctgtacatgccaatggttaccttctcctttatgtttttctcttgttcttagacaatatatgtgctttctgaagtgtcttttggaactagacactatttcccaatagcaaatctcgaatactgatgcctgacaatgatgcaacttaaaacctgtagactactcctgctgtttcttattgccaataagcacaagcacacttgagaaccggccatcacc

SEQ ID NO: 2520 - DNA, 104 bp, Zea mays
ggtgagcttctgatgccaattaggactaaacatgcttcctcgctgcgctcaagtgggagaacaagaaatcagcctagacactagtcatctgctgcaagcagaaa

SEQ ID NO: 2521 - DNA, 152 bp, Zea mays
acctgcagcagccgtaggacacacgcacaccgcctcgacctcgactccaccactgactccaccacctccccctgttctcaactcgcctgcccctgtttttttcgacctcgctctgctcatccgccccgccgcacagggccggccagacagcc

SEQ ID NO: 2522 - DNA, 1088 bp, Zea mays
gttactcatcatgcttggatccaagaaaaacaaataatcaatttccacaagaaaattaatttcaagagatcaacaaagagagtataaacaagatgatttactatcgatgggattgatattgacccattaagtctccacctgcgagtgctagagtggatcactatagacctcaccagtactggtgagaaggaacctggctttgatcctctttgccaatccatgcatgttcagagtcccaacacatttttcatgtgctatcacaaaggttaaggctaacataaatcatgtcaagctacaacaacaagcagtataaaaaggcaaattgcccctaacaaatgtggcaaaaggtagaagtgcctactcatttccagcaaagataatggatttgtttttaatgtagagtacatctaattcacatctaaaacaagagacaatactcctcaataattagcatggatcccgaagcaccttaattcagtaaactaaatgatcaataacacattatggtcctctccaacacccccaacccccccctccaaaaaaaagttgtcgttctttttttgcgagtctagaggtaatagtattggaagcacaatctcaaatgagtaccaggtggcgagtaaaagtaagatagtgtttgaatgcattagagctaatagttagttagctaaaaatttgttagtagaattagctagctaataaatagctagctaactagtagctaatttactaaaaatagctaatagttaaaatattagctagggtgtttggatgttacttatcctatgttctaaattatagtttgttttaattatatatgtagctatacaatatttctatacacaaaataacctatgaattaaaaacataataaagagtgaatattcacttatatagctcggctttaatgcaaagtgatacggaaatccttataaaaaaagcgacgagtctgtggtgtaccgtctaccacggagccgccggtcctagcctggaaccaaccacctcatccgtctgcgtgtgcgcgctgactcccccctctcccaaaacccccacactcccccttcggcatctccgatatccgttcagca

SEQ ID NO: 2523 - DNA, 700 bp, Zea mays
ctctttttatttttatttttctttcttttcctctgccctccagtcgatttggttttgtattatccatttcttttctctctaatataatatatatcggagcggcaagacttttgccccttcctttaaaaaaaatattctaccacatcgagtaatccaaacaattaaaaaaacatcgagtaattgctttcctagccaatgcatctaattgaaattcttttttgtggactattctacaaaggtcacggaagttatttttgacaagttattttaaccgcacgcgaacctacatgttcatttcatttgtgttgcttcaacactcaacaggggcgcgtcgcgtgtttagggtatagttgccactgcacttgctatatacgaacacgggcgaaatggcttcgcatgtcatgtggagtttgatcgatctctatttggatagatgttgagcaaattagacgtatttattaaaaaaacgtttcctatacatgcatggagaaagcacggttgaaatgaaaacaaatctaacacatatatacgttcgacgagagagatcaaacaacaactttgtacacaagacgtacgatctcatgcatatcctgttgggagtgtttacatcgatcagtggtctccagcagtctagctgtcgtcccgcgaagaaggaagaaggaacagcgcgtagaagccgccggcaacggtagaagctccc

SEQ ID NO: 2524 - DNA, 196 bp, Zea mays
ggttcgtcatcttgttcaagatgaacagaaccgaaggcctccacgcagagagctccatcaagaaggctttaacaatgaggacgactggtatgaagatttccatcatggaaattttgctttcgatgatgcttcccctctctcaacagaattgcaggctacaccatggccctagtcttataagccaccccaactcccc

SEQ ID NO: 2525 - DNA, 416 bp, Zea mays
aagtcgaatcagaacgtgagaagatcctgggaattttctcggccacaagctccccgccgtggggccatccgccaccgcactcacaggctcttcttcctcccgtgaacctgatcgcgagagggccggccgagtggtgtgctgacagtggcacgacccgggtacaaaccgacacgggaccttcacgggtcgcaccacccctgcctactgcctggcgtccgcatgcatgcgtggtttgctagcagacgcccggggtctcttgatattgcagatggctacactgtgttagccgcagcggcaacactgctactcccacccgtcccctccccgctatatatacctataccccccgacaggagagggaacatagcgaacaaacatcgagtacagtcggctaggtaatctggtggtacgacgac

SEQ ID NO: 2526 - DNA, 373 bp, Zea mays
ggtgacggagagggagcgcctcccccccattcgcggcctcgattccgctgtgctcgccgcgataccggtcgtgctgatcgaagcgggcgcggatgcggggggcggggactgcgcggtctgcctcgcggagctcgagcccggggagaaggcccgcgcgctgccgcggtgcggccaccgcttccacatcgagtgcattggcgcctggttccgggggaacgccacgtgcccgctctgccgcgccgacgtcgtcgtcgtcgtggcgccgggcgctatcgtgccagccgagggcggggcgctgtcggaggaggtgcggatagacgtggccggggacgccgtcgccgcgacgcccaatggatccacggtagtgccggtg

SEQ ID NO: 2527 - DNA, 1500 bp, Zea mays
gtggctagttggggctttgcwttgcaaccgccaagtgccaatgcaacgtcactgttgattggttgccgcctttcaactcctccctgatcatcattcaattaacatacacatactcaactgaactattctcccaattggattattatattattgggttctctgagtcttgatcaatccggtggttcaagatgaggttattgctaattgttttatgcgttcggaggagcatgattccctgcatgctttatgctcaagcaacattattgtatctgtgtgtggtccgtccgtgtccatgcattttgagcatacataggactaatttagtgactagagatcacagaaggattgaaggagattgaggggaaataaactcaatgccctctaatccctcgtgatccctttgtcaccaaatcaaaccatattactcttcaactttagagcctggcatatcttaggctctaggttttttttctaaaaaaaagtcagagtctcgctaaacattttttaaacagtttactgtaaaaagcgtctaaaaactagagttatttttgtactacgagaaaaaaatcacaagctctagatctagcactttaaaacactaaaatgactctgactcttgatataccaacggtcatgccggggctagcccgcctcgggcatggctagacccgacacgaggggtgatgtggtctagtcctggcacaattattctcacacgagtcgtgtcgggtaaggactaggccagtaaacaaaaacacttcaaaattcagaatttaaagataatattcaaatccattttagattcaattaaatatatttataattttagatacatacttaaacaaaaaagtttcaaatacacatataaacgcatatcacaattcagaatactcttatataataacagaattatcagtattataattaaaaacagactgactattagcctgttaccgaataagtcctttaagcaggtggttaccggggcgggccagacggtcggcccaaacacgacacgactactgccgggtcacaactgtgccgggtcataggtctactgtcggaccagcctatttagacatgtataactcttggataagtcatttatatcaaactatttgcgaaatggtttcagttatataaaaaactgtttttagaaaatcctagagataaatctgttttttttttttttggtactgcgaaacggaccccttcacaggcctgctttcccttgccaccattgtcgcacaatcgcactagagagtcttcaccaatccccaactaaccggcaccaaaacagcaacggaaatgggttgaaagccctgcccagtgagagagagcctattgacttcaaccactactcccgagaaagcagggcaaagcgtttgtgccgtgccgtggccttgtgggaagagaaagaaagggagagaaagacaggactggagaaggtgagtgagagggaggcgcgcagcggcagcggcggcggcggcgtcgccgtcc

SEQ ID NO: 2528 - DNA, 678 bp, Zea mays
taccattccgtacttgcatggcgcgcacaagaatacaaggcctagaacattcttgacttgttgtctgcgcggagcctggtcctgccgcgtgtcccggggttgcacaaaacaaccaggaaaggagggaggaaacaaaaccggcaaccgttacggtcccgcccgttccgtgcgatccgcccggaagcgtttcaagatttcaaatactgacacggccgcagcgggcgtacggcgtcgcgaacgcgatcgttacggcatgtcccgtcccgtcccgtcaggacgtcacgcgcggtcaacccctccgccgctggtcccgcctggcagcgcctcacggaggccgtcccgccgacgcccgggcccgcgtgtcatgggccgcggagggtgggtggcgtcgcggccggtgggccttcaaaagagggtgggccccgtgagcaccacacagcgacccctcaccttccttccgttcgactccacacaccacactccattcccatcctcgcctcgcctttttagagagagagaaaccacggctgcgcacagcgagttagatagagagagagagagagagagaccaagaccaaggccaaggagcaccgctccccgtacatccccagcaggagagggagagagacagagaaggctgtgcgaagggaagaagacccggcgggagagaagggcgac

SEQ ID NO: 2529 - DNA, 437 bp, Zea mays
ccagtcgcccgccgcggattggagaggctgcgcggggccatcgtctggaagcttcgcgggacggaggagtgaaaggtttcatggaccatcggtgtccgatcggacggctgaaaaatatagaatgaggtggatagactagttggactcgtttccgttgactttaaagataaagaaatttcagcaatccagcttaatcccctagtagagtcagaagccccaatccatcagcagattgaataatctggcatcattggagcgtacgtccactacgaagtacgaccaatctggccgccttgtgagttgcgagttgcgacttctagcatatcatcggcatcgcctgctctgctggtgaagagcgaaggccgaaggggccaagaccacacgccttccaaggtccacacctaccccaagagccgcccgccccatcagccgccacg

SEQ ID NO: 2530 - DNA, 1500 bp, Zea mays
  unsure (1)..(1500): unsure at all n locations
aatctatttttacatgcgcaagtattatgtgcatatttggacgcatgtgtcggtgctgtgtttcaaaaaatacttttaaaaaacaaaaaaataaaaataaaaaacgcctagtcaaggatcgaacctggcacgttttgaatacagataaggatccaaaccactgcaatggagttcagattctgatatgctcttgaagatagtcgtctttatatggtcggctgcgcgcgcgttcatcttcatacgaagagttgtttgggnggaaaaagacaccgycgtgcgcctccatacgaagaattgtttgggaaaaaagacaccacgacgtgcgcctccatccacgattgytgcgcgcgcgttcatcttgctgctcgctagaggtattacctaccatcttccaccatgcattctctgttcagggatttctgtttgttagggttttgtgactatcccattcagaaatttccattcgttaggaagggctcagcgcacgacacttcattgatggcggagcaggttagaatccttcttaggatcatcgcttgcgcattggccgccggatggactgcggtcaatgtcagacaaggagcacctcatcatagaatccgtttccaactgtaatatatgagacacgatatttccaatttccttctagcaggctaaaatacgatcatatataagagcatcaatcatcatgtatgcccatcagctttcccgttcctaccaaccatgtctcatgttagatcatgacacagaaaaccccatgcttcagagctgttagcttggataaaggtgttgtcaccattaatcttcaggtcattattaatcttctgtaaatctgacggaggagatgcccacagacgcctacctatcatcaaatttctagttgatgcaggattttttgctttatgtgtacttcagtaaccaccttcatcacattgtttacaaaccaggcaaatagtgtcagttagaactactatacgcttcaggttcattttaacagccaagctacagtgcatcaggcgccacacaaactgccttctgctttcaggggataagtttcaaaatcttcatccataaattccaattggttcgccatcacttactctccatacaatgtcatccttctgttttcaacgcaaagaattacatgaggctgacatgtttaaaataactactaataatatgtaattgctttaaaaaagagcaaggaacgcctttggtacaagccaacagattaaaaaagctaagaaattcagaacacattgatacaccaaagtatattgaaaaactattccagaaaatttataaatatataaaaaagggcgcgctgggcgcgctttagacactagtatccatgaaagacagatacgagcatctagccatgctaaacatgattccatgaaacacaaatatgagtaggccaagtgttgaataattattttttgcacaatttatgaacaagatacatctaacacatgtgtttttaaatttttgtgtttgtag

SEQ ID NO: 2531 - DNA, 490 bp, Zea mays
cgggacatgatagtggttatgacttatgagttatgactagtcagtctgctcaacacctgcgcggttgatgaccgtgtaggttgacccaagcgtcgtgttgacggcccactctggcactacatgtaattgacgatccgaagggatagggcccaacaatattggcccatggtaaactcgactcaagctcacatgtcctcaccagcccacccatcattacacgccgcgggtcccaaatcattccccgccgtcggatcaccttaacaaaccctatcaccaaaccytactacataacccgccattcccactcccctcgccgcctgcgtccacctccgccccccgccctccccgcgtcccccctctcctacgcagatcgtccaggtaaggtaagcgaccgcgccgcactccattgctgctttctctgttcgctgcgcatttcgatctttggctaagaagttgcggtttggtttggccgtgctcgtgggtcgtgtag

SEQ ID NO: 2532 - DNA, 478 bp, Zea mays
tctcctcacaattttatttatgaaatataaactatgttatttttattttttttaggaactatataaatttaatttgctcagttattatatacttagataaatttttatttcgataaaacgtctgttgattagcctactgtaaaatctattattgagagtagctaaatcattaactttaactagtttttttagctaatctttgttctcaagacaatttttcaaaagaaaaaaaaagaaacgggcaagccgcaacgtgaatccaagcagtccgcgcgtcaccccgccgccgaaggaacaagaacaaaccgcccccaaattagctgtcaacccgtcgcttccttcacgtaatcacgtctcctccgccgcccttgctaagcaaacgcaacctgcaactgcaaacccctcctccgattcctcccccgcacgcggaagccccccgcagctcttcgtccccggaggaccaagaccaccaccggag

SEQ ID NO: 2533 - DNA, 355 bp, Zea mays
ggtacttcatttttagtggattcgatttgatcgtcgtgtcgtgtttagatttttttattttgttttataaagcaacgtttctagttctcccacaaatgggcccaattcagctacagagacaagcccaattgagctacagagacaagccgaataatctaggcccactgtgtgcaatgcggtgtggttcactgcgaagatataatgatgagccagcaggttggacggtcgagattctccaaatcctagtagccgactagccgtccgcgcaaaaccctccctgctcagactcgtctgctgcagctcctcctccgccgccgtatcaaacgcactctcctccgccgccgcccgaggcaag

SEQ ID NO: 2534 - DNA, 65 bp, Zea mays
catgtcgcaagtatctatataacatgctaattttattaaacagcaatgctatgggcaacaagtaa

SEQ ID NO: 2535 - DNA, 180 bp, Zea mays
ctgtagcagctagtgccgcactaccaaaccctatataaaagcccgcgcgcgcctcgttcctcttcaaacccaacccaagccatcatcatctatcaatcaactagagcaagctaagctcggctagcattccagaagctgcatctattatcagctacctctcgattcatcgcttgcgatcga

SEQ ID NO: 2536 - DNA, 1409 bp, Zea mays
ttctggatgatttggagttgttgtttcagggttgtgctggtgtctgaacttctggacttaggtttcgtagctagcttttgttgcttctcgcttcttagcgatggtttctgtcgttgtaataagaaatgcttatggtcttattagttgttcgggttgtgttctttactaggtctccttgcttatctaggatgatattgtaaggtgatctggtagggtttcgtttaagcctagtttctgtcgggccatttggtcgtaatggtgtcctctgtaatgaacatttttctatttcctaatgaaatagagggcttttgcccattgttaaaaaaaataaaaccaaaaaaacccggaagtttaaaaaaacgaatgcccagctgtatccgtaagcatatattattgtgcctattgctggtaacggatacgataggagtgctgattaatcattaaacacgcgaatgtggtttgaaaagtgaaaaccctctactcgtgccgtcgtcaccagtgtcctaccgcccaaccgtgcgccgcacgctgaggtcacgggacgcatccggcggacgtccgggaccctgccccggccccgccggtgaccactatggccaccgcttcagctatggctgcatctgtactagtatgtcatagttcatctcctgcagccacaggcccacagcagcggtggccgaataggtccgatcaacggtcaagactcaagaggagggcaccggaccggcgattaaagccctgcggtttgcacawgcacccttgcgtccctgcgcaattacagctgtttaatcgtcgacaaagcgggagtaatttcgaagtaaagccaggatcctgagtttaagaaaggcccgccgggtgatgatgatttccctttcatcagcacggacctcgtgcgccgtacatggcacacggtttcgtccgtacatggccccgtgataaacaaaccattccccgcaagaaacagcaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgttttttttggtgggggtggggggtggaatctgcggtggagtcttgccgtcgctcgctgtaaacgtagagctctctctctctctcttggcgagtaatcttggttcttgctccatttccgtgttagtgctggcgtgtgagtggcaaggtttacgtgtaag

SEQ ID NO: 2537 - DNA, 1500 bp, Zea mays
ggtgtcagacgcgttgaagggaaaccactcgagtggatctcgcgtgtggcccaagaccgacccatcataaaacgatcgatcacattaactacgtgtggcgccacaccacagcggaggcgtcggtctgcctcccacttcatctaaagaaatgtatcattattctccacgttgttcatagcctagatctattatttacagttagactggtccagagtggtttcaccgcccttggtagcgattgaactgacctgcacagtcgaactgataatttgattttattttaaagtttgtggtgaaaattttaggtgtagtctattcacccatctctactttcaataccgcacaataaatttcatatcttgtatggtgaattcttccctttgttgttgaatttatttcttgtacattcgtagagctttgttactataggttgcaaacctattttagttsaactttggttggactatttaattctcttatgattctaactaaatgtaatgagcgtgttcaatttcatatccttcatcctacaatatccagatgttttgtgcaatatcaatttttttgcctagctagactttacagtagatagtaaaaaatccaaacgtaccccaaacgtctttagctgggcaaagtgaggtaaagccctagcaagagattcgaacaacttttttttgggggatggagggtgtactcctgaagccctagcaagagattctgcaagagattctgcagtttatagaaacttatgacattgtagtatatacatgacgtgataaagattggcgcaactttataagccatgtcaaaaaatatgtacaattaccgacatctacagaaattatttcatgcattgaaaatactttaacagattgattttaagtaagatgtttaatccaccgaacggcccaagcccactggaggcctggtgggtgcacgctaagaggtctgtttaacgttttgctagcgaaccagattgtaaaggcatataggaagcccgacgtctagacagatgtcagcattgtaagttaatgggccgaagttgtacagtgaaccatctcccacctttgacacttcgcgctccccatccaaaccgtactgatccgccggccgccgttctccatttcaaattgcaaacctatactccttttccgcctcctcgacgcaactcgtcgccgtcttctccaactcgcacttcgtccctcgccccacccaggggcggatctccacccggggctgcctgggctgcagcccctgtcggcagtcgcggcccagtccatcatcgcgcgacatgacctagcagtagcagcagacgtcctacgtccagccccagccgccgccgtttggctcctgcgttcgatctcgctgcgtcctggtcctgcgccctgcggtccagcctcctctccaagactccacttctccagcgcgctcgcccgcgccagccgccaggccgccaccggccaccgccattggccccaccatttgccgctcccgcctacg

SEQ ID NO: 2538 - DNA, 1500 bp, Zea mays
tttatcttttttttaagtttttgcgggttctattaggttttaactctagcctaccgcaacatgcttaggactaaaaggttttgttgttgtttttttctcattggatcattttgttctcaatttttttgctaatacttccaatttggtatgttcaacttttgtactttatccaaattaatgcataccaacttataatgtaatacagtaatgggaacggatgaggtgtaaatcaagcacttggtgcaaaccgtgcaatcagtcatgataattttacaaaacaacccttccaccgtgcatcagctttcaaaacgacccttccacctcccctagtatattttcaaacacaccctcccacctccaacaacatgttggtttgtatagtttgtaccaagtgtttggtttgcatctgatccattctcatataggtattatcccgctgacacccctcagttttcgatatctaacctaaatgtttgttttcaatatgatcttttacaatacatcttcaatatgaatttgtataatatatttttcatgcaagtttaagaaaataaatatatcaggatacgaaggagggagcattatttgttgttttcttttttcacctttttggcgaaaacccatgatgaggaagcaaatctaacatttataattgttgagcagcaagatcaattagttttttctcgtggtgatggagaatccatgtccatgagaacctctattgttragctcactgagaggtgattcaaataagagcccagcggtagtccaagttcgagtgaagcagcccatatagcacacggaataggcccgttatgacgcccacgagctcaagccgttattcagtattcagcccacgaacttctagccttagggtagtacaacctcatttacttggcgtctcttgaaggatttttaggaggttaataaaaaaatcaaaatatagatttttcgtgaagaacctgatttttcatactttctatatttcctgtctcaactgcattttatgatctagatgcttaagactatctcttgtatttaaaaaaaacattatatggtctctaggttctacatgccttaataaattcgtttggctcaaccgtccctaacgacatcggcacatcgctgcctgaagccctgaaagaaaacggatcaacctctcagacttcatcccgccgtcgaggtgccccatccgacggtgccaccgcggcagccacgcgcgcaccacaaccgtgccgcctgccgcgcacatgccgcacgcaacgtccccaccacaacacacgccagccccgtgcgccctacgcgattctagaagcctccgggctccccgcatcgcctccccacccccatgtctcccagtccctgtacctccgtataaaccctagtacctcttatccgttcgtcactccccaagcgtcacaccgaatcaccacagtcgagctcgagcaggaacaagccgtgagcgcctgcccccggtgctcaatatctattccacacctc

SEQ ID NO: 2539 - DNA, 1203 bp, Zea mays
gtgaggggttatttgtaaaaagatgatgcggaacaaccgttgaaactgatactttaatatagtagagatagagatttaggaaatatgacggctttgattttttcagaaactttcaccactcgttttatttaaaaaattataagttattatttattttattatattttttattactcagtcgtttgagcgtggcttaaaatttgatgttttctaataaatgtaacaagatatgtggttaacgtttttatttaaaaaacaacggcgtcatatattcataaaaagtagtataatttaatgaattctatactatagtttacttctttacaactttaacagtttcgtccgccgtacatcacatacaaaacgtgtaggtctacttctcttacctgcttctcgtctaataatgaaccgttattccacctataagtcttgaaaaatcatctaagcccaacacaacagaaaactatacacaacacaacgctttcacatagtaccaggttactagctgaacgagtacgagcgacctataaaaaaggaattgacttcttttcgactaatatctttattatttttttaattaagataagatgtaatatttgtttttatcagttaaatatatgatatacagattacttgatattaaatttattttttattttatgagtatcaaataacattaggtgtcgtcgcaactcactaccgctcgcctgatagatctaaatatttaaagttgggtacaaagtagataactaaaaattagcgcctgttaatctgttatttttagcgtaatcgatccatacggctattcaaaaaattgttccggaacgagactaaccgaacctccggcgttggccatgagcttcttctcccccttcccacaccacctccctcccaaatcagcccgtggcccaaatttactcggacttcacctctcccaatcctcctccatctccttcttaaattccacttcttcgatttgatccccacccgtcgccgctcttttttttctgcttatttttttttctgagccgaccagaaagaccagaaactcgagtttgttggctcctgatccaaactattctaatcgcacgaaagaggctgcaaatattgaattttgagtttctttgggagtggtttagtggataaatcggggaaaccataggggaattcctgaccgaaagtggtggaaagtttagtttggtg

SEQ ID NO: 2540 - DNA, 1489 bp, Zea mays
tgggccagcgatgattatcgatgggccgaaaagagtcggacggatgcggaagcccaactccaggttccaaggaccagagtggatgacctgatcagtatactgagcctgacggcggcggcaggaagggcatcatcgaacagagctatcaaaatcttcttctccaagtcttcttctcttgtgttcttcctctccttctactatctgattgctgtaagaactattgtggtgaatcctagtgagaacttaacacgcccatgagttgttgagcatggtggcgacgagttagaggtcgtcgaggcgggcgacgaacatgacagggtcgagcaggatagcgtagtgggtcatgctggtgaccaccatcggcgacgagaaggccagctggccaactgccccgtcacctctgctcatggctaggacgacgacgcgggcaacacccccgtgcttttgtagctttctcctcaccatcttcatctctgttagttcgcctcgccactaaccccgcgcccgctgttgctgctgacccaccacggcgagctggctccaccgcgatgccatgaaccccgcgcccgatgctgctgctgcctcgccatgaaccctgcgcccgctcggttctgctgttgcctcgccatgaacccgcgctcggtgttgctgctgccttgccatggcctcacaacgacgagctaacctcatcatgccacgaccctatcgtgagggagaaaaatccatgcacaagaattaatacagggaagaaacacagaaaggagaagtgagaaagaagggcaaaatagtccgtttgtcttctagaattaaattaaagatactttaatttttgttaaatagctaaatgatacttcattcgttccaattcaaatctgacttttttaccttaaatttgatcaagccgtcttattcaaaaaaattcataattattgttaattttcgctatatattatttagcatataatatattttaaatgtggtttatataatatatttaactgtggttttgaatttttcatttttttcgaaaaaattaaatacaaatgtgaaacaaaaggtcaaacaaattataattcgagactaatggagtattttaaaatgtgtggcatggtttataatggtacttggacgaagctcagtcagttgatagcaatctaagctaagcccacgtttagccaaattgcaaatttttcgccggccggccgcctgcgccctaacacttacaccacacgagcccacggccgcacagatgaccggccgccggccacccacgctggcgaggatctagttcctgcgagactgacttcatcgaatcgatgaggcggcagacggcgggcgacatcccgcggcgttgagaagctgcggtccaccttctcggtcggtgggccgtcggcgtcggagtctcggacgtcggaccaccaacggcggcgtccgagagctggtcctggagtgtacttcgtgcaacaaccatcgcggcatcgcccgccgt

SEQ ID NO: 2541 - DNA, 456 bp, Zea mays
cagccccggccgtaaatcctcccctgatgcgaagcgtcttgaagcgacggcagctccacgcgctggcatagccgtctgttctcagcaaacccacccgtctgttctcgtcgtggcggccgccctgtccccattccccaatccctgtcgccgtgtccctaatccggctccgacaatcccacgcccagcagtccagctccagcgccgccctgccccacgcggccacacccaggacccagcggccagcactactgccaggctggcagcgcgcggaggtccagcgccagccgccagcaccaggcttccaggtctctagtgactcgatctcaaggtactcagcgcgctggcagccgatctaggtctctatgtgtcctttgagtcttctctccgtataaattcatcataaaagctcaagacctagatcggcttttcccccttgttcagcaaaggcgtttcggg

SEQ ID NO: 2542 - DNA, 239 bp, Zea mays
ggtagacattactgatactaaaccaaagtttcagttgatatattttctacactgcacttaccaattataatgcgcttattacaaaatgaactgtgttaatgctagacatgctattagcatcactgacctgtgccttctttgtgttgttgcagtgcggagcattgttcacacaaactgactttattcctgcaggactttattcttgattgttcctgatcgaaacccgaactttttggcaa

SEQ ID NO: 2543 - DNA, 1228 bp, Zea mays
gaacctagataccctctttgcatgttttgctgcacttgctagactgtatgtttggacagtgacgatggtttaacccgttgttactccgtttggcattgttatttctctcccttttttggagagagaaatggctcacagatctgaattcaaaatgactcaagttttgatttcatcagcgcgaggagatgcatttttatcttttcaaatagagggagcattttctttttttaggtacagaaaatcagagggagggggctagacaaaagactgctacaatagatcgatgacacagagtataatacaatcataatatagagaggttcgaattgggtagtagcctatgttgttctttgtatggtagatgtttagatgcaaacatggacaaaacttacatatgtggaggcgcaggagagcatgcttctgtctccaacttagccgagctctttggcccatgttctccagtgaagcacgattcgtcatcgtcgatctttccttctctcacggcggcctgcacgactgtcgactccttagtgtgtcaggacactagagcaaacatcgtagtcttctttggcgagatgcccaaaaggagatctggcgttgtactggtcatcgcgggtcatctccagataatcttgtctttagcctcctgttatgactggacacaatatgtacgcggatcagaaaaaaaaggacaaattcttcaatttggcgttgtagtgatattccttctcagggtcttaattcaggtggcgcttgtgtgcgacgaccctcaagagaacaatactttggacctgaaaaggcagatcccaatttcctacagattctggaatctggctggcggctgctaccatagcaggtccttagtccttttgttccatcttgccctgtttttttccctctccagccacaactgccggcgaaatggcacaggcaccatttgctcgcaacaaagccacaggcaccaatcaagaaagcggacaaagatgagaggggagctatcctgtccccgctcctcatctcctcaatcctctcgccgccagaaagtaacacttctgcactctagagcagaggagaaacgcatcctggccaagtacgcctctatccgaagccaaaccacacgcacacgccgcgccagcctcacgctctcacccatgttttgtgcgcgcacgcgtcctgcttcttctcgccaacgacaagccgcacgcagcgtctcgccagctagctgatc

SEQ ID NO: 2544 - DNA, 1500 bp, Zea mays
acattctcaatttatatcttttcccttgaattacccttcggggaagaggtaattaaagggagaaggttacaatcttctaacttgtgttgccttgtttttgataccatgtagtaatcaaggtgactaacagttctcttgcttgcgttcgttttgagttgtctcccaaagttatctgcaattgattgagcaaatcttagcaagaagaactactctttcgcactctgattcactgcagactcattctaacgctaatcctaggtgaagttttgtgttcaagtttataaacttcaggtttgatcgatccatcccctctaggcgactttcagtctttgctaatcctcctctcattcacttaaatataggtccaccactacatatgcttctgtacacatcttgttgcttgcatgagggtcaagttctcctctccttactctcttcttttctctgcaccggtatttatttgactataaattaattgttatacttgctctagaatagaaccccgtccagctagttatcttaggcactatttgcttgagttccagcttttagagtttttttaagtcgttgctagacttttgatcctaagaagccaataataactttctgatgatgttattagctttagaaacttaggaagctacagaagtacacaaaatcatttttcaccttcctgtataaactcaacctttctaggagctaaattgaaaagctaggtgtttgttttagtttttttcttttcacgctatgaagctatcctaggctcaaacaaacatggtgttcagatgtttttaacggaacatgtttcacggaaacattattccaattattttagacgcctttcaaaccaaaaatataaaataattataaaattttaaagagacgctaaggccttgtttggatgcttgatatttttgcactattgaggcaataccatggtatttgatgataccattatattagaagccaaaaggtgtttggttaatacaagtaaaacacattttttaaataccatagtttattccgtggtatttttggagttttaaaaactccactcaggaccttagttttcttctattctttttgtagatactttggttttctaatgaaaccgaacacatctcrgttttaaacaaaactatgattttactacggtaaggcactataatatttgtgtcatgcataattataaattttgacattttaaaattatagtattttaaaactgcattattaaacaggccctaatccctggcagccagcgtttcaggttttcaggacaccagcttcctagtttctattggctacggcatcttgaatcactgtccagtcgtgtcgatgacccctccgctgcgccaaccaacccaccctggtccacgggcgtcacggcactgctacagtgctacaaaccaactacctaccaccactccggcagtccggctagctccataaaggcgcagccggccggctggccggtagcagtcagccagccagccagcc

SEQ ID NO: 2545 - DNA, 70 bp, Zea mays
agtagcttacggggagagcagagctcccagtccgtcaccagctcaagaagactactagctagtgtcagtc

SEQ ID NO: 2546 - DNA, 1500 bp, Zea mays
ggaccacaccagaaacgcaatcgctgcgagtggtccaactaacgagaacggagctcgatctgaaccacctattggaattggaaccgacagggttggtgtgcgtccaaaagacagcgagggagacgatcccaagtgcgtgtccattacaccgcattcgatacctcttcttcggggatgcctgttgcagatgtccattacacgtacggtgcctgagtgctgtagtaccactcgcccgccggccactcgaaaggatgccttgccttgcctctaaggttcgctgccagctgcgctcaaggcttcagagacgaccatgcatgctgcctcgatctgcgtcagacgattcctccaactgatcaagcctgcaggccatgggagctgctatctatctatcgtcttttgcattatactttcaccgacgaataataagcttttggccatgggagctgcaatttatctagctaggctctatcctattcaaacaaaccctgtatatatacgcgtatatatcctttagagagagagagagagagagagagagagagagagagagagagagagagaggctcaaacaaagagtcttattcatgcacttcgggtggtcaactttgtatgtaggtactaggtagatagggctactactacgtactctatccattctagatgataattaagtcgttttttttcttaatacacatggttttgcacttttgctatatatccacgtagaatatgttatgtcgtcgtcgtctttctctctctctctctctatatatgctatccatgaagaatatatgtccataatatagatatctaaatatatgctatgcctagaatatgctgtccacgcgtagaatacgcagcacgcagacgcagtggaccatgcatgcacaaaagacctacgctttgtctagtgacgccgcgagcagatgagccagccaagccaaaggaacctcaagcgcatgcattcgcacgccatccgggggcggcgcggcgcctctgctctgcctctgcgtggccgaaactgtagtggaatcgatcgccaggtgcacccggccgggcgatctggacgcagtgggggcagatggataagggaggcagcaggcactcctgcagcatcctgctgccctcttccctgtgggccggccagtgcagacgtgcagcggccctatagcgactaactgtgcctggggattagtgtgtgatagtagtaggatggcgcgacgagtttccacacaaagcaacgccgcgccacggcctttaaatgcctcgccatcttcgccgctccatccaagcacccacgccacactcctcacctctcctcgctccacgcacgcgctctctcacccgctggctattagtcgtcgtcccttggatttcgatcgacactctctctagcgggcgcctgttccgccgccgtccatcgatcctagctagctagctagctagggcgcgaccgtcgtctcggtggttgttgacaggtcccgtacgtgtgtgctcgcc

SEQ ID NO: 2547 - DNA, 1500 bp, Zea mays
cggataggaggtgagtcaccggagttcgctaacgtggcatttactaggtaaaagcttacggtcgtcactggttatactccacaacctgtgacgacgtggtgaaacagtttaaggcgtgtcgtcgccgaagtaaacggcggcacaacggtggtggtcacgcggccacgtcgtgggtgcaagtgggtatgacgactgagtggtaacagggcccaagctcatccctcgtgcaagatcttttaccaccagtcgttatccacgcaccacagcgcacaaatcgcgacgaccggcgtgaatcacggcgcgagttcaccggcggcgaggtgtgctgcatctgaagatcttttttactactataccatcgcgaccgttcattagtgcgcctgacagagcaagttagagggttttgttctccaatttttatgtaacaacccactaatccgtctgtagcaaagttgttcttctataaaccggcttcaactttgttacaaagttcttggtcgagtactcactaaatcatgcgtaattcgggcccaaagttggtcaggcactaatgtcagtcaagttttcagtatctgacccgactgacagccaaattttcagtacagttttctccaatttctacatagattagggcttaaccacttaatcaaacttgtacccctatagtacctctataaacttgttctagtgacctagggaaaaatctccattgattaagaaatacaaggtcccaaagtcagcccaatcacactgatttcagagttagccatatgggtgcccttggaaacttttacaaattactccaatttgtttcacaacacttgaaaatcttccaatgtaaaagttgcttagttttttatactctaccactttgatacatgcactttggtccaaaagtgtatagaaattgatcgcatatcatagatcacaaattagggtttctagggctcttattagggttttgagtgttctagggtttgtgtgccactcaaatccaccaagtttagcctcatatgaacattccactaacttttgagataatacttaatttagtatcacacacacctacacacctctatcccttggttaagtaccctgttttagggttaagaagcacttcaagtcatcacataataacttgttttgagattttagcctagtggatgcactttacgtgtaacatacataatgttatgtctaagttttagttattgtaacaccaataatattacagtgtgcacttatccctaaaatcttgttcggttgcacttatcctcgagtttatctatgtcgagaccgaaccgaacgtggaggtgttttcggggtttcgttttgtggaatttcaaccgcttggcgggaggcaagagtcgaggggtaaagcatataaaagcgggtaaagtggaacgtatccgcccctgacgtctccatctacacccggattcgccttttttttctgaacgtcttcacggctctccttccttcgccgccgcccgcccggcc

SEQ ID NO: 2548 - DNA, 97 bp, Zea mays
ggttaataactcaaaccttttaccttcaagtcagaactttattttttgaaagtgacagagggaatttcattttgctccttctgcagtgattggctac

SEQ ID NO: 2549 - DNA, 605 bp, Zea mays
gaaatatctatttatggctactattttctagtactaaaaaagaacaaaggtatcatcatcgtggtcgtgacggtatatgagactgagtatcgtgactagctcttctagtttatcttctattttaaatttcacgttgtaaacaatattatctatagcacataacaatgttttatatagacgtatacatgatctagtggacgcaatctaacacgaccttgttagtttacacatgaatcagagtggttgagaggattgaaagaattaaatatctttcttttcaattttgagtaataaaaaatttaatcttcttcaaaaaaaaatttaatccactcctaaccaccgaagcgtcatcataatttgaaattgcagccaaattctttcgttccaaaggtcatttccctctttctccgcaaaggaccaacggctccgatatcacttctggatagaagtttgggggcccgcgtgcagcgtcacagcctcccacccacaaagagataggaggatagcgtctatccccaatcctcccgccgcggcgacgccttcccctccctccttcctccgtcccatgctccgccgctgacacgttggcccgacttaaccttacg

SEQ ID NO: 2550 - DNA, 1173 bp, Zea mays
caccgaatcgtttttgcgcctagtactagtcaatttggggatgaagaaggtgacatgaatgccttccgtgataatattgctaatgcaatatttgccaatgtcaattgaattattttatatatatatatatatatatatatatatatatatgagtttcaacctagtacaaatatagagggcattcttgtcttcctcatacaaaagaatcctattaacaactcaaataatctgggtaaacaaacaggactactcagattatataatccaaattatataatcctccaaaaataatccagattatataatccatggaggtaaacaaacaggccctaaatttatctagctataatagttaatttaaaacttaaaggacgtatgttaccctatttatttgtagtttaaggttaaaaaatcaaactatcatataaggtggatgttggttgattggttgaataatgtactttacttttgaataaatatttttttattcctacgtaaaaatggtattacatcgatagattttgtgaatactttgtctatacctttgcgattatttttattgcaactgcatgtggacatgctgacttgctgccttgctggaatggcatggcacatgacatgagtctctagtcacctgacaccaagacataacaagtagataccgacacggtgaccacgagacgacagcaacaaaatccactgtagacacgcttttcttaatcccgaaagctgtaaaccaccattgaccaccacttaatcaagcagcacacgcagccctggggctgcggcggtgctgacggctggctgcctgagctggggctgaccagtgactgcactggccggtgattttgcacgaaccaccctgttttacgctaaaatctcgatacgatcctgcaccttctcactctctgatcagctgattaaaatcctcgtccccttttgccgtccctctgttcacggccctcgccaaatccccaaaatccaagcgcgtcgccgacggcattgcgtcgccattgcctccaaatccgtgtgcgactcgcgtgatcccagatcccgctcgccgtatcccccgcagtgacctctgaccagagcattttccgcgcggaaaatgccgccgtttcggccggctcttggaagggcgcttcttctgtaggaccgcggcgcgaggctgcg

SEQ ID NO: 2551 - DNA, 544 bp, Zea mays
tgtaagtgtttataagcaccatgtcatagtcatcagtagcagttatgaactcagtgactgatatttgttgaagtgttaggctgactccagcagttcacccaaagcttacccataagcactgttttgcactgtagactgcactgttcgcagagtggagtttgaatatgggcatgagtatgggtaagttgttggagatagtcttagagtggacgcgctagcgagttcgacccaaaaggttaagctgatgggagaaagtagtttatgcaccttttgggttgaactggttagtgcatccactctaacttggtatcaaagccagaggtctcaagttcgaatcctggcagaggctttatttgtgccttcacccattttattccatgtttgcgcctttctctttggctgcgtttgctcctttctctctggctgcacgtgagtgaagatgttgaagtgtataagtggataaactatcttcttccgtcagcttaagcttttgggtcgaactggctagtacctccactctaacaatattgaggttttgtctcaa

SEQ ID NO: 2552 - DNA, 789 bp, Zea mays
ggtaaatatatgaatgacagtggaacaatattgccagacatttttttctctattttttctgaccagacgagttttcaggtagtactgtgcctgagaaagctagcaagggtacatcaattacatctgtgccagctagcaaaagaggtggcaaaattgtggcgccagcacatcctgctgtaaccctacactccccaacttctaacataccttttggtagttctacatttaacctgcagcgaggcactcatctggattttagccaggcagtgtcaccatttgcatataattcacacatgagacatctgtctcccggtgttgccccctggtatactcagagccctggtccacgttctgcaccctggttgatttcaccacaaaacttaatatttgattcatcgatgcaaccagctattcctacaaatgaaactgcaaatggggcgtcatccaaaaatatatccatttcacatactgtttcatctggtgtagttcttcccagtccagcaccttctattgtttcttctccaacagcagttgtgaatgatggaaaacagaaggctgtttctagctctaagtgtggcaccacatcacaaaagccaagaaaaagaaagaaagcttcagtaagtccagaacagcaacctgtcattgcttctcctcagctcaaaatggacatgccgtcttttactcctgccattaagcacacagcaggattttgccttatcccggtagcaagcttgttcctaagacggggtgagattgcctctgaacctaactaccaggtcactgggtggt

SEQ ID NO: 2553 - DNA, 1113 bp, Zea mays
ggaacatttttttcacgggacatacgtgcagtacgtagcggaggtacaggtggtccctgtgggccatggatcaccctaaggcttattccatcatacaaagcccataaaattgcagaaattttggcgtccatctgctctcggcccatagaaagtccttcctagcgcgctcgcccgcccgggttgtagatggtaatggtatggtaagtgagagcaatgaatgtgctagagagcatctggactgtctagggctcgagatggaatccaaatacagagacgcgatagatgaatcacacatatatagatgagattgagaacgcatcggtcggtcaccatttggtctgcgaattcatactagtctaaatggtagctgcactgccacccatgtactagtactagtttggagaaagttgcattgcaattgcaagctgaagcagcagttaaagttacgccgcggacgtactggtaaacaaagcagtgaaatttctcactctctttctctcactcgatcacggccggcacaggaatgcaggatgggccggtacgtttcctaaaactaaccaggcatcggcggtgagccccgtcccacaagtcttgtcccaatgaaacgccgcggcgcgagactaattaccggagtgccctccggcgcgaaccggcctcctcctcctcccgtcctccgtccagctcccttagccatgcatgaagccctcggcggtccagccactcacatttgaggcaacctagagcgtgtgcagtaacatgcctgctcacacgcctaggctcatagctagctaagcttagggttccaactgcatgcacaggtttgggccgacttttcctgcccgtgcttttaccctgcctgcccagccctggccctgggtgcgtttgcattgcagccactgcatggatgcatttggcatgccgcggtactgctgctcgctcgccccttccggtccggccctcgtcgtcttctttataaccacgcgccactgaaagctcgagcgcttctggcacttgaatccgtttgcgtcgtcgtcgttcctgtgtgcagtgcgcggtgcgccactgctagtgagaagagatatagctaggcttcagtgcgacgacgacgacgag

SEQ ID NO: 2554 - DNA, 1500 bp, Zea mays
attttgacttttgaccaaatatggctagatcacaaaattcacttttggctctaaactagggtttttcaaattgagtctttcattccctactaaacataacatcacacttaatttgatctttatcctagtgaatgcattctaagtgtatcacgacaagatgatgctagtgcacataatgacatatcaaaattttagttgtcataacactagggatgttacaataccgggagctgccaccatggtgggccccggtctgtggcggcagaggtcccccgtcggggggcaaggtctgcctcggtggtgaacggggcagctgcgacagagcacttgccgcatgtttggtagactgggtgaatagagaaactgcacctgcggagttataaagcagtgtttgtttggttagcttctctatgcatcccagctctactcatgcaaagaagcgaccgcagccaggcttccgagcgaagctcgcggcgagcgtacgcgcccagccaggctcagtgcatgcagtggcacgtataccgaggtatgtttttagttagtttttttgttatatcttctaattaaaagatttaatcaccgaacaaatttcatatttgtgtccctaacattttttcgatcaaaactagaccatatatgctatataatatttaaagatttatttgtgcattcttcactagtacatgttttgatacatacaaccaaacactgtctcaatacagccagattcaattgagccaagtaaccaaacactaaacctttgcatacactcaaccagactatatatagcctggctgactgatgcgagccaggcggaccagtgaaacgaaccaatcacgtggatagtgtctcggaaacaaatatgaatacggataactcatatgaatgtcagctagtctgggcttctggcgctaacgacaagacagtacacacaaaggagccatggcacgcgtacgcacgaacgaaaggatgcactggactcaccgggagctctccgtcgcacaaggatgcaccatccatctcctcgtccgcggtccggcctccgattcccttcacacctgggcccacggaaaaggttaaacgcagggccgcgggccgaggggaagcgccgttccatggccaatcttgcgtgacaccttccgtgtctttttgcttcccaaaagtttcgtcgccgtgatccgatagggatccacatcagataggttctacacgcacgcatgcatccgcggccgaccagcacatcaccatcacgctatcgaaagcctcgtgctccgtcgtccccgtctggtgacataccgcagaaacaaaaaaaaaagcaaaatcggaggaaccatagagacagatcaagtcacacaacagggcctgccgaaaactgaaacgaggtaaagggtcaaaaaaggcatatgtgcatgaatacaacatgtagtgcgaacatataggccatgtgcttactccactctctcgtcacggcctcacactgcagaggcttggacggacggg

SEQ ID NO: 2555 - DNA, 1139 bp, Zea mays
acttgttatacaaagtaatttgtttcacatggcaataacatgttggaactggtttggaagagatggaagctgctggtgggataatgtagcctggcaatgttgggtaatttgcctgtgtaaaaaagaccgatggatcggaaagactagcaatgcaggcggcggcagtctttgatgtcatgtgatcatgccacccgctgcgctggcagcatcttgacgccactccctgcctacagtaacagcagcctgtgcactatgctgcctactactagcacgattcattgcggctgtgctgctgctttccctggtacgtgaaagttaaagcccgcatttagatggctggtcctgtccgcgtacggattctgaaactaattaacagctatgagaatcgtgttcccttttactgcttccttcatgtgaaggattagttgagttggttcttcttttgccatgtcaatctatctgttcaagaagtcccgtgacaggttccggtgcgtcgccgatgcaaggcaattccgtgcccgagacgagtttgtttgtgtgtgtgtgtagtacatgaacatggaggagtttccggtgcgtcaccgacgcaatacagttgccctctctctttcctgctgtcaagccaagccagtgtgtcctgtccacccatggcagcacatggagtttccactgccgcctgcgacagtcggcacggcgaggcgccatagccagagaatccgtgaacacgagggcgagttcgatttggcgtccagtggaacgtcgtgtggccggccggcgcttgcatcaacaacactggagcagtgaccacactccaggacggagaccggacagacagctgggccccctccagtcccgtcctcggcaggtcatgaaacagtgtgccatgccactgcgaacccgcctgtccataccagaccagcagcagcgctggcgcggccgggcacgccacgccgcgcttcctctcaacttctcttgtgtgacgtcgacctcgtccggatgctataataactgcccctcaccaaacatcccagccagctctcactcactcactcacaagtcacacagccacacttgaaccgctgcccgcagcggagggagcttgcacgggccaacgcacacataacacaagctcgtcgtcg

SEQ ID NO: 2556 - DNA, 1409 bp, Zea mays
ttcaagaaagaaaattatgtgacagagttcattcttagagttttgagccaattgccctaaaaaatggcttcaacctcgaggcttgtgggagatacatatcccatgggtcaataaggtgcagatgcactccatggactgccaaagagacccccaataagtcrtctagtagggcacatagtgggcctcaaaggcatgataagacatgtcctgtgtgcggcaagcgtaccaaccatgcgaatgtcacgcgaaggaatcgcctgaaatcataagacatgtcctatgtgcagcaaaacgccagattattcagaagacgcatcttgtaatcttgaatttagatcaatgcaatactcagcacaggacgaaggtaagcattcacgtggcccgaacctgtataaactccctgtattccgatgtgccaccgcacgtaccattgagcagtgatcgacgtcgccgtcctaccaaaagcattacgtgggcccgtagtgcgcatttgggagcaaacaccgacagcgatgaagttactaacctttagagcctagaatgaatggagaaatagactcttcacaaatagttcgagagcaagagcaaagcaagagaatagggagcttcaaaaattgttctgaatgactcgagttagggggtgatggaaggtgtatatatatgcagacatttaattagtactagttaatagcttggttcaaaactaaaggtcactctaataccgattgaaaccaccaactaggattaagggacacatagcatttattttcgattggtggccatatgtaactaggattgaagagtgacctttagtattgtttggagccatcaaccatgactagatgctcctgtgttgaatctaagaggattagtctcacgtccaactctaactaatcctacctccgttttcgaatatttaatgaccgccagcttatttttaaactaaaacatgacaaatagaaaaacagagaaagtatcaaattgctaaatttaaaaactgcttatcgattctctaatacagaaaatacatgagtgatgagcataactagtgagagtgcatgggagaacttatgaagcaacacaatgacaaggacagatggaacgaatcatgatcttcctactcatgaagcaaatcgagcaaagtaaaaacaaaaaggaaatgtccattcattcgggctgcaagatcggcatctttccacctcgtctgtcaagcatcaagttcaacttttcgtaccagaccaaagcgtgcttgcctggcaagccgcgccgctttattccatcacacccgaccaagcaaaggccactaaagcctagcagtgtctcctcctagccgtctgtagatttatataaacgctctgctttgacacgatacaacccctcaaagccagcgtagataaacgtcgaccatt

SEQ ID NO: 2557 - DNA, 707 bp, Zea mays
gccgcaatatccaattgggctaatattttacaaatattccaagatctaaatcactgtttaccacgcgcgcataggcgcgcgcgatacactagtatgcatatattgacagctccacaagtattccacgactatgcagctcccatcgcaccaggagaactggagaatatcatacattttttatttttcatctaataaactcaactaaattttttgtttggttgtttttttaaacacgtgcctgtggcacgtgcctctcaagtctcaactagtatgtagaaattggctagtcgatcggatactccctttccctgcgaagtgttctacgactggtggactctcttggctgtggctgctgatccgccaatgtcaaaggcacgtgcagcagcagttgcccttgcccctgggtctggttgatcgcgatgcacatgaccggagcctgactttggtgcggcgtgagcacgatgatgcgttgcgcggttcggattcgtgagagctgtagtcaaaaggctggaacggatggaattatccgagcagattgggtgggacggcggagggagccctttgcgccgtcacaaatcgcaaccaatcgccgagttgcttgtgttaaatagctcttcgcgtacgacacggcaagcgggctgcgacggcgactttctcatctgctcactgctctgcttctccactccgctccgctggcagcgcaggcc

SEQ ID NO: 2558 - DNA, 149 bp, Zea mays
ggtttgttttgtgtgtgtgtttaaaaaaagatacagcagacattatctgatattctcttgtttgtcactcactgtcactaataaataacctgtacattcaaaggttctagaaatggaagctttttttgctgaactacttgaagtttgaa

SEQ ID NO: 2559 - DNA, 719 bp, Zea mays
ttttagtaccataactttgatgataataatatatattatagtagtacaaataatctatgattttttaaaatttcgaaaacttatgaaaaaatgtcaaataactgaattatagtataaggggaagctcgatagggtaaatgtttggagtcgtcgatatggggggagaattttttgcgtgatatagtaaaatataatagaaattatggataggagaaaaatctggtgagaatggttggaaatagttcttatgggcataaaaaactatgcatacttgttcaataaaaaaatgacgtaaaggaacgttccgggcgtatgcagatcacatgcgcctcaccccaccttcactcattttcagcgtaagcaaagtgcagaaaaaggaacacagaatattattccacacgcggcccaacctccggtttctgaacctgggtgtagtgtaaagtttcagtgttccactctgccggaaaccagcaaccagagccccctgttttcctctcccgccgcgtccgtccactccttccacgctgccgccaactgcatcggctaccggcctgctgccgggcatatataagtcccctccccttccctcgtcatctccgcagtgcaaagcgtcaacgcaaacagaccaagatccagaagcaagaaagtgtttatagcctagccggtgcgcgcgcgagagggatagccgattatcatcaagctctgagctagcagagaag

SEQ ID NO: 2560 - DNA, 239 bp, Zea mays
gcagctagctaccacaggtacgcctgtctccggtccagtgcaatcttgtcttctttttggatttgtgatcgacgatgatgtagtatgtagcaaagtgtttgcttggcatgtgggctcaaggcgtaagtaaggatcagtctagaggtttggttgccaagttcagtgcactacgctgacactccctcctctccctgcgtgcactgctgctagtaccagcagcaataagctaatcagctacg

SEQ ID NO: 2561 - DNA, 1500 bp, Zea mays
tttgttcttcatccggatcagttaacctctctgttcttgaatttttctcttaattttttttcttcttctcatgtttcttaccctcttgatatctttaagatacagattgtttatataagttgtatatgcccttaagtgtctacctaccttgagcttcatctatatataggcatatagcgatcgtgacctgtggccatatctatgggggagggtttgcattttcgatcaggacacgtagcttaaccctaacatgaccacgcgctgtaccagctgctcttgtcccccgcgctgagagtaaagcgtgagtagtctgcaggctgctctctggggaaaagttactttaatcacggtcaaggtaaaaaaaaaagtcacgcgtgggttctacttcattggttcctgaatcctgaggttgaaagcacaggctgactgacggccacaagtcagtccctctagtggatcagtcttgacaaacaaaggattagttgagccattattatattcatattggataccagttaacacgattattcggttggtggtgtaccgtaatcattgtgaccagcctagcgacagcttcaacgtatattctttccctttctttctccaagaagaagaaaatgggtgggaggatcattcagcgacaagtccattggagtcactggtacatgtgtagccagttcaacactctcttctaagaccattttcacggtatccataatcatattcaaactacactctacgaacaatacaatctacagtgcaaaaaatgtttttgtgacaatatatatgaactactgtacattacacctatataatcactaaaaacattgttttgcgtcgtttttatattgtagagtgtactgtttatagtgtgtaatttgaatatgattgtaggtaaactgttggcgatggtgtaaagcactcgggaagtgagaacatttggaaaatactacgcagagaggcaagacccaaaagaaaaatacccgcgcgtcggccaagcagtccacacgatcacggttttactccgctgtagcgggaaaataaacgaatgtttttcacttgcaacaatgctggccgaaccgcagcagtactgaatgattattaaaaaaaggcaaagaaaaaaagaaataaaacttagccactaaattcccgaattgatcttacaacagggggggaatgaatggatgactagacttgacagtcgtctaaaaaatcctaggactttctcagccatctcacttcaccgcctccggccggccgcactcctcttgctcgtcgtcgaggtgtctgtccccgccgcgtccagctccactccactcgggtgggattggaacgaagggagcgagcgcgaaaaagtggttaaaagaagaaaaaagagacgagacgacgaaatggccgtcgccgtacaggagcgggagcgagtctccggcgaaacggccgtcgcgcccgcgcccgcaatgggcagggcggcgcgctcaccagacggccttgtcggcggag

SEQ ID NO: 2562 - DNA, 129 bp, Zea mays
ttttagctcatatgtgtcaaactaacactggtgcatttctcggtgcagaccttgtaatggagcttggttatcttttccaaaataatagagttgatccccgaaaagaagagtacccgtcctttgctatca

SEQ ID NO: 2563 - DNA, 145 bp, Zea mays
aatgttctagtgggtagtgtgtggtcgtgtttctattgtgcctcctgatggatcagtttctgtttttgtgtttttggccgccttaagtggcctaggatgcttgtatctgtccgcctggacttctttttcccctctacttgatata

SEQ ID NO: 2564 - DNA, 610 bp, Zea mays
tccccagccctccaggagagagcagagcacacgccagaggcccagggaagggtgcgtgggcgcgccggtatgacagggcgtgagtgacagtcggtagcacagttggcttgggccgctgccatcgaggccgagggcgggaggagacagccacgcgcggaccgtagtcgccatggaggaaaaaagctaagagcaccggtgagaaaaaagcatgagaaataaataaaataaaatatagggtattgtaattatgttttcctaacatatggagctattttagccgataaaatttcgaaaacaattcagctttaataaaaaaaagctattagtgaagcttaaagaaaagctttactggctatgccaaacaggcgggccacaatgtcattttcagctcgccccgaaaggtaatgcgcatgtcgtagttgtttttggttcgttcgacgctagctcgtacggcacgcagcatctctatgattattctacagctgttaagctagaaccttggcatgattattctataaatacaccatgcatgcatgccctacacagtcacattcaaaaccacagccagtgtatatacattactagcaagaagcctaacgtagtaaacgcc

SEQ ID NO: 2565 - DNA, 447 bp, Zea mays
cgttatacaaacacgattgcccgtcaattaaaaattaatccggttttataattaatatacttattaacgactacaatataataatggtagatactgaaaatttagattttaaatatgttaatttttagaaacgatatcaactttataaaaaacgatacatttacgaggcctgcatctgcattcagccctactcacgaggcatcctgagtgagccctagtcgcagccgcacgtggtcggcgtgggcgaacaagtccatgctaaacgcatgttttttttataatctatttacgtcataggcgtgcgcgtgcctctcgtcaaaatatatagatttcttatacctaaaaacaaaataatcttccagtcttcagtagttatatataggaaaggttataacctgcaccgtcagactagctttgcgctacatcgagttgcggatgtgaggtagc

SEQ ID NO: 2566 - DNA, 1043 bp, Zea mays
ccggactgtccgggtggtgcaccagactatccggtgagtcgtccgcggcgaactcgtcgctctcgggaaaagcatcagggcgacgtggctataattcaccggactgtccggtgagtcaacagtcgctagcgccaacggatggccgcgcaatctgcaggcgacgtgtggctgctccaacggtcagctaggtgcaccggactgtccggtgtgcaccggacagtgtccaatgtgccatctggcccgaaggagcaacggtcggctctgcccgatttggaaggaaattgtgcaccggacaagctacaatggttgtccggtggcgcacaagactgtccggtgcgccactcgacaaggcaaggatagccttccttgttggcctccaacggctcctagctgccttggggctataaaagggacccctaggcgtatggaggagtcgtctaagcattcactaagtattctaaagcatccaggctctactcccacgcattcgcttcgttgtgttagtgatttgagctcgatttgagttgtgaacttcgtgtgttgtgtttcaagctcaagtcgtgacttgtgtgcgtggttgtgctgcggatttgagtcttgtgtgtgttgctcttcccaaccttactctgtgccttctttgtgatctctattgtaaggacgagagactccaagttgtggagattccttgcaaacgggaaaatacactaaaagaaaagaccatggtattcaagttgatcatcggatcacttgaaagaggttgagtgcaaccctcgtccattgggacgccacaacgtggaagtaggcaagtgttacttggccgaaccacgagattaaatcacgtgtctcttgtgattgctttctctgtgattgttttgtccacaagaactcgcttcaaaactacttagtcgcactaacacatctataactaagttttgtggctatttagtgtttaattttacaggatcacctattcaccccctctaggtgctctcaattggtatcagagccgtactcttcatctaagggattaaccgcccaaagag

SEQ ID NO: 2567 - DNA, 189 bp, Zea mays
ttcatcataaatagtgagtactaatataaagaatggagtcatcccaccaaatataagaaataaacctataatatacaccttaatttagatggtatgattccttaaaccaacactccatacgttacacagctcatgtgacacgaggccaagaaaaccagtcaaacttccgcgcactgccgtctgtccact

SEQ ID NO: 2568 - DNA, 1500 bp, Zea mays
tcaagctttctcgactaagtcggggacagggcctcatggacgggcgaaagtacgcgtaagcggcaaggccgaccgagccgagggactcccacgcctctgggatacggatacctcactcatcaccttccgcgagaagcaactctcgcccacacaaacatccctgttaccgacggaaagtccagatgctcgaaataagaggaaaggagacgcggctttacaagcgcagcgagggtgtgttttctggcctcggcggccgcagaaggcacacgctacaagacaatctgatcctgcaggctcgggtcttcacgctgaagggggctgtagcaccctcggcatcgacgacgtcttcagcaaggtccgacccagcctcggacggcgacgcggtccagggacttctccgggaatccggcccgagcaggcggctcggccggttacccctggggcctcggccaagcatcttccaagggcgccagcccgacccgaggcctcggctgatcgactccggcgtcggctccgctgacgggcaacccggctaggctccggccaaccaggttcccattttcgagccaactccgcctctgttcgtactgatatcgctacccctggcctcggctcatcgaagagcggccgaggggtccctttaactaagctagaggagcctcagacaacaaggccgatcgagccgagggattcctacgcctccgggatacggatacctcactcgtcaccttgacacggggcgactcatgcttggtgaagcggttcagataatcaacaggcgagacttagtgctcgaaaatgaggaaaaaacacggctccgtgccgaaattacatacatgttcaggcctcgacagccacaatgaacaaaaacactggcattcgaagtgccattacaaacggaactccggttccccctccgcaggtacgaacaaccccactccgagggggaaggcctgcggagcaacggaaggccgacgaacggcgcgccgtcacctgctccagcagcggcgacgacgacgacttctgctccggggggtcgaacagcggcagcactgacctcagggcggatgctgctgccaggaggcccccgcccatgccaaaacttgtgaggcaaggacgggcagaaggccgtagagttgaaggtcggtccgtggccggccttggctatctcgccggcagaagaacctcttccagctgccgtggcagacgtcggcgccgcgagcggctccgaagccactcgcgtccgagagccaggcacggtgcagctgccagcgccacggacgacgaccgcccttccctccgatcactgagtgaaggagcgggccgccgcccacgcgggggccgacctcaactcggcacactcccctccccagccctggtgatgaaaatccttgaggctgagggaggggcagaggccgcagcccggctcgctttcccccaccatcaagctggaggtcaccatcttgggtgaccgccggtggaggggtgcagccgggctgc

SEQ ID NO: 2569 - DNA, 1183 bp, Zea mays
ctcggtacttctgcacaccattttcgctgaatcgctgctggttggaagccggatgccggatactccagacgaccatgggagacatcgcgacagtgagctgtgagcgagcgactccttcctggcggcttgcgtggatagactggagagtggagactagggtttgctactttctaattctagttgggctgggccgtttgtaattatgtaagcccacatagacgcatgtggtgatgtttgtacagttcgggtatttgggtattttgggtaccgggtgttgctacccagttaagcccgaaataatatcgggttttaaggtttaccgcccgcataaatgtttcgggtatcgggtattgggctatacgggttcgggctcgggtttttcgggctcgggtttttcaggctcaggttttatgcccgctgtgaggatacaccatatgggctacggctagagtctctacgtaggaaatgcggtaatgcagtttcattatgtaagttttgaaacccgagtcatcagtgtaataatattgtcggcgtttcgagaccggggggtccctcgggccgacgagtgagtgtcgccgcgtgccccagcccagatgggtcgagcgcgagggcgagcgcgaaggggggagaagcgaggcggccggatgccagcgtgagagaggtgggaatccccgcgcctttcgtgttcgtcccgcgcccagtcggggtgcgctgccagtagggggtaccaagcgcccacgcgggagagggagcgagcggcttccaagcgagcgcctgtaaagtcctcgaaaacacgcggccaaccctctctaagagggccctggtccttccttttataggcgtaaggagaggatccaggtgtacaatgggggtgtagcagagtactacgtgtctagcggaggagagctagcgccctaagtacacgccatcgtggcggccggagagattttggtgcctagtttgtgtgatgtcgtggccgtcggaggagcgctggagcctggcggagggacagctgtcggggctgtcgagtccttgctgacgtcctcttgcttccgtaagggggccgtgagcctccatcgtcagggagcgtgcggggcgccatcattgcctatctggcggagcgagccagatgggacgccggtcttgttccccgtagcctgagtcagcttggagtagggtaatg

SEQ ID NO: 2570 - DNA, 1500 bp, Zea mays
gtttagtgtaaacgtgtcacctatttagttttctcacctgtcgtgcgcgttgttccatgtatcgtcagcgtgctatgtcgcgcgtgtccacgcgtcgtttgcacgctgtcgtgttgagttcgccgtcgtcacgttgtctgcgcgtgccgcgcgtggtgcgtgcgctaggtcgcgcacagtcgggttgtttcacgcatggcgtatttcgtctcgctccgctaattcgttcccgcttagaatcgttggcgttatttaaattacttatttaactaagaattgttagtgtggtcagctaattaaaactgtgcgatagctctagtttcattttaaataaatatcgattaatataatcaggtcaaactaaatgtcatggttaatactcgtttagtgtaaacgcgataacttctcgaccgtcgcgtttcttttttctcgcgtgaccatagtaatgcgctctattttgttttgcatattttattatgtttgtatttgtatggtgtaatgttcttatgcatatatgtgtttacttgcttgtgtctgttcgtcttcgcttcgcgttgtgattagagtacgatccatctccaagcctcaaggaatcgaagatcaagcattggcgatcaagtgatatagctcttcgagttctacaaggttgaagaccctgagtatctgtttggtgaaggcaagtgtcctctgacccattatgtcatatctacttataattcactgtcccgcattacttgattaaaacctaaggattgattagttttctatttaccttgtccttgattaccttttgggttattatggttagcttcatgctattgctttaacttaatcaatgaacattgtcggcgtttctagaccgggggtccctaagccgacgagtgagatgtcgccgcgtgccccagcccagatgggtcggcacgaggccgagcgcgaagggggggaagtgaggcgaccggagacgggcgtgagagaggtggaaatcccacggccttcgtgttcgtcccacgcccaggtcgggtgcgcttgcagtagggggttacaagcgtccacgcgggagagggagcgagcggcctcgcacgagcgcctgtcccgtcctcgtccccgcgcggctaaccttctgtaagagggcactggtccttccttttataggcgtaaggagaggatccaggtgtacaatgggggggggtgtagcagagtgctacgtgtctagcggaggagagctagcgccctaagtacatgccgtcgtggcagccggagaggttttggcacccggttcgtgtggtgtcgtggccgtcggaggagcgctggagcccggcggaaggacaactatcagggttgtcgagtccttgctgatgtcctcttgattccgtaagggggctgagagtcgccgtcgtcacagagcgtgcggggcgccatcattgcctatctggcggagcgagccagatgggatgccggtcctgttccccgtagcctgagtcagcttggggtagggtaatg

SEQ ID NO: 2571 - DNA, 362 bp, Zea mays
cctgagaggatcagacggaattaagggggaaattaattcatccccactcaatctactccaatcctcccgtgactccctttgtcaccaaatcagtccttaaagtgttttatattggtaaacagagaagagaggagatactgggacctgtctttagggcgtgtttggcatgattctgctccatctcagagcaattatattctaaaactctaggtggatcgactctactcaaaagtttagattgttttatcataatcagtggtagtggtatataaataactccaaactatatgtctatgtagattgtttttttaagtttttgaggagcaaaagaggtactgcgcctccgaaaacttgaccacgag

SEQ ID NO: 2572 - DNA, 325 bp, Zea mays
gcatgcctgcagcatgctttctactcattcagtgtatatatatatactagtatatccttggagcatgcactcgctgttggctgttgccctggccggccggcgtttataaaaaaaaaaaggatgcaggcagcaggcttgttgaatcgaatgatgtgagcacttgccggtgtttatatactagcgcatgcatgtatatatgcatgccactcgcgagctatatcatttaggggctgagcaggcgtggtcgtccgtcccctcgtcgctgaatctgatgcacatatatactaccactaccaaggtgcaggtgcaggcgcagggtgatcat

SEQ ID NO: 2573 - DNA, 736 bp, Zea mays
tgctactttattgctctaatttgtatatgtaataagccctagttagaactcctataactaatgttgttaactaggttgaccagctaataaactaattactagttatggattagctaacaattagcttaatattagctagggtgtttaaaacctccgcaattaattttagtaactaactattagcttcacaggttctaaacagggtcccaatgagttttttgttgtacctttataattggaactacaataaataaaaaatgaagatattattcggtgatccatatagacttgactagcataatatatatgcgttgcaacaacacacaattagtataacagctaagcaacaacgagggtccgataagctaatgtgctgaatcattcttcccaacaaatatctataaacaatagtttaatatcaaagtgaacatccgttcggggcggcaggtttggtcatatagattgcggcagccagataaataaaatgttgttggctattggcatcttgtatgtttggatggttgccaaatattggactgctcaaagtcacgtgaataactcgctagtttattttccctggtcgttttctggacagccacaagcaaattgattttcccgagccgctgccgaaaaattgccgctgcggcgctgccaccatcccacttctccgcgccgcctccagatcgagcgcgttattaggttttctctgtccctcacccgccgccgcagaacgctg

SEQ ID NO: 2574 - DNA, 1500 bp, Zea mays
  unsure (1)..(1500): unsure at all n locations
tgtcattgcccaggaaccacacaaacacacacacgccaacactcttggcgagcggtagaagcacaacagacacactgttttccggccacaaactcgcctgtatcttggctatttaattcactggacttggcaaaaaaagtggaagagtacagggctacttaggctatagccagcagatcgtgcatatggccgtgcaaaacattattttgcattgttaatagcaccgttanatttaaaatagaaagtgaaatagaaaataggatacgagctgctctgctaaagagcctaacacgttgctggttacgtganatgagcagaagctgcagcgctgatgctcaaggagaaggttcacaggataccggttgtgaatgagcagcagcacgtgatcggtaggtaacaaaaaaaagttccatattatattgcttactcttttcccttaattgctctgatcctgcaaataataatgatgcccacatgatagcgtttacctttcatgcatgatggtaacacaggaatcgtgactcgctccgacgtgttccaggctcttgaggccaccagcaaagcatgggagtgagtcagtgaggtacggtaggcttgttctcgccagatgttaccccctttatttgtgtagtgatctcagcagagagtatagttatgctaccaatatggcgagaagaggacagaaaaagctaggtgtttatactggaatcgctgcaatacaagacaaataatggtgtaaatttatggagttactgaaacttatacgggctgattggttcgccggtcgcgctaagccgggcgggtgcgagcctggccagccacgtacgcgtgttttgggcgtaccagctgtcggcgtttcgagaccggggggtccctggggcgacgagtgaaatgtcgctgcgtgccccagcccagatgggtcggcgcgaggccaagcgcgaaggggggagaaaggtggccggagacgggcgtgagagaggtgaaaatcccgcggccttcgtgttcgtcccacgcccaggtcgggtgcgcttgtagtagggggttacaagcatccacgcgggagagggagcgagcggcctcacgcgagcgcctgtctcgtcctcgttcccacgcggccaaccctctgtaagagggccctggtccttccttttataggcgtaaggagaggatccaggtgtacaatggggggtgtagcagagtgctacgtgtctagcggaggagagatagcgccctaagtacacgccatcgtggcggccggagaggttttggcgcccggttcgtgtggtgtcgtggccgtcggaggagcgctggagcctggaggaaggacagctgtcggagctgtcgagtccttgctgacgtcctcttgcttccgtaagggggctgagagccgccgtcgtcacagagtgtgcggggcgccatcattgcctatctggcggagcgagccagatgggacgccggtcttgttccctgtggcctgagtcagcttggggtagggtgatg

SEQ ID NO: 2575 - DNA, 75 bp, Zea mays
ggtgcctaaaacccaagcgtaaattgccttgcaggtttatgcatccgggggctcaagctggattatcgatagcgg

SEQ ID NO: 2576 - DNA, 1500 bp, Zea mays
ccggccaccctctagcgtcttgagccgctgctacattccttcccgatacgtcgtgcgctccgctaggatcggccatggggtttgggtccgtacgtacggctcgggcgcattttttttccctttttccatttcagccaaatttctggaacctgttcgggtttcgttgtgggggcgtgcgcgaggttttagcccgttccggtttgttgatacgtgtgtactcgatgtggggtcgcagcttggaatgcgatgggttgggtggcctggcctcggtgattgtggtttgggtggctcattagtgtttagcgttgttgatcactgggggttagggtttaaagcccaaggttttgcggccttgcgggtgccgattgcggggattgctagttcgttgcgttgtctacctgttaatcgcagtaaatcgccctggttttggtgggtttttggttggttgtttgagcgcattttttattaaaagataagagaaatccatgcagttttggtgggcaactgtgcctgcatgtgatttatttgttttatttatttctctttctgtttcttcgtttcacgactggttttgtgtgttgtgaacttgtggtggatacacgtagaatttatgtatttttcctgcagactgtacgagatttttattggtacaagagctgaccaaaaattgcctacacgtgagatgtgtcccttaggatgtggttaaaattgttctgtgggcatggtaacatagacagattgcttctgtgtgatcgtccttgttgaagtggtgatgtggcttgggtgcccttactgtgacaaagcttgttgtcttcatatgttcttgtgcagttgtacatcacatttcgatcaaacattttgtgtgtgtgtgtgtgctccacatgattccaaagcttgtattgcaattgtggtctgttgatggggtggaacgagtcttggttctggaaggatggttaattcggtggtccactgggtatgcatgtggttcctattgcaactttgcaaggcaggggattaattaaacgacatgccgtgtgtagtaagttttatttgaagggtttcctcagggctatgtgcttgttcacatattgataatctttgtgacagattattatgtccatggctctattttgcgacaagatttagtttcaattcaaattttgagtacttttgttgctactctgcataacattcatgatttgatgaaataaatataattttccgtgctaaataatgaactagtagtggttttgtttggttacatgttggcataaaatgggtgatctacatgttgtttacacttcagaaagaaaatgttgctaatgttttgaaccgttctaccatcgaaaccaccgatacttgtatgttctctccttcagttatgacttaaaagcaattgttacctcattgatatcattgtatttgcttaactgatgtgctgctacgcatgcaaccaaaatttctgaagctcaagcgcttgaagggacccacaatcttgca

SEQ ID NO: 2577 - DNA, 1500 bp, Zea mays
cataaaatgatatgtggcttactatctctcatgaaactttcattaataataaccttgctcccttcggttccgaattagaagttgttttggacatttgagccaaacttataaaacttggattctttgttatttagctttgaaatctaatagtcatatatgctcattcaccttgaaaactacttttataaaagtataaatgtattaagagttcatatatgcttaacaaatattgatcaaaattatattttagagattgtgtcgttatcctaataaacaacttataatttggaacagaaggggagtatgtgcaaacaaaaagttttacaaatggttaccgtttggcaatgcatcgttagtgcatgtacagtggtgtttaatgtagatgctcttgaagtgtttaaagggaggatttgcaaaaaaaaaacatggaaccgtctctccgcgaagagacgtctctagctcataacccaagtagcaacagacgcctcacttcatattgtacgaattcgtcatctgttctatcgatccaatactgtacaaacacatttacttctgtatttattaatagattacacttatagacacttcattgtataatagagtctcttagttgtctcttgtgcttgaagaaccgttttagtgtatctccactatacatgcccttactgcagttggcaagtagtctctttccaaacaattgtacagagtttgacattttaaaattagataagtactcccttcgtccataaatgtttgtcattctcgctttttgaggagccaactattttaaactttaaccacatttatataagaaaatattaatatttatagtacataattagtatcgttagatagatctttgaatctattttttagtaaaattattccaagatacaaatattgctaatatattctttaaatctagtttaacttgagaaagtttggctgacacaagtaccacagtgacaaacatttgtggacagttggagtatatatataaagtactagtttatgatacatgttactaatattggtatatataataaatatattaaacaatataaacgttgacaatatttttgtaaacatagtcaaatttgacagaattaactcctcggaaatcgataccagcagctttttttgtgcttatgtacaaaacctgagtcaaagtcagtcagtacgtaccgtgtaggccccctcggcttcccttcattcctattcccgcaacaaacacaaccagtgtgccgtgtccagtccacaccccaaaacacgcgctgacgcgcgcctatatatccggccgctcgccgctttcgcaccgatctgaaccagacgcagccggccggacactcgacacgccgcggtcctgctatatatcagttgatccagacatccacacccgctgcacacaaacgtaacccccgcagcgagttactccaattcgcgccgactgatcgagacctgccgatccgttcgtctcctctcccgtgaccgcgcgcggct

SEQ ID NO: 2578 - DNA, 1447 bp, Zea mays
tgcatagtgatttgctatgttacgcctttgccgggaatatatcttattttcatatacagtggttctgcggtctgctgccattcttctgttgcatgaggatcgaagggattaaatctattttgttaatagaatcaacaaataaaatgaagtagatcaaccctgaatttggggttcgatgtgccctcccagcgggggcggagggtgttgaagcaacgaccgccttcgttcacctcccaccactgcgcagcgccaggaaccgcgacgccgtccggtctccacccacgacaggccggctgtgcacgatcacatacacacccaacgtgcactcagcctgctgcgtcgtcagctctcgatccctgctactgtgccgttattatctcaggcgatacaattcacagttgttggcttggctggctccaattctcctcttcttcaagtaagaagccagtggcctgttgagcagtgggacgcacgggcgtagccatagactcgctgtaggtgcggcgggcagaaactgaaaaagctcggcgcactttgggaattgggatcggcatcgcatcatcgctgaccggtgaaccggatcctcctgcgcggagggtgcacctgctgtggcccctgccgacgtgcgggctgcggagagaataaataggcgctctcctgtacatgtccggtcttccggacaacagcccaacacactacacattcgacacatatggtccaacacgaccgaacggagcagaggatccaccgaaacaccaaacggaggcctcgtgtctgctttcgcccatccctgctcttgccccgtttctcccttccatcgtgcttcctcctctctctctctctttttcgctcccgatttccaaatctcaaataataaataaccagaagggaagcgaatcttctccatcaacccagcaaatcgctcgttcgagcgtcccactcgacgagaaattctcacccatcacctccgcgtcgctccccccgttcgccgccaggtacgaacgcactgccaccccctctggccgtcggttgctgctctgattagggttcttactccgtgcggtcgcggattaacggggatagggggatggatttttaagctcgatcgtccctctcgctgccgtctgctgttgtcttatacggattatagttttggcgcctcaatcgcgagggtagggtcaacgcgggaggtacggattcctgtatgggtacgtacatataattagcaaatgagtagcggggaattgcgtgttttgacattttcgtcggttgcgcactgactatgcatttttttttgggtgttgattgatactgtaggggcccaatttcgtgtggacaggcacaggctgctgtgatcctttggtggatgggggcagcgcagctagccaccggaggttgcctagtttgaaatttaaccgcgttaccgaagtggtactccgtagttctt

SEQ ID NO: 2579 - DNA, 1500 bp, Zea mays
aatctagattcgaataaacatattcaacattttagtgatgagttctccactaaataaagtttgttaaaattaataaaaattacccacctctatcatctctactaatataaagtgttcccatgcgctagcgaaataaaaaaaacacatctatcgggattcgaataagtacaactcgtatctaacacatctatcgtggtctctagaaagagagcactcgtatctagaaagagagcactcgtatctaacaagtacaactgatgttagtttatattatacaaaacaaaattatatacgatatatataaaaatcgtagcgacacatgagcaactaactaattttacacaagttacttattggttcttctttgttttcccagttcattctctctttccctccaaaaaaaaattctttgcatccggaatgcaaagaaacacttttacaaccctcacatcgatctatcatctgttagtccatatatatagaaaaaaacaaattattaaagagttaagttgcaaatttttgatttgttttgtggaacttcacgtggtggaagtgaggtaatgcaaaatagggtgcttccatcatcttactcgtgtcttaggacgcagatgatgtttgattcgtgcgtgccatggytaaggtttcatcgtgactgcggcgggccgcgtaactcgtaggctcgtagcaatgcgacaaacccaggagtgcagatctccccgatccatttcttttgtttgcgccataatcattaccgaaactcatagggccggctcacgtacgttgatgccatggagaccggagtgcattcctcttttcgtgtcgggcgacgatgccatcataattcaaacaaagcctttcctccaaataccctccaaaccaatggcacaaagatttgaacgaaccagaatacaaccccctgccgaagggaccatgcatgtccttggagaattcaaagctagaaactccctaccacagtgcaagccacttgccacctttgccatggctgcttccgtctcctcccaaagaaaaagcaaaaggagatgagatagcgagcaagaggatcaccactagcaccattgaaccagagcagcagagcgacgcactagctagatagatcagagtagtacgttgctctgtagtctactagacacccttcatccagacgccatatatatctcaaaagccaaccccccctcccctgccttgcagttgccacagcgagcgagcgaacgaacatattcccctagattgctctcctgacactatcatcttccacctcccagcttcactctcaagcctccactccatcttcttgtgaagcttctcaagattctcgcatgcctttactcctcctctcactcactctcgccagcttgcttgctaaacaacctccaacgccgacgccaatgccgacagctcaactcctctaactagcctcccgccgcaattcacaagcgcccggagaaagaaaaaagaaagaaacattggaggcaccccccg

SEQ ID NO: 2580 - DNA, 382 bp, Zea mays
actccaatgaacagagaagagaaagtgagagatagaagacgacgaccagggaagatagaagacagcaccagggtacatagaagatgtttgaagacagcggctagggagtaacggagcgaacggagcgagggcacgaccgacatttgtaaatggctaatgaccatcaagacacccggatgctatttcttcaaatcgagcgagattataatgccacggttccaattgcgtcgatggcggtggcaatagtctgaagcccgctgaagagagtgccacccttgcaaaattctagaccaggagaaggaaagggatctccggtccccggctcaccacttccgattccaatctggtctcgctgggcctggccgctggcggcaagggagag

SEQ ID NO: 2581 - DNA, 1500 bp, Zea mays
ggctgctacaccagcccaagcacgacacagctgtcgtgccgggctggatcgagctcattttgctccgtgccgtaccgtgcacgtgatgggccaatttcgtgtcgtgtcacgggttgcccattcaacccgatccagatggacatgtatagagactgggcagtcgttgatgcgcgcctcacgtcacgtcatgctcgcgcgggagcgggccccgcgacctcctcggcaacaggccttgtcgctccccatgccccccgcccgccgccctgtgtgtcgtgacgcccgttcaggtccagatccatgccgcccgcacccgacgcacgaagggacgtcacgtggccagcgagacacgcgggcccacggattggtaactcagacagctttgcggcccgtgcgagatgaaccctttcggccctgcgctgcgccgaccggccccgaacctctcggtccaggctgtctcgctgcgtggggccggagcgcggctccttcgctcctgacgagcttatcaccagtgcggtaccgggcccaccatcacatcagcaggcaggcaatgtacgcgtgcaggtcacactgacatgtggagcaggctgtccggtccccacacgtcgtgacggccttgaatttgtcgatggctccgctcctccgcctgcgcctgcccggtgggccagatagcccacatgcaccgcgcagtattagggctgccacggtggcgccgacacgcgtcgatatctcattggagtgcaggactcggaggcagcycatttctaggcagcgccgtctcttcgcgcaccccccaattcgaacgacggagcacgacgcacgcagagccgcagaggtacccctcgctcccttctccgcccctcggcttctcctcctctcttgaatctgggtcgctgctgcttcgattccctttcttccctgacgcttgcttgcttttgcgtccgatttgtaatctaaacatctcgtttccgcacgggtttggtgcgcgtctacttgtggttgggcctctttcgatcgagtaggctcgaggacggggatccatgcccgcttgacctgacgtgatacgcgtactacggatccgtcaaagcctgtactccagacgaaccagtcgattctgtgtaatcatgcatattaagcggcagtttttaccgcttgaaggtcgtcgtagttaggtgctcagatctggcgcttttcaaggttagaggaagtgattgaagctaggagacatgatttcagctaggtttagtttgtggttcattggagacaaaattcgccaagcagatactgtagtacacgttgaattttcgtgatttatactgagaattgtgctttccatctggaaattccccatctgaatatggctagctagagatcgtggctagctagtagctctccgtgccacggatcaataaagtgttaatcgtgcgatgaagttagctcaccgcttgtcctctcaacactgcagatccgtcacactgcaagttttgaaaactgaactgtaag

SEQ ID NO: 2582 - DNA, 1361 bp, Zea mays
agataaatggcgttgtctcggtcgcggatctttacttgtacttttacctcttgatgatgtgcactgcacggatattatatgtgttcgttgtgagaactgggaaattcgaggagagaagaagagcttgattttttacagtccttttaacgcccatagtttcatttcatttctttcgtcacattaggcaggtccagcctccagcggcaggcggtttggtcggttcgagtgttttgctgcgttcgtcggttatcacggagaatatccagacagttgttggttcgagaacatttcgtttgtgaattttggtgttcggaagattgtgtaaagctttgagaagcaagttaaaattgtgcatgcatagatttttttattggctcctattcattcttctctgttggcccgactcagtccttcaactcattttataaaggcataatttaagtctgtacaaaagaacaaaaagttgttcaaaaagctaaaaaacacacctagaaagcattaaagcaagaagccagttctcaagaagagatttcattgagacttaacctaaccaaagtaggagagagatcttcacgaagttgtttccagcgctacaaagacaaatccttttcattaaaaaatatactatttctcacagaccaaatgcacacccggcagcaacaatagcaagctcatcattttcttatctcattttctattttaactccactatacaatctacggtgcaaaatagtgatatgcacaaccatatacataacttgctagagacagtgttaagctccataaacataaccgggttttaaaggatctcctccccacaagaggtctaccaagtaccaaggatagagacagcaagattccaatttatgccaacaagcctccagcaccatgtactgaaggggtactcagagaaaagatgaccagcagacacgtcagcatacccattacagaggacatttaagcatggcaaactcacagagaaagggaaacgtgaagcatacgatgaagaattgaaggccatacgtgaatccgttcatttttgcacttttatatatgtacgttacggggcttgtgcaaactgttgcaagattcactccctctgcaaaagctactaggaggtcaccaaaaacacacattctatacatcatacgtggaaactacatctgaaaacatcggaagtaagactgtacgcactattttagaattcattactaaggcccagctcatcttcaaggtcatctccctcttcaaagagcttgaggaaccgcacctggtctcgctccctcttcttcttctgccaatacttgaagcccccgaacaaggcagtgacgacaaggactgaagcgagaacactagctatt

SEQ ID NO: 2583 - DNA, 195 bp, Zea mays
ggtgcccgactcaactcctcgttgctcgtcagtgctgcttgagtgacccttcaaagtaaagttcacagtaatgcgacgcgcttggtgttgtaatgcttaatttgagtgtggccggccggtgcagagctggggacgaccaaggtggcggaggcgaggcactgcctgtcgcagagccaccggttcaagggcctgtgc

SEQ ID NO: 2584 - DNA, 49 bp, Zea mays
gttcatcggtcttgctaattgttgatgggtgcttcattaatttgatttg

SEQ ID NO: 2585 - DNA, 157 bp, Zea mays
ggtgattagctggtgccctatggtgtcaggttttaattgctcattatccatctataattgtacgtactcgtaccaggcagattgattggtcacccacctgttcttggtgactaataaatctgtacgttgcgaatctgcaaaatggaatgtgatcagt

SEQ ID NO: 2586 - DNA, 373 bp, Zea mays
tatatatatatatatatatatatggactggaatcgccactaatggtcagtgctttagtttctctgttaaaaatgacgacgtgaacttgtaataattactccaatcttccaaaattttacttcattcacttacgctcaatgaatgtatttgtatattcatactatatatgtactatatagtattgcgtcacaaaatctgctgcctccctctctcccctcccgtcccgtccacccataaatagccgcgcatccgctccactccgctctcgctccatgcccaccgtctcctccctccactttattacccacgtcgcgacgccgacaccgtcccgcgctccctccccctgccgcaccgcacccacgctacgctctcc

SEQ ID NO: 2587 - DNA, 1500 bp, Zea mays
atggtgagcaaagagaaatttgtgaaggcctcggtctcgtctccataaggaagagatcaaatagtgtagcgagaaaagtggttgaaaaagatctagttttcttgagagcttcttaacagagatgtaggatttatggacatggactagaacttcagtaaacaaatcaagtgtgtcatttgcttgtccttatgttctcattgtttaagtttaattacttttggatcattagtattgctctacttgttactatatttttgttgtaggttttaggaggaattaacctactacatatctgacaattctcgataacaaatagaatcaattaaatagaagcaaactttttttgatctgtgatttcaggttgtccagtacccggcggccggcggccgccaaggaaattccgatcatgctattccttgaaagttatgtattctttagaatggcctatttaacctgattctttcgacaaaaaaagtagacatatcctatatgagatcatcgtagatccaccgctgccacacacaatcatccgatggtacttattgttgtgtgcatttcctccatcgcacaatgagatctatatctcctccagttcattctaattaaatcgcaagttgttttattattgtaactttgatcgagtttgtaagctatatatctataataccaaacaaaagttatacacaatatgcaatagattttagcagttttgatataccatagacgcgttaatatattttttgtataaacttagccaaaagcataatgacgacctatgcttaatttggaacaaattgtgcactattaatataattatgtgtatttgatgtgagtctttatgattatgtcgctactttattctaaattgtaagtcttgttctcacttcttttctttatttatatttatatattttttattatatatctgcctatgatctatccttagatacgtatagaaaaacgatatacctagctagaaaaaaaagtgtgaggacttgtagttacggaattacgggtgcaagggaagtggcgattacatatgcggagctagcttgttgtaggaattaataaacgaggagggttccatccgagagaacaagcaattccaagcagtaaatgggatcgaatcgaagcacttgcatgcatgggtggtgcaggaggagcgaggaaggaagcataagcatcttcttttgaggaaaggcagatggagtgttgctgcgttcctgtcctgtcatagcgtcggcggcgtcggcaacaccaatctggggatactggaatgaaacggcgacgatgatctagctagatagttcatggtctgcgccggccagccgggcggtcgactggtggctgggcgcatctatccgcctatttatagccacagtcgtcaaacggaacagcagtggcagcgtacgtagtagaggcaagcaaaagggcagggatagagcgccgccgagatatctagctagaagagcctagaagccggtgtagaggatcaggagg

SEQ ID NO: 2588 - DNA, 271 bp, Zea mays
gcgctagcagatcgttcgactctgctgctcacatctcccacaccgtacgtgccgactcgaccgacagacatgggcatagtagtacaaacagaaaggtgtctctgctgctttatttcctggccttcggctgaatgggaaaaaggtatacacgtcgtagtgatgtattgacagacatcgtatacgtcttcccagcaaaatgtggctgtagcaattacacgcgtttaattgtacagagctagctcatgtgagcgagcccatagtattgttcatt

SEQ ID NO: 2589 - DNA, 890 bp, Zea mays
agatttaaaatccattctaaatataaggtattctagattggtcaatctgatccatacgtgtctgccttctaaacctcatatatttacgtcatgtaaaactgttatccaaaatcagtgacatgcatgtctctatttttaaattatatattttaaaattaaataaattaataaggaaatagttacttttttattagattttgttagctggtactaaaattgtatgggtatttgtttttagacacaagaagtatttataaaagtaaattccagaaactccggtcaaaaacagaggacacctcgtgatcttatcggcgcatgttggattggattgattccgcatcagtccgccgcacgattgtgccgagatacccacctcgccaccaaccctgtctgtctgacgtggcacccccacggtaggtgagcaggtgactcggctccgttctgtctcgcccagcccaacccacccaccgcgtatccatgactgaaataccctgctgattacttccaactttcatatgcagtacaccacggtactatcccaatccaaattcatttcaggctaatttcttagttaattattctgttttttagagggctaagacaacatgtgaagtcaaaacaagggcaaaaagggaaactcgagctcgaagttacgcaactactcggcagcgtctggtgcgttctgcccgatgcgcacccgtcactattttacgtgcccacatttccgccaccgccaccgccaccggytaccacctgccgcctgcgccctgccctccctctgtttttctagacccccggatcgctcagagattgagtcgtagtcgtacccgactagtcgccgcgtcctcctttccccgcgcagcagcagagcaccacccggtgaccgagca

SEQ ID NO: 2590 - DNA, 1062 bp, Zea mays
ggtgcttaaaaaccataacataatatctatattgtacatgccctcaagagttgtttagaacaaaaataccgaaggatatttaagggctaaaaatcccactgttattcaattttgaataccaaagagattttagcctcttaaacccttcggtatttttgcttagggcttgtttagaagcaagtgtaatggaggggatcgaggaggccaaaatttcttactattcaaggctattttgggagctacaaaatagagatgattgaatgagctaaaatcctcttcttattaaattttgaataagaatgtgattttagcctctcaatgctctccgatattttaactctcaaactaatcgtcaaggtattttggtcacctcaatcccctctattatctttaattctaaacgatgccttagagtttgtttgggaacttgagtaatggaagggattgaagaggttagaatctttgattactgcattgactcccaaacatgaacagtgtatacctgcatccttcctcaccaagactcggcggcacgtggttacagtacgtgtttaatccctttagatttcttaatatagacgcaaataaattatgtccacctcctgtcaaaatcgcttgccgcgaattgatggcaaggggggaagacgacgacggaacgagagattgagagccagccggtccctttttttgtcagcgttattacgatccgcgtttggttgcgacctcattgtcttactgttagatatatagtgacggaatcgatggttgcccagcaggcaagatcggaaccaaactcggtcgcatgcgcatcgcagcccttccacatgcgggtgggtgaggtggacgacttacgatagacggggtcgggcatggattgattggtggaggccgtgcccccgtgctcatgctcggcgaggacagttgttatattatatcctccttcccttcttgtgcccttgcttggaccatatacctgaagtagcagcttcccttctccgtggaagaacaacagaagaaaagggggtaggtaatcttcggcgccggcggccgccggtccccgcg

SEQ ID NO: 2591 - DNA, 1177 bp, Zea mays
ttaaactctcgtgaagttgtgatttatagtgtcctaactcttaatattgtagtttgctgagtgatggtacaatattgcatattctatccgttttcgttgcatatccgttcgttctaatctgttttcacgtaatcgtataccccgcaactgtttccggctatcccgctcccgttttcgataaaaaaatttggtaaccgaaaaaggagagggtttttttaccgttttcgtttgtttcatccctactcattccttatttcaaatttcactctacaaatatcgtaatctatagttccacgtcacccattttacactaactgctacagactgttctaattggattgtttaaatatcttcagctattttttaataactggctactccctccattcacaaatatttttcactaactgaatttatagaatatattaacaacatttttatctttgaataattttactacttttgtagattcaaagatctatctaaagatgctaattatgtactataaatattaatattttttgtataaatatggtgaaagttataaatgtttgactactaaaaaaagaattatcaacatttgtggatggagtgagtagtgtagtgtttggttgaagagccaagtagaacggagccgttctgtcccatttttgttgttgtttggttacaaagtaactagaacggagtggctccagttaggaaatattctcctcagatctggaatcatctcactccaaaaaatcaatgggacggagccgcttcgttcctatcccgctcccacagctcaccctcccatccgtgcgcagtagctcacgcgcctccctctgcaaccaaacaaaaaacagagccgctccgttccagttcactctgcaaccaaacaaaaaacagagccgctccgatccagcttaccaaacacagaacagagcggctccgttcttagaatcaggaatgaaacggctccgctctacttagctcctcaatcaaacactaatttagtgcactcaaactcctctagtaatactactaatagaattaatataatattgtatccagtagtagtattggaaacggtttaaacataaaaaattcatttttaattactactacgtctgtggatgtgtgccacgccagccttttcattcctcttcctctcccaccggcagggcaatagtcagcg

SEQ ID NO: 2592 - DNA, 168 bp, Zea mays
ggtaaagaaataaacaaatccatcaccagccatattcaccacacccgaggatgttctggctccccatcaccagccatacatcatcctgttgttttttttttgtttgcacacgcaggatcctgctactcgacgacccttcgcgacaggcactgctgcatcgagaactcg

SEQ ID NO: 2593 - DNA, 600 bp, Zea mays
gctgtcactataataatgaggccagccaaaaccccccactgcgtgatttcagtaaaagaatggactccagattttcaaatattgtgcatcgactatatatgcatacctgtaatgacttactctggagtatgtatgagtttatgacacagcttggttgcatttatatataggatcttaattgacccacctcactagataggctaactaccccccattgcgcattggattgtcatcaaaagaatctatttctagctagaatatttagtccctatatattatttcatgctaataacacaataactgctaaatatttacacatgccttgcaaatatctaagtggaatccaggtataaaatagctcgcagtaacattgaatatatatataacccaccagctgcaaactagcacagggattacataattcaaatctttttgctgatcttagtttccactttcgatcgatcctgtgtatatataaacgcttctgtatcaatcctctgcgtactatctccatgcatccacatatatcactctaacacttagcaagaaattaaccaaatatttgcgtcgtcttggcgttggcgagaaggggtatccacc

SEQ ID NO: 2594 - DNA, 1500 bp, Zea mays
cattataacaaaccatcatggagagcaagaaaaagcagcatgaaacaaggcggaaagggccaaaggcagctagcttgcacggattggtcaaggagacgatcattgtggtggcatgcacttctgctgctctttaagcctttaaccccttggacaaaaagtaaaaaaaaaactgaagaccaatgacactgcgtttttcaatgagggaagggaagggaagggagggaggaaaagtcaatggcacaggcacttgtttggatgcaaatcgcaacgcagctgcttgaatttattaatttatttatttacggccagggccagcccactctacactgtacggtgggaccctccggggtgtggaaataataatgctaccaaaccaaacgctttgtttttactcggtggagatggtacaattaaacaaagcaacagctgcccctaaaatagtgactgtcaccgtagttagtactacactactttattactactactccagtccagagcaagagggagcaaataaaaaaaaagagctggtggatgagcctgcttgctactgctgcctagcagagcttgcaaaggcaatgaatgcaacctcctcctcctccaccaccatcatgacgcgcgctgcatttagtgggcattgaaaacgcctgcaaggggtttggtgcgagagaggagaggaggagcgagctagggtgtgtgtgtgtgtccgtgtgtggctgggtgctgcatctgcgtcgtctgatgatgatgatgagctcgagctccgtatcttccccctcacaccttgttgtgtgaatgaatcgagctgggccggccggactctgttcttctttctcctgtttgtggctgtagatttggagagctattactgttcttcagacatctcctgtccgatcccattctcattcgtttacgctatcccctggtggttcttgctcagctgctctgctggggaggggaggggcggaaagagaagagaagaggaggggagtcaaaaaaaaaatttctttgttgtgtttccctgcttttgttttgcctcccccaccccttgtttgatgatgctgtgttcttttctttaatttgagttcttgatcctgccaaaagcaaaagccctcacacccttctgctcgcaaaggcgagggctgtgtcctgccacttcaaaccctccccacaaagctcggatttctgtctgcagtttccttacctctgaatcccgttccctccacgaaaacctcggatttccacgcccagtgttccaccaccgcaaagatccagtttttttcccctcccgaagccgcagtttccctgcgcgagctggtctggtccaagaacacacaccaaaaatctctctccccattgcgcacggaaatctcgggggggaggggtttccccgccccatgcctcagtccgcccgttgatccagaccgccacgccaccgggttcggtagctgcgggttttttccgcccgggagccgggagcggcgtcgtctcgatccgaggccc

SEQ ID NO: 2595 - DNA, 633 bp, Zea mays
agttatacttaatatactttactggcagtcctttcttgtttgcaaattgttccactgaacttgtaacagtaattggactttgataccgtggctgcatggtgtgtcatattgcgtccaagcagggttgcattttgatatgtataatacttgcttggagttaacaatacaatttccaagtagcaacggatcatggctagttcagttatctggatagtgtgaaaccatttgaattatataagcgattaagtggaaatcaaaatattgaagaaaaaggttaatatcatggagacttagcttgcatttcataatgaggatggaacaacacaaactagccatgctcttcttgagcctatatttctcatatggttgtaccagactactgtctgccaaagttgaagtttcagattttggaaattaataatctggaatatttgctcaacaacctttgatatgcattactctgatttgggactagataatgaatcatacatactagtaagatttgtagtaattatgtatgatgccctgacgcaattcattttgttttggcaacccgcaatacagactttataacgatcaggatgtggtcttctaacagttatattcaccctatctttattatattattctcag

SEQ ID NO: 2596 - DNA, 1500 bp, Zea mays
catagtaacacagagataactaactagtttcttttgtatagaagaacaaggattcaatcgatggacaagtcatcagttgaatagaacccacgtttcaaccaaccgagcaatgggaaaagtgttgacataatgtacagtatataccactacagcagggagcaaaaggaattccgggtcagtttcgtgcagacagcgcgcacccagcactctccaggagatcagargaaatggaaacgggtgtgaggctgaagaggccgagcccagatcgtttctaggttaggcccacggaaaacaggccgagttttaagcccgtgccgcaagtcgggcaatgcccagagagggagacagttgtcgcagcgttcgtagcaaggtcgccagcggcccatcgtacggccttgccgcccagtgctcccccgtgcgctcggccaagaacacaccactacaccagcagtccgggacgccttgatccgcaggacccgtcacatctcaacaccacacggcgcgaccccagcctttggccgacccgacaccacgtgatcaacaggcacgtgctccgaactagtagtgaaaagagctgctgtggcacgggtcccccgctgccctatccgtgctgccgcaggagcctggccgtgcccgtgctccacgacgcacgggccactgggccagggggcactcaggcaggcagaggcagcagcagccgcgactgcgacgtcgtacgcggcgcggagggggtgggattctgcgggatcgacggccggcacgcgcgatacctgcccgcccgtggagagtgaagtggaggtggagccgttgggcggccgcgcccgtggtccggcgctgttctctcacgtccttctggcccgggtcccccacctgccatgccaccgtactcgtactctcccatcagtcccgtgcacgacgctgatgcctggtggacccccgcctttcaatttgttgttgtgtcgtgtcacgcacgggcacggcgcaatcggtgtggaggtctccacttgtgtgtcgttcattctcaaatcaaacctttcgttgttgggaaaattacgtttatgttcgaacgaaattcgaacaagacagggcatttctgtccaagcaccgaccgtcagagaggagagagggggaggcagcgatttattacccgatatatctcgcgttttctcgtcagttaacagatctgatccgacccctgaggccaggcaaagactctccgccctcccactcccacctcgccacctcctccttcctcgctcccaattttctttttttttccccttccccttcggcgcggcaggattttctccatctgctttccccatttccgccgtattttattcgatttcgaggtcggttttctgttgcacagggagaaaggtcacgtccaaccgccgcgaactgcgcatgtgaactgtgcccgacgaggcgcgctgcggcacgggtgaggggagctgcgccggagcaccagccctagggttttcaccgccctgccgcgag

SEQ ID NO: 2597 - DNA, 593 bp, Zea mays
taaattgacaatgataggaggcttcactgtggagtcactcggatcccaactatttgtatatatggacccaacattgaaggaggatcacatttgattcatgcacattcgacaatgattggtccatagagacattgtgtccagtagtagagtctttatggtgcaaaatatgatacagtaagaatggtctgacactaaatctgaagttgtgaaatattttgttcccaactcacatactaaatacatatatgaatatattttcaagagaacaaaaaatgaagacctaagtcaacaagctaaggtagtaccacacaccgacaaaaaaagaggagtagcacaccataaacctacactgtacacatcttgactactaaacaggcaccacatttacatactccgccgcagcaacagctgccgcgtcctgttccgggtgctgttcctccatctctccgctgatctcctccagtgccttccccttggactccggcaagaggagcgtaaacacaaggccaacaaggttgcacccaaccaaggcgaacagcatgcttcggttgttgttatgtttttcggcgtaaacgaaggcaaacacgccaatt

SEQ ID NO: 2598 - DNA, 1500 bp, Zea mays
gagtcttcctatcgtgatgcaaggcctctatgagttgtctcctaggttctcactggcatcccgaggccttattaccgtgttgacggtggtaattcctcaccgttgtacccatactatcgtagatccatctggtccgcggacaacctcgctgacgccaccgtttcgggtaagtacaccctaatctgtgtcgctctgtcctcggcgtcgtgtagcatcttctgttgtgagttggggatgcctgggcaggggatcttgcgcaagccggcgagcttccgctgtggctctggttgcgtcgccactcggcttggattgaggaggaagacaacccttgtctgtcgatctagccaccaacggctagggttgggtcaacttggtatgcatgtgctcaatgcattgggactatagatctgatgatgtccggttatcagtgcatacagttcaatgtatgatctgaaccgatggatcaagatttgaggattgccaatgtgtctcggttctagtctaatctgggccatcagatatcaatcgaatggctcatatctgaaggtaccccttcggcggtggataatttctaaagagaccgtgttgtttttcttattcaacccgccatccacgcgcggggtgggtatgagtcttggagaaatatacgaaatagcccctggtctttcacagaatagtgtccccagtccaatcattgaataaaagggataaaacaattcagaaaatggtttttagtttagaaataattctagaaacttgtataattcattttaactccaaattgattcattccagttgcaataattttgttttaatattgtttatcatctagtatctttgtttagctatgaaatttgaattaaaattattcacttaacttattctatactaagcacttaataacttcaaaaattcataactcccccgttttaattctgaattgactcgttctagttgcattagcttcgtataaatatttactacgcagtagcaacattgattatatgatatcccatacttttataattaggtaactaatttggttaatctatgttttcgggattagcttattctctactactccttatgtttgtgttgtaggcgtccacaggcaggatggtgcacggttctgccgtcgcgctccctcccgagtcccaggcgggtatccgcgccccctctccctgacgctgcgatggtcgcgccccctctccctcccctcggcgtgatgcctgcatcccccctcccctggtgccatggtgcacctcacagtatgttatcctgttggatcgggaggagtagagccgacgcgacgggatcaagatttgtatttgaacctagacgacgggaggagtatgaggcccagtcatggaggaggagaagcaagcgatggagggtgccgctacggcggcgaggcggctgctggtgatcggggtggggttctgggtgtagggcttccggctcttcctgtggctgggcatcaattccttcctcaaggacggc

SEQ ID NO: 2599 - DNA, 202 bp, Zea mays
cagaagacagcggcaccgcaccgggcgcaactaccgcgtccgtgccgtgatccactccccattgccccccgaccctcgtgcacgcgcagagtaatcggctcagaaacgcaggcagcccagcccacgccgcgaggaagcctgaggccgagagaggactgagcaagcgtcccgcgagaaactggtgttccggaccaccacgcgg

SEQ ID NO: 2600 - DNA, 1500 bp, Zea mays
ccgtttttaagttgtggatctgtttatgtgatactatacttttgtgataactagttccattatgtttaartctatggttctaaagtagctacctaagttaataatcaatgtttgttgtgtttgagttgatatttttgtggacactatcactacaccacacttaagttttatcgacccttattaagcataaaccattggttgctaaacactaatgatcgatggttgatcgttaaatatgtttttagaaacgatctgttggctacaaatttaacaaccaatggtgagctgctatatatgcaagtggacatccgacaattggttgttaaataaatttggactagccgtatcccattttggaaatagcacaacttcactactggaatagacgttgacyatgcaatattgtgttgaaaataacacgacgtatttgaaatttgtagcagtagtactcacgcaccataacactaagttggccattcaaatctactgtacattaaaaaatatatagaaaaaataaagaaaattatgtcgaaagcaaaaatgtattggacacgtgacgactaacctaagtcgttggaatttggggattcttatccttgaattagtagtgttgacatcgaccttaggtatgcctaaatgtcaactgactgcgtgcatgtcgatgtatatttggatggtaggttgattggacagaagtagaagaggtttttataaaaaggaacggcggtaaaaaccagaaaaattagtgttttataggagtaggatacataagagaattctaacgtagaaaattacggaggaataaaataacaaaataattggaaagacaggtaatagagcaggctggagttgtgtacggctacggcccactgggcatgatcgtcccaacagaacgacggtggaaccctggtctcctccctcttcacccgcactgcactgcagcacacgcgccgccgaagcgctytgcccacctcgctcccctccagtggccgccggcgcggctcagcggtccatcctcctgacgccacctgcaacggcgccaggcggtgatccattccaactcgcggtaagctctacccgtcggtctcgcttgggtcgctcgagaccaccaagtccatgcctaaacccaatccttttttccattatatttatatgtacaatttcaagtccatccggatagtcccggctggatttgttcgatactctgcatagcaccgatccgactcatctctgtttcgattccatccggtttggctcgtttttttttaatcgagtgtactgtagtcttgtaccctaatgtcgtgggagtgctaccgaagtactgatagcaatcactttaatttcattagctccgtcctggtatcataaatccgccagtggacgaagcggtgatttggggttctcatgtgctctagatagcccatggctcgcttgagggatgttgctaaagattttctcgtttgtcacacctgcaggtcatctcaagtgggtgcggcaacc

SEQ ID NO: 2601 - DNA, 1500 bp, Zea mays
tgcaggccgcgttgcttaattgttttttttctctatttcaaggtaaggacgtcagccactttagaaaacttgcatcatctgatgctgatctcaatgtcatcatctgttcttctgcagccaaattcagtacaatggtttttttttaatggcaagaagatactaatgataaaggattcgcagatcagattagctgtacagagagattcctctggcaatcacttccccactcacaacaagacactatgggtgttggcattggcctgaaacaacctgaactttatttcttctgttctgattagtactagctacctggcggaatatatatttcttgggagattaatatctggattgctccgccagtcgtccctgccgtatgcgtcccggcactgagatcacgatcggattcacaacaaaaatactactagcgtctactcctacaagacaagacaaaacagttaggacctgtttagaaatacaattttgaaatactgtagttttgacataccataatttacttgtacatgacataaatactacagtattgctttaccacagtaaaactacagtattgctcaaaaccgagatctgtttggttatattggaaaaacaaagtatatgcagagagaagagaagaaaaccgaggtcctgagtggagtttcgaaaactccaaaaatactacagttttgggtgaaccataatatttaaaactgagttttgactatataaaccaaacaccttttgagctttaatactatagtatcatcaaatatcacagtaatattacaattccaaacaaggccttaaaattgcattgctgcattgacgtcctccgtggacacgaaaagggctctaatttgttgggtggataaaaatccggtcgccgtcccgcttccaaaccacgcaaaaaccccactccatggggcaggcaggaccccgcaccaaacgaccaccggaaaaaggaaaaaaaacactcattttagactaaaaatacactcattttcaactataattcatttcagactaaaaatacactcattctagactctgcgctagcgctcaagaccgaggccgcagctgtggtcgtgaagagagaagaagattagagtaaatcagtactgccctacgataaggacggaaggtagaaagaagtcaataaggatatttttattttctcaaactagccctgtaaatacgaatgcagataatggtatagatcaaatattttgattgaataatggtctcactataatactcgattttcgtgtaatgacatacatctggaaaaaaaaagcagccagctgagaggccgagaggcacatcccttcccagttcccacttcccacttcccacggcccgcgctgcctattcggatcccctttctctctttcggtcttcccccttccccccactttctccgacccacccggccgcggcagcgacggttctcgcctctcggtctcgggtcagcccctgctgcgacctaaactctagcggtgccaa

SEQ ID NO: 2602 - DNA, 820 bp, Zea mays
agctcggtacccctgcggtcatttgaatttcagtttacatgcataatgctttgattgtacgtaaaaaaaaccatgtacattacataataaaggggattgaccaatttgcatttccgtttacatgcataatgcttgggttgtacgtaacaaaccatgtaccttgcataatgaaggggattgaccaatcacagtgcagtatcacttgatgggacacacgatcatttggctcatgttggtgtatgtcggtatttgctgaaagttgcagcctcagtagagttgaattgtactcattgtcattggttaccatgggcctattcatttaaaccctcagatagatgccgttttgagctacaatctgttactgctgctgtgaggattgaaatctggttaaaactataaaagctagcaaaattgatgtagtgcttttgacatgatatatcatgtaacctggtttttccaggttgccctcctgtgaatgaaaaaagaatgagaagtaatatatgttagtagaaggaattacaaattgtatgaagaattgtgaagtggagacaagataaaagtcagatgcagacattaatggtgactggcctaatattgctcaatgtccacaagtaatcctgacatacattcatggaaaacagttatgagtaaagtggcttctagtcatcattgcagcatctgttttacttgattaacattttttaatagcatccttgctctgctgtctactgatgttcagtaacatgtcataactagtgacgtgaacatatcagattccatttcctttgttttgtcctgttgacatatttctttccttttt

SEQ ID NO: 2603 - DNA, 131 bp, Zea mays
ggtctgcgacgtgctcggcgcactcagcccagcggaggaagagcgtgcggctcaacgtctgcccgcaggtgacgcagcaccacgtctggcggggcgcgctcgaggcggtgctcggggatctccaggccgac

SEQ ID NO: 2604 - DNA, 327 bp, Zea mays
taagctataaggtttagtttctgccaatcaaagtaccttagtttgcctggatatttttgcacaaatgcatgtgatttgtgacccattcgctgcttttattgaaatgtgaaaacttattattgtaacaatttgtctatatttcatggtatgaaatattgactgttgatatcatgctatcgaatcaatgccctaaaaatagtttgccattttcagatagcagttaatggacagagtttcaatcgctcagctagggatgcttgggagctgtttcaatccacaggcatcgaatcacttgttgcttatgactgttcaggtgctatccttcta

SEQ ID NO: 2605 - DNA, 67 bp, Zea mays
agctaccgcgttcttcttgtctggagtgcacagtgcatgggcagtgggtgaactggtagagagcaag

SEQ ID NO: 2606 - DNA, 1355 bp, Zea mays
ggatcgagtggttttctaggaggcatcatggggtctggttttcgtcgcgagcacgatggctgccaaatgttgggccagacaggtggaccctaacactcgggggcacatgataaacatggtgctccaaaaaacattaggttgggaacagtagtgtctcgtcaagcatgtcccatcagttacargtcgtgtatttatagggcgactagggcatgtaaatctaaatacaattttgcatccgactactggctacatccccggtatatgttgtgctatggggtaattacagtacaatattaacgcttcggaactaagtacaccagggcactcacccaccctgtaggatgaagagtgggcctagcagggcaactgtaacccttctgtggcccgctagcttagctctccttcgaggccttcgagttcctaggcrtcttcgcccgagcatgcgatacaccaccagcgaaggcttcaacctcacttcagtcgccacggtttggctctcgcttgaagggtatggtaagtgccttcgccttcgatgagccccgcgagtgcttgccttctcatggtcttcgtcgagcatgtccaattaagaccctttgggcgatgcgagcctggcgaggttccccgttgcgctaagtgcactcagtcattgttagttttatcttgaggtcgtttctgcgcttggtagatcgaggtctggtttggcctccgccccaacactaacaccagcatttgaatgaaagctatgcaaccaccccttcatggaacccaaagtcttctcaaactgcgactgatgctttgtcttgagcaggactccccaactctatataagagaaatatatgcatacatgatcaaacattatatgcttaagatatatctttggctatttcctgcagatttcttatttcgtcttctattttaaattttaccatgtaaacaatatagcctatatgccgcggacaaccttaacatgattgtgatcccaccaaaatttctctgagggctagtttgggagtccaaatatcggaggggttagaagggttaaaataccttattcaaaattgaataagaaagaattttagccactccaatctccttcagttttatggctcccaaactagcccttaattaataaataaatattgacatcctcaggggcccacacgaaaaaaaaagaaacgcaagatcttgcactgttgcacatctcccctcttttagcccgcagcacccgtccgggtgtaccggtgtactatcatccctcggctccaggccgcatcgcgatcagtcatctctttccctcccagccttcctcctgcgtctcgctctcgccggaggtcaggcgcaccgccgccgggcg

SEQ ID NO: 2607 - DNA, 51 bp, Zea mays
aatattaggtacctgactgacaatatgctgactggagatttgcctgcttga

SEQ ID NO: 2608 - DNA, 1500 bp, Zea mays
atgaggtcatcccaccaaatttaaggaatgaactaattatacaccacctcattttagatagagtgatacctcaaaccaaacatctccttaattccaaacaactctgcgggatgttgtcaaaattctcacaggataatatgtcaaatcttccttaatgtcgagttcttctaattgttgagcatccattaagattgctgtgacgaaccaaaataggacaacacaattaaggccatcttcatttattcttcctatcccacgtggattggatggaattgaaaaaaaaatatatgatgaagatcaaggagagaaggctatagtgcatatgaatgtataataaagtaaaacacaaaggtatgaaagtatgtcaatcatgcaacgtaactacgtaagcttcatccttgtaaaaatgttataaagagtatgttatatttttacacagttcagcattgatattatgtcctaattaagttggtcatttaacgcaggcagtcagcagcatagactgtaccgagctgaaatctttacaagattctggggatattacaccatacgcgtacaatccttgtcgtccgatacgtcatacagcctggagctgcaccgatgtgaaatcaaaacaagaacagtcaaacattcgctggcctcaatcaacagttatttctttgtttattgcagctgccgtccgggacgcgcgcgacgaagactagcagcagcttcgtacctgtttcgttgcaagaagtagagagtgaagcacgtaattccagtcttttataattttcagtcttctggaagagattgaatcatgtaattttcaattagagcagtttttcaaatcaattagacgaaacagcagagaacttttgtacgagacttgtgtgcctagtagataatgatgaaacgtactcctagtatttttttcccacatgattgtaccgtagtaacttcttttgtaccgcaattttactcctctttccaaaaattaggacttatttggggtaaatgtaatataggggatttaggggatcagaatcccttattattcaatttggaatagtaaagcattctaacccgctcaatcctttctatttcacttgcttcccacaagtttttaggattggtttggtgaacaaagattttttccctagagggaaaactctttgctatttaattttgaataagggaaattttcttcttttaggattctttctaaatttctgttcaccaaattaattttagtactgtttgagagcaacatatcagagtgaattaattaagaattttagcttctctgaaccgctccggttttgtggccgaaactagggacgacctgttctttttggccgattttcgcaataacgtttcagccaatcacggacaaaacttgaaagcgcgaccatacatttttacactccccagccatatacatcatatttttatctgaggaggtttgcaacaagagctagcggaagaagcgagcgctgaatgctcatcgagagccgccaa

SEQ ID NO: 2609 - DNA, 825 bp, Zea mays
cgtctgacaaaaatagacgggagcggggccaggcggtgcgacgcgaacggcttgtccagaacgaggcgcgcgttccgtttggtggcctcgtcgatctagactagacgggacggggaatggaaagggtggtggtgtggccatcagcaaatattattgtccgacctatttgtatcatcatctttccgtcaggttttaaagtatcctggccctgagccatgggtttattttataccaacaggttttaaaacgacttgccatcggaatattcagctgcacgagtcttattttacaggagacgagatgcagaaaattgcatgccgattgccgaagacctagtctaatctccgtacctatagaccagcagatatacgcagcagacatactgttattgagctactcttgagtcttgggctcttggccgctagtcttggtggaaatgtttgagttgttccttgttgatcatgttctgccggtcttcctttcatcagattccccaacattccttgcggaatgtggagctgtttgccttaggcaactgtgcgatttccagcttagatcacttatcaaagaaatgttagttcgtgagctacgagcacccgcacccgctgacccacgtcgattttgacccaattcatcgcaacgacttcggtaggcagaggtaggcgaggcgaagaaagaccaaccttggtatcatcgccggcctaatatcgaccccctgttctactacacaaggggtgaaacgggaacgcttacccgtcctccccgcctggaacccatcgcctccactgtgcccgacgccgcgcccgattccaccggccgacaacg

SEQ ID NO: 2610 - DNA, 255 bp, Zea mays
gcacgccgccgtagcggtaggcgagctcctctccgagtacgttgcaccagccggggggtctggctcctcaactgatggcaacggggaattccccgccggggaatagctccccatccccgtccccgcgacgaaaaaacttccccgcggggatccccacgaacgcttgcggggagcatttcttccccatccccgttccccgcggggataaatccccaacggggatccccatccccgtttaaattacaattaagacat

SEQ ID NO: 2611 - DNA, 1500 bp, Zea mays
tttaactcattttttccaaacctaattggctttaactaatatgtaaaccatgtgttcatttttttcgcttagtatctgaaaaaataattatgtaatttgacgtgcgtttagtatcttatgaacaaaattacatctcgtaatactcagtccataccgaagtcaagaaaataactatctatattcatatatggaccatctatatatgaaattactgcaggtactttttattaattagatactaggataatatattttgatattgacgctctagatattctatcattgaaggagcaatcatgccaaaatattagagcctccttggcagggttttaaattaacttcggctcagtgctagttctacaagtctacaacacacggtagacaagtgggtgaaacccctagatcacgagcttctccatctttccaatgtatgtggggaaaggaaagaagatttttgttgacctaaattatgtaaaccatgtattcatcgtaggagcaagcatgcccaaaagacgctataatgcatgtcaaaagaaactgaagcttgaaaaaccggctgccaaagagtttgcttattttttacgtaaactatttacgcttaattattatataatttaaacagattataacacgaagcaaataagcgctaaaagcaacacagcctgccacaggatattttgcagacctcacggttacaacacttgaatccaacacagatagtctacagattggcaaacagatataccaaaacccaacgcaagcatttcccaagtgtggccataactctttcaccaaaatgcagaatcgcacatggacacgagttggaaaggaggtcaggttgctttattagttgagcacacataaaaaaaaatttagcagaaatttgagaattccatcgtaagcaagcaatcaaagccgagagtgacagacgcttgatcactctctgcaaacagtgctgaccgccaaggcaaccaacctttcctgcttcccagtcccagcccaactcttcgcaaatagccggagaatattagaccctcgctacacgacaaagcgcctgccggggtctgcgccccgcttgactccactagcgagatgcccatcgcctcgcctgtgcccgcgtgtacgacgacgatgcctccacgccacgctcaccgtcccggtgagctcacctcccctagttaatgcaccgctcttgcgagtcatggctccctctttgcttgcgtgtattccccgtcctttttagcggcttctccgactccttccgatcctctcgcctcgtctccgtcgtcagtcgcctagctagcttccctcacaagcagcaaggcgggagcgaacacgccggcgaccgttagctcgacgcctcgaccgacctccgcgccgtcgctccgcccttgcaaagccgcagccgcgcgcttttatgctcgcggcagctcggtttgtggtctctactagcggtatcctctcgccctcggacctttctgcgaaagcgaagattccggt

SEQ ID NO: 2612 - DNA, 1500 bp, Zea mays
gcggccatcatcgtcattgcattgggggcgtaaaaccaggttggctaattaatcaaaaatcagtagtaagacccacaccgatgtgatatgcgctcaattaagcaaccatttccttggagccaaaaccatcgccgcggcaggccggccggctggttaatttatgtcacgtacggaggggtggcaccaaattaattaggcagccaacaaagcttcaattggtagcaagataccaccaccggtcacaataatccaagcaaggaagcaaggctttttttgttgtcgtgccaacccccagcccgcaaatcgcaggcaccctatgtgcgtgctgcatgccgcagccttgcatatgcatgccatgttggtgccatgccaaaactatctgagcaagctccatgtccatgtcaccaaccctagctatatatgtgactgctggtggtgttaccaaaccaaccatatatatcaggacagaaggaacaaacctctgatggcccccacgctctctctctctctttccctcctttgtcatctgggactgggaaataagaccatcaacgaataaataaaccaagcaaagccaagccaagaagaatgcaaatcactatatacatctttaaagtgtgagtttcgccgtgcgtcgcttcctcgtgagctcaacgagagtcgtatgaggatatatcgcgatatagctgaatatattaagctaaacaacgtaactttttgctgctaaaaaggatatatcaggatatatcgaccattagagctagctattaaaaaccttgcttctaaccacttcagctagtgttagtttgttctatataaatgataaatactataaatattccattagctgctttgatgcgtgacaggagagagagaaaagaagaaatttaaggctgtcaaagatatagcacacactaaccagaatcattaatgggcccaaccatcagtgcccccaccacctctggtttgtccactctctctctctctctttaaaattgaaggaaattggaacgaaagaaaaaaaacaaatatttgcttcaaaagctgagcgaggaggagagaggaaaagatgatgagaggagagagagagtggggcaaaaaaaacgacaggagagagagaaagtgtggagggagtatcaagaaaggagaggctttgcgtccaagcgtgctccccttgaagcaaccctcctccggtcagcggcgctgttgaccgtgtgcaggcgcggcgccagcgccacacctccaaatccaatctcgcaacggaacggagtgagtggagaacggctcttcccttcctcgcacgtcgcaccccacgaggccacgaccctgtcctcctcatcgcccgccttgcattgggcctcctatatatggctgcccctcctctccaccctcgccattacggacacacgggcaccccgtctcctcttctttctctgtgtctctgtctcctcaccaaagaaccgcaactaggaacggctcgccacagaagaacgtacggct

SEQ ID NO: 2613 - DNA, 366 bp, Zea mays
cgtccccggctccacagctacggtctccactcgcaggctcggtcgcaggcgtcgccgccctcgcttccgcctctcgtctcgctcgagtcccccgaccagcgcgccctccgcaacgccgccgacgtgggctacttccacctcgccggccacggcatcccttcggggctaccgtcgtccgcgctcgccgagctgtcccggatcgacgcgtccacgcgcctggagtctaatcttcgcacgctcggcttctccgtggaggaaggggaagagcaggatgtggacggcggcgccgacgatcccgcggtagtgttcgacgcytgcgagggggacttggacgcgctcccggctgcggcggagtacgcgcgtcgg

SEQ ID NO: 2614 - DNA, 680 bp, Zea mays
tattaggtttgtatgactttttatgagttttattaggtctgtatatactttttattaggtttctaagacctagtctgacttagttcaaagccactaggttggggctgttgtgatggttttcggtttgttctctattaaatataactgataatatctctattgaaatctagctataaattaaaacataaaaataaatataataccaacgatatagtacctttgactcggtggcacaccagcagcagctctcaccgcagcgcggcacgaggacgccgggacaccaagcggggaagacaaggtaacaagacggacacgcctcccccgcctcggtacactccaaatccaccacccaacccgtgcgcaaacaggcacgaaacgcagcctctgcttcacaagaccgctcgaaaaaagtcctataaaacgacgcgcccctccttcccggcagctgtagctcctccagtccttctgctacacagaaacgccatcgcctccgcccaaaaaacagcctccacacacgacctaaatcttttcctgcccacgggcgactcccaaacccaacagcagcaagaaagccaaggaaaacactcatttccttcttccttccttctctaccatatagccaagaaccgaaggtagcttgcgacttggcaagctacaagttgggcgattcaagcagcagg

SEQ ID NO: 2615 - DNA, 173 bp, Zea mays
ggtgcttcactaggaaaaaatgaagtaccttagttaagttttgtaacaaggatatttgatcagtgcatgtcaaaggagggtatcaaaccaacgtgtcatatgactgtctagcttatgaatgttgctcctgttttatcacccctgaaggccaagcacacaatcatcctttattg

SEQ ID NO: 2616 - DNA, 1500 bp, Zea mays
ctcactcatgcaatcgccaccctgtggtcaacccctcccctcccgccattgttgccgtcgtcgccgacccatctactcttctcctcgagatagtagcattagcatgggctacatgctatgatccaagagagggggaaatggtgacgacgatggcgcgagaggagaggttgacgacgktaacgacgacgggagaggagaggttgacggcagcggcgatggcggcgcgagtgagggggagggggccgggggcgacgggggcaggggagggatgtctgatgatctaaacaatattgttcaataggtttgagtggagagtgaaagttatacaacgatctgaactgttggtttgggtggtgtgtttcatctaggtataatttgtttggtggatttagtgaagcttatgggtgtggggtgatttagttggatgggttttatttgcaaagtttaatctgatagatttatatactagtataaattaaatgaagtgtgtgcaaataatataatatgttaataaaaatagttataataaactagtgcacaacatatacatataaattaaaattagtggtggttcgtcttgcatatggataaaatgagaataaataagttcatctaaaaatatatagtttgaaaataaaacattttttatcatagatagaaaacatctcagattgaataaattgtaagtttgattcacttcccacaaaataaagtacttgcgtgtcacaaaatatcattcatctgacatgtggcttttctctctggaattatcttctttagcactcattgggaaatctttgagtacactcgtagcctgacctactatcttatagtatgtctgattgattttaatccatattgatttctactacttatacagtggtttatctttataaattgcagttgcagcayaactaactttaatttgaagcgaagactttaatttgaagcgaacaaatgtgytatagttttcacccttgaagcacaagtgctgtggtcacttaaaatttttaccggaaagcaaattgtaaaatcaatgactgaggtgccgtctgtttcacatattggtaatgtaatgcgtaaccgataatgttaaatcatgtttgtttaagtccaaccgtaatcgatatcacactacaaatatatattgtcttatttaaatttgttaacgccratattcgagtgtgaatcgttattattaccatttatgttacatttcgtgaaccaaatggtatattagttgtattttatatttgaagatctatgtcggtatctatattgtacatgctctaagtgtcggttagtgcgagtgctttgctgcgtggcacgtttagccataaatacccccaactgctggtgcctaccgaactcacgagcaaagcaaaggctccaaacttactcgtcgccctcaaaaaccacgctaatcagtgccaaaacgcaaataacgcgagggagaagaagagacagaaacagtaagggtttgactgtttggctaacgtc

SEQ ID NO: 2617 - DNA, 247 bp, Zea mays
ggtttgtggtttggaattctgttacctagtaacacaatttgaatttttgggagtataattctaattctcatttctaactctttgccccagggagtcgcaagcactgatggtatgctcacaattcagtatccgggattcatatctatcatagttgacaacacatatatatttacttgtagcatccaggcaattattttcccctgtagcagcttaagtttcctgtacatagcgcaagttctggattcat

SEQ ID NO: 2618 - DNA, 388 bp, Zea mays
cgtacgatactttaatactattgtttaaggtatgcagtcaaatcgattaaactacacagggatctcataagatttgttttcaggcttatgctatgctatacaagcatgacatgacatattatcattggatcggtgttttcacggttagttcctatcatcagttcgtcacccatttgaaccttgctggcaagtctatttgtcgtttaattggtctkggggcgattgctgcatcagccaaaaaactctttcccaacatcaccagcaagcatgtataaattagtttttgctcaatcacgcgtcagaaatgtataaaatagttagatgagggacgtttctgcgccattcttgcctacccttctcgctcagtgaagcacgagcgaggtcagta

SEQ ID NO: 2619 - DNA, 1247 bp, Zea mays
cttgcatgcctgcagtagattttggtagctagaagttgaaaaaaagtctaaacaaacagtaccactgaaagatagcatctctctattgacggacggcgagaggctagtcgaagccggcctaagttgtggagcaaacgagaggcttggccgctagggaatctccagcttctgctgcgggtcgagaggtgacaaaacttgaccaacctctccgctccaccttggttcctggtctagcaaagcgcgacagagaaccttcctgcaagcatccttctattccttttaattcacgacaggacaacccacagccttgaaccccatccaattggaaggaaggagtaggctctagaacaaaagttcgcgaacaaaatgttagatccacgtgactacgctgcgttgaccgttgtgaattgcggtatacgggagcgtaaaaactttgtgctttgatgagtttctctggcctacgtgtatgcataatctttgatgtttatttttctcaacagaaaataataacctttggcgaggagccgggtactagcaggaaagagctaatgtgacgattcaggacctagagttagggcggaacgagccgaattgagtcaaacttagctcagctcgttgtgacttgatcgcgtacatgccgaacttaagtaacgaaccgagttcggctcgttcctctaacaagtctgaaaagtgggcttggttcggattgcgagttggctcaccgaaccaactagtctgaccataagctcatcagactcgttctaagtgcctagccgttcgaaaccgagacgttgcaagcctgagttgactcgtggagctcaagtttattttccagacctccctagcgtttaggacgccaggcgggtggccctacaaaaattcctccacgccgtcgcgtcaccaaagcaagggtgggaggtgggacggtgggtcgtcgagcccctccaacatgagtccgagtccaccagaccaccggctggtccaaccccaaggaggcagagaccaaacgacgcgccggcacacgcaaaccaacgactcgcgccgatgtttccgcgttgctcccccgcactcctgctcggctgctccgctcgccgcttttatatgcggcctggcccggctcagttggtcagtcctcgacgcacgcacgcccgcgcgcctcggcaaaccaccgcgcccgccagccatactgagctccgccctggttccattccacccagagaggctccaagattgacgccgcgaccacg

SEQ ID NO: 2620 - DNA, 603 bp, Zea mays
agtaagttataaaaaagagtgtcaaactctttagttaagataaaatataatattattcttttgtcaatatacgtgcattatactgctgctctactatattttctatttttatttattatattttagtttaaaaatgaacttaacaaatgttcgagaagatagtgccacgtcatgtaccgtatgttgctaatcggacggcacgcagaccgcgccccctcgtgtgaatctgatgatctgtcagattccccaccttcctcggctcctcgcggctcgcgagactcgcggctaccaaccagtaccaccaccgggagaccgggcaccgctcgcaacctccgtccacgccacggctactattcacttcacttgttaccgcgcgcggcgcgcctaccactactctctactcatcactccccagcgggcggccacgcgcacgcacccataaaagtcctcgctccaccccctccaactcccgtcccctctccctccctccttccccgccgccgccgccgccatccaccaggtcagctccagcggacgacgtctcaacagtctcgcgccactgagatctcgccgagggagggagagcagcaggcagcagcagac

SEQ ID NO: 2621 - DNA, 339 bp, Zea mays
cgactagaaaaggcaccatcaagttcatcacaacgcaaaggacagaaataacaaaaaagagaggaaaagggaaaataaaatcgttttggtttcttccctctccgttgtcgtatcggcgcggctgcccccaccacctcccccctccatctcgctctcgctctcgctccgcccctctctccctctctcattggccattccgcccgcatgaaaccccaaaccctcgccggcatcgccgtcgccgcagcagcgcccgcgtagcccgcccctctcgccctcgccccccctccccgcgccccgatcccgcccgctccgcagccgatcctgccgggagcacgaccg

SEQ ID NO: 2622 - DNA, 888 bp, Zea mays
ctaactctagccatggacttttttcttcggtctattagcttgagtgctatgttaggttgctaccaagacaaaatacactcacttgtgagtgttgaagttggattttgttcctttagggctagcttgaaacttaaatcccctccagagtttttggggattgagtgaaaaatgagctattttcctactcaatcttcgagaattatagagggaatttaagtttttaaactagccattgtctaaaaaatgtcatcttcttccccgtgtctaactcggccatgtcgctcgtgctaggggaggttcgactgttgtaacacccaaaatttctattttgagaatcaattaaatttctttaaaaatatttgaattaattcttttatgtgtattatactgctaaaaatatcttcttcttctcggccgtacaagtaggtcgctttccaatatatattctcgttttacaatattttcaacgcattttttccttttattaaggtccaagtaataagtagtagtaccggtggggaaagagaaagagagagaagcgcggccgcagcgagcagcgtcgtcagcggttggggcgcggacgagagtgagaggctgacgaggtgggcccgtgcgagccttgaccaatcggagttcgacagcagcctgcccccaaacccacgcacgctcatcacacagacacacacactctctgtgtctctcgcgtcgcgcccggccgtcgcctcccctccctccctgcaccgaccgatccctcccctgaacccctcctcacatcctaccacctctttaaagctacccagctacctgcctgcctcgcctcaacctcgccggcggccgcagccgcatagaccggaagagaaaggaagcagagatcggaggcaggcgaag

SEQ ID NO: 2623 - DNA, 1500 bp, Zea mays
gtgctggaaatttcagatttatgtgttgtgttcaaaaaatcatatctcaagttttaaagctccaaaaatcacgaaatttgttttgttggcttccttatgaaattctctaactattggatttataggttggcatgttttagtggaaaagtttttctgtagaaattcgtaattaaaaactggtttagagaataaacgaacttgcttctctccataattttatttataaaaatccaaaaatgatgaaacctattttgttagttagatgttgtcatactccatcaagaaaaaatacaaatcttatatgttgttcacagttttcttggtgtgttaattaaaacaagttaaatagagaaaagaagattgatttgcttgttatttttggatctgtagctccattgctccaaatgggttgacatgtttacagtagactcttggcgtgatgcttggtgactggtaaaaatttcatgaattgttgtgcatgtatgattaagttagtgatttaacttgtttaatgcaccttaagtagttttaaatgatttataaaacatatatggatgtaaaaatggaaaatgatgttccactggtccttgtatgatattatagtagcctaagaaaacttgatatggtcatgcatccacataaaataattagttttagatttaaccttgtctcacatgccttattgcaccaacaatttgttatttttgtagtaaataaaatataaaacctgggcatgtgaaatttatacattagtcataatttgttgttaactatgcctcataaaaatgtcagccccaaattaaatagtttcatatggtgctaaaataacacccatttctctactaatctataagagtctagtgtgggcgtccacaccctcaccgtgcccccgcctccctctcccgtcgccgcgcatgcacaccccgcctcccaggtcccagcaaaatctccggcgcatggggaccgccgccgccggccgccccacccgacacctctctgattctctccctctatataacctgacctgatctcaaggtgctgctcgaagctaccctaaaccgccgccgccgccgccgccgattgctcgagctcgcttctttacggcggttctgcatctgcgtgctgatatcttcttgtcatgttctctcgttctgtgcttctctgttttttccctattcttctctcaactgtgcgagggattggttcgtagctcgggctgatgatgatttggatccgagaggatcttagcggatttcggtgaggcggatacttccgccgctgatcgccttatgttgttacacacactgaagcccccccttcgatgcgtctatcagatgggttcttttcccgtttcgtctctctcgctagatttctcactgggtggctgctgcaatgygatgatgattcaatacatggttttggcagtggttaccccttgtggtcaccgtgagccgtcaaacctgaaaacgacttctctttcyactgagcattgcgaaaaaa

SEQ ID NO: 2624 - DNA, 483 bp, Zea mays
gaatgttcttttacacacatatatatatatatatatatatatatatatatatatatatatatatatatatatatatatactccatacgccgcaacaatctctacagttttcagtaataatattactaactagctagtggctttggtgcctccacgtagtcaatgcaacaggtttgttggcggctatggttcctcatttatttcattcttatcaagtcagcatttctttcctgtttcaagaaattaataaatatataggagcacaagttaaatactattccttttttgatgtgtcgttctcgtccctcttgtgctactcgctatctataaatttgcaagacagagcctcatatttgccgcaacaagcatatatatcaccaaagctggacgaagcaaaccgagccaaaacgacgtgtccagacacgaaaatacacagcatagcagtcgtcgtatagatatacagtgaacaagtgatcgttggtcc

SEQ ID NO: 2625 - DNA, 370 bp, Zea mays
gatttcttataggttcggtaaaatcaaaaaattgacttaaacaacttcaagaatctatatcaagcacagagggagtttatatatatcaagcacagagggagtttatagcagtagtaattaatcgctttaatttggcacggtgcaaaaatgtgaagtctcgcaggccaaaacccaaatggtcccccatgattttagaaaatatgaccataaaaccctccgaacccactccgccgcaacccactagctgctctggctcccccgaggcaatcgagtaatcgacgaaggccaccaccacctccacaccactttgcctcgagaaggttccaccaagcctctcggctagggtttggggactttgggggcgatcgca

SEQ ID NO: 2626 - DNA, 1050 bp, Zea mays
cccctgatgtggatctaatcgaaaaataacacatcctaacaacaagtttaatactcgagattatggtgggttctaatcctgatcatgtgatctgcagctaacaataaacatattcatatactaaagtcgactctaatgttggcttttagacgaatcatacgtctatttctctttcattcttttgtcttgaaatccatgtaccacctagctattgtataagagcgaactatctttactttgttatgtctctctctcccacattagcaaaattgccatagaagtatgcttagagctcactattgaacttgctatagtttatctcaccactagtacttggtcccacacgtaatacgctcagtttcttagaatatgtgaaaacttatatctatttgctcgtcgctagctattcttgttttccccatattttctacccacgtagtaaagagagtgaatctagctagtgaatagctagccattggagacgccctaagactatctctaacaaactagccaaatggctcgtcaacccaaattttagctactcaacagcaaaataactctccaacataccagctatctgactcgccaagctattcgagccaaacttggctagccacctgactagtcaaactagatagaaagtctgttaaagggagaatgtgagatgctacgtatagagtgtaatctttatgaaaagataaatcgagagaaaaaataaagagtctcttgaagatgtttacttaatttacgctctgattgcctatcgaaacaaaaagtcgatgccttcgattttgtctttgggcgctatcattatagacatggaccccccacctttagcatgtggtcctctatcaatcagtctagcaatatcccggaaacattaacacgttcatttatggactttgacattctcaaggaagttctgatgcacccaagtttattaatgtgttttgcttcagttgctgcataaccataggtcgtgctctttatgcagatttcactccgtctcgtggcagcacacccgtctaccagcccagagcgcagacggtg

SEQ ID NO: 2627 - DNA, 356 bp, Zea mays
ggtcgaaatgactgttctgtgacactttccccccaatcccatcaatcccggtacgcacctcacccgtttcacctatcatctgtttattttgtacccagttaactgaaggttttccaagttttgtgcagatttgatttttatttgaacacaagatgggattgtaatctcggttgctgttctgtgcctcttaggttttcctccgtcctggatttggaagggaggaactcttggatttctgtctccatggcgcacgaattgtagtttccagaatcttactttgtagatttagtgtaaataatagtgatagcagctggtgacgaatctcgggtttccttagtagctgtcaccctgtgaat

SEQ ID NO: 2628 - DNA, 232 bp, Zea mays
gtaaataaactcgcagggtggcacctggtgtattttcatagtgaatacccgtgctcctgttggatatcacaagtatagctggatgtatacataggttttctcctttttttttgttacttctccggtcttatgtggggctatgctttcagctgcacgtttttgtcgaagtaatacctggattggctggatatgtacatcttgagaacggattgactaacaagctccctgaatt

SEQ ID NO: 2629 - DNA, 1500 bp, Zea mays
tcattaacatccatttgaacatagacataaaaataaaaagctcaaaggactaatattttgggacggagggagtacaaaagaaccaggacatgcctcaagctatatggtggtttctttgtttctgtttgaggaaaatagatattggtctccgacaacagaacaaactctattgctccctccattccaaattataagacgttttaacttttctacatgcacagattttttttctagaatgcgcaggagagctgcgcatcattatattaagaagaagagaggtccgaaatagctgttgggcttgggcacacgaagactgcccctcgaagacacaaacgttccgatgtttccacagccaccaagcgactaagatgacagctgaattgaagcctttgcgctgacttttgtccacctgctgctctgcattcctccaccagtcctggaaaacatgatcatgaggttgaggagtcaagacttgccagcccattggggaaaagacatgccaccagatttgtctagtaaatacacaagacactaaaagcggtgttgcatcatctcctcctcctggtcacaaagaggacaactctcaggatggtcaagccctcgtcgtgccagacgatcagccgtccagcacctattatgagtagcaagccagataaagaatttacaccttggtggtgcccaacatttccatattctttggcaaggttcaaatccaacagaaccttcaaaaaaccttttgtatgctgatttggaggagtaaattcctgagggtgctggtgtctagagatggtggtctggcaccccgggcatgagttgaatgccaagcaaaacatcccagagccagagaaactcaatcaaggcttgcacatgtagaccacccctaatatccttgatccactgcctatttagcaaggcatccttgactgtcctttctttgaaaaccctctttgggatgagcagggagagatctggagccaattggtccacggagcccccgtgcagacatttgtccgtccagaaatgagtactttccccattcccaaccgaagtcaccaccgagattgcaaacatagcagcagcatttggatgcacctgaatatctaaccccgaccaaggccgattaggttgagttttttttcaaccaaagccacatcatgttcaacacccaacctagagactccagattgtgaatgctcaaaccacctaggctctaggggtctgcaaactcggttccaattcactagacagtgaccccctttaatatctctccttcccttctataggaagcctctccttatcttgtcaattgccttaatcacccatttgggacattgtaaggcaatgaaatggtaaacaggcactgccgtgagaactgccttgacaagggttgcacgtcccacgggatgcattaaggctgctttccatcccattcaatgatcaacaaccttatccactaacggaatcaagtcatttttccttagtttcctgactgagagaggc

SEQ ID NO: 2630 - DNA, 1500 bp, Zea mays
aagaagagggagctgttggagagcttaaaatatgatttcttctctaaaaacaggttttgggttggtttaggggacttcttggagatgctcttagacaatggcggatccagctgctatgcttagggtgtacccgaaaaaatataaaaaacaaacaaaaaaacatgagtcatcaagacttgaaccttggctaccaagttcaagatatagcacttacaccactatgctaactactcttatgtaattttagggtgtgccgtggcccatatggaccacccgctggattcgcccctgctattagagcaacttcaagagactaggtatatgattttgtaaaggtaaatttagctaatattaaaagaaaattgtatccaatagactcggtaaacgactcttcaaatttagtggctctctattttctccatcttcgctctccaattttggatagcctccttcactctctattcagtctgtaggtttaccgagtctgttggattagcctacactttttctttaaaatctgttttagaaagtagctaaatcagtaaatttggctaatctttttaactaatctcttggagttgctcttagaccaactccaacagaatccctctccgcatccttattttatgtgacaacagtcaacatgctccatattttacacggtcgtccaacagactctatatccgtatccccatacctctcaatgacagttaggtcccgctttttaaatgccccggttttaacagaggagagagacaacgtaggaatacggaatagaaaaatgcacacctattttgcactgtggtttataaagtctgctggaggatgaaatagtggcttcggccgtgcagaatacgaatgagtagcgagtactgggcgttgctggagttgatcttactagactttagcgtctgcctttcgggatttattattaggacagctgagtactagactgttactctgccccgatgacycctgggccccgcggtggtgacgcatgatgacgcatggtatgcgccgccgcatttatttgggcggcctgagagtgagcgtggccaccgttccttgatgcattcgctcgctgcaaccgcgccggtcaaaaagcgaggcgcccggccgcagattttccgtaccaccggcctcttttccattccatcgactccacaccactgctcggttacgttgctttycagtcccagtgtagtcgtagtgtattgtgcacatgatgagttcagtatgcatctgcatgcggtagggtaggctcctttgactttgctgaccaagcgacgtgcgctcttcctccaccaatccacctccaccatggcaccatcgcacgattcgcaccaccaacccccacctcgcgctataaaaccaactctcatcagggaggagacctcggcagcctactccactgagctcatcaagtcacgcaccgcactcactcagctcggctcagctctctgagtcactctgaccacgtacgtacgagcgaacaaggca

SEQ ID NO: 2631 - DNA, 505 bp, Zea mays
gattccccaacttagttttttttcttggtttatgttgaactttatgcacctgagataaatgatgactagacaaactagttagttcatgtggtttgtgatgcaaacaccaaaatcgattataggaaatgattataatagctattgggaacttgtaactgcatagaaacatgttggattgcaactgctggtaaaccacaagcttaacttgcacattaaaccaaacggacgggaacacgtacacgcgcacatgagcgcagtcatgtaattttcaggggacacgtcaagttgcataaaataatcaagttagatccaaaatttcatcgtctggccttgaatttttttctagtgaagtacggaagaaataactcgggggcaaatggtgaatcggaaggaaggaatctctttggaaataatatcttcttccgcttccctatatatttacttaatccacttgctcctcttccatacgcgcgtcctgtgacactggactgaaatcctcaaaacc

SEQ ID NO: 2632 - DNA, 762 bp, Zea mays
aagataaaccttaaattcaacctgtattttcccagatgatagatataaaacgagtgctggttactcacgtctgctaccaattctagacatacccctgcccagtcgctctgctttgagagagagcagcagcagcaactgaaagtaacctcacagtcacagcacaagtcgagcaaaactgcaagagcaaatcctccagggcacgggactgacggctgattagccggctggaatgctcccgtctctcgccatcattccgcccagggctgccgcctgattggccgtcttcgctcggaaccgaccatcactgcccatcggaaaggcgccctccacgcaaaaccacatggaaagtcgccggtggatcgcaaagcggttgctgaaaaggcccggccacacagcgcacgtcctcgccggcgctcctgccggtgccggtgccggtgccggggctaagtaaccaccggaacgggcgcgcgacccgtgtcgggtcggccgcgttcgtttgattcggttataatagagtattagtttattactaaatgaaatgatggcatgcatgtggttagccaggttgacagaagtcacagaacgcactgctcgactctagctgttccaggcggcgagacgcaagcgcaagcgcaagcgttttgttggcgaggctacaaaaggctgctccaggccagccgtctcgttccagttccattcaagcgcactgctggactccaactcgactgctctgcgtagcggagtaggctgatcagaggcgag

SEQ ID NO: 2633 - DNA, 1052 bp, Zea mays
cgaatggctgccttggcatggtgggctttttgaatgtcattaattcttgcactggctctcgcgccccgcgcccacaaaaacaaacaggatggctcatgtgagagagagacaggcaggaccgcagcacggcggtgccggggagcgcgcagcatgccctgcgttaggaagttgtcgtaccactgtgatcggcctgcgcgagaaaggcagagagacgaggaggaagaagaacaggagacgagagcgacacgccgtttggttcgtcggctcagtgaccgtcgatggtgtcttaatcgaatctcaggtctcataattgtctgcctttccaaacaggcgagaatggtactgtcttcttcctattttgtttaagcccacctcttgctttccattttagtgaagtctaacctgctgttttctacaatcgcaataatctcgaatttggagggtgtcctgtatcttttttagtaaaggaggcatgcatatgagtcatgagtgacaggaaacatctggttttgtgtagactattgcattttgaagtgtattttatctatttaggctacattaatgattcttgaaaagtatactttttatggttgtccaaggattgggagctctaacatgcctttacataactcttttttcttgtttctttgcagggcttgggtaaataattgacacatctcccttgtaattgcatgtgatttttgttaagatgagttyacaaaataaagttttttcaaatactggagatgcatgttcagtgttacctagtaaagtcacgtcattaaatcccaatgcagcggagtttgtaccttcatctgttaaaccatctcttggaagcagtacagttccagatgtaactaagttagattttaggggttcttctggaaaaacaatcctagataggtctgaatcatcaaagtctaataactcagatgatgaggcacaccagttttggcgtaagcagcttcctgatgacattattccagacttcacttcttttgagaaagttgaacaagggcctgaataattgtcccttgctggattatctttga

SEQ ID NO: 2634 - DNA, 1500 bp, Zea mays
gtgtctgtcctagaggttcccgctggacacgctgtcctgttctgcatcactgagattgcactgcactggcggtgtggagcccttgcgctgttaggcattggtgtggctgggaacatcatgctccatgagccggcactgtgctgctggtgcagagctgcaagtttgcgtgagtatatcttatcaagcagacagtccacaacgaggcggcacttgtctggtgctggagggccagattagtgctgctaagctgattagccctgctattgtctgcaatatcggccgtagctgcatcggcggcaatatactgtatatcctagtgacaaccctctagaagcgctatggtggtgctatagcatgctatgtgaaacctggaaattaacgagggaactttgtccttttagatttgagtgctcgaaggcatgcaaagttccaaccatttttctttgaatttaaacatgatggtcgaatacattcacagttaaagctcttggaccagcactattacacttttgaattagttgctatttcacatttcattagttgtaggggcaactaattttggtcccacacagatcccatttaatgcacccgccttgatctgatttaattgatagcacaaaaatctgttgtgcatgtggcaaccactcccgtggcatttacgatgcctagcagacaggggaactcatcctctaccttatgttccttttctcctcatggttgctccagaattgccacattagtgtaatgtataccattcatactaaatgttgactcagcaagatgctctagttttccattttttaaataaaaatggtagatttatcactacaagcaaatgaccaaatttgaatacagattgactaacttgtatgctcctaagtgccccccaagtgaacgctgtacattatgctttctgtttttaccccattagtattttccttttttttgttctgtgcgtgtcatatggtcacgttagcatgaattttcataaagctaggctgagggcaagttttgatgggctatcgttgtttgacacttgagcagaccatatgcatgattggagttgtggaaaggtacaaagagctctcgaagttcaacctaaggcagctgacctcaccggagtcggagaagtaagcctatgagtgacaaaatcttccaggcaaaacgtggaccaacttaaatcagcagcagcgtcaggtggttaggcgctagcgaattaaattaaggccggccgaacctcactgtcttgaaagattcagatgttctaatgtttaatgctttaccaccagtggttagtggttgctggttcatgcttcccaggttagagtcacgatttttttttttgaggctgtagaaagatctgacgatacttcatgtgtgctttctctctgacgatggttccatacaggggcttaccaaagacgtagaatctatcgttgcagctccattgctctgagcatttctatagcttgaataaatctgcgtgctaggtttctatgc

SEQ ID NO: 2635 - DNA, 1500 bp, Zea mays
aatgtaggaatagaaaaatgtaggaatggagttgcatgacaattacaatcctacaggaattaaaaatacagaaaaacttctaaatagtatatttggatacaacatagaaagaacatatgaattacagagaagagataggcacaaaggaaagtttccaagaggttggacctcttgttagaaatcctccaaaatctcactacaatgagcaatcccataggcattttatacgatttgtaggaactcaatcctttgttccaaaggactacataggaaaattttctatatgattcaaatcctctwaaattcctctactttccctttgttccaaatggggcctaaacttgcacgcaaccatgttttcgtgtaatagttaattataaaaataaataattgcagatcactctttgtacaaatgtgtttattttgatatacatataatgattgcttacatctaaatgtgtataagtgataacattttgcattaataacaaagcaagtacatcatagtcataatttaagcggagatggggatcccgtcgggaatttatcgccacggggaattccacattaccatccccatatacaactacatctattgatattgtttctgtgcaactataagtcccctatgcatggtgaaaggcaaaatttgcatcactttccttgattgtctgttgcttgctatgtgtgtcggggaccataattaggggtaccctcaaggcccctaaatctcagctggtaacccccatcagcacaaagctgcaaaggcctgatgggtgcgattaaatcatggatcggtccattcaagggacacgatcgtgcctcgcccgagcctagcctcgggcaagggaagccaaccccggagaacctacgtctcgcccgaggacccccctccagcagcgggcacactatcggctcgcccgaggcccagtcttcactgagaagcaaccttggccacatcgccacgctgaccgaccaaatcgaggggcatttaatgcaaaggtggcctgacacctttatcctgacgcacgccctccagtcgacaggaccgaagtgaccgcagtcacttcgccgctccactgaccggtctgacaagaggacagcgccgcctgcgccgctccgactgttgagccaccccacagagtgaggctgacagcagccaaggtcggcctcgggcgtcataggaaactccgcctcgcccgaccccagggctcggactcgggctcagccccggaagacggcgaactccgctccgcccgacccagggctcggactcgggctcagccccggaagacggcgaactccactccgcccgacctagggctcggactcgggctcagccccggaagacgacgaactccacttcgcccgaccccagggctcggactcgggctcagccctagaagatggcgaactccgctccgcccgacccagggctcggactcgggctcagccccggaagacgacgaactccgcttcgcccgaccccagggctcggac

SEQ ID NO: 2636 - DNA, 430 bp, Zea mays
tccaacagttgatcgatcgggattcatcttgttcttcctggatgcttttctcggtctgtctttgatgcgtgtcttgctggtgtgatgggcttctcaaacctgtctgtcgcgtcactgtcagcgcccttgcgctctcaaagaggagcgagcgccgaagctggctggagctctcggggtctgaaacttttcttcccacaaatgtatagcgagggttcagatctcaaagcatataataatgcgaagacagctagtcacctgctcttgtactgcactgcactccaggcctcagtgcctgcatgggggagtcttcaccgggtgtccgggtcccctactccgtctcctgacctataaaacacatacaagaagagagcgtgactaaccagtaaccaacctccattgcaggcaggcacatcactagctagtacagaaa

SEQ ID NO: 2637 - DNA, 590 bp, Zea mays
acagaatcaatttgttttcaccggaaaaatatatgaagggcttgtttgggtgtattcaccttaatacacatgggttggggacctcaatccactccaagccatatgtattggagtgaatattagattatctatacataactgaaattggaaaatttctcgtgtttcaaaggagatctaaggattagtttgaaaacttcatttttacaagggattcatatttgaaaaagaaaaactaactaattttccttaaaaatagatttttttaaaaaaaatgggttcctaaactaaccctaaatgtaaaataaggatgtattggtttatagaataaaagttagggaataaacgtcaatccatataaaccaaacaagctcctaagtaaacaaacaagaaaagacagccattgccaactactaaacccttgcggcagcgccccaaggcgcgccgccaccagagccccgagccacgacgcctccaaatcgatagggttttcgctgccccgctagcccgccgcctcctcctccgccagcgcgcccggtcgcagtaaaaggaggccaccaggcggcgaccagaataagcttcaggcgggagga

SEQ ID NO: 2638 - DNA, 1500 bp, Zea mays
acacgttcctcagttggcagttagaatttaaagggagaattggtgttatgaagttgaagttagtgctgcagaatcatttcttatgtggatgtaaatatgtacgtgaaaaatttattgtggcactgcttatataaaaatactagatctgccactggacataccatcaagcgaagagatcaaacacgatccttccttccatcagctggtcgtagctttgccatgcgtctgcgttgccgtaagccaagcacacgcgtcggcccctcacatggatggcgatgacgaaacggagcggcagttggcaccggtcagcagacaagacaaaagacgcggaaggtccccgtcagtccatgtccatcaggctggctttgacagcaccgaccccggtcaggcggccacgactccctgtcccgttaaatcaccgtcctcctgccgtgctgccaccactgccacggcggcacggcgcacggcacgtcacctgccgcggcggccgtgccagcccagctcagccagagtaaaacgcgcaggccgcctccgctgcgacgcactctgccgggctgcccggcactccgcttccgccaccgcctgccgccccaaagtccgagccacacccccgtgtggcagtggcagtggcaccacctcatttatggcggctacctccgctccacgtctcggtcccatcggcggatcggccggcctttcctcctctccccggccccttcctcgcttcagctagctgcagtgcagtcccgcccatctctgaccctgaccctgtgcgtagctggcttgcagctagctgctgctgtggcctttggatcaatctacaataaacgaaacaaataggccaccgcggaaccatacgttaccgttacgaacgtagagccggccgctttcttttccctgggctttctgttctaccgtcaaccgcgtcgtagctgtgctaaaattttatttcttgcaatgaatctagcaatgccatacattttaattcttatataaacttagtcaaatttaaacgatctgacaaaagtatattgtttcttttttctgacagaagagccaccggtcctagaatttaaatagtacgtggtgatgactctggcttcctaggcaccaggaagggcagttgtccggcgcgcaatgcaacaccagtcaacagacagccggtcgtcccataccaccgcattcaagcccactcgccccgcccggcgatctcatgcaagaaagcacctcgccggctcgcccctaataaatgcatggccctggtcccggctgcccgtcgatcgcccgtaataattgcagccagccatgctgcgggctgcccttcccttccccttgctctcgtcgacgtcggagcagcagcccagccagcaggtgaaaaatccggagcatttattatggccaccgggatccccctcggcctataaaaatccgtctcggctcctccccctcgcttctcgttcctgtcgccgcccgaggagagacggagagcgaccgaccgcc

SEQ ID NO: 2639 - DNA, 785 bp, Zea mays
cttgcccgaaccatgataaagacttgtgtctttttgcatcacccatatggacctgagcatgcaatattaattcgctagtcagtaggatcctcaggtcaaaacagaaaacacaaaatctcactcactcacacctcatgtccgcattgaccgtgcttatatataataaacaatttaaaacgcataatatattgagccaaaccacaaaaaactatgacatggtttacattgttgtatttcaacactatttctaaaaaatatgatatttttagagatgacattatcatgacaaatacaaaatataatattataaaaccatggttttgagaaaacaatgttgtagatagcctaggcaaaggttcagttgtcacaaaaagcaccaaagttaaatggggaggaacgaattctcttgtgggctctatctgaatgggccgcttggtggccgttgttttctcgcaggtaaacgggcatgaaggctgggccctggcccgtgctctcttcctcgtggtgggcgccgccacgacgcgtgttggtgttgggaggaccgaaccctcaccacccgctcccagtcgtgtcgccactcgccgccatccgctccgcaggtcacgtgaaaagcagtgcaggcgcaagggcaccgccgaggcagaaaagggcggataaactgcttgaactggaagcgaccctagtccaaaccaccgcaccgacaccgactccgagccccgccgcgccgcgctacctccgctcctctcttcgcccctgccggcgtcgaggccgaagcgaaggcgagc

SEQ ID NO: 2640 - DNA, 238 bp, Zea mays
ggtgcgtttcgtcgaactggaaaatggccacacacgcctgggaataccaataccaggtggcggtcagcggcaaagtcgccgcggtcggcggccgaatgttgcaaggggcctcgaaagtgatcatcggacaaatttttactcgcctgtcgcaacgggtcagcggccaagccatctccaccggctggtgggcgcgactgcgggcctcgcttggcgcgctgtttggcaagggaggtgcgca

SEQ ID NO: 2641 - DNA, 115 bp, Zea mays
ctctgtttcttgatcgctggatcgatcgattcttcagtacctacgcgtttcttggacgtgtttcctgacggacgcccacctttggttccccgcagagaagagcgccgccgcaggg

SEQ ID NO: 2642 - DNA, 248 bp, Zea mays
tgcagctaacaacaacctcccttgactcccattacccgtcgtcgttgcttctttctttgctcgttttccatttcattcccatacgcgcggcgtcataggtcatagcccaccagacagcaacgtctacgtgtcgcctcttcgccttctcgtccagtccagtactgcctattaattagggcgcgacacaggccaaagccaaagccctcccagtggtggtggagccgcagctagcacctagatagctagcc

SEQ ID NO: 2643 - DNA, 940 bp, Zea mays
ccccatgtgttgttaataaagtatgcatcatgttgagacttttgtttgtgcatatgttctgagacgatatgagtttacatcccttttcttacaaatctcaaggacgagatttctgttaagggggtaggatttgtaaggcccaaaatgtgtataataaaaaatataaataaacaaacaaataaaataaataaacaaatatatttaggatagtgttttgagaattgttggacccctgggaaaattcatttgggtcttttcttctcataatcaattaatggtacgaaataaattaagcaaccaataaataaagaaagaaaagtgcatcgctcactgatggctttgttgtgaggtactttatcaaacacataaatttgacctcaaagtataaatgaaagtacaattttagaatttgagaaaaaaagagagaaatactataaaatactagataaatttataaataaataaatttatcccatagtgtgatgattcaaatgatgcattcaaaattgagtaaaagattaccacaaaaatttgaatttaaatttggaatctaaaggtgaaaagaaaattagaaatagaaaataaaaagaataaaagctctagctgggccaatgttcctagtttgggcccagtaactaatctacagccgcgatcggccacgccaaccccgcactggcgggtaggccccatctaccagccggttgccgctcacacccgcgccgcgctgtgtgtctcgccgtcgggtgggccctatctgccagctcgttagcactcgccgccatgtgggccccttcgactgacaaaccttcttccccgcgaggatcggatcgcgttgacccgaatcgaccgtgacttcaggagcgcgcccacatgctcggattctgcgggttgcttccgtcgcggtgtataagtttgagaccatgccctttccccgttaccg

SEQ ID NO: 2644 - DNA, 460 bp, Zea mays
acttatatcgtttacgctttcctaacaattctgattcagtttggagccatccgtattccccacaaacagactatctccagcagaatattatattttatcttatatcttattccttattttaaatttatcatatacatatatttttcagtctaatgagtctcaccttcacctcacctcacctcacctcacctcatgcacaggccaagcgggcgcgcgaggctcgcgggaaacgcaaacgccaggctacgggcaccgatttgcacgtgctgcatccaacgaacctggtttgatgcccttgtcggcatcggggggcttcgcctacccgcatcacccaccctctccccgcttccctatccctcacgcagtcaggagatccccaattccccattcaccaatccccagtattgtagtagggggaaaaacgagagaaaagaaacagcagtagcggaggcaagacgaa

SEQ ID NO: 2645 - DNA, 1262 bp, Zea mays
tatatatatatatatatatatataaagataccgtaagatacaccatatgaaatgcatgaacaaattatttaacattacagcatggcgtgaaagggcataccataccatatgaaatgcatgaatgaataatttaacaacattacagcattgacagaataggtaggtcctatcagaaagtctatgattatggcgggggaaaagtagattttatcggaaagtctatggagaggcatgcgccagggtgttgctgcatccaagccacacgatccctatctgttccacggccacaggtgagcaaaagcggaaacactgaccacgagttcgtacttgaaagttgggtaaaatgatcattctgagtctcaactaataaaaagagccgaaaattagtatatgcaggtaagcatgtgattttttgttaagtttctacatccatgaatttgattttttttcccagcccaaggaccagtgccaagcagaacatgtccttcccacaagactacttgatgagtagctaccagtccgaatccaaatagaaacaaaggtagaaaaacgagacaacartaggcataagcaagtgagaaccattaacagagtttaggttattgcatctctaatattatatttaaaagtaatttttttctgacaactttaagaggttttgcccttggatcagcatgtcatcatgttcattttaaataagagaagcaacagagttccaaaaattgtatttccaacatctatgtacgatgaacgccgtctcagtcaaccaagtcatgggttcaaaatagcctctcctgcctcagtttactccactacaccccacaaaggtggaagactggcagtgggtctacctttatatgttacaaaagggaactaccaaaaccataggtacagcatgtacattatatttgaaccagataaagtctacatcagttgataaggttcctatggagaaaagaggatagtttttttttctgcacatcattatcttaagaagaggggtccaaaatagaccaacaatcaagggtcagcctaaagtaacttgccttctcatcttttcttcaatgttctctgcctctttggccaggtcaaccgtcgctacaaggtcttcaactcttaatccagaggggccgtgtaccgtgtccccatcaaattgcaaatgctgggtcgttcaattgcacatttgacgcataccatgtgcaagcccgattacaaaaacagtacactagcttagcgttccacattgttgatattcggaatat

SEQ ID NO: 2646 - DNA, 635 bp, Zea mays
actgcaaaaaccaaccatttcataagttaaaataacaccggcggaycagtaaaggacccgatatattttttccaaatacaagtagccccaaatagcttaagttcaggtttgggcgctcgggttcgcacagcagcaagggaagagaagggccggcatacctggcagtggcaggtgctgcaagggaagggtttagggtattgggcgtaggaggctagggtccccaatcgtcgccacgacgagacaggggtgaacgggaggagacgacgcaggcaggggtggtcctgtggaaatttgacggagagcttggagcggtcctttcaggcccggatgctgcttcggctagtgggccagcccatccgcgcggactgattgccgcgaaaaaaaccggtgacaaagtggcctaaaaatcacggtccaagaacaaactacggcccaaaaaaaggaaggagagctgctagtgcttttcttctcggcgagtctttctctttccccaccttcacttggccgtcctcccgagctgcggcggccgcatcgattgctagggtgaaaatccgttctccggcgattttgggctctcgggaacagacaggaggatccgcgggaaggattcggctgcgtcctagtgtagtgtcgac

SEQ ID NO: 2647 - DNA, 866 bp, Zea mays
cggccgccggtgagcttcacctggacgccyttgtcgacgaacttcgccaggtcgagtgcggtctccttgcgcccagcctgaccgtgaaacaaacggcaccgctcaacctcgcatcacgcgctaccaaacgagcggagtgttccccgcaagcggaaaaggggcgtcgacgcttaccatgtcgacactacactaggacgcagccgaatccttcccgcggatcctcctgtctgttcccgagagcccaaaatcgccggagaacggattttcaccctagcaatcgatgcggccgccgcagctcgggaggacggccaagtgaaggtggggaaagagaaagactcgccgagaagaaaagcactagcagctctccttcctttttttgggccgtagtttgttcttggaccgtgatttttaggccactttgtcaccggtttttttcgcggcaatcagtccgcgcggatgggctggcccactagccgaagcagcatccgggcctgaaaggaccgctccaagctctccgtcaaatttccacaggaccacccctgcctgcgtcgtctcctcccgttcacccctgtctcgtcgtggcgacgattggggaccctagcctcctacgcccaataccctaaacccttcccttgcagcacctgccactgccaggtatgccggcccttctcttcccttgctgctgtgcgaacccgagcgcccaaacctgaacttaagctatttggggctacttgtatttggaaaaaatatatcgggtcctttactgrtccgccggtgttattttaacttatgaaatggttggtttttgcagtgcattagatttacagcaacggattggtttggccaacacgttgagttcaggttca

SEQ ID NO: 2648 - DNA, 659 bp, Zea mays
tggtggtggttggccaatttgctccatcctcaccctaccccgcttgaccgcggcctgctatgcgcttggcgttgacccgctctatctaactttggcagctcatgcctcctgggacaagctgtggtgggctgcactgtcaccgccaccgctggcggcgacggctgggtgctgccttgttggatacaccaatcgggattgtcgcccattgcctatagaagtatgccgtgcatcttctttgagtaacaacgaaaggggctctagttgagttagttaggtggtctgagtatcactccttaggttctgagttagaatcctagtgggagcgaattttaggttgatgttaaaaaaggtcactcgttggttcccctggttgtgtgcacatgagatggactgacctatggggggcggatactcgtgtaggggctgggagggctcaaagcacgactgtacgagtaaagatctggtctataggggcggtctttcccctaccggtcgagttgttttattagagtttgtgcccatgtaatgcacacacatatatctgtaggtgatatttttctattcccatgggccgaattttttttgtttatgtgtaagtaatattttattggttgtaaaggtctaactattagtatttttggtgtctctttgcaggaatc

SEQ ID NO: 2649 - DNA, 1500 bp, Zea mays
cttcactttggaaatagtgtaaaatagtgttgtctacggttctgcctcctctattttacacgatatagcggagaggcatttttcatttcattatttcatatacaagatgtagcaattaatatatacgtaatgctacgatcctctatgttccatgtaaactatttatccgtttaaaatatgtctaaactaaatataattccttctgtagtacaacatcttagccaacaaataatcacgctcaagtaaactatattaattattccaatattaagtaatacaatgtatcaaataatccccatcacactgcatacaaaagcgtcgataggtggagcgagaaataagggtctgtttggttgggctgtggctgtgaaaaaagctgttgtgggctgtgagctgtgaaaaaagctgctgtgggctgtgaactgctaaaaagctaaaaaccgtttggtggaaaccactaaaagtcgctaaaaattcttccatatatattttcacagttccacctaaaagctgctaaaagcaggtccagaggtgcttttagttttgcactacaagaaagtcagcttttagaaaaagctgctttccaaatttagccctttggtttgacttttgaacttttaggaggcaaaagccaaagccaaaagccaaaccaaacacaccgtaagacggagactcagggaggaaaacaaatacttatcgttaataaacatgacatatgatctgatgcataaatttgtatttttatttttaacattgattttttaaagattcccaaaagataaacatcaaatttatcatataattcctcaaatgatacatataaaatttgaatacgaatatatttttactttgtttattactgggagtaaatattgtataaaaaatatgcaaaatttattcttatttatagtaatatgcaaataatgtataaatagtccatgctcataaattttttagtagcccgcaacccaaggcgaccgcgaacagtgccaagccgagcgggggtgtgcatgttggagatggagagagagagagagagcccgaaaaatatcgctgatgactcgacgagatagaggagggagggagggagggaggcgcagtaggacagggctgcaggcaggtgcttgtccttagctggaaccctcccgtgtcggcctcatcccaccgccccgccctgccgtcctgccctgcgcggctgcggtcgcctataaggctagcccaggccatttgccctttgcccccgtccgtccgtccctcacctcacctcacctcacctcggcccgcctccctcatcaggtagccgtagcgagcagtatagcacgcacagccgccgccctgccctgccctgccctgctcggcgtaggcacaggcacagcccagagcgagcgagacagagggaaagagacagagccagccaggtaaaaggcaaaagcacagcacattaaaagagaggccggaagcagcggcagagcggagagagagagagaactagaagcatat

SEQ ID NO: 2650 - DNA, 156 bp, Zea mays
tgtaagtagagttagctccaacttctactctgtcgcactattccctacaatctcataagcaaatgtctcagtctcactgaccggacattcctaaggtatcacataccacgagaatttctaaaccctcaagacaataccctagccctttttgaggaa

SEQ ID NO: 2651 - DNA, 425 bp, Zea mays
atttctttagtttctcactgaagctaacactctataactaaacaagctgttaacatggagcatctatctctcgattgatgctggcaatgaatttatgcactgtgcattatgttgttataactttgcgaaagcaccattggtacagttgtaagatgtggaagtatagctccactcactatggctcaaatcctagtgtgcacatattgaagagaggtaaatggtggcgtgtacctctagttggtgcagaaggtggatataccccctccaatattttgtaaatttttttataccttttgcttgttcttaatgcaggtgcaatttgcatttcccatggagctcactgattaataacgtgtgagctgaacttgcttttctgtggacaatttggaacttcagtactagtttccgataggattcagggagaa

SEQ ID NO: 2652 - DNA, 423 bp, Zea mays
caccggagctcagatgtcgactgtccggacgccatccccgtccttggttgccacggcgagttgttagcaacgcgacagttgcgccgtatctcccctttcctggggttttggagctcccccatctttatcatcccctcgatgaaggccctgaagaaggcgtcctggtccttgctgagccgctcgacgacgcgacgggtcctggtgttgtcagagaagagcgtctggtcggagttgaggaagccgcggagcgcgacgaggtcctcgaagtactggttgtcgaagacgcgtggggtggcgtctaggcctcccgtgacctcctcgtcgccgcccttggggcagagtgcgtcgagcgagcggcggtaggcggtgtccatgtgcgggtcggggcggccggatccagactggttgtagaggcggaagacg

SEQ ID NO: 2653 - DNA, 61 bp, Zea mays
acgaccgaacgcgtccgaaagtgtttacaggcagcacgctcacaatcagcctccctcgtgt

SEQ ID NO: 2654 - DNA, 1244 bp, Zea mays
catacccatgacgggtatgaaattttgcccaaacccatacccatgcgggtttcgggtacccaacgggtttcccatacccactaacatcaacataaaaaataattcatcatgtaaatgacaatcaatacattaataagctagcataaaacgaataagtgataactaattttaacttaaaatttgttacatcaaatttatttcaattagaacatattcaattaataatattatgagacatatttataagaaatgttgattttaaggcgggtttaaaaaacccatgtgtttgcgggtatgggtagtggaagaacaaacacatacccacgtactcgttgggtttccatttaaacccattaacaaacctatggatacagaaattgacccaaaccctaatagagcaaaaactcatcgggtttcgggtagcgggtacccattgccatttctagctgcgtccgttggggtgcggcgaggtgggttccaatcacctcctcattttgactgtatgtgaagaccacgagtgcggctgattttgactttgtacctgagttgtcgttcccggactcctcacgcgatggctatgcggcagccgcgaagaatcatagtctaggtaaacgaggaagaaaagccgccggaaattcctaacgctggtttagtgataaagaaattgaagatgatctattgatttaaatagcaagggatttttttagatccctttcaattcttttgtcactaaatcaatatttagatcttgtttgaattgcgactgcattgaaggaagaggttaaggaaaattaaataacgtttttatttaatcttaactagaaagatatttaattctgtccgatctatcccttcgcaatggaacgtacccttgtaggataataatccgcgacccaaatttctaatcacgccggagaaaaataaggcctcgactttaattcgtttccccattttctggttgcagattgattctttaccatttgtatcgccattcctccctgttcgttgggcgtggggtctcaacctaaaatcagtcccattccgcgctcctagtggagagtggattcgaacggaaacacctttttgtgccccaagatgcctgtttccgcttcgtttccacgccacaccttttgaatcctttgccgtcacctcgccttttgcagcactagttgtttgtcagccttcttggagtgtggaggggcagagagcgccgtcctgttgattcaggaaaacagtccgagccg

SEQ ID NO: 2655 - DNA, 819 bp, Zea mays
acgcaaaatgacattgggacatgggtaggatatgggatgctgggaccaaccagctggatcaattcttgggtaccctctgtcgagctgccgagaactgtagcaccagccgccgctggggacactggacacgtagaaacatacagcacgtcccggaaacctatagccattccgtgaccttactaccagccaagccggcgcccatctcatggctcaatggatctgagtcgtactctacggatacacacagagggaagaacaccgtccacttagggcctagggattccgctaaacacggggccaatctagtgcttaatttatcctaagctttcaatctgaatacggatttgtcttagcgattatccgcgatgcagctcggtaaacctccaaatttgccagcgctgtcaccatggtgcgcagcgccgcctgccaaaattctgccaaagtctcgagccagcccacgggttggcacataccggccgccgaccatgggcgatttctgcccgtgcgcgcatgcatgcatgtgttatctagtcacggcttcttgtcctatccgggcccgtctcccgaagaacagcatgcaccgtgctctattgcttcccgctccagtctcctgcactgcaccttgctttgctttgctgatcgctgattttgcccgacctaccctacgctagtactttgaagtagtaggagctagcgagatctccatatatataaagcgaccttctttgcactcagctcgtagatccacacctgcagctgccacagcgggtggtgcttagcttaggctagcctagctgcgcctgcgcatgctcgtgacca

SEQ ID NO: 2656 - DNA, 428 bp, Zea mays
ctctgtgcttctctgtgatcatatacttgtaagggcaagagactccaatttgtggagattccttgcgaacgggatattgaaaggcaaagcaaaacaccgtggtattcaagttggtctttggaccgcttgagaggggttgattgcaactctcgtccgttgggacgccacaacgtggagtaggcaagcgttggtcttggccgaaccacgggataaaccactgtgccatctctgtgattgatcttctgtggttattgtgttttgtggagactcctatctagccacttggcattatctgcgctaacacttaacaagtttttgtggctataagttcaagttttcacaggatcacctattcacccccccctctaggtgctctcaattggtatcagagccgttctcttcacaaaagggactaaccgcccgaagag

SEQ ID NO: 2657 - DNA, 1500 bp, Zea mays
gaaccggtcgttggggcggggccgcgcggggtttaaccgggagcagccggtggcgcccctctccgggagccgggatggcgtgggccgtgggcgtaagcgtaagaaggcgaggcggggttggggggtttaagaagggggggtggttttgaggggttttggccaacccacaccaccgcaccacgcacctccaccaccagaagaaaaaaccaaggcggagggcggagaggagagcaagggggcagaagggaaataaaaataaaagaggagaggcgaagcaaggcgaggaggaggagggagcacccagaggcaggggagggggaataattccgcaggggctcgagggatctcgtcgggtctggccggagcagcacggcgaggcggcgatccgagggcgagcggaggcgggcgagcgtcgacgccggcgaggtgaacacggcgtgctaattccggggcattctggcgaattatgcggttttggggctgggtttcgtgctttggtgccccgctgtggggcgctgttgtgttggggttttgcctccgcctggtttcggtccacccctggtccaaattctgcttgctttggtccgatccgccgcgctgtgctccgacagagaggtgaaattcgcgtctttccgagattccggcacatttcagagtcgcggtttggattcgtggggttttgcttaatttcgcgtcgaattgctgtggatcgggtgccgagatcggatctggcctcgctcgattcacgtttttctcgacgttcttgtgcgcctgtgaggtttgtggttcactctttcttttttattagtcgacgtgcccgctttccttttggcagttgcttgctcctcgcggattccgatgcacgaggttttttttttaaaaaaaaaagttttcttctcctctctctcactctcccttttgatcgcttggcgtgctggtttacctggcgaatttatttgcttgtgcattaaattcagtggcgaaaccatttcgtaagaaaaaaagaaacatttcctctctctctctctctgacgtcttaactcggatcacgagttgaagtatgaattctctccatttcttctgctatttctgtgtttgcttaattaatatgcgttttgattcgctcttggagcgcagcctgctgaaaattcttttcatttggctgtttcacgactagatctctcggttaatcggcttggggtattgggattataacttttggtaattaattacttcaaacgcagtagtactcctatgatcgttccctgtttaattaatggaatggagggtttaaagaagatttatcccaagtcactgcggagatcccaatgaatgatttttttcttttattttcttattctcctactagtgagatttttcttttgctgattgctgatgggttcttgcagatttgggtcggggacaagccatgaacaacgcaaccaccagttgttaactaaccctcttttaaacttcaagcaaccaaagccaagagcagaa

SEQ ID NO: 2658 - DNA, 684 bp, Zea mays
tccggggcgcgcgcctgtagcttggtgccttggtggtttagggtttgggatgggtggcgcttgagcttagccaccttgttttcgggttgttttgaaggcgtagttacggattacagcttggcactcggaattagggtttggagccttttattttcagtagcctcgtgtgctttgcggtcagactggttgagggcttggttcaatccgactgctgtaaaccaaagctttacttgcaagtaatgttttgctgggagttcagtgctagtgagcgcatggtcctggggtcaaaatgcaccgcacatgttctattcatcagccaggagggggtatggtcttagttgacggagaatgctctagaaaatgtagaatttgcacttcacttttggcgtttttaaaacagccacacatatgttcagtgcgaattgcaattttgtgcgggtcatttggtatgcaacaatcatcattactgggtactaggtggcagtcttatagagacgtctgagatgctgcctactgcctaaaatactatctcgctctctcacatacactgatatacactcacacatgttttgtgcaatgattttcacacatctgcctgggtagttttgctcccatatatgaattatgttatatataaatatggttctccgatattttttgcttgtattttgtaggcatacaccc

SEQ ID NO: 2659 - DNA, 1266 bp, Zea mays
atccgaatcggtcgtaggctcgtagcagagcgcgcgcatacagccatgcactcacacgtcaggaataataataggcagctttaatttcaggcgattaatttagtcattcactaaaaggttggagctcgattgctcgatattattccccctctgaaaaaagcaagatatatatgctcgcctatcgatcttgttaccatgcacacaccctctttccagcggcggaatccaatctttctttgcaactagctatttggggacagcgactgaatgttcttgaccaaataattgtgcgtctgagctgtaagttgacaaagcatgcattttccgtagtatgtagtgtgtgtgtgtgcatgttccaacgcaaatctatggctgctgtggctattggctaatacggtgtatgtatacaggtcatctttgctaaatgttcgatccatctccacatgcagctagtgacaattgcctccttctgaatattcatcagtgtgagacgaacatgcatgcatgcatcggagacggagagatcagtctttgggtgcctggagttggaaaaatgtctgaacttctcagctgtgcagagaatatttcagctccttgattaatttcttgcgttagttaaccagcaccttcacgagtatgagcatttcattgaccacgagagatcgatcgagtatggaaatcgacacgcactgagagctgargcagcaagagaagcgagargtagctctgaatcttttggtcaggacgactcaaggaggagctaggagatagaagtagaacagatgccaatacaagcagccggaccgcgacgtgaccggagcggggatgcgatagaaaggtccggagtagatgagatgagaatctgagatccccactcccaggggacagaaatctttgttcccttcccagctgctgttgctgctggctctctcgccgcctcatcagctttcagctgcatgcagtgcagcgtgtggtgtgcccccgccggcattattccttccctcctcttgtcctagctagctccccccactctgatgagatcgatgatgcgccatggtccacctccctcttcatgactccatgtccatgaggcctgccgccacggccacttcgtcttctataaatagcagctcttcccacacctcctccactcatcagctcagcatacacaacatcatcatcatcatcttctcgctagtcgagcgagcccttgtagttaattaagctagtcgatcgatccaagagaagaagaagcagcagacagga

SEQ ID NO: 2660 - DNA, 463 bp, Zea mays
cctgcacggcagacaggcgcgagcccatgtcttttttttgtcaacggaaacggagggtatattaaggattagtttgacaaacatttttccaagggaaaggaaaatggaaatcccttttaaaaatgtggctgccaaactagctctaattaacatggattcctatacagtctggcgaatgttacagacgggtgttacactactacagtcacacctcgcggtcttgccattttgacgatgctccctcatgcggaaacgtcacctatgtacagaggacatcctgcctgctgctgtcggcaatcaggaggaagaggacgacgggcatgctcggtcacttcaacttcatgcctccggcgactcgcacagggcaagaggaggcgacgaccctgtcaacccgtgataccaacaaggatcgtcgtgtgtgctgtctaattacttagctagcggaggaggtcgtcagaagtct

SEQ ID NO: 2661 - DNA, 253 bp, Zea mays
gttaaccgatcctgcgtcaattacttagttaatcccgtttcatcgtttgactgggctttctttctttctaatgactttcagtgtaaccagcaacctcagctctgaaagaaccctagagtaaacactcacatcaagacactccactgttcactcttgggctgctcctaccaatgaagcaagagcatctccacctggcaatggtccactcgttgtattcatcactaagtcagctcgattccaccaatgggtgttc

SEQ ID NO: 2662 - DNA, 170 bp, Zea mays
gttaaccgatcctgcgtcaattacttagttaatcccgtttcatcgtttgactgggctttctttctttctaatgactttcagtgtaaccagcaacctcagctctgaaagaaccctagagtaaacactcacatcaagacactccactgttcactcttgggctgctcctacca

SEQ ID NO: 2663 - DNA, 1500 bp, Zea mays
tgctcggacacagacagacaagcttcatggcttggtggtccatacccggttagtcgttgccgctgcgggaccctgtgagcgcgtagttccacggtggtgggcggtgctggtcggccttcgccgagctgatgcagccgcggcggacagagccgacgacagcgcgctgctcgatcgtcgccgggccgttcctgtggacgatgctggtggagacaaacaccgacgtcatcacgacaatccttcgcatgcatgttggccttggcctgacgtacgaggaggactgcgcgtgacgtacgtgcaaaaagagaaatagaagcggaatatgacttttagttgataaatagtaactaaagaaagaaatatgcaagactggaatggttcaggaacagttattgtttcgatgcaaaacagtttattagttttttataaaaaaagtaaacaaaacctccgtcaaaacatgtgaacaataattcgtgaccccaagtaagtacaggcatacatctagtaaaaaaactaatatatcaatccaaattgcattcccgcatttagatataaatttaactaactgttactcaatttttacagatctcgactattactcttaacaaatatgacaattgtgttctaacaaaaaaaaacgaaaatcgtttttggacggatcgagtgagtgcgtcgatgatgcggctgcagtgcacgtgatggcgcggccccaccacgcggccgcttcttttctactcgtgtgacgaaatgttgaccagtgatcgtcgctggcggtgcaggtaggggatatacaatagaagggacaggatagacttttggatctttaatagacgaaacgtacgtatggttggttgtactgtcacgtacacaactggggctccgaatttttaatttccaaatatcacttcactccagatctctggacccatccagcattgtatagaagaaatgtggcaaccggacagtattctttattattatatagaaatgcggtacgaagtccgactttaagacgtgtcaaccattggtgtagagttcgattgcaaagtgtactacaacatattacaaattattagaaaaaaatctctgagtctcaaattatttatgtgacggtccaataaagcgtacttcccgtgcagcatacggccacgttgctcgtaagcagaaaatgaagcctgcatacaaatttgtaggaattcagaaaaatccagctaagccaagcccgccggccagcgatgcagacttggcggcgagcggagcggcctcaacctcctcctctccagctctcctcccatataaaacgcggaagaatctcgaagagacgcctcgtcccatcgttcctctctctctgccccgcctacgcctcgccccagacgcatcaaaccgctctcctctccctccctgcccccctcgcaaccctgaagaagcccccacacgcaaggccgcaaacgcgccgcgcaccgcaaggtcccagggagcgacacgaggcggcctcattgcagc

SEQ ID NO: 2664 - DNA, 473 bp, Zea mays
agtagtaaaaaagtaaataatagtaattgctctcataattacaaaaaatatacaataatatcaacccaaacaacccggatccccacgggccacgaccccaccaggccaccacctacacttgcccacgttccccttcccctcgcatccgtttcgtccgtgcgccgccgccagcatctcagcccagacagagcaaaacccccctctaaaattcggttatatttgggctcccgcctccgccgtcgcccctacagtcctacaccaggtgccgaggccttcgccggtcaagagcggccagcaggtattcccacccccttctcttccccgtttgctgtgcgaaaccgagttcacaaactacctcaagctatttggctattcaatgcccactgcccagtaatttctaacttttttgcgaaaattattggccacccttgtccttctactagatccgccactgggtttttggatttggagac

SEQ ID NO: 2665 - DNA, 1196 bp, Zea mays
gagattagtcgttgagtaagtctatgaacgttycatagtkggtttcaaagaaactgaatcgaaatagagagtgaaaactatgaataaagaagacttgtgaattgaagacgaaagtgtgtgaatgaatataattatcctctgtttatagaatacattcagttttctttagatttctacgtcagagtaataatggctcacacccatcgcgtcggtctttaccaataccgaccgggctcaccccactaccatcgacacagccgcatcaaccgatcggcagggcagccaaccggccgggccaatcactcgcagctgcagtggctggcggtctggcaccgatcgccgggagtgacacggcagcgatcataccgaccgcgggcaacagccagctcctcccgtcctcggtccacgccacggtccttcatctccaaagtcaaactggtcgaagaagaagagccgtttatggcatccttccgttaccagctgcggccatcgtgcgcgcctctcaccatttgggcccccgcgcactccgccccgcgacgagcgcgccaccacccccgcctctatttctttagcatcgccgcccccaagccatttctctccagcatcgccgccccccctctccgcctcaaggctctcctctcggaggtacgtgcgcgcccctcagttccgatctagccgttctatggggaatcacgagcgtttctgttggtacattggcctcactcaaggccgcttgcgtgttcttccttctcgtgctctgttctatgcacacgttctaggttttgatcccatcattgctaatcgtcaggtatcgacagattatctcctcgatgcgagggagaaaacacactacttatctagtctcaactgcacacaaagagaaagagccaccctaaaaaatcaatgcttttgatcctaccacttggcattgaatcagattatatctggtgcattatcaccacactgaaatattaaacgcattattcttcaaaattgatcatctgtgccaacatagcatttgatcgatgcaacggcgatgatgtttttaagtttttattcagacttattcaagtagtgtaagtgaattgtccactttttccatcagcataacctctccgattagcctggtaggtgcatggaatggaactcaatacgacctcttctttcttttatcaggtctgataggcaacccaata

SEQ ID NO: 2666 - DNA, 1160 bp, Zea mays
tttatacactaaggattgaaacatgataaaaagttgaagaggaaaaaaataccccaaacattgacatttagtatgagtgtgttgcttatggtatcttgagagcacctagagggggggtgaataggtgatcctgtgaaacttgaaacttaagccacaaaagcttggttaagtgttagcacaataaacgccaagtggctagaaaggagaacttgcacaacacgataaccacaaggagatcaacacagagatgacacagtggtttatcccgtggttcggccaagtacaaaacttgcctactccacgttgtggcgtcccaacggacgagagttgcactcaactcctctcaagtgatccaatgatcaacttgaataccacggtgttttgcttttcttttcttattgagagcacctagagggggggtgaataggtgatcctgtgaaacttaaacttatagccacaaaaactttgattaagcgttagcacagttaatgccaagtggctagagaggagtctcaacaaaacacaataccacaagagatcaaacacagagatgacacagtggtttatcccgtggttcggccaagaccaacgcttgcctactccacgttgtggcgtcccaacggacgagggttgcaatcaatccctctcaagcggtccaaagaccaacttgaataccacggtgttttgctttgcctttcaatatcccgtttgcgaggaatctccacaacttggagcctctcgcccttacacttgagattcacaaagaaatacggagtaagggagggaagcaacacacacaaatccacagcaaaatgcgcacacacacggccaagaatcgagctcaaaagactatctcaaagttctcactagaacggagctcgaatcactgagaatgacaaacgaatgcgcaaagactgagtgtggatgatcaagattgctctaaggttgcttggtgttctcctccatgcgcctaggggtcccttttatagccccaaggcagctaggagccgttgagagcaaatctggaaggccatccttgccttctgtcatcgggagcaccggacagtccggtgcacaccggacactgtccggtgcccgatttccttccttaaatagcgaagccgaccgttggcagacttggagccgttggcgcaccggac

SEQ ID NO: 2667 - DNA, 1172 bp, Zea mays
actcaacggtggctctggcattcatgggcgtaaaggcagcggcgcccttgtgtgttaactttgtacactgaacaatatttcactctgtgtcgagcttaaacgtggctggctggtcctgcaagcgaggcagggccaatggccacgaattagagagattgtagaataggcatgcgtcctctgctatgtataactattcacttttttttgttttgttttgtttgtctgagtagttttaacttttcctttttcccgtttgcattgatcccccgaggcagaagaaagtgactttggaaagaaaaaaaaaactggtgtttgcccaactgatggaaacagttttaggactgaaacagctgtggaactaccggtcatagtctcagatatgataatgaactgcaaatatttcccatgctgtttaaatatgttgattcttattattgaagctacgcactatagctaggaaggaaggaaatgcaaaaatggctgcctgctgagtgagcgctgacaacaaaacctatctatcaggtcagtcctttagtttttgctctacacaacatgaagagagtaaagtcacaagctaggttgttggctacatgctagtttgctagctaaaagagaacgaaggaattaatcaaggaacaagtgatgctaagctgtatcagccggttcatcgtcagggctactaattctgccgggggttgtatctgcttgtcggcgcgctcttggtgctgccgttaaactccactcccggcttcgtcgttgttgccgtcggggacgctgtcgtccgatggctcttgacgtcgaaggtgttggtggccatggtggcagcccccgccggtcgcagcaacctccttgatgaggtcgtggcacgacgctgcgcccagccttgcgatgccgccgccaccgcagggttgctgtcgctgccgcctgcacgctgggccgccgccgccgccgacgacgacgacgctactactaccactgcagccgtcgcactgctgttgaggaggaggaggagatagagcaggatcacggcgctcgtggccgcgcccgcgcggcagcggcatgcagcctgcttcatctgcagagcgttgagctgtgtgtgtgacaagcagtagccagcagagcaggagcaggaggactggtaggtctatggtctgttgcagttggagtagaag

SEQ ID NO: 2668 - DNA, 628 bp, Zea mays
aatcaacaaattttctttagcaattatcagaacatattttgatagctagacgaagtttgagtgtaaaatgatctttttctatttattgtttctgaaatcttacagggttgtcttcctccctcttcttgcaccatgcatgccctatcttttgtgcttatttattatatctggtgtaccaaaatttgttccagcaaatgcggcctcgaggctaggatttcaggatcagaaagtagcactagtgaatgatttgtgccatgatgccgtgctattggttgattttatttccttaaggtgcataacaagtttgcagtgcaaccattaccggctcatgttaaactcgataaagcttaggcaatgtttggtgccactgtctacttgtcaatggtcatgttgtgaattatgatcttttaggtacttgctcacccttcatttggtgtttctttctttctttctgtctttctttcaagtcttcaggttcagcaagtcaagttacatgcttacttttgaaatctatattcgaggtttcagtctccggagaactgatacagtgacgatgcattagtgcctgctgcattatttagttttttctacatttttctacattctttcttataacgtgaactgattc

SEQ ID NO: 2669 - DNA, 123 bp, Zea mays
gcggttagaagtgagcggttgcctttcccttctataaataacccctttgcttctctggtttcttcacatctctccgctgctccttactgcctcttccctttcttctctcccaaagctttaacc

SEQ ID NO: 2670 - DNA, 467 bp, Zea mays
ctgcagaagaagggcgtcattgttcatacaaggaaacacatgttaaccttgccaagataataagattgcgaaatgaaggaaatttaaaataaaaaaacgtggatttccagaagcgcgtactgacaactgcccctacccacgaaagacaaacgtctcgtgcacccggatcggagcccacgtatccccatagcccaccaccaccacacgcctcctcacaccgggcccactactttctcgtcctcacacgtcagtgacacaagccaataccccatgtccatgaccccctgcccccaccccagcctacgatctctcacagagtcacagtcactgttcacacaacagctgctagtagccgtagcccgtaggcgagccagaggcggcccaattcgagagcggttccggcggcgtgggcggcgccgtgcctgagatcggagccccgtggcgcggtgctggcaactggcggcgcg

SEQ ID NO: 2671 - DNA, 79 bp, Zea mays
tagcctgtatccgccccccacactctgcgtctgtagtcttctttctcgcgtcggcagtcagcttggcagggccgaacca

SEQ ID NO: 2672 - DNA, 733 bp, Zea mays
ggggggggggggggcaataaatcctgtgcatatggacgtcctatatacctctaccgggcaatgactccgtttaaacggtttcccgttttagccgcgtgttaggaccggcatgcaattcatccacatgtttagggtggcttttgttttaggcggcgcagtacatttgaggaaataatcgatgcagaacagtgtgattttccatagagctagccccgtgttccgaggtggatggacattatggtcatggatgaatgaattttgttcgttcgctagaccgcaattgtttgaagtggaatttgtcgagagattgctacttcttgtcttgttagtgaaaatggaagagttgatttttattttgtttttattttaaaaaatgaacctggaagttgaactagactagcctgcgccgtagtcccaccgtttggttccgacctccgactccgagtcccggccacacgcgccccaccccgtccttctctccccccaaaataaatctcagcccaaccactcctcccataggcatagcgtacaccagcgcacaggccgacaggcgcaagggcagcgccaaggaaaacccgagctaccctgcggtacaacgccgctgctacaaaggctacaccaaaatccaaaacccaaccaacaaaccaaccaaccgcgctgctcctgtctcttgcgcctcgcgatctgcctccgttccttcctttctccctcccggcgtgatgagcggtgggag

SEQ ID NO: 2673 - DNA, 578 bp, Zea mays
agttcctacacttctacaccttacaagagctataacattcaatacaagacacaccaaagagatcaaatcctctcccaactccacacaaagctttagtgattagagagagagatttgttgtgttcatttgagctcttgcgcttggattgcttcttttctttctcattctttcttgtgatcaaactcaattgtaaccaaggcaagagacaccaaattgtgtggtggtccttgcgggaactttgtgttccgtttgattgagaagagaagctcactcggtctaagtgaccgtttgagagagggaaagggttgaaagagacccggtctttgtgaccacctcaacggggagtaggtttgcaagaaccgaacctcggtaaaacaaatcatcgtgtctcgctctttatttgctcacgatttgttttgcgccctctctctcggactcgtttatatttctaacgctaacccggcttgtagttgtgcttaagtttataaatttcagattcgccctattcacccccctctaggcgactttcaattggtatcagagcctggtgcttcattagagcttaaccgctcgaagtg

SEQ ID NO: 2674 - DNA, 58 bp, Zea mays
agaggatccttctgattcctcagctctgcaggcttcctctgagtcgattgcgcaaaag

SEQ ID NO: 2675 - DNA, 1473 bp, Zea mays
gacaatggcgggcggcggccaccggacctggagtcctggactgcctgcaaggctgcaaccctaacacaatactgcagtctccagtagcacagtgtccaggacctccaggtaaggccggcagttcggcactcggcacgacaggtttgggccttggctagttgcccagtgctgggcgcctggtgtcagctggtgttggggcctgttcgggcctttcggttaaccgaaataaaaaaaaccgattttttacatttaattcggtttttttgaacatatacccgaaataaaaaccgagtcctgaaatatcgttctattcggtctcggttttgagtgttttgagttcggttttcggtgtcggtttcttttgcccagtcctagaaaaacggccgaccaactagctgtataggtgtacatgtaaggcaaatcacaatggacatttcataacactctttccaacactgccacatcatcaaaagtgtcatgaaactaagaatgaaacaatgtctctcaatgtaaaatttcacttcactatttcatatactaacataccaattaaatgctgcaactgaatgatcaatagaagttaataaaatatgtgaagatgaaataaatcactctcaatggagatttcacacggtttccaagaccttggaaacgagttgacatggtttcattcctataaaactagtttcatctcatgaaactcatttatcttaaatgctatgtcatgtcatcaaaaaatctgatgtgacatactattaaatgtgcatgaaatcaccatgaaactactattgtgaatagccttatgttattagttgaaaaggatggataatgatacaccatcaattgactataaaatgtcatagctgacaaataatctaaaccatgactgcactaattaatactccctcggtactaaaaatatagttttttttaatcttttttccgtctatattaaaatagataataatgtatgggtagattcatataaactatatttatagattaattaataaacttatgtttaatctaaaataaaattatattttaggacaaagggagtattcacatgtcatctcatattctcatgaccaacacacacagggcatgtgtgtgccaaaaaaaaaacagacgaacggacacagtaaaacaggaacaaggaagcccccgtaatagtgtagccacccaatgatgggagaaaactctaaggtccaaatttggcgaaacagcaaaactgcctgaaaacacatttgcagttttggttgggtggctcaattacagcagagaaacgggggagggaggttagggacgagcaggacaaaataaggcgacgggagaggagagaaaaaaaaatacctgctgtctctctccaccctccctccgtttcgccccttgctgggaatcgattgggccggaagctgattgttgcattgcgaaagaggaagaggacagtggtgctcgccgtcaccatcgaag

SEQ ID NO: 2676 - DNA, 91 bp, Zea mays
  unsure (1)..(91): unsure at all n locations
agggacataccatgcatgcatgcatgctgcttccttcagctnttttttttcacagcattgtgacgataaaccgagggaaaagtgagatagc

SEQ ID NO: 2677 - DNA, 657 bp, Zea mays
ggcaggcgcgacgcgcgaatctcaaagcacaggaggggtgtgcggactgcggaggcctaggggtattttggtcaggtcgacgcggaaaacactctagcgagggggaagagagagaatcgcaggaccaaaccctaaacccccgctcccgcctcctctcgctgctgcagcttgccgggagctcacgcggcctttgcttctcgcttctttcgctggccacctgatcccggttgttcttcgctgggctcccgagccgctgcactcgctgggtgctgccgcctgccaggaggagcggcacggccgtctacaggattaaaggttatttgtttgcctgcctccctgttatcgccgcatatgaaatctctgatagcttgtttacgctatctgtagactgtagtagaaggcgtgctctaattcagcccaagtagttcgtactcgtgaaaatctactgaactaacgttgtgtggtttgttagggagggaaggtttgtggtttaagttcccggaggaagacttgtggcggaactgtactgacttcaggtgaatcattcggcttatgtatgcctgtttaagagtccagtgtggttctgctggaggtttcagttttgtttgttcattatcatccttcagattgaagtcaaggagctaatttgggggaaga

SEQ ID NO: 2678 - DNA, 1096 bp, Zea mays
tgatgacaactatatcttcttgtttacaaattgcaagagagatggatgctacaakaaataacaacaaaaataggaacagaggagtgaaaagtaatgagtatatatcaaggatggacataaaaaaggtttccattcaataaccctaccagttttcgtgtcataggatttttgtatatccttgccctagtgatgctcatatactgccgtcttacgtcacacctaatttgtctagacgtccaaaaggtagtaggtcgttgtgtcttgtcttatcgccttaataactttgatatataaaaaaataattgtgacacatccatataaaaaacctagtttcgccactgatcatgtgtattgtagacgggcacaaacctcagccctcgggtaagcagagctaagcatgttggtcggtgaagaggacaaagggtttggatgctacctcgccacgcgacacaagcgagcagctggctcttcacgtgtgtgcacacctccctttccctctacagtctacactgtcttcactcgtcccctccacactctccagatgccaaccaagcattactatggtagaatctcatctgacgggtacgaggagatgctaggctcacggctagccacagttgtgcattgctcgagtgcatgaccactgaattgctcgagtgcatatatgatcggatcctccagtgatctgattgatgctcaaagaatccatgcactatgcaggtaggtggatcgatagctgggaggcattaaagcggacgatgacgccttggcctcgctgcaatcttgcagattgctgctgcagcgcttctttaagagccaaccatccacatataccttgcttgacgccaagccaccggcattgtcggcaccgtgccctccgctccgctccccttcctcttggttttcggttccttcctccctcaaccagtcatctgctgctatttatgccacagccactcccagcagcggtgggaacaaagagtgtcagcgtctcacccctgaggccgcgcagagccactgcttgcgtctctgtctctctgtctgctcgtttttctccttctgcgactcgtaggagggtgaggtcttgcctcgcgga

SEQ ID NO: 2679 - DNA, 1056 bp, Zea mays
caatcattcaattccaaatccattgacgacacactagggagtcaaagcatcaaaatagaatagatcgaagaaagacccatgtgaaagagatgatgatacccatcaaattgaagatcacattaggttgattaggaatgtgacacatggattattacctctgctgaactgcttttggaagcaactgtcggcaacacaaaggcttggtggcgcagtgacgcacggcacggcggtgtagggtgctgggactcggtggtgcagcgggtatgttgcgactgcaggtgccagcgcagggtggcggcgacaaccgccctccctacaaacgcgcgaagcaaactatcctcggcggattggttttacagttggaggcatcgtatatggatttttgggctttagactcaaacgactgtttgcatcttctaatttgggtcctgcacttggagatggtctaaagactagtacctaagagacccacattaaattgagttgtaaatgttctaggtgtttgtcagtttgttgttggtgtattgttgtagattgtttttatttaccagtttaacatgtcggtttttctcttaaaaacatttcttttcactttttcagtaacccctttgcgtgaccagtyatgtaatgccacggtcatctcatcaaacctccagcgggtcggtggttggccgggtcggtggttggacgcacaggccttcccttcctagagaccagaccaaacgagctgacagatggcctccccttggaccttggcctgccgcgagccccacctgtcagctgtcaacctccaaccagagcccacagccccacaccacagcaatcccaatccgctctccccaaacggccgtttcctcctcccgttgtcagcttcgtttcgcctccggagtctggcatccgcgtcgcgagtcgccaaaccaaacccaccgcccttataaagacaccttcccctttcccgtcgccctcctctgccctgctcgagctccccttccgcgctccctacccacaagcctttccgcaggtgcgccgcctctgcgaggtggggtgactccgtga

SEQ ID NO: 2680 - DNA, 874 bp, Zea mays
ctgcgatatgttacgtgcatttgatgctgaacatagttccagaattaatcttcagagaattggtagtattgttctgcttccgatttttttgcttgttaatcatgtggtgtctttattctttaagaatggttatgcctcgatcccattgttaggagcagaagagtgttacatctgactgtaggaccatagcgacattgggaaatacgatgaacacaataatctggttaatggaaaacatgtatatgtacttataaatcctgatcagaaatccacatcacacttgcagtgcacatttcctggcatctggcacaggagggattaagtgtttttaactgtataaagaaatggcaaattggtaagcatgatcgacataactgtgttagtttctaaaaaaacgtactaatttaataatttgcaatagggtcactagagagagagtggaatttggtgcgaattagtgacccccaatttccactttataactattggagcagtaggggatacttgtttacttgccagaactcctgatgcaagatagaagcagtatatgtacatcaaatcaattacttcacaacaagtacattagcatttttatttgacattagagttcaaatggatatagtatcatctgtttgcgccatgacagaggtttgaacttgccaacttggacatgcatatcttttggtcagaataaaactgcagacctttgtttgatggtattgctttcatctaatcacactcttggccactgtgggctgactacctgcagagtaaacaaacaaaataatcactaacgagcatatcatctttcttatttagcgcgtacatattgacggtgccgctataaacctctaatgtgctgaaaactaactgc

SEQ ID NO: 2681 - DNA, 1115 bp, Zea mays
ggtatgattccaactttgcagctagcaaactttttggtgaatacaattaagtagaagttgtttttattgcttcggtaccactgatatagcagcatggtttgtttctatgtcttctctatttccacccccccctgactaaatctttagataggggtttagggagcttctaagcattttatcaatatctcaacctttttttatagcttctcagtttctccaatactatgctatccattcaacattttctctaaagtatcagggaaaaaaacataccgtcttggtaggttttgttggaccagggcttagagtttggatgcaggctgatattctctggatctcattaaagtgcattctgaacaggcaaactatagtgtctgaaaaatgtttggccctgttaaccagctgtcataagctgaactgaaattctgcacgtggatgaaacctctggtgattaatatgctacgctcgttgtttgtaggcattgccgctgctgtagcatggaagcacggccaggcgtacaccactgtaagtcagactgtaattcgttttatcgaggaccacttgggctagctttctgatcaacctctactctttcgtcacagacgatgaagctgcttccgtggggattctacgtcacacatgcagaggaaatgctgcttcgactttgcacgacttgtgtagtaaaacacaacacactgaataataatagttctctgaaaataaaacgttttgcaattttatagcctttccgctttttatagatacgaaccgcaatatgcatgatattacattggctggaatatgcatgatattacattggctggatttagttttcttgatgagagttattcagactacggatattattttctaacattggttgattggataattggacagatactgcaagtgatggccgatacccggctgattcctcaggctccacctctagcccttcaattacaaggaggaactcatggccgactaacaggcagccccaaccggatggatcgaacaatgccatcaacagaaaaggcagccctccttcaatcgtggctaagaaaaatctgcctccttcacgccgcagcacagaccaattcaagaaatctgaggac

SEQ ID NO: 2682 - DNA, 195 bp, Zea mays
agttactgacaccacgaagataacgcttttgttctagacagttaaatgaacgatgggccagctcaagcattttggctagcacagtcccaaactttggaagagcacaaggaaagactacgattccaaattactacctcctttaacaatgacaaaataatttaaatccggatctgttttagaccaaacattttcatt

SEQ ID NO: 2683 - DNA, 437 bp, Zea mays
cccttgttttaaaccagtcaaatacaactagaaaagtaaggtagtaccatacatagaagtcacaggttgaaattcaaaatgaaaatttctgattccaaaattactaaagctagcatcttctctttagtaggcttaaaggttgttcttttgatgtttgttccaagactctagattctatgttttcccatataaaaggcacctcataaggcactccttatcaacctgagaaggccacaagggtatcaaaaggcttaaggttgggcaagagggcgtttgagtttgtcaacaggaaacactccaacacaagttcagcctttgggaacagagaaaagagtggaaaacacaggccagaaaggttaagaaaattcagacaccctgccccccggcgcgtctcattgacctaactgcttagaaattacatttcatttctacagcag

SEQ ID NO: 2684 - DNA, 787 bp, Zea mays
cgatcccgtgtgacgacgacgcgaggcgcggggggacaggaggtgccgtgccgcgccgagcggaaagagagagagagaggtggcgtccagtcagtcagtccagcagccagcgcttaccctcggcgggtggtccacgtgcctgtgcgcgcgcacgcgggcggcgacgggggatggttggcgccgcgcagacagcggctcggtacgcacggatcgtgatgcgtcctcgagcggggccccacgccgcccgtgacgtgctccctcccacaacaggccaggccctacgcgcccgcggtgggcccacccagcggcggctttgatgccttttgtttttgtttacggaatgggatcatgctcctttttttattaccctgctctcaagccctacgagcgcaatgccgcctagccgcccacgccttggacgtgaagcatttttttttcttgatcgaagccgccggtcccctctccccaggttgagcaattttccactccaccgtgggggagcggaagcgaaagcagtcctcctgccgaatcgtaacgcagccacgctaaaagacgagggacggcggcggcgcggtcagtcaaaccgctccctggcagcgccttgccgctccgcaaggcccggcccgctctccccattgttgccgccctttttaaccaccagtacaccacctcctcctcccaccgctattaaagtcccgtccgcggctccgccctcctctgtgtcttccttccacctgaaaacccaacccacacgctcgcgcctccgcgaagaaaaacaccgaggccc

SEQ ID NO: 2685 - DNA, 319 bp, Zea mays
ggtgtgtttctcagttcctcttagtagatcagatctactcgtcatcgagtttttactttcagttacggattggtattctagagacttaggaatcgatcctaggcggttctccagatgatatcgtttataaaacgccggtcactgaatgtcactcttgtccagatctagcatgccgccctgaccgcaacttccgtagtgttcaaggacagcaaagcatactctagcaagctcttcaaaggtgcaaaagccccgtacaaatttggcaatcttctacaattccaccagctactgggatgagtttgtgtggggtggtgcgtgg

SEQ ID NO: 2686 - DNA, 128 bp, Zea mays
ggtgcttgtttctaatgtgaaaggacccaagaccatttgggtacctaagaataaggcctaaacttgttttgtaggtttatgcatccaggggctcaagttggatcattgatagcggatgcacaaaccac

SEQ ID NO: 2687 - DNA, 99 bp, Zea mays
ggtcagtcctcaacctcccggagcttggggtcaaggtggccgagcttctgaaacagttctgtcatcggaaccgtctgctgttgcttggtgtttgatgac

SEQ ID NO: 2688 - DNA, 514 bp, Zea mays
actgtttcagaagctcggccaccttgaccccaagctccgggaggttgaggactgaccgtagctgctccaagtgtactcccacaggcaagatcttgatagtaactgtccggccatagtactccagagcaatgtagcccctctgcgactcatacttgagcccgagcatcctgctgcagcacgacaagaagtgtctggcataatcaaaagtgtggaagccaatcagatcggcgttcagcagcgaccggagcagctcctcacgcacaggcagggtcttgtagatctccgacgacgggaaggggctatggaggaagaacccgagcttgacccggttgaagcgcttccgcaggaatgtggggagcaccatgagatggtaatcgtgcacccagacgaagtcttcgtcggggctgatcacctccaggatcttgtcggcgaagatcttgttgaccgacacgtaggcctgccagaggaggcggtcgaagcggccgcctagctccggcgacagtggcagcatgta

SEQ ID NO: 2689 - DNA, 1500 bp, Zea mays
ttgattccttgtccagtttttagcagtgcgcggatggggcggcggcggacgggcttaagagttgctggctggcaggagaaaaaacaacgcgtcattatccagtcctttcttggaaaaacaattgaagtcaaaagatcgcatgtatgtgcaggcgtgcagctacgaacggaaataaataaataaataaataaataaattggagacggagcaggcgggcgacagataagactccaggtttcgcaaggaacgcttccgtcccgttcctgcttgccttggtagagagtccggaggaacaaatccccacctcccccaacacgctctttgagcgaccaaaacgtgtgctcgctatctaaaaaccagcaaacaggataacgctttcgttcgaggcagcagcataccataatcgtgatccgaacagctgctgggcgggtgggtgggcgtgggcagcaggacaggacggcaggcagagggcaagcggccacccaagcgataaacaacaagaacacagggttgtttccagcaaatcgcccgagttgtattactagtattttattcggcgcgtctccatcgcgaggccactcggctcggctgcccggctccggatcggcgtctctgctactaaactaaaataaaataaaacgctaaagcttatcgcaactcgttctctcggctgctgctcctgctgcttgctacttaaacaaacacatctcagcgtcccctgccgcagctcttgcgatcgctcaagagccaccaccaccagtccaccacgccccctgcacgcgacccgaggccaagaatcgcttccgttccgcgccgcctcctatatccagcgagcggcgctgccagcccacgcctcgctcgaatccctcctccttcctggaaacggggtttgctttccctgccccgccaaatcctttcttctccatccagccggttcctacccatcctgccggctgcggctgcggcagcggctgcctggcgctgccgtgcgttgcagagcgagggcgaggcggaggtggccaaatgccggtccaggaccgggtcgtcgtcgtcggcgagcgcgcgagactctgtctcccccctgccgccggtctgtcgaggtgtggtagtggtagtggccgtcccagctggagcacctgagacgtcgttgctcggtcgtccggattgatttcggccgaaagctgcttgtgggtttttttttccggaaagggagggagggagggagggcagccttttcggttttctgattgttactagttgctctgcggattcgattcccttgccgagatttatctcttcgccgccggagactggtggacagcagatcctcttccatctccgccggccgttcattcttaagctgcctgcgaagctttttcttgagaccctctccagagtactgttcgccggatcttggtttggagggcgagcggtgaaagatcgaatccttgtttggaggttcagcggcaggcagctcgctgtgacgtcgcccgtgcgggc

SEQ ID NO: 2690 - DNA, 137 bp, Zea mays
cgccgggttccgcgtataaaaaacggccaagctcactgccacccctcgcctcgctcccgtcgcttgacctgtactgtccccacggagatcacgacacgaaccgagcaagaaccgcacgagccgagcccagcagcagg

SEQ ID NO: 2691 - DNA, 827 bp, Zea mays
tttactgaactagtaacaacataaagaaaaaaagataagaccatcagatgcggcgggcaccgaggggcggcagaatcccgcgactagcagcaacgcgtcgctcatcgctctgctcacacgctatcctacttttacccagcccctcacgatggccgtcgtgtctcgtgagcctgggtacttgtacagatttccacccgggacacctatcctcacccaaacggtcggtcgacctyacacgtcccccggatccgacggccaacagagcgcgtggcccctctccgccgccacctctgtacaaaatgcccgccccaccaccacgccgaatccgccctctagtgactagttcacgtcagttgctgctccccccaccttctcctcctgctcctgccctcggtttctggtgagttcgacgcttctcttctcgtggacttaccgccgccttgaccgcgacttgaattgctggttcggtgtctgacgcgggctcatctgcttgttgcaatccgctttcccccgattgattcttacgatttccaagtagttttgtgttatcttctctctctcttttgggaaaaaaaggggtttcaattctgttgggcatcgactcaccgggttttgaggtttttcgtgggcggctttgatcctcggtcgatccgatctgtgtcaggctttcatcagatgttgcaaaacccgctcgcaaccgtaatcgcagcgttattgtcagccggaaactgtccttttcttggttgtactgtgctttccccactgacggatctgttcgatatctaaccggccttcgctccgccttgggctgccgcagatcagcgaac

SEQ ID NO: 2692 - DNA, 816 bp, Zea mays
gaggatcattagatttatgtaattttctattaattattatgtaatttctttaatttccacttacttttttcttttaattattatgcactttgtattttttaatccaataaaaaattatactatgtgatttgtaagcattaaaataaatgtgtgattacataataatgaaatagaaaattagatatggctatggactaagaccataaatctgctacaatttatatacttaagcagtagagaccagaacgaagtctagaagtaacgtagcaaaggcgagaggggatagtgccaggaacccatgctccacctgtccaccacaggccacagctacgcgcctgcgcttacgccctacgcctccgggaagggaaggtgagaaagagaggggcgaggccgcgagggccgagggggaagatagagaaaagacatggaaggaatgtccagctggaggctcccgcggccagtagtgggagcgaagcgcatccgcagaggatcctcggttggaggctcaaaacctcccgcacccaaccaaactccagcggtgctcctctacttctctacatcacaccccctctactgctccttccgtttactccctcctgcaaacctcacatccctccctctcctctcctctccctcttccctctctacgccccaaacaaacaaagctaaggaagaaaccgagaaatctccctcctgttgtcttggcggtgaggcaaggtccaacggtgaggatcatgtctgcggcgtgggaaggcgggaaggagaaaggcgcggccacccccgccccccgggggcgcgtgcgagctgtgcggcgcc

SEQ ID NO: 2693 - DNA, 969 bp, Zea mays
gtatctagctttgctcaccttgttgaaactagcctcgttgcaatagataaatccttttcccgttgagaatgaacagctttaccattccactgtctttgctggaactgctgtcctcactgaactaactgcccgtttcacttgtcccgtagctggcttggaataagaaaagtcttttcttccttccccgaaaggaagagttttgggcttaaggcataattgctctattgcggctacccttgctatgttatccgatgctgttcacaaagcggctcttactatagctatagacccggctatctccgagttgaaattgaacccagccccgtccatcaatccagagctcaaaacaaccgcgatacttaaatcgctcaaatagccagccaccttagacggacacagccattagaagaagaaacggaaactcgatggagtaccagagatcctcgacaaagaaagtcccgattcgaggaacggaatacatttccttgattgaaaagaccggtaagagaaaagaaagtaagcatagtcttctgaaaagaccgggaaccgtttgattttccgtcaacgaagaacaaaaagtaacgctgtgcaaactcatctgatccctgtttgggacttcttcttcatgtcacgagccggaatcgaaccrtaaaatgatcattcattcaaagtagacttttgtcatagggcaaaggagcttagaagggtgatgtagggaagtcgtaagggatgaccttagatgttgtatgacggaacgatgacttaatgcttccatttttgcttgagaaatgacgtaggtgatagactcactccttctttccatttttgattgagaaagcgtctggcccaaagaggtctacagtagtgccttgcgaggtcgtagacccggtaacccatcgttcgcctaagatcgaaaatgcgatgtgacatcactcttcattcagttcagtccatttgcttaacacatgc

SEQ ID NO: 2694 - DNA, 1500 bp, Zea mays
ttaactacgtccacgagaagagtgtaatgctctgttcgaatgttgatattggagagcgtggaattgaattaggttgaataccaaatcagccatggtattgaaatgaaatacaattttaattctattgttcgaatgttactgcattgaagtttggaattaggtgacctaattccatgcaatacagaggtgtgatgctctgttttgagagagaaagtttctagttatagtccaatgccacaggattgctctgattctaaatctcaatcctatgtgcaactaaataacagaatttaggaaggttgatttcaattcccaattccgtgcaccaatatctacaagcagacgaggtataatagtattttccataagcgcgcacatctggcaaaactaataaaacactgtggacaagtgtttaagctaggaaacataatttcatttgtgagtaatactctatcccttctaaaatatagttctttctagcctgtttttttgttcacattcaaacgaatgctgataaatatagacatacatacaaacaatattaataggttaattaatgaatgtatgtttagtctaaaaacaaattatattttaggacagagagaatttaaaatatcacatttctctaaaaacgtaccccgtcaacgtgcctagacattttagtttatcattgagaaaacttctagtttagggtgaaactcaattcctctctatgattagtgagaattgaactaatttctcccttaatcatttctaatcactaaggggatttaagttcccaaattagctttagagaatgttttgatttcccttcaaaaatttagtccctgtcacataggatgtttagatagtagttagaaatattaaatatagtctaattaggaaactaattatatatgtgaggaataagcgataagatggacttattaaacctaattagtccatagtttgcttatgtgatttgctaatcataaattaactaggattaatatttttcttttttatttagccttcatctatgcaattagttttataattaaattatatttaatacatataattaatattgaactaaacttcagttacacattatattaatgcagtaggtgggccttgcgttcttgaggtcaacatttttattattattatgaaatccttgaggtcaactaggcctagtacatcaggcgcggatgtcttctggcccggcaatgagaaggaagcgccgccgtccgcatcgtttgacggggacggaatcgcagaagcgcgtgcccgctacgcgatgccatctctgcatcacaaccgctcgtgtttgcgcaaatggctcagatgtgttctcaccgcattatcgagaaacttctattttcgtcacaaggctattccgttccgagagccaaaaactccactgctttcatcaactccggcgacttggagaagacgaagttccagaatccgatcggaagtttggtgctcgcgccttgacggattgatttcggtgcgccg

SEQ ID NO: 2695 - DNA, 1500 bp, Zea mays
ttcgcgaagagacctctcaaaagacctcatattcaataaggttgtgccctaagtgacctacaatttatattctcatacacacctagcatttatttgccttagagggctacgaaataatatatgatactatacattggggtaataatattttatatgataacatatgatgtagcaactttggatattgtgataagaaacaatgagttgggatccacatttcagtaggacttctgatctgcaaagtgttcgtcattaatgacgtgatgttaggctatctccagcaggccgtgtaaacagccgtgtaaaagtactgttttgcacagtagattgcactatttacacttttacagagtggagtttgaaatagggagtgatataaagagtctcttggagatagttaggatgttcactagcgctgttttatatatatatatgtcgaaagtagagatatatcatatattacctttttgtctacgtcccgtaatttgacaagccaaggttgacagaaaattcatggaggatgatgcgccaagcacttgcaactagtacaattttgggagatgtcatatgtctgtcaacaactctacgattctggttaatggtacgcgtgcgctgattttacacgcaatgaaaacagtacacaaaggaacgatcaattttttgactgatttcttgttcacacatatcttcgtacaaatatggaaacaataaacgtgtgattggatacatgtatctgtataggcaggctcccttgagcctgacccagcggatacgcaactttctcccgtatccacgcatgcagccgtaaatacgccacttgcacatgtgcatgcaggctgaatcaactgcatgcaggtaaccgaacgcatgcacagagcaagtcaacgcatgcgaggagccctgctacggaggtacacgcaaccaatcacatcataagtattttggctgatgtctccttcacatctagtatctccgtcatgttttttctggaacacagaaaagccacatatcattatattaaaatgagaaataaacaagtaacaaaataggcggtctaaacgtagtatctccgtcatgttgaacggatcaaattatggaagctgattactattatttgttcgcacctaaacgtggtaaccatttgctaaaccaagcaacaaatattttttgaattacacgatacctgcttatctctaaaaacacatgctcctccggaccccacctgcagtgacaatacatgctccactaaacgccatcgaacagcttcgcgaagccgcgcgcccgcgccgcctcatgagtcatgacccttgacccgagctgagctgagcagcgttcaaacattcaaaccctagacgaggccccttgcaacggtcggatccattcccatataatatccctccgcccccgacctcctcagcatcccatttttgctctattcgccacccacaaatccactgcagccagcgcatcaggagaagaaggtaagagacgaggggggag

SEQ ID NO: 2696 - DNA, 514 bp, Zea mays
tcccacttgcccataccgacggtcgagtcctcgtcgtgccgtgtctacctgccgcatcggacccgagtgcggagtgcagtactgcagtgtcagagacagagtgctgccccccttctctttcctctcgacttgctccgaggatcccaagcacgccgcccgcggcggccgcgtgccgtgtgccgtgcgcgctgcacccggcactggcagacacccgctcttcgacgcgactccccagtccccactgggccaccagtcctccgtccatcactccatccacgagtcagcgtccgcgtccgcgtcggcgtgtccctctccttcagatgcgaggcctccaagggcgaactagtagttgcttggagacttgcagtgaaaagggcacgcagaaaagcgagcgtctggccgcccgcacgccaggagcgatcgacagatcggctgatgcggagttagcacttagcagtcgcccgccgcgacctcaacctgcaccggcgccgcacgccaagggcggagacgccag

SEQ ID NO: 2697 - DNA, 252 bp, Zea mays
actgagaccatatatgtatagagtatataacaatagtatatagtatataacatattatatgcgaaagggcctctagcgtaatggttaaggctttcgagtaccaggaggtcacgggttcgatccctctcgggggcgaatttcggccttggttaaaagaatcccctcgttgtgccccgcccgctctcgggttacatcctgtgcgccaccctccggttgggtcgttgcagagtggacggtgacggcccgctagtg

SEQ ID NO: 2698 - DNA, 758 bp, Zea mays
gggcgcaaaagagagtaagagattttgggctcgactgcgtagcaccggacggtccggtgcacagtccgccaaactgtctgctttcgagaattttaacctgcgttggctataattcatcgaaccgtctgtgcgaagcaccgagtggtccggtgtgccagctagccaacgactagtggccatgtcggttggaagacaacggtcacatggagcaccggggagtctggtgccacccaccggacggtccagttcggcggtgcccccagaacaggaaaccagccaatcagaaaatttgtagcctttgcactgttcattgtccgatatgcaccggatagttcggtgcacctcacaacaggaaaaagttgagataaraaagagacccgtggtactcaagttgatcagtggatcacttgacaggggttgagtgcaaccctcgtctattgggacaccacaatgtggattagacaagcattttactcgtgtcacttgtctctttaccttatagcgattctactttctagtagttcacttcacttcaaaattgctctaagttcaatactcacctcgtgagagcaattaagtgaagaagttctctcctctcatcctcttcattcggacttggcttttgatccactaatataatattagcccaagtttgttttgttgagctatttttacaggattacctattcaccccctctagctgctctcaattggaatcagaactattctcttcatcaagggactaaccgctcgaagat

SEQ ID NO: 2699 - DNA, 98 bp, Zea mays
ggtgcgcggggcgccatcattgcctatctggcggagctagccagatgggacgccggtctcgttccctgcggcccgagtcagctcagggtagggtgatg

SEQ ID NO: 2700 - DNA, 766 bp, Zea mays
ttgagtgggtcagcacagccgcagcggccgtacaatacgtcactccgtctgcacatctactgtgtatcatcatatttttttaattagagggtaatgtattattaacattgatttttcgttttggaacgggagagtgagtgctggatgctgttcatctccctcgctttctgaaggaaaaaaaacataaaatgaatgaacgaataaaaaaatgcagcgaaggcttgcaaaaaaggcaggcaggcactcacggttcactgccttccttcgcttgcatctcgcagactcgcactcccagtcggccagtgagtctctctcctccctcctctgcttccttcccttcaccacccttcttccctttttggaccctcctcctctcttcaacctcttgcggctgtgccaatccccccctgttctctgattgatccatcgatctggtcccttctcgtccccccttcccctccccttgcttgcttgcttgcttgctcaggtaaaaaaaaaaaaggagcagaaggagctgctgcattgcacaagcagaacccctccccctctctttgttcgcaagattctccctttcttgtcatatgccccgcaaaggttttgtttccactgtcttcgctccggccgagcaaagcacctgctgttcttgccacttccgatctctgtgtgcgcccgcccgccctctttcacgcccccccaccccccacccccacgggcgcatttgatttctttgcaggtgcagccgtgcaggtgaggtgatcgcgcgtgg

SEQ ID NO: 2701 - DNA, 532 bp, Zea mays
ggtactcggcaaagaaccctccagtgggcccctttgccagtatctttgccgagtgccttggcaacagcactcggcaaagatgtctttgccggttcccaggtttccttctttgccgagtgccatggtcagcactcggcaaagatggctttaccggttcccaggttgccttctttgccgagtgccatggttatagcactcggcaaagcgcccctttgccgagtgttacactcggcaaagtgaccagaatgtcccttttttatttgcttttgttgttccatccaaacaaacaaaagatatatatgattcacatcacattatatatcaatcacatcacagaatgaacacatttatcatcaacaccatatatatcacaaagtctcactaaagtctcacaaatataagtaaggatcatcacaaaacagatataagtctgcgtcatcactaacatcaccaagtatctcacaagataaagtttaactaatgttggggacttgttcttaaatgctgtgaattaagaacaaggcaacataaa

SEQ ID NO: 2702 - DNA, 1098 bp, Zea mays
tgatacatgcacagcttgacaagccatgttatagacatgtggaagacgggatgacagcatgtgatacatccacatgaccaagcagtgctgatgcaatctgcagcagaatcctatggaggaattagacaaagatgtacagtattactggaacggctgcagttcgattgcttcaatgcactgaaactggtcaagaatttatggggaccaggaaatttgcagatttttagttaaacgggttccccttttgaaatattctgggtttaatggaactctaaacttcggttggattgctggagtgaagttgtacataaaactgattttggagaaaactccaatatgacacaaaacaatatgatgctattgccttattgttattgttaacaattctttatgcaatcaaatgaaatcagtggttagcagaaaaaagggatcagcaaaggttcatgcaaatacacgagtaaaatttactgggtctccaataggaaccaattcatatgcagcagcaatgataataatagcataagctgcttattcttttcaatttggtgatgctattgacagggacatagcaattactgaaatacaaggatctacatgtacacccccaagcctttggctattcatagaaaaaaaaatgtaggcttatatcagcggaaatagtgctaaactgtaccagaacgaaactaaaaaacttcaaactcaaggtcctctgagttgcttctgaactccaggcacttgccttctttcttccgctctttggcaagagtcacgatgttgcaaggttgtgtctctggtggagcagcagaccgaatcagagcccaattcaagccttcaaagaaggggtgctgcttgatctcagcagctcctctcaacgatccaaatctgttctcaggctccttaaccagtaaacctctgatgagatctttggtgttgctgctcacagctggatggtctgggaaccggagattctgcgagaccacatttgccaatgtttcatcattcccaggtcctctgaagggtgtcttgccgtatagaagttcataaaggaagacaccaaacgtccaccagtcaacagcgcttccatggccatcccctttg

SEQ ID NO: 2703 - DNA, 553 bp, Zea mays
tgaggagaaagaccaaagtttgagcaaaaatgggtatatttgacacaactcttgcttgttggaaaacaacttatttgagaaaaaacaataaaaacagcttctgcttattacctacttataatttattctaaaaatggatgaactgataggctgttatagaaacactctatttaatatagtttctacatgaatctacgaagaaactgtcaaataacttgtgctaaacagaaccgtaagactatctctaacagtttaccctctctatactcatatttaaactgcattctacgaacagtgcaatcaaagtaaattgcgacggtctaatgaagacttccaaaaccaacttagacaattatcgtagggcccccagcatgccctgcccgaaaatatgggccacaacccatatacgcaggtcaccaaaccgcgacccaccgtcctgcgaagcccacatccacatcctcctctcctctggccatcttccccgctcttcattcgctagacgacacaacaccgcgttcagccgctctagaaccctagctccccgccccgcgag

SEQ ID NO: 2704 - DNA, 693 bp, Zea mays
ctggggcccagcgccccagcgtcctcgtgaccacctcggcgcggcatccgccctctgcagccccggtgtctccgcgaccggctccggtgcgtccggaacgcagctccacaggtggatctccgtccgcacagcgccacgatcctctctctccttaccacgccaacagctcttccctctcggtccctctccgtctgcttgactctgctccagcctcaggccggccttcgcctctaaaagtttcattacatacccagcttgtagctgtatgctgcaaccctagtctgcgttgtcttctcaaaccttaacgtaattcgtaggtaaaaccgtgcgcccaaaccctaacatcctattcgtaagcatatctgaatctgattataagtttatatgtatgtattatgcctgctaacttagattgctttgcaaaaaaatattgggtgtacaacacccatgtattttactgggtctgcccatgtattatcaattatccataaattagtggagttctcaaacaaaatgtagaaacctttacttgccatatatgatatcaataccaaactgctctatatatatttcatgtttagatgcatagattatccacttattttctctgttgaactttactaaattcctgctaccttgaattacaggagcatcattatttatagaatacgatctactttatagctgatgaca

SEQ ID NO: 2705 - DNA, 1465 bp, Zea mays
tgttgaaatattagatattttccagattaaattctgaatataaatcatgaccaacaataaatagtctaggtgtctattccataacaagtaactagcaggttacctaacaacataatcataaaaatgcaacacacctctaccatacacagatgaactgaagtataaggtcaaatcagatgatgtgtactgatcagacatactggtagacgacgcgggccgaaagcagcagggttgatgacgtcgaagcagggggccgatgacgtcgaagtagcagggccgatgacgtcgaagcagcagggtcgacgacaagatcgcgagcagtcgcgtgagggcgcttcccaaaaaccttattcgccctctcccggtacaggatctcgaaggcgaagggtcccggagacctgctctcccgaacgcagatgcacgtcggcggtcgggatgaagagaactacgatggcggcgcagttgtgagcagaggcaaaaacctaacttgtgttgggatgggtttgacgttggctgccaggcgccttatataggaccatgtccgggaaccgataacgatccgtgatccgatctgcacgttatccacgaaccgatagactcgcgttctgataacggctcagatccttatcacgatcgttagggctctaaacttaacagccaagtaaccaaaaataaaacgggaaaaggaagacgcgccccgcaaggcgagaggccggatttcagcggaccattcacgtgcatgtcgtgcgcccgtgctcgcgccctctgcyccaccccggccagacgaggcgagtgagcgcgcgtgtggttctccacactctcttctctcatccatgacttggtgagtgagtgtagcctctatatttaaactagttccactccacttggactagcaatatggtactatttgttgcaccattccctagtcatactcatacatgggcttttaagatttttctatgatttaattgaatttgtcaattgggtctagcctataaatccaacactgagaacacgacttgatagttgtttcattaaaaataatagaatcacacgactctaactacgatagagtcctcgtacgcagattttagaagccaccaagacagtggtagagaaaactcaaattaatgacgcaaatgtcaacgtggtgacgggaggcaaggtgctagtcaaacgtctccagagagaagccggaaggttacagaatgtgctcaagtttcctggatcagccggcctcttgcagttgcagcactcattcatgctgaggcttttgagagagaagaagatgagctgaccaaaccggtgctgttctctcagaggattctctctatctctcaagatttgacttgatttctgatctgaagactttgcctaactcggaatgatcttgtgtttaggaatatatatgaatatctccgtcggggttggaagtttaatgaataattgaagtcatgtattgcat

SEQ ID NO: 2706 - DNA, 951 bp, Zea mays
ctgcaggattccaaagtatagtcatatagatctctctctctctctttctcgaacacgtaggagagctgcacatgattatattaggaagaaaaaaggggaagaacccttacaatcttgcaacattcgctgatccagttgtctgggtaaatactagtaacttaaatgatgagtgatggggtggctaacctccaagaaataaggaaatcgactgtttcttgattttttttaaaaaaaaactcccatcaagtttcagatctagattacagagcatgcactgtggtctgttggagaaccaaaaccaatctggatcaggatttcacaagaaataagattgatgccttgattcattgttttgtattgttgatatcttagtcgtatcacatggctggttatcaggggtttttgtaagcagtagaattacaactggaatgacctttaggtggtaggaaattgcgtgaaatggtggtaattgatgactgatacctgtccagcagtgtactctagattgatgcttttacggactgaaggcatatcttatctttagaaggatggctggatttttattgtggagctagcttatttgattcacattcatacatcactaactatgatgttaggaccaaatggtagactacaataggaaatttgcagctctagctaaatcagctactatttggtggtgtagtcagtcacagtagctcttggaaaatttagatctatgcctggttttattgcactagcaatgtatgccactgccttcttcgttattgcataatactctccagaaaatgtatctccacctttttttgtgcaatcaagtatagcctcacacaatattctcgtttccttcatcatttcccttgctgatacctgtagttttgatccatcttcacccatcaccattgaacacttactatagttataataccttatagttatggtgtcaatgat

SEQ ID NO: 2707 - DNA, 505 bp, Zea mays
ctcttgggaagcatcaagcatcgccaacagattagtagtacatccacgaagggatactgatgtaacagaatagtagcttatcttatccccagcagaataccacgcatgggagctaatatctggcgatgatgcgtgcacggagcggctgcttcatgacgacggtgaagtccagcgcttccgctatttccaccgccacgccgtccaccggcgggcgccactccaagtcccgcaccatcctcgccacgaagtactcggcgtggtggacgccgagcgagtagccggggcacatgcgccgcccggcgccgaaaggcatcatcttgatctcccggctgccggtgatgtcgacgccgcagccctccccgccgtccaggaaccggtccggccggaactcccgcgcctttgtccacaccgtctcgtcacgcccgatctctgccaccaggaagttcagctccgcacccctgggcaccgtgtagccgccgacgtcggcgccgtcggtctgcacgcc

SEQ ID NO: 2708 - DNA, 541 bp, Zea mays
ggctcaccctggcagtctgtcacccaggcgaccataaaatatattttgaattttgataaagaattctaatgaattatatagtgcaaagtgtttacgtggtctttcacttactcatagacgcaaatcagacctaactaaataagacaataatttgagatataccgccatcgttaaccgtttggttctcgatgcccacccagtctagcggctgggggctacgacgccatcactgtcgtctggcacgaatgtcatgacacaaccgctcttggtaaataatacatattgttcatatcacacgaggtactacagatacgataacagtaagcagagatcgacatgcatctttttattcatccacaccacgaggcacgagctagcgccctagcagctcgggacggcgatgccgcaggaggtgagcgtgcggcgggcgttggggctgttgatgtagctgctgtacgccgggttgcgcgcgtactggcagaagcacggctcctgcgcgcgcaggttggagcagcacgacgccgtgggcggcgacccgctg

SEQ ID NO: 2709 - DNA, 1333 bp, Zea mays
gctgatttttagaattcaaaacaccttttacttagcattagtcttttttctcatgttcaaagtggacaatttcagtgggagtcttaggaagcaacattatcttaatgtttagggttagggtttatggtttagggtttagagctacacctttgaaaaataatattgcattatatagtgaattaatagtctataaatgtgaaataaataatcataatgcgacattacaaataatttaaattataattgtcatatatgcatcattaaaggctaagaaacgagtcatatatctataaaattatccaatatttatcattattgtgtaggttgattagttttatgcagctcgcgagccagagcggctcggctcagctcgttgccccaacgagctcaaaaacctggttcggctcgaggctcgcgagccgctctaagctcaagccggctcgtgagcttcgagttttttttccagccctagtcacctagacgatttatgttttagagatttattcaatgatcatgttatctgttccagttcgtcttgaaattataccctatacagaggcatggcgtgttaatgtaaaatttcaagactaacgtgccaattaaaagttgcaactaaatagccgatagaaatcagtaaaatatgtaaagatgaaacaaatcactctcaatgaaagtttcacacgatttccttaaccttgaaaacaggttgacatggtttcatcccatgaaaccaatttcacccacgaaactcatttatcttaaataatatgtcatatcatctaaaatattgaagtgacacacttataattatatctggcacaatcatgaaactgccattgtgaatagctatagtctcgtatgcaaacgggtcatgcatgagtccatagcaagtacgagtacatgttatcctaaatcccgtaacaaactcctactattgctggcggatgccctaacaacacgacgggttgtattagagcacgacgggtccggagctgaagtttcggttactcccgtcaaacgtgtccagtcgaaaatctcatcgccagagccttgggtttacgcatttacacgtaatccagtaggatccgccagttttacgccgcctgctccgatccatcgatctcataactgcatgcatgctatccccccggccctccaactccaacgaaccccgtcaactcgccagccttatccgtcggtctctccctccctcctctatataagccgcctacgtccccctcgacccctaccaatcgtcctcgcattatccatccatcatcgactaatccagtgtacgtcgttagttgttactcaagagatcaataccgcaaca

SEQ ID NO: 2710 - DNA, 370 bp, Zea mays
ggtagaagaaaacgaggtgttgccgtatgagtctgacgtccccaccggctgaggactcaggacacaggacaggacgacactgcgcgtagattcgtgtggctggccacaccggccacctgtatgttggcccgccgcgacccaaatctgtcatgtgccggcccgccgtgcccctctgttcgccgtcgaccggccggccactcgctatcactctacctcgctagaaagttccaaacgactacggcatcctctgactcccccgctctcggtccgcatttccattgtgctttctccgttgcatgcagcctcgcatctattctagcctccgccctcagctcaccaccacgacccgagggaaagggagaggggacga

SEQ ID NO: 2711 - DNA, 403 bp, Zea mays
ggtaatagctattaaaggtctatcgattttgctgatatacctagcaatagttcaragattccaacctaatatgccctgttacatcttttgcatgaaaaccacataacctgctatctgcatgctgatggtgtggttttacttgatcacctgaagcagtagtagatcatgaattgtcttgtatggaggattttgggaatttgaagctgcatatgattttattaagctatgctagttgtttgcactttttgttgttttttgtctgcaccttcttttcatttttgggtttatatttttgaagttgaactgctagaccaaaatgttcttatttgaaatataagttgctcatactatcttatcttctgctgtgtacaggtcatgatcaactaatgcctattcatttatt

SEQ ID NO: 2712 - DNA, 1500 bp, Zea mays
cgcatgatgcactcatatgcatgcattcctcgcccccatgcccgaacttgaagcctgtatccttaatttgctttggcatcgcccactcccagtttcgcgaggcggcatgtatacagaatgctgctaccatggcacgagtaattgcatcgcattgcgtcctttccctttgccccttgatgacaggagtaggagccgtagctaggacccatgcatgcatgttcgcttggtagctcttggttggaggtttatggcgagtgatagccgagacgggagcccaaaatctgggtctgatcatgatctggggcaggatcggagggcgggggccgccaccggccggcttttctttccaagtggggcaaccattggcttgttgagacgtgcatgatttcgtcctctctttctcccgtgctttgctttgatcatggcgccgcgccgggcgccggcccctccgtccctgaccgccttgtttccctgctaccagcgcagcagccgctacttcttattttctttctcgatcggccggcctggggatcgcaaagcaaagagccaccgcatccacacccacacctcaccccccaccacacgcacgcacgcacgcaccaacataggcaaaccattcgttctccctgctgccgttttattaggaaactctcccctttccgttttagcttagtgtccagctgcaaacttctccccccagcttctcttgctcagtgtgcatctctctttgtatttcactgtgctggcctgctttgttccttcgttctggttactattggttgctgcttccaagtgacgtaccagagtggtggttggcgtttcagtatgatttgataaggtttgggtcctcactcttcttgagcctctaatgcttgctttgcttccaagaagccatctatgcttagctgtagccctgtgccatgcaatgcatgtcgccatgtcggctaagcctattctattaattgatcaaatcgaggctcgcatttcttagtgttgaccaacatcctgttttactgtgtgctttaaacgagtagagagtacctcttgaagatacacagcctacctaatactaggatatagtaacttttttggtctagctagtttattctctgggactgggactgggagaaacctgtagaacaacgccgcctacggccctagtctctctcatgtgcatctctgttgcaatgtccgtgcctgattgctgctgccatgccaggttacctttgcgtataggagtatttttctttggtggggaggtgcgggtaggacgagcaatcttctgaccttgtccggaccggtgttcatgtcgccactatttattcattcattcatccatccattttattctaatcgcgccgctgcgttcagtttcaggcccttctttttttaaaaaaaaatcggtatctagttatctacaacgtttgacacctcctcccggacctcaagatgaccggcaacgcgtcttatcagcatctgggactgggagtcgacgccacg

SEQ ID NO: 2713 - DNA, 352 bp, Zea mays
tctgtcaagccaaaggtacaaatgtaattcaatattgtttctgtttattcatattaagaagaaggagatatattaacaaggtcatatggttattcatgttgtctcttatatgttatatgcttcttcttatattaatatatattgcgatgatgaaggtacgtccttcacgactttcgtctgaagatcattatatcctaagggaaataatacttcgaaggacaaagggcattaacctttaatattttgtgttgccttgttcttaattcatagcatttgagaacaagtccccaacattggcgcccaccgatggtgtactcacttccacaaccttcggcaagcactgaccttcgtc

SEQ ID NO: 2714 - DNA, 852 bp, Zea mays
gtttagtttaaaaatgaactagcgagcgacaaatatttaagaacgaagttagtatcatataccttcactgcaactgcaatggattggcattattaacttatgatacacattatttataataacaatactttttactaaggccctgtttggatcacctagtttcttataagctgttttttaaaagttgaaaggtctccaaatagattagttttttattcagtttcttaaaaactaagaagctggtcttcccagctaaaactagctaagaaactaggtggatccaaacatattctcctagttttttctaaaaatcagtttctacaagccagatctagaaactagtttttaaaaaattagagtgatctaaacacagcctaagttatgagacataattcagttacctataactaggaatgttggaaacataactagaatggtgacaacaggcaactagtcttccttaaacaaagaggcatttttgtccacgacgccctgcctcgcggcctgagctggcacatctccactcctcgccctctctactgtcctgtctcctcactccaccggtccaacccaacaaccagccccgccgaattccaaggtctattcttctgcccctcgggcgttcccgagatcgcatttccgagttcctgatcacgggaaacccttctggggacccgggaattcctccctcagatccgcgctttccttggaggcgtcgctgaatagctcggttctttgcgcaggtttcccgcgtgcggcggcgagcggggcgggacgtgccggggacggtggttgggttggattggattggatcggatcggtgccgcccgttgaccagagcgtaaaccagag

SEQ ID NO: 2715 - DNA, 694 bp, Zea mays
atttttgagcttctatctaatcgagtgagtgagtgtcgtaggtgtttagtgagttctttggtttggtttggtttggtttgtatgccctgtccatatgtgaatatgtatgtatacacgtattggttggcaacaaacacaaaacaatatcattgtttcgtaatgacatacatctatttatctatctatctttagaccgctggtgcatgtggtcgatctgtccatatgagaaatgtatgtatacacgtattggttggcaacaaacacaaaacaatatcattgtttcctaatgacatacatctatttatctatctatctttagaccgctggtgcatgtggtcgatctgaagtttgaaataggagattggatagaagatatgatgagcaagtagttgctggagaccttggggtggtcttgcttcttgtcgctgaggaggacgccyttcacggtcacctgcttgggcccgttacctgagtgggctgggctgggatggtccagtaggcagcgcaggaatcgtctcgtctcgtcactaggaagtggtactaggaatagagaggcgccgccgcatcccattcccattcccattcccatccggtaacggcatcccgcgtccctcggctcggatcgccgccgcccaacggagcaggagcaggagcagcgatccatcctatcctaggagccaaaccctagccagct

SEQ ID NO: 2716 - DNA, 189 bp, Zea mays
ggtaaaaaccctatagggtgcgggtttgggtgtgagtttgtacccgtgggtacatgttttttctcgtgggtatgaaaatgttgtatctgtgcccgcaaacccacatactcgcatgtgtgtgtatatatatagggatgaaaactgttggaggccttcatcttccgaaggtcctcaaaaacatgactaata

SEQ ID NO: 2717 - DNA, 91 bp, Zea mays
acccggtgatcctgcagttcggcaaggtcgggagggacatgttcaccatggactaccggtacccgctgtcggccttccaggccttcgccat

SEQ ID NO: 2718 - DNA, 1500 bp, Zea mays
aatttactacaagacatctatatatttcatgtcacaaatatataacattgcatttttagtgttgtatagttttatgatattggttgtttgtcataaaatcatatgccttaccacatgggcaaataccacgtagcatcaaaatcctatgccattattttcgttttgattttctttgcccatatactttttttatggttgcaaccgtacaatttttttcagcccgcacaattaagcccatataattattttggccggcacaattctgcccacgtatttctacaacacacatatttcaacctatatattttttctagcccaattcaacctctatacatttttttcagcccatacatgtgttttagcccatataattcagcccacgcacatagttgggaccttgcaattcagattagtggtctgaccaggaggtaggaacctcggaattgcgagttctagacccctgcgcgccaggtgcgagcacagtagcacacgagttatgagtttcgcgccccacctctctagaaaaaaattctgtccacatggcaataggacattctaacatattttttttaacaattttgatgtgggctgagataaataatagaaatattaaaaatctggccacatgaaaggatatttaaaataatttgtggcacatcatagacacactaacatttttttgacattttgatgtgctgagataaatagtattccattcgtcctaactcctaaaatatagttcttcctagccccatcttttttctgtacacatttatttgaaggataatgaatataaacataggttgattaatgaaagtatatttagtctaaaatgaattatattttgtgatgggggagtaaaaaacaaaaaaaattggccacgtgacaataggacatgctaacacatggacacgaatatttaaagtaattcaataaaataatgtgtggcacacgaactatgtcaataaaataatggcacgattcaaataggtgtaacggcatttctcacataaaaattataataaaataaatctaattaacgtactttaaaaagtttagcatctcaaacctagaattgattagtaggttattactgtggttgcctaaatgcttaacaaaaattggtaaaaagagtaggcgcctcgaggcgtttgtcgtgtctgtgtctgagtgtctctcacgtgccgtgccggaatctcgcagccatcgatcgatccagcagatgtgccagccgccgcggccgcgccaagcccaagccgagctgacgatcctgatgcggttgaaaatttccacgaacatatagatcctcatcgtcgaccccatccgtcctcctcccgacggtacgccagcctgccagagtccgacgcacgcctagggctcctggacacagcagagcccacgccttgagcccttgacgcgctccgtgtgagtggagcgcacaggcaccggccggcgaccagagagggagcggatcgagggggctcggcttgagtggaggag

SEQ ID NO: 2719 - DNA, 1500 bp, Zea mays
cctcacgctcacggtgtagtgcaggtggcgcatgctccagtcatttttttcccactgtagtgcatgtgaaccggttcttcggcgccaaagaaaagagctcgagagggagtgaaggtgacgccatgtgcgacctgcaagggcaacatagccactggggaaaaaaaaggggacctccatgtgggtttacgataggaaaaaaagactgtctttttacagcgatttgtcatctgttcacttgtgcctgtctgtctgtctgtctgtctgagttttcttgagcatgggttcatcaagcgttttgaccgattccttttcctgattgtctggccgttcctcgccccaaacttgaagatcttttgcgattacgcacagtagatatgaatatgatccgcaggctgcggcagcacaagatcacacacaacacaattcacagaggcagtgcagtccctcccctaccattaaaatgtactggtacctagctagcgcgcggtagtcacagtgggtggcactgggcaatggcagcagtcgcagaaagagaggacgactgaggagcagcgatccagcggctgcagctcttcctccctgccctgaagctgaagctgctgagaatagatgccctctccttccctccctccctccctccatctccatgagttgagcagcctgagcagatgaggtgaagtgagttggctgccagcgcgtgctgtatcttgtatggctgtactgtatcccccctcctctcgctaaccctttgtctccttcccccacaaaaccacctccgccccctcctcccaccagtacctgtgagttgtgagctccttgctgcggctgcttgctcccctcatctctagcctgtacactggttggagtggttgccagtgttctccccacctgctcctctcgatccactccatcccctttggccatgggtgtgcaagcatacatctacggtaattgcatgcttctcctgccttgaagcggaagccttagccttagcctgccgcctgggggaaaccttctgtttcgccgctgccgctgctgtggtataaaggtggaaggctgatccgtcgacggacggagtcccggcggagggaagattgctccgtcgccgcggtttcgcggccaagaaggtggcctacgcggtggaaaggggcggggcggggccgtgaaggaatcttgctccgacgccaatccctcctctgcccctcgattttcgggcggttgtcggtgctgcctttcgcagtaagaggtgggatctcgcgtccggcggcggcggcggcggcgttgctggatcgagcaacctccggcggtggcctgcgtacctgcgtggccgatctgtgcgtggctgttcatctcttcgccggcattgcgaggcgggctcgccgggcggtgtggattgcttgcggtgaggagtgcggaggagaggtgctgatccaagcggcgggcgggcgggcggctgcacgccaggtgttcgacgaaggaccccgaccgggccagccagcc

SEQ ID NO: 2720 - DNA, 1500 bp, Zea mays
acgcctacttgtttcccgtcactccccgtccacgttagctgcctgagtcgtggggcgtgtgagctccggaccgggcacccgcacgaccgcgactccggcagcgagagcacagaagacgacggcaagactgagcaacgggccaacggcgcgtgctggacgcggacggacggaacatacggttgcgtccacgcgccaaaagtggtttggctgtctccaactggagcctatatcaacaacaggagactacatgttttttgattacatagattatatgtaatattttttcgtttatagtctctaatagtatctttttaaatattgttctaaatacagtacagtgtacactctttcgtcctcatatatagagtttcttttcttgttatctattttttataatctagataatatattacataaaaaatatttgagagtatgacgtgtttataaaaatttagagtaaaacatatttttaatataaatatttcatatgtagaacattgttggaaaataatattttttaaaaagaaactgtaaaagaaacagaggaaacagaataggcattgcccgggccgcgtttataagtcgccagaccctccctccccgatctcgcactctcctcccccgctctcgacttcccacatcccctgcggccccgccccccgactcttctcgtcgcggcgcgcccaatcggctcggtggcaggctagtgcaccggctcggctcgggtccggttctaccgccaacgcgggccgcggcgctcccggatctcggtctagtaagtccctgccctcgaatttgatcatgcgaaatctcatattgtttcctggggcggttctcctctgttggctcctcgtggtggcgagcgcggtagatctgatcctcgcgtctctctccgaccatctgccgtcgcgttggtgggtgggttacgtcatacgtgggtacgcagcgtgatctggcattccctgcttcaaaagggatggcctggtcctggttgccgcgtgatttggccctctagattcgtggatcacgaggattatgggcggccaccttttggtgattgcttgggctaggacattggctgccttaccgttttagcgatatcctagcaggagtagttagtagttgatttaatgatcctcactggcctaattaattgcgctcgtaacatacaaaactcaagttggtaatcaccggcaacagtgcgtcatggagagtttgyctgttctaagcataaatgttacgattgagtcatttcaatttcagattacattcgagacgagtactggaatttttttcatactaaattgtttccatattttctactcattgtttgtcaatgaaatagtatttgctatggaaggcaaccggatctctgcttttactttcctgtcattacacttcctcaactttagaggatgggcaatcaatctgagagtactcctaaccccgttgtgtttttttttggaacacattaacaggtcagagagttagcagacaaag

SEQ ID NO: 2721 - DNA, 1500 bp, Zea mays
agtatgggaaatagggggagtttttgaaatctttgatcaatctcttttggaatgactctctttatgcttcaacatgcgtgtttgacttagagatagaaatttgagtttgatttgcaaaaacaaaccaagtggtggcaaaggatgatccatatatgccaaaaatgaatcaaaataaatttgagttttatttgaagtgtttttgcacttattctagttgctttatgttgtgttggcataaatcaccaaaaagggggagattgaaagggaaatgtgcccttgggccatttctaagtattttggtgattgagtgccaacacaagtgcttaaatgtgaatctatacccatggatggacaaagtgcaaatcaagagtaaaggagaaatcgagtcagagaagttggctgtgtacagccaaaaggttgttcggtctggagcaccggactgtccggtggtgcaccggacagtgtccggtgcgccagactgactcgggcgaactggccgctctcgggaatttaccggcgacgtacggctataattcaccggactgtccggtgtgcaccggactgtccggtgagccaacggtcagccgggccaacggtcggccgcgcgatctgcgcgggacacgtggccgagccaacggctagaagggggcaccggactgtccggtgtgcaccggacatgtccggtgcgccaacggctctctggcggccaacggtcggctgcgccgtttaaggaaagaaatcgggcaccggacagtgtccggtgtgcaccggactgtccggtgcaccagtcgacagaaggcaagatcagccttccagatttgctctcaacggctcctagctgccttggggctataaaagggacccctaggcgcatggaggagtacaccaagcattcctacaacattcctaagcaccaagacatcgattccgcgcatttggttcattgtgatagcatctagagctcttgttgagttgtgaactcattgagttgtgttgcgagctcttgttgcgacttgtgtgcgtgctgttgctctgattttgagtcttgtgtgcgttgctagttcctcccttactccgtatttctttgtgaatctcaagtgtaagggcgagaggctccaagttgtggagattcctcgcaaacgggatattgaaaggcaaagcaaaacaccgtggtattcaagttggtctttggaccgcttgagaggggttgattgcaaccctcgtccgttgggacgccacaacgtggagtaggcaagcgttggtcttggccgaaccacgggataaaccactgtgtcatctctgtgtttgatctcttgtggtattgtgttttgttgagactcctctctagccacttggcgattattgtgctaacacttaacaagtttttgtggctataagtttaagttttcacaggatcacctattcacccaccccccctctaggtgctctcaattggtatcagagccgttctcttcacaaagggactaaccgcccgaagag

SEQ ID NO: 2722 - DNA, 333 bp, Zea mays
caatcacctccccccatcaaaccacacagaagacgacatcggattcggagcggaggacggagaaaaacgacttgccttccggacctccggttgcggtggtgccggcgaaggcggggagagggagagcgctagaagggggcggaggcggtggtcgtcgagcccggcgtcgggggcgatgaggatgtggcgggagaaagcggcgacggtctggaggacgggcgccagcggattccagcccgtcagtggcatcgaggtggtggccgcgggctcgcgtgcgtgtggtggggacccggggtagcaagcgcaatcctgcgaaaggcggtggattggtgg

SEQ ID NO: 2723 - DNA, 92 bp, Zea mays
tctcctctagtggtggcgccgccataaccggtgctgccgccgccataggcgcaggcgcatgcccaacactggcttcccccggcttggcctcc

SEQ ID NO: 2724 - DNA, 206 bp, Zea mays
ggtacgtgcagttcagtgataactggtaacctcgcttcgctcagccgtttgtgcacctcgatattgtactagtgctcttgagagcagagggggaatgcggatcggaacaagtacgctctaggagctggttgtttaagaaatttatatccaaaaatcagtacgaattttttgaatgccttcgcgttactccaattaagaggaggtgt

SEQ ID NO: 2725 - DNA, 324 bp, Zea mays
ggtaagaacgctagattccaaatcaacgtcacgttgtccctttcgacccatgctccacgcgctcaacgattaccattaggctagcgcgtctcttgggcttgacgacacgtctatgtgcatccatctccatcaaagcagtagcagttgtcatcagtcactttttttaatccataaattgcctgtacggttgcccactttttgaacttgagggttgatggtgggattatgtgatgaccgacctggtttgggaaatatttgtgcagatcgagcagatttggaaggctgcagggagtgaagtgtgcgattgcaggaaggaacttgtac

SEQ ID NO: 2726 - DNA, 1500 bp, Zea mays
attgaagaaacaatccatgcatatcttataagtatttatattggctcaattccaagcaacctttgcacttacattatgcaaactagttcaattatgcacttctatacttgctttggtttgtgttggcatcaatcaccaaaaagggggagattgaaagggaattaggcttacacctattttcctaattgattttggtggttgaattgcccaacacaaataattggactaactagtttgctctagtgtataagttatacaggtgccaaaggttcacacttagccaataaaaagaccaagaattgggttcaacaaagagagcaagggataaccgaagtgtgccctggtctggcgcaccggactgtccggtgtgccaccggacagtgtccgttgcaccaggggacttcacgctgaactcttcaccttctagaaaatccagaggcgcttccgctataattcaccagactgttcgatgtacaccggacagtgtccggtgctgcaaggaagggcgtctctggaactcgccagcttcgggaatttgctccgctataattcaccggacgtgtccggtgtacaccggactgtccggtgagccagcggagcaacggctacttcgcgccaacggtcacctgcaggcgcatttaatgcacgccagagcgcgcagaagtcaggcacgcgcgcgctggcacaccggacactctacagtacatgtccggtgtgccaccggacatccaggcgggcccagaagacagagctccaacggtcggaacccaacggccttggtgacgtggctggcgcaccggacatgtccggtgtgcaccggactgtccggtgcaccatacgacagtcagccaccaccaaacggctagtttggtggttggggctataaatacccccaaccaccccacattcaagtcatccaagttttcccacttcaactacttacaagagctctagcattcaattctagacacacccaagtgatcaaatcctctccaaactccacacaacgccctagtgattagtgagagagatttgcttgtgttctttcgagctcttgcgcttggattgctttcttctttctttgattcttcattgcgatcaaactcacttgtaattgaggcaagagacaccaatcttgtggtggtccttgtgggaactttgtgttccaagtgattgagaagagaaagctcactcggtccgagggaccgtttgagagagggaaagggttgaaagagacccggtctttgtgaccacctcaacggggagtaggtttgcgagaaccgaacctcggtaaaacaaatccacgtgtcacactccttattcgcttgcgatttgttttgcaccctctctcgcggactcgattatatttctaacgctaacccggcttgtagttgtgattatttttgagaatttcagtttcgccctattcaccccccctctaggcgactttcaattggtatcagagcccggtgcttcattagagcctaaccgctcgaagtg

SEQ ID NO: 2727 - DNA, 472 bp, Zea mays
aacttgtggagtggactagtgagagctctgataaatttatatgaacttttaaattgccatgtatttttattttaattattgtgcaatctataatttttaatttaataaaaaatattatgctatgtgatttctgagcgttgaaataaatctatgtgaattacttaattataaaatagaaaagttgatgtggttatagtctaagacaatagcgctcgtgttctagagcaacaatgacgagagtggagtcagagagtggcaacaacgagagcggttgggggcgttggctccagyctcatgaacagtacagtcgccctgattgaaggtgtgagtctagtcttcttagtttttttttaattctccagtcccactacttgcacctcgcactttactctttctcatctctcgcagctagcttcgagctcgctgaacaagtgaagccatagcgggagcagctacaacgaagtgatcctcc

SEQ ID NO: 2728 - DNA, 1500 bp, Zea mays
aaacacataaatttatcaatttaacaaatatatgtatcacctcaatttatttttactttcaaacctcttttaatagtttctgtcgcttactattttctcaaatagaaccttttattttcttaatttatccatgcgtccaatttactcatatttatctaaaaacgttggatgaggagccaatacagagttcctattggttttgaaaaattatgagttagaggagagttttacaaagttacttttaagaagtttttttttccaagggcacttttaattttttccagaaatatccaaacagggagttcatttagaaaattactagagctattctcaggatcttaaaataggaaagagttcttcttacctccctaaattatctatctcatgtgattttcttctcaacctttaaaatcaaacaccttatcatcttaattgttaaaactatttaaactacctctctctatctctctctctgaagcagtttcatcatttgactattttttgtatatatctattaattattgaaccatgaaaaaaatcctcaaatcttataaaagtatcaagaaaaatcccagaaataggctataccatgaacaatttagaatattctaattgatgtataaatatgttttgagaacctcataacaaaacataagattcaactaacatgaatgtattcgacattaaatttgtgatgcattcttgtgttgttgtcccttatgtttttaaagtttttaaaacacacttaaacatcaattagaatgtttttggaaaattttaggttttcctaaacttttttccatttcactagagctaaactcataattttcgataggatacatggtttagtagaaatatgccactccagttttaaaaagttagaaactagttcatttttatgccactctatagtgttaaaatgaactaaccatctaagtttgcaaaagtagagtgacctatatacaatcaatccctttcaaaatatacaaatacttcatttgttttttcatatcccaatctagctctataatttattagcgtttttacaagtttagagatcttcgtggagttttagaatcttattaaacatttatcattttaactaaaaactgtaaaccacctctatgctagatagatagttaatttaaatggttttataaattgatattgtaaaatatccgagtttagagtttacataaaatcaaaccacacacataattttgagagataaaaaggcataatatattatcccaacctcacagtcaaatgagacccattcagcccaccggctacacggcccatattccgtactcgtgaacctcgtgctgacgtgctcacacagtcactccgtttagctcaaatccttatcggcgactcggcgtcggagctcacgaccacgaccgcttccacgccctcgaccccgaacccccaatcccggacgcgaccgctgaaccctagyatactccggccatctgctgccggccccggcgatcccccgcc

SEQ ID NO: 2729 - DNA, 723 bp, Zea mays
tgaatggattaataacatcatgctatgctatattgagcgggatatgtttgtagatattcaagatgaaaagattttgaagtattttcaagacttaagaactcaaagataaatttacctcgtaacatcaactcatgaacggtatgtattgattattgtatttctagaattcgacgaattcgtatcgacttatttttgggctacatatttcttgaatgtttaaattatatcttacttcttgtgtcatattaaacatcaattatatttttttgtttggtttaatttttttatagcattaacttagtagcccctcttaaatcgatgttggatccgccactgatcacatcacgttgcatgtccaaacacaaatcgaactgtcgctagtccgataatatctgatcgtaaaatggaatagggaattctggattacctattgctaaagtaaagagaaaacgaaatggaaaaaggaaaggaaaaggaaaggaaaaaacgaaatagatagggagaaaaagggcggagaaaaaccgcaattgcaacttggaatcctcccctcgcggtcgcgtcctcgccagtcgccacaccgctgcctataaatccggcccacggaccgcacgaccagccacctggttctccgtccggtcagaccaatcaacaaagtgacgcgagcacgagcatccatcgtttccccttcttccccatcgcgtgccctcgccgcagccatcttcc

SEQ ID NO: 2730 - DNA, 1500 bp, Zea mays
ttggttcagctattgattcctaaaaatctgattttagctacaagctatgagggggctgttatgagctgatggctatgggaaagctaaaatctatttggttgaaacaattgtcaactatagattctataatagtatgatagcttggcaacatggcagggggggaccaccctggcctctcgaatgagtcaattcgatagcatgatatcatcggcaaggggtgatacgctttgtcgtgggggtatatgcccacaacgctatacccaaacgttgtggttgtagtcatgcccaatctagtgtatacaaagcatcctatacgagtagcgtgtatggcagtgacaatagctgaagcgataggtgttgcgtcatcgtcttccattggtatgaagcctctcagtcatggaatatcaatgtggagtctagagagatgttgaaagggatagcatcatatatggacgagcatcgtggatgggggatgatgagcgaagagtagatgagaaaaatgtataatgttcaaggacaacaaagccacatcattgacctccaaaatcgagtgtagagagatgatggcaactttagctgtcgctaggaggtgtcatggagtgagagtcgagcgacaaattagatagaaaataaaacgattcaaccctataaacagtagtaaccgaataataatttctaaaaatctagatgacataattttttttaaaaaaagataaaagtatgttctggattaaactagagaaatctatagattctcgtaaatctattcatcccacgtagccttttgattatgattccagattttttggcttaggatcatcattatgtcgttattgtaggaatctgatattaacgttatgatcatatagatcccatattaattgtttcgttaccatcgaaggaatcgaaatgggaacgcagcatgaaaatcttgcggtgaaaacggcgttcacagagaaagcgaagatcaatctacggcgggtacagtcagtgcggtggtcagtcggaggcagacaagcgaagcagccaaaaccaccagcgaggcggcgatgagtgagcaatgattcccctgccaaatcgaaaaaatctccctgctaggctaggcaccaagccaagcaaatccactcgagaccagaccggcgacggcggccccgcgtccgtcgccatcaaagccaccgctgcggtcgctcctccgggacccctcctcctccgcggaccaccgccagcgctcgacagcaacacgcgcacgcccacgcgcgaagagtcaacaggagagagactggcggtggtggaactggcagtagaataagcttgcgtcgagtgggagttggcgaggcatcgctcgcttcccctccaccccactctgcccaccgagcgccagtggagcgcttacttgacttgacctcgccgcctcctgccctccccctccccctccccctgccggcgcccgttctttcctcccctcgccggacgcccaccgccggagcggaagagggggga

SEQ ID NO: 2731 - DNA, 406 bp, Zea mays
tgttgattaccaatttaccacccgagattatcgcaagtgcatgtgaagcctgaagcctctgattgagtttatcttttctttttctcaaccggtggtcgttggggaaacatgcaaactggaactttcacatgcgtgcagatgcaatcatatccgacagcggtagtcagccaaggattataaaataaaatctgagggatgcctcagttgcatgctctccagcgaaccatttgttgacatcatgcatgatctgtatctgctggtttcctgtaagagctgtcgctgaaatatcgaatcgacccatgtacataataatctcatgccatgttctttctgccactccagggaaatctccatctcggtcgctgctgttgctgaggtcggcggcgcagatcgtcgcaacatgagc

SEQ ID NO: 2732 - DNA, 1500 bp, Zea mays
ttttataattataattcttacaatcaatgataccatattacatccttactgtcttggtgttggttggaatttttttagtgtccccgtaatgaattacttttgtgtcttcatagtcaatagatgggttccacaggctgcaagttatggaatgccatagtgaggatatagtaatgcagtggtcaatcctctaggttagtagaccttctaaataataatatattcatctgatgttttgttgaatgctgaattaaggaatcatctcgtagtttacaatttatattaccatttttattagatttgctaataaggttagaagtaaatttctggtatcatggattgattggccatttaatggaaatctttgagtgtgagattaataatacttggcaggattactatttttttattaaatttgctaataaggttagcagtaaatttttgctatcatggattgactggccattgagtggaaatctttgagtgtgagattagtaatgtatttgcaactcttgcttttaacttatcttgttcattaggaaatacaaacatgccaaatggaaatactcaggattatcaagctggccattctctatttcatgggccactgtctcatttctgccagaatccttgcatgggtatcaaagcacttcaaatacaaatgccccatcaagagtttattggtaacaatgtggtgcatggtttaaatccttgtgtcgcaggtcttcctgtacatccaagaatgctagctctcccattcaatgttgatcacacttttgggcatccaatgcacccaactctgataaaccaagctaacaatggggctttaagagttctaacatattaggtggcttcatatttgcaattttttacccataaagttcttgcatagttgcatgtatctgttaataacaatattggaagctggtcgccaattggctgcattctaccgcatggtgcgcgacgagtagcaggtcgcgtccaggatgaaccgcctctacgtcctattgcccaacggcgccgtcgtggacctccacaccatcgcatccagcatggccgccgctgggtaacagccacgagtgcgcgcagatgtacatttgtggcttagttaattccttcttttgataataattgtctttaactctgctttaggacaatccagttggaaattacagccgggttaacaagatttttaatgtggattctcaaccagtatgttgctgctcacatttccaactttgaaaatgcacttcaattactgttgtttacttaatgtttctttatccaagttcatgtttgggatttttcargacagrcaaayctaatattaatgaatgaatgtaatggactacatgacttmtgccatgcagatcaagaggtagcatcagctgccacatctgatccatctacttttttcatttgaccgaaattaatttatatttggagatggtattaatttatgtttttatcatcttatagcatagcctaatattttcttgccac

SEQ ID NO: 2733 - DNA, 164 bp, Zea mays
taagcgttactccccatgtatccagtggtcgaccagatcactagatcgggcagattgcacgctgggattcatgatctgtatggtaggcatgggggtgagatctgagcgcggaatgaatgaacgattggtgattctgcaggtgctgaaggcgagcacggaggaag

SEQ ID NO: 2734 - DNA, 1500 bp, Zea mays
aggccggcccgataagcactgaaaagggggccaaacacgggctaaacggggcggtaagcacgattcagtgcaaaaaatgggcttaaaggtaaatgggccgtgtcgggttagcacaacgtacttagtttcctgtccggacccggcccgcttattcgtgtcgggccgggccggcctggacccgtataaaagcgggccggaccggactcctactgggccaaaaaacatgcttcgagctagactttcgtgtttagttacatctataggtaccttcgatgaaagtagaaccgtagaacaaagagtagacacacgaggcacgttagctgtttgtgttgttgtgtgtggcttcacgatccggatcggcagatgataatgaaactagacgctaccgacgcccagccgtagcggttggaacctgcctcagccctcacagatgcagcgcaacaagatgatatagtycactgtcaggtatgatcgatcggtaagctaagatctgcatgcatgtgcatgtcatgtccacagccgtcgtcctcaaaagctggcagccttggcagcaggcagcaagccgcctgcagtactgtacaagacaaagtcaaatttgagcagctccaactccaacagagtctaacttggctgccagctgccagggcttctacgatctctccacgttccggctgctaattacatgtgaaaattcgatgtcgtaatcttggagtagtatactagtattatttgcggtgttcgaggtcaatactacagtacctagcacgtactacggtactatttatttagcaactaaagtttagttgagagactaaagtttaatatctaccgtatttggttgtaggaactaaaaatatttagaacgtattaaatgactcataagaagactaaaatatctattaacattctctcaccattacattaatgcatctgaaataaacgaggggcaaaagatggaatgaatatgatttaatttgttttagtcacctctttagggattagagactaaagtagtttagtccatgttttagtccaaccgtttggttatttagaaactaaatgagacgaaaatctttaatctctcaagctaaacgggacattaattaagataaataataagtaatacttccttggttccaaaatataatttattttagactaaaaatatatccattcattaacttactaatgtagtttgtatgtatgtttatatttattatcattcattgaatgtggacagagaaaaagatgactagaaagaactatattttagaacggagttattacttataaccctagagatcagtattccacaatagcgatccatccacgtacgtactctacccaactcccaagactcgattcatgcactgcattgcgcttgcgccacacatatatcagactactatatggtggcaagcctatataaggacatgcttgcacaccgcttcctgcacacaccacccaaactaaacaacaccagcttctctcacgatcacg

SEQ ID NO: 2735 - DNA, 440 bp, Zea mays
ggcggtgcccagtcgacgccgctccttccggcatccacctactacagcgtgaaacgtgctcgggggtgcctcttgcaccagtcgagcgcacagtttccattttattactaagaagcgttttggttgatggcttaataagcactcgtgcagctgtgtgctgtccagtgcggaagcccactaactagctagccggtttgcaactaatcaagtgagcactcactagccaataagccaaagtggagacaacactacccatactcgagtcgagtgctgtagcacgatacatgtaatcagtgagcgccaggtggtcacacccttccgtccttcgatcagtgtcaggagcactatataagaagcaccagccttgtaggagaggccagcagcagcatccttaccagcacacagtggagctagctagctagtagagaggtcaatcacca

SEQ ID NO: 2736 - DNA, 161 bp, Zea mays
ggtaagaagcttgacacaccggttaggttagtcggttactcaagactcttcgcaacaagctagcgtcagtcatctgttgctgacgtctctttacgatcgtgctgcctcttcacagggtgcaagcgcgactgccacttcacaccttcctcaaggcggcgaag

SEQ ID NO: 2737 - DNA, 754 bp, Zea mays
tgtataattatatatatatttgtgtgtggatgggccctccatttcgaatttcgcactgggtccctgaaaagtcaggaacgaccctgttgcaagaaacatgctcgcatttagaagatctagtttccttaggattgttgggtattcaacggctgagcaactatatgggtagatttataatctcacagcctgatggaaaatggacatgaatagaagaaaggaggaaaggcaggagaaagtagtagtaagcaaaggcaaaggagaagctgtagtgttccacgtcgatgtcagcagtgaaggcgggctttgattgccaagtcagtggggtgagagggacccataggggcaaaatcgagataatagtggggagaatcaaaaaaccgcaccccggaggccacaaatcaagcttgtggctctcggccaccgcccgctcgcccacgtggcccccacccccgactccggctcccgctccttaaaactatccccaattccccgtccgctatcccgatcgatccatccatcgatcgcccacgcttccgtccatccagactccagagagataaaatctaattcctggacctggagtgcagaccgatcgccgccgccgccgcgttgtttcttgtctgctcagctgtggtgatggtgcggtaaaagaaggctgctccatcgctccaacaaaaaaaaaggttgggatcgcacgcggcaggcgacaagcagtttccaaagagaagggaagcctagaggaagggagctagag

SEQ ID NO: 2738 - DNA, 384 bp, Zea mays
gagctgtggaattgacattataacataaatcagattgctacaactgtgaagtatttactcaaacctgttccaaatttgattgagttgtgctcaacacatttagatattgtttatgcatggtctctatgaacatgtcattgtgatcccataatccgtcgtcaccctttttattttgcttgttgttcttagactttgtaataagcatttgttttctgtaaagaatttgaggcctcgccacatgtctcaaaaagtaattttcataattcccgatttttgatttcaggataatatgttcaatctgtttccttgttcatttaaacgtagagtggccttgaaggatgataattgaagcaaaatgattctctatttcaccatattttggag

SEQ ID NO: 2739 - DNA, 1086 bp, Zea mays
tacaagctaccttacgtgataaaacatatcacaaaaaatgataattcattattttttttaacaagaccggtgatcaaagtttttttaaaagttaactgtgccatatatttatggatggagggagtatatatgcatttcgtttgctttcgttgtccgagcgccgatgccacccacaaaatgtcagaagagcctcgagtttgatggcttcgtcrttcacgtgtgtggcgtgtctgatgtctccgccaggtgccggtgcactaagactatttctagcagaccgtataaaaatcgtgcaaaatactattttgtattgtagatcacactgtttgtataatattgtctgaaatagagagtgatatggagagtgatagaaattctgctaaggctgccgctacggcagcacccagcctcctagtcacccagggacaccggtagctctgccaggcctgtgaggctgtgagcctgtgactcggaccggaattctgtgctagagatgaagggaaactcacgccgggacgcgatcgattgtgccctcgaacatggcagctcatatcaaaaagatcctacgagatcacagcgcctcttctcaccttctcttgtccaccctttttacctggcacaccttgctgaacgcaacttaccatccacatgtgtctgcaaaaacggtaggaagattgcttctacgcggctatggcaactgatcgaagtgcctggtgtattccatgcgagaagtaatcgcatcgctctgtgatttctcacgaaaaaataaatactataaagagctgtcaatctggattaactgtgctttattcccaccaataaaagggcagtaactgacgtcgctctcgctcactaaggcctggaccaggaccaattaataattccctgaatcgtttactgatactactaattccttgccaaatttgaatgcacgcggattatatatattaatactactaattccttgccaactttggatacacgccgattatatatattaatacacacaccacacactacacaaatacgcctctgctttagcagtagtttccaaccagaggcaggcacctcgagaggcgggtgaac

SEQ ID NO: 2740 - DNA, 525 bp, Zea mays
tcgatagagagaattaagtatatttttagtgtttaaaccagaagtgattatatcttatatactatgagagagggagtataccgtgaagaacggttttcagatgcggctgtttggactgactttgaaggcgggagaagtgtccgagctcataggctcatagctcaacacaggatgtgagtgtgtaagtgtgaatggtcggcgtaactgcgagaatacgtctctctagtgttttggcgtaggaattaattacacgtgagtggttggcttaaaagcctaaacctgtgtcctgtaaccggtgaatttagatcaggattcaggaatagaaaaagaaaaagaatggacagcttgttgctcaagttgttcacccacctccactccacctgtgtgtgtgtgtttcacgtcccggcggaacttgccggcggacacgcgtcgtcacagccgaccaacggcgcttgcccgttcccccatcccccttgattcctccgccagcccagcggcggccactctccacgcatctgcatccgc

SEQ ID NO: 2741 - DNA, 1500 bp, Zea mays
tctcaatcatatacaaactaccagattttttatccatatatatcaaacacatcgggccccatcatccaactccttcccaccaacatgattgcacaatagagtaggagagaataaactctgtaaataaggtttctcttgcacactttaaatttagagtgccaagtaagatatgtggttgtagcaattttttactgcatgcatagtgtgcactgcgaccagccattcacgcgactcacgaggccaagctacacccatcgcgactttttatactagtatcgccatgctaccaacatccacatatgggtgcttgacaccacgtcatgcatgccatatatggggtccctagttttcgttctgtcggcaccatacatgttcgcttcgaattaaaacccattatttagactgttgtagatacaatttatacagacaaaaatattatataagtaatagaagtcggtaccgattaaagccaaacaaacagtcatatggcttcgttgggtaacctatggctaccatgtccatagagaaggtgctcgtatataaagtcatgtttgtaactcatagagctaataattagctaactaacaaaatgttagctggattgtgccagctaataaactaattgttagttgtgtgttagataacaattagctaggatattagttgaggatttgaaacctccacagtaattttagcagctaactattagatatagaggattcaaacagggtcaaagatagataaatatactataggattacatagaataggactttgtgggcttccggcataagaaaagctaaatgattaacacgagacatcagtttatatagggcagggtactaggtcatgtagggcctatttggtgtagcgtcgaagctgccacacccagcgctcgatttggccgccacaacggcgacggcaaacctatgacgcgttgtggcgtgggcggcggccaaccaaacaggcctgtaataccatacttcctatgtagcatggtgtcttgcgttggattgctaattatgatatgttacaagtggagtaccaatgcatctctttatatatagtccaaaggatagacgtacaggtcgagatctagtcggtcaaggcagaagagttctgatccaattaggggtcatttggatccattcattttagaggaattagaatctacttaacatatgatctttaacatatggtctcggtaacacttctcgagtcctgagttcgactgttctcatatagtctacggtgtcgcttaatgatcataggttatcttgctcctataggttgagctttttttttgtccgcatcacccctatatcgacatgacgtgtaagatagcaggtcaagtaatacctattttcatcacctgaaccagttccccatttagggcttgttcggttagctctcaatccatgtggattgagtgggattggatgggtttaaatcccaagcaagtcaatcttcttcttaattttttccaatcccatccaatcc

SEQ ID NO: 2742 - DNA, 515 bp, Zea mays
gcatttgttaccttcggatggaatttcagttgtatttattttgggtttttgtaaagataactatctgcatttcaaaatctgttcaccttggtgcatgttttaaccaaaaaatgaatagggaatttgataatgttatgttttcatggtgccattcgggtatggtcatgtatagaaattttttgctagctgttccaagttgttggatacagtttttttgggtttcccatttgtgcatgaggtattcattgggatttacaatctaagttgtatcatcaccatttttccttctagaacttctggatctgatgtcatgcactacagactcatgtttgtgaaaatgcaggtggtttttgttggaggacgcactcagcctggcactgtaaaacctgaagaaggagaccgccacccttattctatgttagattgtgtggcacagcgtgaaacaattttgcctttcgtactctatatccagaaaacattgcgcaggaggcctttcttaataaaaaatcttgaaa

SEQ ID NO: 2743 - DNA, 1500 bp, Zea mays
cgactgtgaatagataccaaagtattcagtctatacttagaatataatattagtgttaagatgatatttttctacacagattttgcatattatagtgacaattatcgttacatatttatgttttatataaatttttaactctcgtgacaacgtacgtacacatatctagtagtattcagggcaaataccgtctcggggacgacgaccaaacaaacaaaccaaaccaaacagtgcgggaatccttgctgattcataggccgggaacggcgaatctgtccaaccggtctcccgatccggagtcgaaggatagtgctcctatttgtttagatgagaatctttagacaargaaccgggatcaacgaaatcatcgccacgtagccatagaatatactacggaatcctccatggatcagctttactagcagccgccgccgccgcggcggagagagacgccagacacttcttctgggcttctctctctctatctctctgactctcttacaaggaggggagtcgagagacaaatcgtcttgaggtatcttcctcccttgtatggttcgtttatttcttggatgttacggtggtgatccaccgcctaggagctcgatcgccggcgacgtcgtggccgtgtgctgtcgttctaatgcggctaggggtggatctagaataaaatatgactgatagtatacttgtgaggacgagtacaaaaatatcagaacaaagacagttaggttgaggaggtgatctcatgataaatattagagcttatttgatttgctgactaacttgttatattttatctaaattttctgtttgactttaatatttaattcgaatgattaatcttagtcaaaatgtgatgcaattagacacgaataaaacagtcctttaaattctactagttacaacagataaaaagcggaggtctgtaccctcgctgcactagccctaactaggtccgcccctcacggtcccgttgggttctgaaaactcaaaaagagagagaggtaatttgggtaatcaagtctgtgtatgattactagaataggtacagtatatataggctaagccactagccgattatagaaacagatcgggagggcagtcactggttagccaagattacagcacggctgattagccaaaattacagcagcagttacaggagaggatatcctctagcaatatactgtcaaagctccaacgccattggtgaacgaatctcaaggaggtacgtagacagagacagacgccgcaagctcgcgttcgcagtgccagtcaaactggtggtgagcaagttggacttttcagtcagtggccttgttggctctcttcctctccggttggttcttggttcagatatcgggggtgggtcttcgtcttcccctgcctcgcctctgcttcactgcaggtggtcgaagaagaagaaggccctcgatctcctgccctccactccaccagagccggtgcgatcccggtcccgaccgacctcagcacagc

SEQ ID NO: 2744 - DNA, 116 bp, Zea mays
cctaagaccaactccagcagtgtgcgactccgtatccctaaaacgcgcggccgacacattctctctcctctccgtatccggctccgtttccagcaacactccccatcccactccgc

SEQ ID NO: 2745 - DNA, 1500 bp, Zea mays
tatgcctcaacatgtgtggttgacatagaaatagagatttgagtttgatttgcaaaaacaaaccaagtggtggcaaaggatgatccatatatgccaaaattgaatcaaaaccaatttgagtttttatttgaagtgattttgcacttgttctagttgctttatgttgtgttggcataaatcaccaaaaagggggagattgaaagggaaatgtgcctttgggccatttctaagtattttggtgattgagtgcaaacacaagtgcttaaatgtgagaatatgcccatggatgaacaaagtgcaaatcacaagtaaaggtatgtttctaagccttagtacattggttttgtgtactaatatatttgtctaagtgcttgaaacaggagaaatcgaataagagaaaagttggctctgtacagccaaaaggctgttcggtctggagcaccggactgtccggtggtgcaccggacagtgtccggtgcgccagactgactcgggcgaactggctgctctcgggaattcgccgacagcgtacggctaaaattcaccggactgtccggtgtgcaccggactgtccggtgtgcaccggactgtccggtgagccaacggtcggccgggccaacggtcggccgcgcgatctgcgcgagacacgtggccgagccaacggtcggaagggggcaccggactatccggtgtgcaccggacatgtccggtgcgccaacggctcccagatcttcaacggtcagcaacggtcggctgcgctgttttaaggaaagaaatcgggcaccggactgtccggtgcacccgacgacagaaggcaaagatggccttccagatttgctctcaacggctcctagctgccttggggctataaaagggacccccaggcgcatggaggagacacacaagcaaccttagagcattcttgatcatccacactcagtctttgcgcattcgtttgtcattctcagtgattcgagctccgttctagtgagaactttgagatagccttttgagctcgattcttggccgtgtgtgtgcgcatcttgctgtggatttgtgtgtgttgctttccttccttactccgtgtttctttgtgaaattcaattgtaagggcgagagactccaagttgtggagattcctcgcaaacgggaaaagatcaaagtaaagaagaacaccgtggtattcaagttgatcattggatcactgagaggagttgagtgcaactctcgtccgttgggacgccacaacgtggagtargcaagttttgtacttggccgaaccacgggataaccaccgtgtcatctctgtgattgatttcttgtggttattgtgttttggctcctctctaaccacttggcaattattgtgctaacgattaaccaagtttttgtggctataagtttaagttttacaggatcacctattcaccccccccctctaggtgctctcaattggtatcagagccgttctcttcaagaagggactaatcgcccgaagag

SEQ ID NO: 2746 - DNA, 237 bp, Zea mays
ctgatatcctgcattcctgctgcacctatgctggccatgctgctcaagtatatcagactcaagctatttttttgtttggcattttgaatgttaaaacaatatatttcactattttacagaccttaatatatttcttcttaatatgcgttttcgagaaaaagaacagagtccttaagctgagatactttgatagagacaatttttacatataaaacatcgaattggcatgttcacctg

SEQ ID NO: 2747 - DNA, 907 bp, Zea mays
caacaaaggctaagctaaatcaattacgatgtgattacatcattacataacatttatattgccattaaagtcatctgaaccattttagcaatcctgggtcatctgaatatatcatagagcatatactagcaaataaaaagctataagtaatctttctgatataaagtaacctttctctttttttttttctgaaatcgaattatattttaagatttttaattgaatagtacttgctgtccattttgtgactgacgtgtgacgtgatgtctaattcagtattttgtgactggcgtgatatgtcaaaattaccgttcaaaactgatcatgttattgcaacaagcggcttttttaaaacttgttgacggttaaaaattcggttttctagaatcgaactgccgcgaaagttagaggttcaaatggacattttccaattacattcacccgttcagtcaggatggaaggcttatagtacattcctccttctgggccgtaccgcgcggaccttcaaagcctgtatcatgctgcatcttccttccctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagc

SEQ ID NO: 2748 - DNA, 400 bp, Zea mays
ctgatgattgtctgtcgcgtgtggcatgcatacattggacgaacccgctagttgcgataacgaaaatgtttccttctcgttcccccttttttaactctttataaatgaaaattttccgactatgggggctttccctacagtttttcctggtaaaaaatgaaaatgtttttttcttttttcaagttatccaagtaaatgatgtcctgtgttccaggtaaatgttgaacctagtgcccctctgtctagttatctcgacatctgcttgtcttcgactcctgtcgaatagcgaaccctaaccctagcgggcagcgacttgcggcgtggaggccggctgcggggtgccggggtagcacgtctcgcggaggtgcgtagacgacggcggagcggcatcctcacctcc

SEQ ID NO: 2749 - DNA, 654 bp, Zea mays
agtatgtgaaccttctgcagtgaaggctggtttagcagcgacagctgttagggtctgatgcagtgtttgctggtttaacagcattattattattattgttgatgaaacatgggtttggtttcgttgatctcactaaaagtgtcaatcttttggatacctctccattgtgcttgtggtggtctgtgctctctgtcgaccggtacgctcccctctgtaactgctgtgtgttcccgtcttaaagctggtttgaaggcccaatccggaaaaaacgatgggcccaacccaaccatggagatgccgttccgtccgggtggagtggcaactgggtcgcggaagcgaagaaaacgtctccgccgcacgcaacgccagaaacccccttccttcccattcccactgctcggattgctttccccacctccaccgccaccagaccagatagcaagcaaccgacccctcctcgctggtacgcgcgtctctcctctcttccccaatcaacccggccttattaggttgattggttaagcaactggatgcggcgcccgattgttttgatttatttaaccttgcatatcgcagcgcccccatggatcaataatttccctgatggctgtattgtactgtactaccgcttcagtattcgcagggaaggagaag

SEQ ID NO: 2750 - DNA, 633 bp, Zea mays
ctgcagatgatgcaccttcattcacagaatggtttagctgaccccaatcaatttagtccctggtctacttccatcaaacatgagacaaagttctgccaaataccccaaatccaacatgatgcctagcagtagaccatagcagtaagataattgatgagctagtcagctatattgcttctctgatacaaacaagggctcaatcattatattttcttttgtacagtttgattccaaagtagttcaagggcaagagatctatccagatttcagcgggagcacaaaagaactacctttggcgatctaattggtagtctttcttctgaaaaaacaactgttggtatagatacaagaaactatcaaaatattagtgctctgttctgcacatgcattctggacatcgtggatgtctaaatatgcttcttgcaacaggcctctcatgaacttgcttagtttgctgtatgagtttccttactctactttcaaattcattccactcaatcgtggcattcttcacaagtatgctggctagccggcgcttgtttggccttattgtgggaaagttcccaccaccatagtacatgcggtaaccttgaacaagagaagagaattgacttcctgggtcagtcatagcaa

SEQ ID NO: 2751 - DNA, 290 bp, Zea mays
ggtcattcgtgtgtcatgggtgataaccaacggagccgtggtgtagtgattgcgaggaaccgttcgcttggagccttggatcatcaacgtcgagatctccactcaatcaagttatcgtatctcatggaagattgggccacgtctactatcatagagtcttcaacaaatccactggattagttgaggtttcttgtgacattgtgtttgatgagactaatggctcctaagtggagaaagttgatcttgatgaactagatgatgaagaggctctgtgcgtcgcgctaaggaac

SEQ ID NO: 2752 - DNA, 567 bp, Zea mays
gcatttgttaggcaaaatatggagaagaaaattagatattggacaaaacgggagtagagaagagacatgccgcgatgtcatcgatggcggcctgcccgcctctccaaatttccaaactaatgatgtggctgttgcctgttggcccatatgccgtcacgcagccgtgaaattaacacccccatgctcctgggctgcgcaagcccatacataattgggcaggcccgaatcccgtcggcgaggcccaagtcaacaattcccccaccgaccagcttgtccccgtcccacctgcccggcgtgcccgaacagcgcctcaccgcgccgcacgcctgcgtcggtcgccgaccccagtcaccggtccacgcccgcctccccctttctcctccgccctttcttgtgaccgccgccgcgggccctagcccgccgttccctctccggcgccccgctcccgcacccgcaccggatcagtccgggccgcgtggtcgcccccacctaccgcctcgggtccactcgctcgcggttgcgtgtcccgcggggtggcccctcgggcctcggcagctccggtttcga

SEQ ID NO: 2753 - DNA, 114 bp, Zea mays
cggggcttcgtgttcggtcgatcaatgcgggacggtcttgtgttgggttgcagcagcagcttgccggctggaatctaattagggttgctggccgtgtcatttcttggtgtgttg

SEQ ID NO: 2754 - DNA, 1009 bp, Zea mays
ctgcagtgtaacccttggacatcttgttgatggcgaggcgaccaagtcagagtgcgtccgatcttcagagaccgaaaccgacgacgtcacggccacggcgtcccccatagccagagagacaaagggctgcctttatactttggttggatgttcttctctcctcgcctgagcttgttgaatgttcttctctcgcctgaattacatacaagctcatccgttggttgacttgagcaggttttgtaatctctgcccaaacacaaacagtaacattcttgtacgtgactaacgggcccggtctgatctcctcctcctctcaacgtgggcctctttccccttcggctactgggccatggcccattagcggaccctacagcagcagttggcgccagaaatagagcctgtttaggacttcagctccgttcaacaacaaaaaaaaaagccagacggtccagattcatcaaattggttttaagcaaactcggttttagttggacgaccgatcaaatcagggacaaaaaaaatgtttgcctggagccgagggccagcggcggcgaaggcatgggcggtagcgtcggccgcgtcgccggcgatggcggcagggtgacgtcgtcgagcaggtagacgaggtagcagcggcacccaagcggcctcacgttccgggcaggctgcccgcgcagaccgccggcaaatcggattaaaaacggcagtgacagcagccggcatgattcgagccaagcgcaggccggcaatgtcgacggatttacccaacccggccaaaccacgtttgacatgacaaagctcacagttgcaccgctttagattagaaccaagacatttcgaaccactcttgtgaaacttccaaacgaaatggacaactacagaggagaacagaaaagaggtcgggcaagggtgtcgccggccatggctgcccgccttctccgcctccatctcgccgcctctgccttcctcttcgccgcggcagcggggcagcaggacaacagcgccatgg

SEQ ID NO: 2755 - DNA, 1405 bp, Zea mays
gttccccttgtgttccgtctcgcgccgacccatctgggctgggacacgcttcgacaatttactcgtcggtccagggacccccgggtcgaaacgtcgacaatactaattagttagagttgatggagcagttctagttaattattcaatctttgacattttctctcgtgttacgtgggcagaccagccacgtgcaagcctcacaaagcctttattatcaacctccattttctatcattcagtcaaacctcttttgtacactttgcatttatgtttcggctaaaagatattttgctaatgagtcaccgaacaaaccagagaatgcagaattttatagattgtacttttcctgactgaatattttgtccagtaatctcattttcgtttttttttgagcaagcaaggtattgtgcttgataaattctaaagctacagcataatcaagatgacctttttagttcgtgtgtttgaactcgtggttttaattttgactgcaaatacctattcatctttgtagaaaacctaattacgtgagttggtgcattgtcattccaaaattgagtcattatagggtacggcatgtaaaaggtcccatttgtcctattcaatatgatcacagaaccctttttctactaataaaagatacagcagtttttatatatatttaaaaagttggatgagcagctgacacggtcacaacaataataaacccgtatgctgagccggtgagccccaccatttcaccaaattggcaagaaagccgctagcaatccacagttgcgatttgcgggaacaactactactatcaaaaactttcgacattcgattatgctggcgatggaaatggagctcctggtccgatttcaatgagagccataggcctccaaaaatagggttcaaaaagggccagagagcaaggagtcatcccatttttagccgttgccgtagctggtcgtcgtcgtcgtcgctgctcccaatctgcggccgtcggtgttgccttcgactttaatccacaagggcgagcagcaccgaccgagccgatccgctcctcttcttggttcttcttcaataaatcagcagagcaggaaagatctgtgagcgttcttgcagccggcaggtgatttgcattttttcaactagttgcgttccttctcatgagttcttgtcctgattgctcgtcgtttaatacgaaatgtgataaatttctaggatttatttttcgaatgattgtaggggtccaggattacgaaggaaaccaagaacgcaagaaacgtctaagaagaggggaggaaagatttgggtgtagattggtagatatattacacaggttttgttttggtgtaggttattagcaaataaatagctggagaagaagcctggcaaaaaaaaggtgaaatttgtggagaac

SEQ ID NO: 2756 - DNA, 606 bp, Zea mays
ccgttatccgtttcttacccgtccggattattacccggtcccgtcctgtatccgtcccgaatcttaactacccgtattcggtcccgtatccgagagaaatatattagggtaggatacgggatgaccctatatccggctgtatccgtcccgttttcatcctagtgtcgatcgcgtcgcgtggtaaccatgaaggccgcgcggcaggccataaatgtgcacctcctccgatccgggtcctcccaaccgaaccatctaccacctccatcgcttttctccacctccaaggctccaattcaattccatcgcgctgtcgtcttcgttgcccggtcgccattttttcctcctgatttcttctttttcttccctcactatatggtcaggcctctgcctgtccctctcgtgtcgtgccgttgtgcggtgctcgatcctgcccgtcgcctctccggccaccgctgagaagatccaccattaaatgcctgatccacccacctcctcctcctggcttccctatatcactcacccatccacctcgcttcgacctcacctcacagactcctcacacttagtactgttagccaggaacaagccccagcagcagcagcagca

SEQ ID NO: 2757 - DNA, 252 bp, Zea mays
ggtgagggagccggtagagcaggtttttttcgctcccatgtgccagtacaattattggacgcgattcgctccgctccttcggtgaagcgtctggttttttgaccgtttggcatatgagaattgattctgcttcggagcggagctgaaaaagcgctaccaaacgcagcctaaatacctccgccaaggagctaggagtgtggcgtgaactaaccagcacgggcgctgagggctgaggccgcgacgacgacgacc

SEQ ID NO: 2758 - DNA, 1500 bp, Zea mays
agaacagacgacaaattcgtacagtgggaagtgaggcgtctgttgttacttggtttacgagccagaggcgtctcttcacggagagacggctctaagattattttgcaaataaccccctaaaacaccttaagagcccccacattaaacaccactgtacatgccctaataaactctaggaacaattggatctataactgaaagggaaatgtgcccttgggccatttctaagtattttggtgattgagtgtcaacacaagggcttaaatgtgaatcaatgcccatggatgaacaaagtgcaaatcttcaacaaaggtatgtttctaagtcttagtacattggttttgtgtactaatatatttatctaagtgtaagaaacagaaagaagaagaaargaaaagaagtggagagtggctgtgtgcagccaaaggctgtttcgggctggggcaccggactgtccggtggtgcaccggacagtgtccggtgcgccagaccagcgtggagcaaaccagccgctctcgggtttttctccggcgacttcggctaaaattcaccggactgtccggtgtgcaccggactgtccggtgagccaacggtcggcctggccaacggtcggccgcgcgatcggcgcgcgacacgtggccgagccaacggtcggaaaggtacaccggactgtccggtgtgcaccggacatgtccggtgcgccaactgtgcgcagaaagcaacggtcggatgagctttttatggaaacaaatcgggcaccggacagtgtccggtgtgcaccggactgtccggtgcgccacgagacagaaggcaaagatggccttccagatttgttcttaacgactcctagctgccttggggctataaaagggacccctaggcgcatggaggaatacaccaagcaaccttagagcaatcttgatcatcaacactcagtctttgcgcatttgtttgtcattctaagtgattcgagctccgttctagtgagaactttgagatagtcttttgagctcgattcttggccgtgtgtgtgtgcatttttgctgtggatttgtgtgtgttgcttccctcccttactccgtatttctttgtgaatctcaagtgtaagggcgagagactccaagttgtggagattcctcgcaaacgggatattgaaaggaaaagcataacactgtggtattcaagttgatcattggatcacttgagaggagttgagtgcaactctcgtccgttgggacgccacaacgtggagtaggcaagttttgtacttggccgaaccacgggataaaccactgtgtcttctctgtgttgatcttttgtggtattgtgttttgttgagactcctctctagccacttggcgattattgtgctaacacttaacaagtttttgtggctataagtttaagtttcacaggatcacctattcacccccccctctaggtgctctcaattggtatcggagccgttctcttcaagaaagggactaaccgcccgaagag

SEQ ID NO: 2759 - DNA, 1424 bp, Zea mays
ctgcagcagcagtgaattttgaaggtgaatatagaagagagacaaagatttagacgggttcgggctctcgatgcgagataatgtccctatgtcctgtgtgttggtgctattacttatgatttggtgatctaccctcttaggacgtcttatccttttttatatcacaggtaggggtggttgtagaaagattatcattttattgtaccagacaaggttactgatatgtaacagtattaccttaatgtgtgatatctcaacatccttggcatataaggctaagctacgtaatctcgggactacgaaccataatatcgatctgtagatggaaagaagggattagttactagttacggtttaaatacaatcagttttaagaataaaagggaggaggggtgtgtgagattcggccgtccgggccccgcccgctccagcggtaggtgcatagatagatgcatctccgccgcccgctgccgctgtcggtgctgcgtgctgcccggctccggtgtaaacggcgtgggaacgcggcgatcgctgttggcgtgggaacgcatccgcgtcgcgaccatgaaggcacacgagacggcaacagcgggagagagacggtgaccgcacgagggggtccccttgcgaaacagcagcctgctagtgccacagccttcagccctacaggtagctaggcgtgtgtccctgtcggccgtagagtacagtgtgtgctcttcggttggacgtacggttccatccgtttccagcagcaggggtcccggacacgaggcttggagtccaagggagtgatcatgcgatgagagtctagctcccaccggcggcagtacggtggtggtagtgcagtggtggccacttaatgaccgacgacgccaccccgcgcggactttctggtctccgatcactagcaggggccggcgcggcgacgaccgactggatcggattcggatgagggtgcagcttattcttcttcgacattttgtctgcaaagagaccacgatgaaaactactcgcactcgtcggggccaggccatgcactcctccatcgggctggcggctcactcgttccgtcgttcggtcggtcattctgctcacattccttcgttcggtcagcagtcgtcagtagtactgaccttctggaactcctacctggctgggcccaccgactccccctcccctccactgaccatgtggcgactggcgagacatcagacatggcatccccgccgctcaaacgcccagggcccccccacccgcgcctcctccttccttcgtaatcataggcatatataaacacgcgccggcctcgcgcttcttatcccccgcaccgcacgtctcagcccacctcctcctaccaccctcgccgaggccgcgccacacaaaagcagtcacgccgtctgacagcggggaaaaaaaaggaggcc

SEQ ID NO: 2760 - DNA, 145 bp, Zea mays
acgtcttgtcagtggcctattccatcggttaattaccctgattaattaattattcggtaacgtgattagcgcttttcttagcagtagtggataagtaggcggtctgtataggtaatgattttgggtggatcacgcgacgcgatga

SEQ ID NO: 2761 - DNA, 208 bp, Zea mays
ggtacggttgtggacttgtggaagcagcgagactggagaccggagacggagagggacgaccggacgagacgagacggccgaagcaaggaactgctggaacattctggaaagtcaaggcctgccctagtaggacaacccaagcccggcccaaaacaattcgtgaccctgcgcggctgggtcgcactcgcggatcgtggcagaggctgtg

SEQ ID NO: 2762 - DNA, 233 bp, Zea mays
tgtagccgaagcttcctagcatatagcttcgggattgattcgaccttcgctgccatctaccttcgtcccgatcatactctccgtagtatatatatgcctttgacccgagggcgaaggtgcctgtttacatgtcacactttggaaaatataattaaatcacgtttttgaggaccttcgaaggacgaaggcccccaacaggttggctctagcatcgccgactagcccatgttggg

SEQ ID NO: 2763 - DNA, 565 bp, Zea mays
caatgaagttcgagcatgatcactcctactcatctagacaaataacatggtcggttctgctcatctaaagaaataactcatcaaacgtacgtaagtggggaatagtggtgtgaatgaggtggcgtttgtccgctggtcagcaaattgggaccaatcgattagtcttcagtcctcgaccaattacgatacgatcatacgttgatgaccatcagcgaggagaatacccatttgtgcccttgccgagctcaccggtcttggcgatgtcgacgccatctcggtcgaagtcgaaggtacgcttcaagtcaaccgtttgggactgtgggtgtggccgtgtgggggtatattcggtattccgctgcaacgcactctctcgacccaacgacgagatcacgactcacgagacgtcgttgtcgacttgtcgttggacaccaagcaaaccaggtcctcgctcggtttggtttgcttaccactccgtcctagcagcacggtcctcgattcttccgatcgctccggcagggcacacaccgaagaaggtggttagcggcctagcgccgccgaagaaagt

SEQ ID NO: 2764 - DNA, 147 bp, Zea mays
ggtgagtttaccctaattctaagaaacaaagtacatcatatcataattatttttttcttatcatatgttttttttcctgtcaagcctcacaacccactcgctatccaggtgtatgaactgcaccgagtttacaaaatacagaaggat

SEQ ID NO: 2765 - DNA, 1500 bp, Zea mays
ccagaggtgacaatcagctacctaactaattaatggttggccttccacatcacatttcttccttttttttcaccactagctagctagctagcaacactcaatagtccagattacagatttaggccccttttcgttggaggaaaatgagaggagtgggggtgttttttactgtaaaacaaaacggccttttttgctggattgggagagacacccacatcagctgttgttgcatgcagaaattaaagatcatcacctggggggttaaactaattaatggcacatgtgatctctcccagcattgctcggtgattaattggggtgcttacgtattctccaatataatacatacttgagtctgcaacaataatagctgcttgactagttcctggcttgacttgcaaagcaattcattatatatggagctccacttaaggcacccctcttggttcgatcgataacgaagagaagtgttttttttttcctttccagttttaattatacagctttcatacagcagctgtcatccacgccaatgttatgtgggcattataaataaagtgccgtttggttcatatgttggtaacgtaatggataatcgataacgtaaaattatgtttgtttaagtctaatcataattaaataccacactagaaacagatatcgacctattcaaatttgttatcgccggtattcaagtgaaaatcgttaccattaccgtttactttacatttatggtgtgtttggttgcaatgccaggacgggacgagacgattcctcaaataaggttgtttggttcagaggcaggagttaggacagaactatccagtgttgtccccatttgtccctcaaaattggagggacgagaggagacgtcaggggacgtccctgtcctgactgtcccgcaaccaaacacacaattaccgtatgtttggttacccgcaccgtctcatcttggaccaccgtatgcgttgactttatctcagctcctatttggttgcctgcacaagggagacgcaggctgcatgagcggatacaaattaagtcattttatagctatttggttgtatccactcgtacacagaaaaatgccgtactaggtcagccagggccacccgagccgcgcgtccggatacacgcatccaatcagccgattagtgaaccaaacggcacctaattactttcgatttcttcaggttagagcacgagtaaaaaattactgtatgaactgaactcccccaacgtacgggtaatacgttggtcaggttggatcgagttaaaggtaaacagaatcaggcccgattggttgggtggcctacgaacaggtctagcccatagcaacaccctcgccccctcccttctcagcctcaggcggtcaggcccactggccgtacccgcgacgtcttcctcctcggctccgccgccttccgccgatcgcctccgccgaatcgaatagaagaatcgagcgccgctgctggcgaggggctcggcgcacagcgcggg

SEQ ID NO: 2766 - DNA, 552 bp, Zea mays
agcattgtctctgcttcatgttatgttcatagagtagtagaaggcgcatctttgttggccctttggctgtagtcgaacagaaacactttgggttcacatgctcaatacatgacttcagtagatagaagagctgaaaggtttgccgattacctaaatatttaggaagttgatatggtactcaktaaagacatctaaacttggtggaataaatacatatgaatgattataccaagctaaaaggactaagtakaaataactatagagatgattattaatatgagtatcacaatccaacaccccatcgcgatggacagaagagggctcatcgtcaccgcctagaagtccatctgcaaccacttcttgtagtaaacgcaggtgctgggtgagatgatcccctccggcgagcactcatgagtcctggggcaaatcccacaatggattccctccatcatccctccctgcggagccccagtcaccagccgatagcacattgtgccggccataacggcgctaaaatcccgcgtgccggtgctcttgacctcttcgagcacc

SEQ ID NO: 2767 - DNA, 259 bp, Zea mays
aagcaatttatttcccatagagttttacaagttttattatacatattatccttttgccttcattattgctatgcaagagaattccatctacatataaatgtacagttcttcttggcttttcacttctcaagtttcttatataaatatctggtacagtcctctaaactgtaaaaacctattatttgttaatatatatacatcaaattatactcttctataactaatataaaatatacaaaactttatttccagcaagaac

SEQ ID NO: 2768 - DNA, 982 bp, Zea mays
tatggctcagaataatcgacaagaattcgtagaaaatggtgtatgttttctttcacgaaagcaagaaggaactatgcaactcatggatgaggatttatacaaatataaatgatccggtgggctacataggttatagggttgttatatattgtcgtaccaataccagttcaatttgtcaagcaatcggttgctttgatgtgtgatagtaattgtaaagcaagagcgctacaacaagctgcccaagtgacagggacaatcgcagcaggtcagcaccagaatatctgaatgtgctgcgcccatgctgagttcctgaaaacctcacgaactgacctgaccgttaggagacaacacgttcctgggccctgtgttcgcggacggaaacttggcaccacacactcttatccacaacgagagcgtgggtgtgtgtcccaacattctccacgcgttccttccttccctccatctcctctctgttcatagcctcccaagaaacacaagagccaaacagcgcttgcgaagctcaagcgccgcagcaatgtctctggccccgtccatcccttccatcaaggtgaaggtgggggccgtgtcggtcgctcctccacaccgcgcatgccgatccttcgcggtgatcaggagctccaaggcagagggccccatccggagacctgcggcgcctccgctgtcgccaccggccgccgatgccacccaagacgccggctctgtccactcctcccaccctgtcgcagcctccgacgcccgtgaagcccgctgctccacccacgtcgtcgcagccgatgccaccttctcgtgaggcccaagccagttgacgccacagcccccgcggcagcgctgcagaggccgctggctggggctgtgacgctggagtaccagaggaaggtggccaaggacctgcaagactacttcaagaagaagaagctggacgaggccgaccagggcccattctttgggttcgtgcccaaga

SEQ ID NO: 2769 - DNA, 67 bp, Zea mays
ggtacgatccgaatccacccatgcacagctctgtgcagagagagactcacacactgatgggtgaggt

SEQ ID NO: 2770 - DNA, 918 bp, Zea mays
aatttaacactattaaaactttctctaagtttcaaacttgcatatcttttatcaatgttttatgctccaataaaatgacgaaacaaaattttagtacaacctgtcacgaagacagaaaaccttgtgggacatctaaaagggtgaaaataaaaacattttcctgtctcttgcttttctgttaatcactagttagttgcccgtgctttgctatggtttttatatatcatataactaggcattgagatatttattcaaatataattattgtttatttctaaacactaaggtacgtgtggtctcgtggttaggctatccgcaaccgttacctctaaatttttcccctatgttactttttctccctatctccctatttcctcccctattttttcatctcccgcaacggttccccctaaatattccccttatatcccactaccactataaaatatcattttctataccaactatcaattttttatctactaacaattactcgtggacccacaacacagtatttaggaggatgaacagtgatacgctagatctgggggggagagagaagggtgccgacacgtagggggcaccgctgcggccgtagggtgccccctaccgccggcatgcaaggggagggggattgcaagggggcagcgttgcgcacagcctaagtcactcactcactcctcacgcgtctactctactacttaacacgcgcccgtgccatccgcccactcctctcccacgcactccgcaattccgcatcacgcagaggcagagcgaccaacccagaaccccaccccaccgcccgcaaccgcaagctcagattccctccccaccccaccccaccccaccgtcccgctcactccagcccagcccgcgtccccacagcccagcgacagcgggcaccggcggcatccagcc

SEQ ID NO: 2771 - DNA, 198 bp, Zea mays
cgtaagtcgctactggccggccatgaattcttgtgcgctgggacgacggccgttgctgacgttgtgtgagtgtcctcgaacaagatgtatgtagaggagtagcacatccggcggtgcaatgactaggtgtactacctcgctgatgagcctggggtgcaattcgtttggcagcccagccaagagtcatcggtactcgcc

SEQ ID NO: 2772 - DNA, 955 bp, Zea mays
tgtttttcaggctttgcctgccgagcgtccccgcgcgtgcaggcgggcataggccatgtagccccaagctaaggcacgtaaaaacgagacactttttttagatgaacagtgaagaacagtgcttgccgattcagagccacccgtcagaggcgcaccggacagtgaacagtacctgtctggtgcggcaccggactgtccggtgccactagaagacaaagcctccaacggtcgacatcgtctgaaccctaacggttgggtgacgtggctggcgcaccggactgtccggtgcgcccatcgacagcagccatccccaacggctatgtggtggttgagggctataaatacccccaaaccaccaccactccaagcatcgaagttttctaaagttcccattcaatacaagagctagtgcattcactcctagacaaaatcaaaagatcaaagcctctccaagtccccaaaatcactccaaccacctagtgacttgagagtgtttgtccatgttcttttgcgctcttgttcttggattgctttcttccttcctcattattgttctcaagtgacttgtaatcaaggcaagagacaccaagtgtgtggtggtccttgcgaggtctaagtgacccatttgattaaggagaaagctcactcgatctaggtgaccgtttgagagagggaaagggttgaaagagacccggtttttgtgaccacctcaactgggactaggttctttagaaccaaaccttggtaaaacaaatcactatgttcatccgctttatttcttggttgatttgtttttccctctctttcggactcgaatttaattctaacgctaaccccagcttgtagtgtgtgcttaagtttataattttcagattccgcctattcacccccctctaggcgactttcaattggcatcggagcccggtacttcattagagtctaacaacttgaagta

SEQ ID NO: 2773 - DNA, 177 bp, Zea mays
cccctgcaaatcatataggtgcgcacaaattctattgtgtcgtgctggatagagccgtcagaccaactaccttccaccaagcctttttgacttcctgatgtaaatggacactagcactcatcgatcagctcttgtcttgcgttcgttgcagccagtgcagtgcaggacgaactcgac

SEQ ID NO: 2774 - DNA, 1500 bp, Zea mays
tagcccactttccagtacattttgcgggctgcaggcccacgcacgcgccactcggggcccaacgaaactggcgccgcgacgaatcctctcgccggctgcaccatggccgggaagagcgagggacgctcccgtggtcgagggttgggataccgatgactctgtgtgtgtgcgcgcgcgcgccccaagtccagtccaaacatccatcggtagggatgggactgcctagtcgaggagaagcttcgctggcgccgcgccgccccgcattcgtcgacgaggtccgttcctgctcaggtttatcccactccgcgttcatctcttccgtgtaacaatagagggatcgaacaaaatgcaagtgacgggaaaccgagcaaaccagtgattctcctggagggaagcatgcaacggggccgccaggccggatgctgcgtttttgtttgtagctcgcagacttcgatctgcttgatttcactgacgtgctcatcgcagaggcattttcgactgtttccacgcggttggcgattagctttgactccactcagctgtaacagtccagcgaaatttccgtctcgtcatctttcctagatgcctaggcacgagacaggagtcacaggagtccacatctgtcttccactatgctctgtcgttcttctctcctatactttcttacacctctttcctgctagctactagggacctttgtccttttgcttcagtgataagtaaggaacaatctgtgggtggataacaaagcttgacctgactcagagactcggaatctttggctcttgcccccgcgtcttctgggaaaagacgctaaaggtaaccagcatgaactaataactgggaaactgcattatgcacacgaaattaagcaccagtgtaatgagtgatcagttaatcagaaatttgtttttttatttgtaatttgggttgtatgcactgcaattcattgcagtggataagatggttgggaattgcagatattcatgctaaatcactgtttaaacgattttcattcacagttcgacaggcccagtgctgccggctcccatatgagtggggtagtaaccgagccaagacttaattccgtggtacattctacatagaggcttcatcgaactcaggacctttggcttaatggaaaggcctgtcaccattgcgtcaggtctgtccttcattcacagttgctattttgaaaatatttcatttgatggttagagaaagctttaggattaatggaattttgaggttgaggtttcctccaaaagaacaaaaaaggaaaagatgtgaaataatggaaaggaaagcagtctacctaacttttttttgcattgttattaaaggtggctgaccaagacagcttgacttgactcccaccttccatgaaatgcactggcactcagccaaaagacttcaggagttcgacacatacattgaatcgcaaaatcaatatttacattacttcactccattacgattcacaacagctaaagccgctcc

SEQ ID NO: 2775 - DNA, 222 bp, Zea mays
ggtctggcacacatgtatcagcggataattgttgctttatttttttttatgtgaaatatgcttgtcatcatgcagaacatgctaacatgactgttggagcataatcattattattgtatattggctgttgctgatagcttctgtgatgtgatgatatagggggtcctgactgaatcagcaggaccagatgccgatgatcgcaccttcactgttgtcgatagc

SEQ ID NO: 2776 - DNA, 1194 bp, Zea mays
tttccttcccgactattccagacccgatcccgtttccgatgataaaatgcgtatacggaaatgggagatgggtttttccgtccgttttcgtccattttcatccctaagtatagtctacagtgcgttgcacgtatgtatgcacattatggtggagatggcgttcgttgctaggaattcagttttattggttttgcggtttattcgttgtcaaaaaagtttggtgtttgaaaaatggaaaccaaactttttgtccaggaataaaaaaactgcacaatttggtgtttgattttttggtttggtgtttggtattaccatagtcaccagacaagtagcaaattaaactacaaacataaaattgtataaagaacataacgataatttatcaataagtacctaataaaattgaataaacaatttaatgttgaatagttcttaaaaaattaaaatgatatgagtatagggtttaagactttatatgaactgcttgttggacgtcaagggataggtttgctaaattttggtattctggtatatttgatgtgcgaatattgaaaaccgtactaaatacctaacaccaaaataccaaatagagttaaatgcctaacaccaaatagagttaaaaagttgtttggttcgtgtggtgtttggtttggtaattttttgcccaccccggcgtgaggtttcccgtccacgttctagaagattctcgtctacattggccgaccccgcggcccacaccgtatatcactgcgtcctcactcctctccggctctccccttctcgccaaaggggaagccctgcccgtacttccgttgcggcgctacgagcttcgacgggccgctcgatctccacctctgaaggtatgatcggaccctccatttctccttactggatggttaggttcatgtttgtatgttttttttgcggcgggtttggagccgttcagctgggacggcgggtttgtagtcaccggttgggattcgcactgcgtttggttaagagttcatagctgttcgctttgatgcgtgaaattcatggttttagcgttcttgtcttaagattcacgcaagaatccgttgcttctctgacctgcctaaccagtagatctctggcttttgcgatgcagtgactacttgtgatctagatctgaaagctgcagtggttgacagctgagtgtgaaactgtgaatcgaag

SEQ ID NO: 2777 - DNA, 347 bp, Zea mays
ggttccgggattgtccacgtatttggacagccggagaatgggtgtggccgcatgtgattcgtgcacgtgtccgttggtccgaacgagatttcagcagcataacccagttgttctccgtcgcaccatgataggcgtgtgttcggagaacagcggggttatgctgccgaaatttcgttyggaccatcgggcacgtcacgagtcgcatgcggccgcctccattctcgggtgggtttatgtcctttcctatagtagggttatcacctaagccacgtgcatygctcttatatgctgaatttttggttggtggtttacacaacagcaaaactgagccatcctagtccacaaac

SEQ ID NO: 2778 - DNA, 342 bp, Zea mays
ttaataaaacgataacagctaaagaaacatctaaacacctccatcaagtaaattctttcacagatgctgaataattccatctccatgcggcagtattttcaattcaggaaccaaaatcttattgtaaagtaactaagcaagataattttgaagcatttgcaaacatgacaggacttggaagaacagttattgttgcatacacaccacacacatagagagagaggcacggtcggtcagagcagaatgaagattggaagaatgcaggaagagaagagaacctgccctggttgaagaccctgatggtgttgtttgtgaggcagtggcggcgacgcgtaggcgccc

SEQ ID NO: 2779 - DNA, 894 bp, Zea mays
ggggggggggggtcttgtcgtcgtcttactcgagtagacgggcttcttcttgaggatcttcttgggagcggccgccggcggcggcggcggcgtcgtctcctccccggccgccgcggaggccctgcagatgtgaggagcggcggagcggcgccgggctgggccggccggcgtcgccactgggcacgcgcgcgggaagagcgcccgaggcgccgaggcgagggcttccatggtgcggcgggcgaagggatggattgctcgctcagctagtcagctactcagccaaatccggacgcgcggtgtgccagtgccacaggacccggataaggcgatcgatacacggctgcctttttgctattggttggccatttgcttcccattgcaagcgcaagagagagagaggggggggggggaatcatcatctactttggctgctgtcatgacctgccaccaccaagaagtggagattcccattcagaaaaagaagacgacgatgggaaatgggtggatccaagagccaggcaggcgcccccccagtgcgcagcgcacgcaggtggatcttccttgtccggtcccaccagcgccatcaacacaggtttgacttccatccttacacaccttccaaaacccctctgacgtgtgggtccaccgagttatcaaagtggcgatggggcccgcggccgggcgacgaaccggcgtgcgcgggcaggcaggcaggcaggcggttggcctggattcaaaagggactctacttttggcccatttccaaccaccatctgcctaggcgtctgtctgtctgtctgacgccgcgccccaccaccgtcccgcaaaaggcgcgccgcgccgcgccgcgccgtcccgtccgtcttcgtccccagtccccaccaacctgtccgg

SEQ ID NO: 2780 - DNA, 94 bp, Zea mays
tttggaaaggtggacatatataaatatcataaatagaagggtggcccatgcgctctgctaatgcaataatccttcccatcagctctaaatttgc

SEQ ID NO: 2781 - DNA, 570 bp, Zea mays
tgtacacggtctcttcttgtactgaactggtattcaacttcattcaaagagttctggtaaagtataaattgtgctagaacttttgagctccttaattttcatgtagtatttttgttacttgatttttcgcctatcttgccaatagcaactttaacactgaaaaagattgcttatggccactggcaagtatgaattgatcaaattctcaaaacatatcatttgctgatttgatgaagcacgattcttaccttatttgtatctaatttgttacattcactgtttacagcttctcttgtaacattggatataatgacgctgctacatgactattattttgacatcataacctacatataaagattagagactaatctgttttttttctgaactaaggtgttaacacatttccaaatatcgaacatctatcttttagtatgcaagcattttagtttctcagaggtatactgttccccatctctgtattttatttcatccactgcccttgctaatttgtaggaaatgaacttccatcagacttgatagacacactactaaagtggatcccaagca

SEQ ID NO: 2782 - DNA, 480 bp, Zea mays
cgttttgagatgttgttgggggcttggggctgtaaagacagagtagaagttctgtgcacttgcacgactggacgagtgaacactgctagacggatgaccgaccccgcccaggtctacgctcagcgtttgcgctgttgtttggtggtgcacgcataaccatgggccacataggggtaggcccagcccattttcatggtggccctcggattcctttctggcgggagcccctcacacgggtttccgttcgtccaacggtcacttgccagatgggtcaacttgaccgttaccagtcgtgggtcgcggcgcgtctccttttccccaacggcttcatcgccaccaggcaccagcccaccaccaccagttttcctccccttcccgctcatcagacccagatgccgcctcctcatcactaatcaccactgccccgcgctcccctcccactcgctttgtgctgcctctcgccgtcgctcgcggttcccg

SEQ ID NO: 2783 - DNA, 1361 bp, Zea mays
tgggcttgtggatatggtggattcttgcatggacttggtgtttgtgtgcagaccgtatcggagatactgcctgtggggtgagatgtgacggggtgtgtgtaggctaggtccaggtagagaggatggtggcacccgcgttatcctcttacataaataaagtaatgatatataagtactgcacatcagcacaagggaaagaaacacctgtcaaagactgaaacgagagaagtgcttgtgatgacgaccaaactacgagcagagatcatgacttcagcggtagcatgggcacgaagatttagcaagtttcttcctgctgacattctccaaccaaagtaatcagcccactcttgttcatctgttccagcgctcaatcaagcatttatgctgaattgctgctttcctatgttcgagaacgccatgacagtaacgggccacgcagctggcgagtcagcacagcagcacctcgatctcctcggtgtgcatggaagcgcgcagcgagcggtgcggccaaagcacgccgctggctcgatcgtctgcgccgtcgcgccaccgtccgcggcagcggcgatggcagccacaacacgcgcgcgtctcgaatggacatgacctcccgccttggcacgtgctcgcgtagtcacgtccacatatgccgagcactgcagtctgtagacggccggcaccacgtgtcccgcctcccatcgtcgtaccgaccgtcagatacgaggtggaacatagggacgcttctagccggcgccgggggccacgtacgtgtgcacgtgtaagactagccgcagcgcagcggtgcacgctgcacctcccctccccttgcatgcggcgtgtaggggcaccctatgaccgcagcggtgtcccctatagcgcccctacgtgtcggtccccttctctctccccagatctagcgtgtcactgttcatcaccctaaacactgtgctgtgggtccacgagtaattgttagtagataaaaaattgatagttggtatagaaaatgatattttatagtggtaatggggtatatgggagtatttagggggaacagctgcggggatgaaaaaatagggggggaaataggagggaaaagtgatatagagggaaatatttaggggtaacggttgcggatagcctaagctcgtggagcacaccccgtgccgcccgctcgcctgctttttaccggcgccgattcacacacagcgccgccaccgcccactcgcctctcgccattctcagtctcaccttcgcttccgtcgccatcgctcgtccgaatacgtcctcgcttgcacgmgcaaagcaagcaacttgttcgatcgttctcaaaactccgatccatccgctgaccgcgcgccgcc

SEQ ID NO: 2784 - DNA, 174 bp, Zea mays
cagctgtaccccggtgacgaagccaccggccgctcccggtcacccgctatataatgcccggcttcgccttccccttcctccagccacggatcgagacgtcccaatcgagctaatctcacaccgccagtgccagtgccagcggcagctgctaatccgtgccgtgttccagcagcg

SEQ ID NO: 2785 - DNA, 309 bp, Zea mays
cattacgaagctgcttcgtcattctccattatgttatagaaaagacattattttacatccgtagtcgcacgcacctaccatctgcacccaacgagcatgtactattattattttcctaatccttcttggccccttacacagctgcttcgtcatttccagccatatgcgtgatgacagctcctccgtcctttccagccatattcgtccaccaccacatcactagtctcactctcacctataatatatctgcacccaacgagcaggtaccaagcaattagcaagagaaacacaaggtcgaggtggtgaggc

SEQ ID NO: 2786 - DNA, 1368 bp, Zea mays
tgtttgaattatctcgggcttttaggacacgaaataaatccacaatctgttttttctgatttttttctcaatttcaggacatagtaaaatattgtgcttcgtacagcatttttttaccagtttggtatatagctctcagagtgtattgatgtgtcatcgcaagaagcagtagccttaagcaaagcaagtgtgctacatgttttttgaaccgaaaactttttttatagacacattaataatttgaatcagagttataatatgtctagacgtctaaacacataacaagaagtcatataattaaaggtcgaaacattttttgtaatttgaaaaaaagactaataattaaagaaaagaatgttatatcgtactaccacttgctaatctatggaccatataccagtagtgaaaacagcacctatacggaaaggtaggagccatcaagtactactactgctgctgctgtactagtatcatagtatgtcggcgcacgagtctgccagatgattatgttttttcctaacaaatagtacatactatactagtatattatatagtatcggcaaggataaccaagcaagcacgcatttgacatttcagggttggcgcaaatcacaccggcaaaaccgataaggtgagtcacccgtcaataacaaaccagatgcacgtccgtttcactgcaaagccagccacccatccagccggcagcgtcgctcgcgggcccagagcgctgggcccttgtgtgtggcggatagtgctggaaattggatcatgccgacccaatcgtgttttcattcaaacgtgttcaatccaaagaatagaaacagacctggttctaaagcacagagtatcttttgttggacaggacggttccaaatccggtatatatatttaaaccacataaaatctaaatattaaaacgacataaaatctatagtttactaaattaagatattaaacaatacgagtatcatttgagaatataaagttcaaatattacaatatttattaaattaaagaaattaaacaataagtgttttttctttttcattccctccatgtgcacgcatttctttcctcgctcgtagtacaacgaacgctcctgactcctacttctactgctgctgccgccaccgctgccaccagccacccgaccctcccccgcctctatataggccatgggtggcgcactcggtgccgggcatcagctgcgctgctcaccaggaaggccatctcatccatccttcattgtattgtagtggcatcaccaggaacagcccagccgcaagaagacagacgacagcagcgagtggggatcggaagaaagaggaagcggagacgaaggtgagagagagaggcaaaagrgcagcc

SEQ ID NO: 2787 - DNA, 1063 bp, Zea mays
ttggccgcccagttcacgcgcgctgccgccacaaggcgccaagccgggcgcagccgcggccactgcgaaacaaccttgacttttggggagtgtgtctctctcacaccacggtgaaaacccgcgcaaaagtgccctgtgctgtgcatgtgtgtgacccccctttcacgacctttcttatccagctggtgtttctttaaaccatcttgtttacgtgcgttcttaacagtaggctgattgctacgtatgcggtcaggataggatggaacggggcagtagcgcctttgaatactgtacgcctctactaccaacggcgtcggcgaggcacatgcacggctctactacgctaacgcgcgtcgcacggctcggccaaacaaggcaataaaagcaagcttagttaggtaaagggtagaaaaaggcaaagccagctagtagaagggaaaaaaaatctactactactagtactgccgccctaatccttttccttttggagttcgtgttatatctcgagcccccaccctgccgctcgctccccctcctcccgcttgattccagtggccctgcttccctcgtcgtcactctctctcgagagcagcaccggcacttcggacagggtaagcgggcatcacgaatctgcttcaattcccttcccctgctctcagatctcgccttttcttcctgggatttgagctcgctctcgcgcttcccctacgcatcgtgaactcgtttctttagtggtgacaatagcagcgatttgcccggagggttctcgaggtatttcagcagttgcgctgttgcgttgaatcgagtaggaaaggagtaggaggactcgccccccatccacagtctattcaagaagcttgtggaggtagtgtgcagttccggcgcactgtagtgaggatctgacgacagtttcacttcacctacttctcggatttcgagctaccccctcatcacaccgtcgctgaattccgtagaagaacttttgcgtggtttcgtctgatttgttgctttgcttcccctttgctgtggacgcagagttgaaaagcaaaggtgtgttcttgtc

SEQ ID NO: 2788 - DNA, 242 bp, Zea mays
cttcttattgattcacattatttaagaacaagagaacaacaaaaataatgttttagatgatcatatgcaccaaagacacggttttaaaatgactgtgtcctgaaatagaaaacaaatggaatgatcttcttcgatacggagctcccgtaaacgttacttttattttgcagttcagcggttcagccccctcaagtcggggtactctgtaaaaaaaaaaaaattggggtcctccgcctcccgca

SEQ ID NO: 2789 - DNA, 271 bp, Zea mays
gttagctgcggcactgaggaagctcgatcgcgtcgtgcttgtgcattgcatgcgtgggagcttctttagatccgcctcttgcgaaattctgccgcgtttcttttcctcctttctttcccttccgatccctgcgtattccagacattttcgttttttcttttgttaattattacattgttggtacgacctacctcctccctgcttcttctaagttctaatgagagagcaatgaattctgttggtacaaattgtggtcgttttgtgagtaatc

SEQ ID NO: 2790 - DNA, 192 bp, Zea mays
cgtcatctcactcaagataaccagaaccgatgacctcaacgtagagagcttcgtcaggacaattcctacgatgatgacgaatggtatgatgatttccgtcatggaaattttgcttttgatgatgcttctcctctgttagcagaactgcaagctaccccatggcccccatcatacaagccaccccagctacca

SEQ ID NO: 2791 - DNA, 678 bp, Zea mays
ctggacccgtgggcactcaactctactacgcccggcggcgttactgcgtccactcctttgccgcggcaaaacccccggaaacccgcacaaaaccgatgtgatacagcaacgaaacggcagccgtttcgaaaaaccgaagcgaaaggtgcgggtgctgtaccgcgctgagcctgtgcggatcacggggccacccacccgcgctgtccgtgagtccgtcgcttctccgttcgcgctactaccactaccactgtaccactgcggctagtaaaaaaaagcagcgcctccacctccacctcccgactccaagccaaggcggcccacggagccacaccgcacaccccatcccgcccggagcagcaaagcataggtgctcgagcgctccctccagagctccccgcctgccgccccgtcctcaccctcctcggtcgcctcccgccgaggctcggctcccgtccgcagccaccacgtgcgacctcccctcccctgttcctgagagtaagatcctctctccagtcccgtgcttcggctcctccggtaccctgaatttcgcgggctcagcgggtctaacggctacgtcgctgctgctgcgcgcgcagatctccgtaggtcggcatggggtgaccagatcggtgctctccagctgaattctgctcgcggctcgtctcggaggcagcggag

SEQ ID NO: 2792 - DNA, 1113 bp, Zea mays
gaaaatttcgggtcgggtaattcgggttttaaaaatttcgggttttgagaatcgatacccgaaattacaacgrgttttgcaatacccgaaaattcgggtacccggaatttcgggttcgggttcgggtattcccgaactacccgaactattgtgtcggctttgtaaaaacgcatacaccctattaaattagtataaaaatatagtttgaataatgatatatgtgaacatataaaacacaagcaatctacaattacaagttatgcgcacttacacataattatagatgtacaaattaataattaagcatgacattagtacatgacacaagaaagttcgggtaattcgggtatttcgggtacccgattgtgatacccgaattacccgaaataaattcgggttttgcaagttgttacccgaaattcccaaacaaaattcgggtttcgggtatttcgggttcgggttcgggtattccgggttcgggtttcgggttacgggttttttgcccagccctaggcgcagcgacaagcagtaggttcacgaacgttgcgttggatgacatggaatcacgttccacagtcgagtgccgcccgtgggatctgcggcgctttccgacgcactcgcacaagtatagttctatttttttctcccctttttcttttccttttgaataagatttaaaaaaacactcggaacagcttaaacacatgtgtgcttgcttggctatgagttgtgacgtgcctctgtactgctcttttcatcttttgctgccacacgttctaacttctaagtaagaccatcgagaaaaagggaaaaagtatgcatgctgatgaattattggtgctactcttcgtctcgatctgttcatgttttgctccatcgcaccacgaaaccatctcatgtcagtgtcttagtcttagcttggccccctcccacctgcaacggcagcccactctcccgtgagtctccctggccggcctcgtctatataaaccagccactacccgttggctactccaccagtccagactccagacacacacttacacagttacacttgaagctctcattggtcctccctcctccgtcctcctctcctaccactctaccagcgacg

SEQ ID NO: 2793 - DNA, 941 bp, Zea mays
tcgtcgctggtagagtggtaggagaggaggacggaggagggaggaccaatgagagcttcaagtgtaactgtgtaagtgtgtgtctggagtctggactggtggagtagccaacgggtagtggctggtttatatagacgaggccggccagggagactcacgggagagtgggctgccgttgcaggtgggagggggccaagctaagactaagacactgacatgagatggtttcgtggtgcgatggagcaaaacatgaacagatcgagacgaagagtagcaccaataattcatcagcatgcatactttttccctttttctcgatggtcttacttagaagttagaacgtgtggcagcaaaagatgaaaagagcagtacagaggcacgtcacaactcatagccaagcaagcacacatgtgtttaagctgttccgagtgtttttttaaatcttattcaaaaggaaaagaaaaaggggagaaaaaaatagaactatacttgtgcgagtgcgtcggaaagcgccgcagatcccacgggcggcactcgactgtggaacgtgattccatgtcatccaacgcaacgttcgtgaacctactgcttgtcgctgcgcctagggctgggcaaaaaacccgtaacccgaaacccgaacccggaatacccgaacccgaacccgaaatacccgaaacccgaattttgtttgggaatttcgggtaacaacttgcaaaacccgaatttatttcgggtaattcgggtatcacaatcgggtacccgaaatacccgaattacccgaactttcttgtgtcatgtactaatgtcatgcttaattattaatttgtacatctataattatgtgtaagtgcgcataacttgtaattgtagattgcttgtgttttatatgttcacatatatcattattcaaactatatttttatactaatttaatagggtgt

SEQ ID NO: 2794 - DNA, 1228 bp, Zea mays
ggtccgcgccggcctcgtgcactcacggccacgtatacaacagcaataaaaaccactgcctgccgtgccgaaggaaggaggagggaaaaccacttaactctttgcgtcgcgggcaaacgcgccattgggtggacgacactgctctggtggagctgtgggcctgtggctggcctggaccagcggcgcaggcactacggccggctccggccccagtgacgccgcacgacgccatcgcgcgcaccaccaccagcccacggcaccgcccgcgagcgcgaggagagaggacgcgcacgcggcagcggctggggctggggccctacgagactacgtcgctacgaccacacgggacgggactccgaagcgattagccgcgtgctttgtccgccgccctggattattagcacgggagctcccgcgcaccggcaagagacgggaggtaggaggagagtagatcgataaagcgcggcctctttctttcccatctttcctcaccagaaaagccgagcggagcgagaccagaccagtgtgagagagagagcggggtcacagcagcgcccagcggccgcagcacaaaagcgttcgtcgggggctttggattcccaggaattccgttccaaagcagccgaatcgcgggaccccgcctgctcgctcctcttcttccctccaaccgcccccccctcccctcctcctcccgccgccgcagcgagagccgagagcggagcgagcaaatcttggcgtttcgcgcccgctctcgcagtctccgggcgggggccgcctggcggagtggttacttccccgctggcttcttgctgcgccccgccattaaagccggcgcatttgggtttctctctccacctctctctatccgccccccaccgcgctctcgccctccctctccctctctagcggtagattggtgctgttcccccctaatcggtcggcggttgggggccgggttccgacgtctgcccgggagctcgaccgggcctccgatccgggctcccaagccgccgcctcccggggcgcccctccggaattcttgctttctcgggctccgaatctcgccgcctgtcgtcgccagcggctggcgcgggggcttggttcccggcgtttcattgcgaattcgggggcgatctggggcccctggtctggatggcgaggatttgagtggattcgagacgaacaagtggaggtggagccctgatctgggtggcgcccccgccgtggt

SEQ ID NO: 2795 - DNA, 1500 bp, Zea mays
atcagaatgtattggaagttcagtcaaatgaagaggggactacgataggatggaagagatgcttgatgatgtatggcatgagcttctacctgacgattatgagaatccacctcgacccccgattctgaggatcctcctatgcatgagtttatgaagttcatcaagttccttaaagcctctgaagatccaatgcacaagcacacttgtccttgttttcatggcttagcttatggctattaagtccaagtttacattctcagacaactgtaacaaggagcttgtgaacttgatcagtgatgtactttcgaagaaccataagatacccaaagacatgtactagtacaagaattgctcttgggtctcagtatgcactacaaaaaaattgatgttggtgataataattgtatgcttttatggaaagaaactatgaatgagaagacatgtgtaatatgtggagaggcaagattcgtagagattgtaaacgatgattgtgtgaccatgatgactgaggtagcacataagaaactttgttatatgcctcttttatgaaagggaaatgtgcccttgggccatttctatattgttttggtgatgagatgcacaacacactatgtgtgaactaacataaagttgagcaaaggtatatgaagatatatctagatggatcaagtatgaaggtaagttatagacacttagtcaattgttttatgtgctaaacattattgtctaagtgccaggaactcaattaagtcaagtccaaaaggagcaaacggagttcagctgaaacaactagtggaacaccagctgcgggtgcaccagacagtgtccggtgcccaggctggctcaagagatgaactctctgctctcggtaatcgccgaggataccgtggctaaaattcaccggactgttcggtgtacaccggactgtctggtgagccaacaacgtccgcgccaacggtcggcagcgcgatgggcgtgtgtttctattccctcccttactcttgtggttttcattggggatcaatattgtaagggtgagaggctccaacttgtggagattcctcacaaagggaacatctgctataaggaagaaaatcatggtattcaagtggatcattggatcacttgaaaggggttgagtgcaaccctcgtccattgggacgccacaacgtggaagtaggcaagtgttctacttggccgaaccacgggataaaaatcgttgtgtcacctattgttattcgtgtgcgattctctctgcttctactcacttgataattgctctaagtttaaatactcaccttgtgaagagcaattaagtgaagaagtcatctctttctctctagacatagcaccttggttttgattccactaacatttcataaaccaagttttgtgccatttagtgttgatttttacaggatcacctattcacccccctctaggtgctctcaagttgtatcggagccgtactcatcattaagggactaaccgctcgaagag

SEQ ID NO: 2796 - DNA, 1500 bp, Zea mays
ttcatagtagggttcatgggaccaaaatgcttactacaattcaagtaacaaatgccacccctcctttgctgtgaagtgacccatcagataactccagcacgaacaggcataagacctggtagatgtaagcgctaacagttatgcacgaagtacatccaactatcaaacatgtaaccatatctcaactgccagtcaaaatgcgtatacgaatatttacggaacacagcagtgcaagtctaagtttgatacaattgtagcttcattaggaaaatccatcattttaagactggctccagcaaggtccgctaaagtgggtctgttcgctacgtatagcggatgctggcctcgggtacgcctccagcaagggctgttataggctcctgtaaatttagtgcatgctgccagagacgccaaatgtagggttcctcagccgtccgctatacgttcgcccctctcgctcccaccctggctcggagttttctcctccacgattggcttgctctccctaccatctcgtcgtcatttggagagagggcagctgatagtttcactgtcgtgaaactaggattgagggcagccatggcttccaaggaagggtgggattgattgaagcctccgaccacagacactcaacggaagctgggatttgggcatctgtttggatcttcatcaagtttctatctttcttctatgcgctctctccgagattaaaataatttatttataatttattttgagtgcatacttaatttacaattgagaaataattcaattttgaaggaaaacaaatgggaataagaattctgttatcactgtacatatagaggactagatttagagtacaccattggagatagagaagatatagagaataaaaaattttagagagtgttgtaaaagacagtataatcttttagaggatgaaatttaggagacgttgctcgagagttggacaaacactaaccaataaggaaagaaaattagaagtagggatatgttttttttccgccctgtagattgacggggataggactagagaggcccatgcttgtcctaaggtatattcaaagagtaagggcttgttcgttttggtgataatctacatgtattgagtgagattaagccggtttaaatccataacaagtcaaaatccatctcaatcccacccaatacactccaatacacatgtaatattaataaccgaacaagcccttagtatctcaaacaaaacaaggactaaaataggttttaatgggtatcgggtctcaatgtctcactaacacctctagacacgaccgagtcccgtgcccacgccgccacgcgagatcggcagatccatggcgcctcatctccctctccatccccatccgctggttactcgatctaaaccctaatcaatatagttcgcaccagatcgatcgcgtctcaggtcaaaatctgaaacgatttgaacgatcagaacgaacaacgatttagcttcagctcctgaatccagcagca

SEQ ID NO: 2797 - DNA, 898 bp, Zea mays
tgacatcttaacagagcccccaaaaaaatttagtggaagccacgcttccaaaaattggtccctttcggcaaccatctctcttacctcttctgatgttgatgtgcctttttaacccccaccgcaccgccaccgcacgctgttgcggccgcgccatataaaagctgccgagcaaaactccgtcgcccacaccgttaccccccctacgccgcactgygaaaccaacaaccaaatcaaatccggagccagtagggagtggtaggcggagcggagccgcgaggagcccgcgtgtcgcgagagagcagaggcggcggaccggcggcgtcyaccgaacaggagatcttgccgtgacatcgtcccgtcgcctgttcccaccagaatcgaaggagaaacttcgtcgccgctgccgcggcatccggtcatcctcgccgcttgccaatgcaggtggagaccaccgcggtaaggcccctctgcgcgcggttccgttggtgggagcagcgacagcgtgctgtttgcacagctgctgcgaattcagtagcactactattttggacaactgatgcattagcttctcgccgtaggtcatcgattttcgtggttcaataactttttttttgtaacatcaactctcctttctaagaaaaggcaaatggtgtggatttgattggacgccacgtgatagcgcgtgcgctttcatcaaaggcttcaaagcagcttgcagcttggcttattaggtgtctgtgtgctttcttttgcagagctcgcttaagatgtcgccgtgtttgaacctcagttggacctggtcaggacaaatgtgactggttgggctatatacggattgacgtacctgttgcgagttgctgctgctggactgtgattgttttgtcacgtattgaggctc

SEQ ID NO: 2798 - DNA, 454 bp, Zea mays
ggcatgactttgttaaccttctgttcatgacctgtgttttttatcaacatatttcgtagtatttggttcctcctcttattaatatatttttccatcataaatgtggcacatcaaaggttatcattgcttgtatcatttgtttggtacacttaaagtcttctatttactaggtgtccagatagtataaagtgtcatttaatagcctgtttactatttaggtaaactggaaattaaaatgggaatggtcacattaattacctttatctgtaagcctgtcaccataaagccctactaaaatactctctcgactgaagcaaattttttttgctagatatctccccgtcaaggccttttgagagtccgtgagtttactttagcggaaattgagcactttgtggacccagaggacaaatcccatccaaagtttggtgatgtttctgatctagagttctgg

SEQ ID NO: 2799 - DNA, 951 bp, Zea mays
ggtaatcaccaatcactttttcacagttaaactcattcatttttgtttggggggatctttgtatctatttcaataatgctgttcaggactttcctgtttgctaataagcacacatgtatgttactgatatgaaacgtgggtctggtttattagttgttgcttaagtgtatctattatctattcgagtcattttttttataaaacttagtattggttgttagaatggacgcactaactagttcaacccaaaagcttgagttgttcagagagggtagggagagaaagacacaaacatggagataaaggggcagaggcacaaataaaacctctgttaggatttgaactcgagacctttggctctaataccatgttagagtggacgcaccaaccagttcaacacaaaatgttaaattgttaggagaaggtaggcaattcacctatacacctcaaggaattccataaacttagactagagaatggaagtaaaatacacactacaattttgtttttctacactcaacaaaatttgttcaagtgtgtaatagaaaatatgtactccctccatcccaaaatataattcgttttagactaaacacgcattcattaattaatttatgaatgtatctacatttattatcatttattcgaatgtggatgaaaaaagagctaaaagaactatattttaggacggagggagtaagtaactataagatcttttacgaactgaaatcttatcatgatttctagttttgattaacatggattttaaacactggataattgaagtggtacgctttgcatattgaattgttcaaaagtcaattttgagggttcacactggagtcctcaaaaggctaacggcgcacatatgtaggaggtcctaagttttcctctcctggttatttgcaggatgctgctttgcatacacttcagaaggacttgcaagagaag

SEQ ID NO: 2800 - DNA, 946 bp, Zea mays
tgcgactttcaagagtacatatgattctagttctagccggttaacatagaagatttctaatcctattacaaagattgccctccatttattcgactaaggaatagcttggtgaggcatattaaatatcattgtgatttatgtgctacccatatgtattgtaccatcaattgatcatatttctatcatgtagcatgtggtggaataggggagcaagtattatagacgtacatgatcaagaaaagatgaggagttgaggacatcgagccatgcagcgtagccctagtaaacccggtaagctagaatatggcaagtaggctgatgcgtatcatgtagttgtcctgaacaacaggtgtttattagagatgaaagtgaggacaaatttaatatatttaaaataggtaagtatgaaatttgatactaaccctttcttatattaccgagcacattattatgaataagagtattttttataatttatttgctccatacaacgaaaaagataaaaaaaatatttgtatatgtatctgaactgtatttgaattttatatttaacatttagaaagatatataataaatttaaaatttactttttaggaatcctacaaactcaatactaaaagcaagaacataggtttacatacatagcaaattcacccgttccatccttattataaaccctacgggggcacggggcaacgcgcgcagggtcaggagaggcagaggcctcagagatacgccgggacgcaacacgtcgtgccgcgcggagggttttgccgagattttccctcaaaagggtattgccacccgcaccgagaaaagaaaacgatacacaccgcgataaaaacataccctctccatcctctcctcttcttcctcctcccgtagcggcttcccccgatttgcacccgggcgcggccccatccccacctggccgccgcgcgccgcc

SEQ ID NO: 2801 - DNA, 1500 bp, Zea mays
atgctgtgtggtaacagagtagaatgaatggcagtattatgtcatcaattgtctataataatatttttcgatacgaataaaatcctgccaactaatcaaccggtacacaataaatctacccagcacagaatcgtgctggggtgtttcggtgcccggtaatttcccatgagcactcttatcttataggacgaatcgcatagagcggcagatcgttggagcaccacaccaccaggggcggataccgctgtggattcccagtttcccacccaccacgcgaaagacaaacctaacgaacgaagcttcgacgagccggatggactgtttcgggtcccggagaaaaaggttggtactagggttcagggtcagggggaaggaagattctacggcggaattgaagggggaagagagaggtgcaggtgcagccgaagcgtacctgtatctggacggagacgtgttcatctgagtgggtcggcgaccggcgcggtggcggaggcggggggcgagttccccgttgcggtcaggagagagttggcgtcggcctcaggcggctagggttactagggcactcggacgggagaggacgatgaggacccttttgggaaggaaacgggaaggccgcgactcggactcgcgggcttgatgggccttcagccaatcccgaggtgggctgtgcaggcctcgacggcttcttgaaggccgaggatcaggagaagttactgtgcaaacgacagcagtgaacaggcccaacaaaacctattcctcttgttgtatcagtattactcgcggttagacacgctttgtattcctattcacttggttctaaactataactataagtttttttagcttatgtatacataaatatactgtttttactatatatccaaacacatgtgtatcttagtgcataataaaaattatataaaatacgaaaacgtcctgtgtttttgatttaaaatagaggaagtacgtattgggattaaaaaagtgtggatatgaaagatgagtcagagggtgacgctccttttttttttttggcggtcgattacgtattccattccatcgcggcaaggcggtgaaagacgaggaagacgggacggtgacgccccttccttttggcgggaactccggctccacctgcatgccaagtcaaccgcgatagagagccacctaccagcacgcccacctcacagctcacgttactatcgccgccgtgcacacgccacagagcttggcttttggccatcttccccacctgcccaggggcggtcccttcacacccgtaaacccacctccgttccctatcccaattcatccgttccaggtttccaacgctcagtggaatggaagcctccaccccgtgcttgcgcttttaatttccttccccccacgcgcactaagcgcaccaccaccgcttaccatgagtgggagttgcactagctaatcgctagccactccatagttagcatttagcactgcctgcctgtccggtgcccggcc

SEQ ID NO: 2802 - DNA, 49 bp, Zea mays
ctgagagcgtgagagcgtgcgaagcaggagggaggacaagaagaagccg

SEQ ID NO: 2803 - DNA, 1500 bp, Zea mays
ttataaacaataatgtgtaatattctatattacagtaacttatatacagtttctttactgatatgtatttagtagatatgtagatgatatatacatatacctagttatatggggcctctatataaatttttgcttagggcccccgaaatgtcaggaccggccctgcaggtaactagtacagcaggtgtgtgtgtgacgaggccacgcagttttgctgggtgggagcaggcgtcatcagtgccggccctggcgggggtcgagcagtgcccccgaccagggcccccaaattaatggggcctcactttaattactaaataacagtatatatatacaaccatatatcgtatattgtatatatatatgtctgttagctctacaaaacttttaaagacctaattataagtcaacaacacggcaataacaagcaaggagaattagacgtaacccattaatcttgatttctatattctagtagtagtacttcgtagtctcaggcccatctgtctaggctctcagtcgcaaacagatagacggtcgtgccgtctcctctcggtagccaacacacgacattctgtacgacaacgcttttgtctttccctacatagcgaacacgaaactaacatgacatgatcgattgatctcacaacgtattacatctatttgatcattgttcgaggtaaccttcttttgagtcatctggacacatatataccccatttttctacgagatgttatgttatattttagttactttgtatttaatatgaacaacgttttcaaatatatataaatatttattaacaatatatatatgcactataattatgtgtaataattaatattatcaagggcctccattataagtcttgtcctgggcctctaaaatgtcaggaccggcactggttgcggtgtagcctgatacactttcgtgcgtaggtgargccggtgtcatctcgtctcctctgtctatcttttcatactaacacacgaaaaataatggaagtcataataaagggtgtccaaatagcacattgggtcaatgctcttgggcaacggtgcactctatatgttgcaggttaggcacgccgcgtgcattaaatgcagggatacgccacttgccactattgtgggcaagtgtgcatcccgcccgcacgagtgaagagtgctctgttatcgatggattttcgaacgtccagatcgtcgaagacgcaacgcaacgcaacgaaccgaaagaacgcaacggaacgaagaaacacgagtgctgctccattctctaccgggccagagcgaataatcatctcgcaatggcccaagatcagcccaaccaaatcactctgctccaacaaaccggcccgccagctcgcggcgctcgaatggcagcccacgtagcctatatatatctcgccagccgcatcggcggcccctctcgtgtgtctggaaaccctagccgccatatctcacgatccactcgagcaccaagccgagggaaggtgaggagcg

SEQ ID NO: 2804 - DNA, 339 bp, Zea mays
cgtggcacctcaacgacgtggcccattccctaccggacctcgttccacccggcgagcgatgaggacctcttcttctggcaggaccgggtgcgcgcgttggaccgctcgtacctcttctccttcgccggcgtgccgcgccccggcgacgccaagtccatcgagggccacctcgtcgaccagtgcagggcgtcggactcctgctcgctcatggagtgcagcaccacgggtccagacaacaggtgcgagtccacggccagcgtcatgaagctcttccagagctccacgttctgcctcctgccgcgaggcggcaccgacacgcgccgctccgccttcgacgcc

SEQ ID NO: 2805 - DNA, 199 bp, Zea mays
gagcgggagccctctcttctcttatcttcttttctcttggagtagcgagcatccagagaggaggggaattcaacatcaagacgatgtactgataaaattttacttgccttacactactatcgttgaggttcacgtctgcgtattgattagaaccttgtttgatcgataatccaatatactagtagtatgtgtgtggttg

SEQ ID NO: 2806 - DNA, 347 bp, Zea mays
cacacccggattttagggtccaaaacccgggcgcgaacataatcaccaggtgtgctgggaccaagtctcacacatatgatgaatcatggcacatgatcgaatgtcacatctttactacataacaggagttctgtacaaaataaataaataattacattataaggagacaacggtccagcaaccaaaagttgactgggagacgacgacctagacctctcacgaactcgccacagcatcctccatgcgcctcatcctgtggtacctgttcttgacctgtggggggggggggtgtgagacagcaagagtgagctcacatacgttcatcgctcaacaagttgtggggaata

SEQ ID NO: 2807 - DNA, 240 bp, Zea mays
ggtaagaattggagagttcctgttgacattgagaaaagaacttgtggttgtggacaatggcagatttctggaaaaccatgcactcatgcaatagctctattttgtcagcttaaaaaacttaacattgagaactttgtagatgactactattctgtagagaggttcaaattaacttaccagtatacagctgctccattgggtgattagactcattggccaaaatttgacctcgggtttaaa

SEQ ID NO: 2808 - DNA, 94 bp, Zea mays
taccaatgttggcgacattggattgtgggatgttggtaccaaagacagactcgttgtaaggaacttcaaagcctaggacctcagtaaatgtaca

SEQ ID NO: 2809 - DNA, 310 bp, Zea mays
ccatgtttatatacttattttatttatatgatttacatgcttcatatgctttgtgttctcataattcatattttatggatatttttgagatcatgttatgtatgtttgattatctattatatgtcattatcataatgttaatttatggaaattacaatggtacggaaaatgactataattctaacgggtactttggtagcgcgtctaacggccatggcgaagcttgctgcgcagctcaagatcaagttctttggcctcgtcggccgcatcgctagctgcggccgcgccggcgccggcgccgcttacaagg

SEQ ID NO: 2810 - DNA, 753 bp, Zea mays
ggtaggcaaccaagctagcacttctgcattgtaggcaacgtcccgttcctatacaacactatagctgttgcacaaagttagactttttgagctatattttaattcagaaaataaacaactgttgataatagaaggtgtatgccctgttcctatgcaacaccacagctgccacacatggacgtcactgtagcagaaaccttccgctgagctctggagcggaagaagagagaaatgtgcacagagcaagcccggagtgtcaggacgccaaaacagtttccatggcactgctcatgaatcagaccaccccaatccattcgtgccatcgctgtcgtcacgactcacgagcgagcgtgatcgcgtctaacggcccgaatcatcaagcgctggcagtcacgggagaaataaaaactcgcccgcccatccggcaggccgtcagtccggctgccaggcgcgccagcgcggtggaccagcgcgcggccgatgcagtcatgcagaccccccgcgtccggcaacgtcgcgcgggcgcggcacgtgagatccacaccgcacccgcgctccccaacggctatattcgacccgtccccaccaaaaccccccgcatttaaatccgccgcgatctcccgccgctctcccccccgcatcccatgcccaccaccactcgaccaaggcacccagccctccttccctcagcgcttgccggccgacgcactgcttggtgcctgtctgcctttctccttccattgacagccgtcg

SEQ ID NO: 2811 - DNA, 213 bp, Zea mays
ccatgtttatatacttattttatttatatgatttacatgcttcatatgctttgtgttctcataattcatattttatggatatttttgagatcatgttatgtatgtttgattatctattatatgtcattatcataatgttaatttatggaaattacaatggtacggaaaatgactataattctaacgggtactttggtagcgcgtctaacggcc

SEQ ID NO: 2812 - DNA, 265 bp, Zea mays
gcttgcatgcctgcagccacaagcgcagcgctcgacagcctcaccagccgccatcactcgcggcagtacccggccgctgggactgcaagagtggggagaggagacgctgctgctgttgccgagtccgaggagacactactagtcactcaagagtcaagactcaacagcagcaggggcgaccgaagctctgcgtgcgtggggagaaccggagaaggcagcagaggagggagggagggagcgcgtggaccaggctaggcgcagcagc

SEQ ID NO: 2813 - DNA, 707 bp, Zea mays
gtcttgttgtgatttctagttggtgtgcgtgcttgttctagaagtatgtatcgacaaaggcccccatcacctctgattttactggaatttgtattctttccgaaagataaaaccgttcctcacttttcagcttccactctgcatccaaaattctatatagcccagctgccacattgggcaagctcacttatgcatgataccatcaaggttttaaagtcgactagtcgactctagtcgcctgagtactgataaggtgactaatcgcgattagtcatcgatttgctcgattagtcgagcctagtcgactcctagtcgtcctataatcgtccacctataacaggaccttatgtataaatatatattaatatatatagttgtagcagtactgcaatacatcagtacactatagctgtagcaggacaacaatatattatagctgtagcaggacaacaatatattatagctgtagcagaacaacgggaaaatatcctatgcaatcacttatcctgtgcaagcatgcaatcaagcgatctggtgcatccgatctagatctaatgatgactgttattttatatttaaccccttccacctaaaacatagtacctattttacttttaaccccttccatatgaaactattgaatctggattggatgctctagatagtttgattgcacgcttgcaccaaaatgagtgattgcacaggat

SEQ ID NO: 2814 - DNA, 664 bp, Zea mays
ggatcggaggagagcctgtagccagaaagacgctatgattttttttttttacactcgtgtacaacttgacccgtcctcttacaaccgacctcgtggctaatgtgtaaccaccgtccactctgatcatcgtaaaatacgcaagatagtaagatacaataacagatccaacatacacgacataggttattatctcagaaagagagagattgaacttgtataaaaactttcctgtgcttttatctttagttttcgatcttgtgatctagttaacatcgactcatcgaataaccttcgacagaaaggggagggagattagacgtgttggatgatggcttaattacatacaggtcacaactcacagccgacgcgacgacgacgatgaggaggagcaaaacagcagagtggtgggggagagaagagaaggaagaaggcagcagcttactactagcacgtacaatacaatacaatacacagtgcatagtacaggcacagcagcagtactagtctagcagtggtacatgtacaagtacaaacaacccgtgcgggcagcgggcggagaaggaagcgaggacgccgcgcgcgggccacgaggcagaggcagaggcagaggcaggtgcagcagcgcttcacttcacctcacttgggtccccagagcagcaggtgc

SEQ ID NO: 2815 - DNA, 754 bp, Zea mays
cctaaaaaagtaaaaagtgccgtcgtaattgcctggtgtcatgatgtctctcaatttcatggccaaagtgctttgatgaacaggcagctctcatgggacggagaattacagcagactatacaaacagctggattataatataaatgaacagtgatgtttatgtgctccttggtccttgcattgcagtcatccaagcccgtccttgcattgcagtcatccaagcccgtagcagacatgacaacgggtacccgcgactcgattcccgatgattatttactccatatattagggtatatatatgaactaaatgttctactccaatggataaacggatattagaatattgtctcctcacttcttattaaagttcaactaacagtttcggtttgtacccctatttataagctgcgcggtactaattaaaatgcgacttgctcaacactggcacatgcttggctcggtacctatcaatcaatagcagttgaaagggagcagcaaggactggacggcaccttttccttctgccagtcggtcctggatcggggcacagctagctagctagctagcgctctacgagcaaaagaaatgcagcagctagcaggtacatggcacggacggaaccaagccgatcgaaactcaccggcgacgaccgtctgccggaggagagcgcgaacgtcagcagcggctccggccagtccagcccgagcacggcctggccgtcgccattcctcgcttcagtcagtgtgcacctggc

SEQ ID NO: 2816 - DNA, 681 bp, Zea mays
atgcctgcagaactaatctaacctctactacccaccggtccgtgcttcgtaccaaacggattcgagctaagtaagtctaaatttttttggcgtaccataccagtccgaattataaaaacagtggtctatctcagctctaaattacgtcatgtcttcattgggctatacctcccaagctcgactcatatatttaacaacataaaatcaaaattttacaatcatgtaaagtatatagcttactaaattaaagatattaaacaatgctagcattatttgaccacataaagtctaaatattataacaatataaagtctataacttactaaattaaagaaaattgaataatatgggctttattggaccgtgttgggcctgacatgccgaaatttaaggtctagtctagacctacattcagactgtggtagcctgatccatattatttcgtgtcagattattctttgaactactatttttagatcgtgatcatgctgacaaaaaaaacctggcgccgccgaccgccgccgcggcagttgttgcttaggcatagctcctcccgtaccgactgatactgcgccgcagtgctccgacggtccgaccgatcacaacccgcggtccgacggttcgtgtggtggaacgccgcgcgcggagatctctcgtaccgtcgtacgggaatcgcatgca

SEQ ID NO: 2817 - DNA, 792 bp, Zea mays
actataatactctgagtaaattttggcacctgtacgtaatggactctttgatcctctatattctatattcaagagaagattaaacaaatctttaaatagaactaaaaaccatggtgggacatctttcacgaaactaagattgagttttttttatatttcatctacacattctgtaactatatgcaaccctaaatctcataaaatatttattaactcccttgtggatcatcatctattaaaaaactataaataagattgatgcacttacactagcacactacactacggtgttcgattgtatatctatatacagggctgtgctaccgtgccgcgctgtaactagttcgccctccccctcctcctccccctccccgcctggacaccgtcacaccggtcagcctccacgcctcacggatttcgcacccgaaaaaaaaatagaaagcgaaatcaaccaatctcctatcattcacggcctcgccagcgcctcctcctccccctcctccccagaaatttccccacttgcgccgctcgcgatcggcgcccgagctcccggaatcccggcccggtttcgcgaccgttcgccgcgagccttgggccggtccgggctctgattcgcgggcgccgcggccgtggttcgcgcggggaatgctctacctcaagcagccgggcggcgcggacttagggttccggcgggcggcggtggcggctgctgctgctgctgctgcggggctgtgatctgccgctgtggtggatgcgaggttgagccagcacgcgccggggattctgctggca

SEQ ID NO: 2818 - DNA, 217 bp, Zea mays
ggtgagctgtgagcactgagcacaatctgttcgtttgatttttggtatatttgattcaatatatggttgttcttgttgtgtttgttatctgtgcgattgtactgaacaccgattgtgagtaaactttcattgaactaacatcgtgacggcgacctcgcgaaggggcgccgctgctgctaccgttgtcacggccggcgccactactaaagataatcta

SEQ ID NO: 2819 - DNA, 817 bp, Zea mays
gttcggttatttgcatctcggttttgatctaaatcttagaacacggatgtatacatgtttttttttgcatcagaagaaatattttctcagatatttttagccaaccctatcctcccacctagccttatctctgtgttcagattttttttgacgccacacaatctcgtacggcacagaaaaatctggccgtcttcatctacttcacggccgcgtcgctcagcctggaaaaatcccgccgccgaagaccctgtcttctccacaagccgcgcgccgtcttcccagcaagccctagccgcgtctctctctccctcgtcttcttccccacgaccgcgcgcgcccctggtccaagctccctgcttccttgctgcgctcccccggcagcgctccatctctccctcacggtgctccggctcggcctccatctccagctcgcttctcccccgttcctccatggccgcgcgcctggcatccgctcgccatggagctcccgcgcgcgccccattttccatggcgctyggccgcgcagagtcttcatcggacatggcgcctcatcgtcgctgctcccagccctatgtacgacgcctcccctccagcttcagcacggcgcacctcctcatggccgcacctctccctgctcggcatcaacgtcgaccgtgccttgccaacggggctcacccatgttggccatgcctcccaactccgttcttggatcggctgagctcctargcaccacctcgctgccgctctagatgttgtgcttggccctccgtgatgttcacccagtgagcagcaacagctccgcgaactagtcctccac

SEQ ID NO: 2820 - DNA, 169 bp, Zea mays
ggttactcaattcagggaagctttccgaagccaatactctgggctgtgattttgctctttgtgatgggttttatagcaggtggcttcattttgggggctgttcacaatgcaattttgctgatagttgttgtggtcatatttggttttgttgctgcacttcttatctgga

SEQ ID NO: 2821 - DNA, 401 bp, Zea mays
tgcagcatcatcctctcttttctttctccgaccacaggaagaaaagctcaaagctactacaggtactgtacgcgtagcctaggcaactgttcgccacgtagcaccacattgaccgtctggcccgcaactccccaccctttcccggccgctcgccttttctcctcttctccgatctctctccccctcttgaccgcccttgggatttggggggccctgggcaaattgcggtggccggggcccgccgccgcgacagctccgtccgtcctcggttccgctcttccgtccgatccatacgtttccgttccctataaattctttaaattcccgcaagtcccgtaccgctcagccaacccaacacgacggcgagtcgacggcgagtgggagggaacaccgcagcagcg

SEQ ID NO: 2822 - DNA, 366 bp, Zea mays
cgttcgagcgcctcctgcccaaccatgcctggaacacgctcatggacaccatgatggggggagctgcacgcgcacggcaggacgctggccgaggtgaccgaggcgctcagggcggcgcccatcgacccgcgcgtgcccgccgccgtcagggccgcgcacgcgctcggctgcgacctgcgcgtgctcagcgacgccaacgccttcttcatccacaccgtcctggaccaccacggcctgctcgcctgcttctcccaggtcaacaccaaccccagccgcgtcgacgcccacggccgactccgcatcgggccctgccacgacccgcgcgcggcgccgcacggctgcggcgtcggcacctgcccgcccaac

SEQ ID NO: 2823 - DNA, 296 bp, Zea mays
ggtaccctgtcatcctttgagaatgactgcagttttttctacctcccttagcttttagtcagcggtggagttgagacaattttgttattggagctagagtgctgaattgaggagcgacatcaatatgcccaagagattagagagacggccaacctgagtatcttgctctgttgcggggttttgcctgcttatgaagctgtgtatggtgattttgttgttgtatgtttatgagtaggctctgactagcgaggatattctgagtgtagaacgtcgaatctagattttttgagggtcta

SEQ ID NO: 2824 - DNA, 868 bp, Zea mays
ttgcatccgtacgaccgactggagttcgatcaacattaatctatgactattgttacatcttattacgaactaatgatttatatgctaccactatgtactagtcctgtagcagttgttgttgacttgcctaggggtaggcattttaaaataaaaattcaaacccgaatatatcgaattgtcagtctattcgggttcaagttcggttcctatatatgctatgtttagaggtatgagttcgggttcggtttctaacctttaaaacccgaatagaccgaataacccaaaatataaaaaaactgaagatattatatttattaatttattagttaaaaattataatatcatcttaacgatagtatatatatctctgtatgatattttttatagtcacttgttataataataatatttcgaattaattattcattgtatatattttwataaaaaatacaagtctctctactattcggatctattcggtggatcgaatagaccgaaccaaaatcgtgagtttattcgagttcggttcctaaaactattttaaaatttcagttcttattttttaaatccaaaattttataaactcgaataaatcgaaccaaattaccctaatccacagaatgccgacttgccaactgcgagtgtgatgggctgctgatggctcgggcatcaggcgcagtatacttctccagacggccggacaagccgtggtgggcctgacacaaattaagtgggccggtccgggcgacatgcaacaagtgaagaagaggaagaaaggagacgagaaagaaaggaaaccctaggccgctacgcccttggccccttctctctcttcgtcgcgccgccgtagcacgactccgactcggcc

SEQ ID NO: 2825 - DNA, 1500 bp, Zea mays
acagttgtcagttaggatggaaatttgatatccatcaataaaattgataaattatagaatggtgcaccttatcttttattttactagaacacagtgcaacttctatatattcttatttgtaacttggatatgttgcaaaaataataaatattactagatccttgcaaagagaaggagaaataataaaatctagaaaagaataatacaatacaagggagctttgaaatgaaatattatttatatacaaaccttctatggattgaaaagaccgtttaatctgttactggatttcattatatttgattcagctcctcagtgcaggtatgtactgttttcagtatcatgtttattttatgttctgaagtagaaatgcctttgtagggccataaatactttgtcttttactgctttcaggtttctggatttgtttttaccaaggttcaagaaaacctaggcgctagtcacacgttatcctactgactagcgtctaggaagattaaacgtagattaagcgtgattaatcgtttgttttttaatttttgtgctgcagaaagcaagatcagcagtgagtaactaagtactaagtaataataacacaactactaagtagtgatactagtgaacctaccttttactgttccgcacatttattttttacataagttgctttcctccttggcttcttgcaagttgcttccaacagcagctgatcatcaaagagagacaagttaataatctgaaaactatacaatcagataatttggaaagagtagaaactcatctgaggggcagctcaatattgtacatgcacagccaagcttgcaaacaacagggcaacatcacaagtcaaaggatcacaagaaatacagaaaacactcacagttcatcacatgccttaatggtccacaaattaaatagcagtacagcacacaataattgttttatggtccacacacattaggataagtaaataactagatattaactacacggcgcctagcgcgtgcacaccgtgtctaggcgcgcccagcgcctaatactgcgcctagtccataaacgagacactagaccttcgttagcgtttaatcgagattaatctccgtttaattgtgttttttcgaaccttggtttttacaaaatgttgataatgtggcctgtatagtgcaatatcaatgttcttattaatccactttaaaaacatatataattattgtgttcatattatcttggtttactggtactttgataaccttcagattctcatcatatgcatgcaaagcaaaaaatgattgtgatgtttttcggtcacatgtgcatggatagcttatggttgatcattgatcatttgatcgttatccatattttattccttgagtttctttttgtctctcttgagtgaacaaaatattgggtctggtactgagatgattcttcttgttgggcgtttgagcatgaaaagaatttgctctgtcacttttggcagatgacgtgatccatgag

SEQ ID NO: 2826 - DNA, 562 bp, Zea mays
gtccgttgtcatccctactaatatggtagcattattttccgtagtatgcatgccaatgtgtgcatggatagtgatgcaggacaggtgtcaggcagggacaatcagctgcagcctgatgggacaaattaaataaaatgatttggataagatcaccagcggcgtctgtcagccgcagcgggcaacggaacggacagacgggtagataagctgacgcaatgatcagtctccaactagatcgcgtccatttgattatagtcctaatcctagtcgttaataatttgattagggataagcgcccgtgccatccatcgccgtcgctccccggctccaccggcaactctctataaatacagctcccagcgcacagtcgcacaccgagactctctcaattccccactcatatagtcatatttgctcagccttttgcaaacgagttgaaatcaccttgttcaaatcgtcccctcctctctctcgctcgcttgccaagcacaatcttctgcgcgttcgtcttgcggatttgttaattggttggtcagctcctctctgacccagaggcaaagcc

SEQ ID NO: 2827 - DNA, 646 bp, Zea mays
tcctagcttattcaaaatagcaataaataaataattttcaattggacatgaatgacagtacaagtaaaataaaggtccggcccactaaaaacgttctgtccccgagcgacaggatgcttggcaccctccaagtcagggagaagagttaatatgtgaaaaaatgatgtctaggtccttataacttcccttggggagacaggccgaattcggccgttccaaaatataattcattttagactaaaatacatttattaatcaacaaataaatgtagtttatatatatgtctatatttattaatatttatttaaatgtggacgaaaaaagtgatggctagaaagaactatattttaagatgtaggggtaatttttaagaatcggaatatgaaattgaatttcgatttttaaaatataaaaatgtaaaagatacgcacaaaaatgggcttgagagtgccccctcgtctctataaagtcagcctcgaagcgtcgccgctctagaaaccctaacactcatcacgccgccactgatctgctctgttgctggtactcctcgtcttcctcccgagtcctcctccggattcgatgttcgtctcctgatttattggtggaaccgcaggtgactaggagcagtagcgagagggattctgg

SEQ ID NO: 2828 - DNA, 722 bp, Zea mays
aatcccccggtgatccatgggtcatcaaattagtcctaagttttatgaataaaatgctatccattactctcaaaacaaaactgaaactagatttattggcaacgaagataaacagggtaaaggacactgtccacagtaagttttatcccatatacttccttctcttgcttctttgcttgatgtcaccttgctcgtggtttgatccgtaacagttttatatattctactacattaacaaaaactggaacggctgaattagcaggtcgtctttgtttgttggcgtccggattgcttgcaatcacactcttggagtgacgtggcaggcacacagcgacatccgttatcctttccctttcgaaccatccaattccattccttccggcaggggaaacacgaacacggtcacgcactccgccgatcccgccaccgcggcgcggggacgcgcacatgctgccaygaatactcctccagtcctcccccgtggtgccggcccccacctgacccccgatccccgcaaccttctatccagaggggaaaaaaagaagacaaaaaccgccggcgagcatgggcacgcaacccggctcggcggttcgtgtcgctgcggatgagagctcgctccctggactttacttaactctactctgagtctcggatgctccagagtccagacttccgggattagaaatccacgcacatcgccgtgcacgcacgcgacggcggag

SEQ ID NO: 2829 - DNA, 52 bp, Zea mays
ggctatagctgcgccattttgtttgcttctaaatttgttgataaatcaacga

SEQ ID NO: 2830 - DNA, 1500 bp, Zea mays
aagctgacagcgcgggcccggttgtcagtggaagcaaggcacgacccacttgtcggtggtcgagacagaagagggagtgcgcgctttcagcaaaaacaggctacgcgatactgggcctcaagctgctgggctacggccgcggaccgctagagctgaccacacgcttcaccaggcttagcacggagagaaaagaagagatgggctgcgttttggtgtggagctgggctgtagaaacaacttcactggaagactgcgcgtaaagaggatggggaagcaggccgcggctttgggcttccaggtaagctttagttttcctttcatttttattttctgttttcaaatccatttcctaaattcaaattcaaatctaatttgaattcaaatttcctcgcaacaaatcaatacaaaaataatgctccaacatgaatgcatcaaacgatatttttataaaatatttttattaccaaaaatattatttatcccatatagaaaataataactaattcctattaaatctaaataaattcatatttggtttattaaattctagaaaattagtttttcaaaattaggcaaattttagtaggggtgtaaacgaatatccgaattgttaggacagatttaatattttaaaatagatatttatgaaatttgatgttaatctcttcttatgttatgaagcacattactataattaagaataaaattttgtataaattgtttaatacattatttgctctatataataaaaagacaaaaaaatatttatgtctgtatccaaaatttatatatatattggagaaaatatatgataaatttgatgtttatttttcataaatatttacaagttcaatcttaaaaaagaatataaatttatatagcaaattctatattctattaattcacaaaaaaatatcaaaaactaatattcaaataagtatctgtttgcacctttgaaccttcatgttggtgtccattatgagatcggtgtcgtcgtattgtcagcatcatcgccaactctagcggattagagttaggcacaatttgatttgagggactaaaggttagtttcatcattttaattttatttatagtttctaaatagtaaattggtgggactaaaatatagattaaactgctttagtctctagtctttcaaagagtgactaaattatattaattttattttttgttctcgtttatttcagttatatttatggtagaagaatgttaaaagatattttaatctttttatgaatcatttaataattttagtctctacaaccaaacacaataacctcttaattaaactttattcctgtactagaggaaccatgcctgcaccgtacatggactaaggagcgcctcatcttacactaaccgtacacacacaggtcagccacacattacaggcttacagttgacgtttatccacgtaagcctgttacaagaaaaagagactaaaaaatcgccgttctgttttcccagttcgctcctccc

SEQ ID NO: 2831 - DNA, 153 bp, Zea mays
gtaccgttaccacccctttccgccgccctcgcccaatatcgcccctccgcggccgccacccttcgcttccgcacccccttttccgcgcccggcgtttcggcttcttcgtctacccgggcgcgcaggttctcggttatcgcgtcggcgcgcgag

SEQ ID NO: 2832 - DNA, 811 bp, Zea mays
cgacctgcagctctgttacgggaatggtctagaaactggctcccggacgtcggcgcagggaattgtctcacgacccgtttagaaacacagcacaccctgacagggacaaagaaagagagagagagagagacaagtcgttgtattgtaaacgaacgaggttaactatccgtgggtcccggcgtcccttcccgtccaaccggcggcatgatcacaggccactgtgcgcgtgacggttttcactcgacagcgccgcggcaaacgccatcgagttgtagtgtgtaccgctgctacttcagacggtcggaatgagacgcatggtcacgatcccatcccacggcatccaattccaatccattatgcatactcctagtaaaaaaagagtactacacttaataattatagtaataaatagaaaaggcagtgaaatgaaaggtcccaactgccctccgtttgcgtgacgaggtaggcaagggcagaactagcagcctggcactgtagcagcagcagctgcacacgtaccaccacgccaccggcactcccggcccggcatcagctgctgaatccggcaatcaatcgcgcattctcgtccgcttttcctccccggcccgcgcgccagtatcggctgctctgcctcgtgcctccataaatacgaccccgccctccgccattcccacccgcccctcctacagctccgctcccggcctgtgccgccgtcgccaccgcccgcctgcctgggcccgctgcaccgactctgacagcgcacgtcctgcttcctgtagcggcaggcgagggagaggactcagggagtgtg

SEQ ID NO: 2833 - DNA, 1038 bp, Zea mays
gagatgggtatgggataagttttgcacctatgatgggtatggagatgaatcaaacatgacgggatgggtctaggatgctataacccggtggggaattccccattgacatctctattagtgcctcgtggtgggtaaagatcatccttctgatagcagcttctgttggaacataatataagtgaattgtccacctcctcctatcagtttaagttttaggttaaactgactggtgcatgcaacttaatagcttcattttcataccaacttataaacatttccatttcaacaataaacacataaacattttttactagtaataactctatctgtttcaagttataaaacattttagctttttaaaatcaattgcttttagtatctatatattttttataatttataatagaaggagtactattgatattttcgtaaaagtccatccatttgcatatgagaaacgcatgattcaaatgaaaaccttatagtctatacataatagatcaatccaaacaggtccactccctgtggacggcgtgaagattactattttgggtcaagcggcctgatttgcgagattaatccggcccgcaaaaatcccggttcatgggccatccaatctgcttctggtcggaccggcccaaggtccgcccgaccctcatctgacggcatgccagccaactatatcgacgaacagaacaactttctccttcttccgcgctgtcgccgtcctcctctcaccccaatctgctcggactctgatcgcagcggacgcgcatccaaccagctcggattctacctctctcccgggtaagacgccgggcctcgcttcggcggatgtgggttaccctattttttccccccttcctctactcgacgaattccgttccataggatatataggatctcttaatctttcccagccgccgcgagccgaggagtcagatcgaaacctttcttttttcggcggaataagtcattcgtcttcggccgattgaattactaaggtaggtgggtgctccttgtttcgccagggaaagg

SEQ ID NO: 2834 - DNA, 109 bp, Zea mays
ccatctccatgcccaaagcatcaacaacatacacacaagcaaaacaaaaagctaagctccgtagctaaattcagatattacaaacacaaaaagggagtgcagaaccaaa

SEQ ID NO: 2835 - DNA, 1500 bp, Zea mays
cccctaggccttatatactcgaccgtggggcagtacatgtggatatgataacaacaagtagctaaaagatagtgaacctcctgagtttatccctacgtaaccctcgccgacttatcctcgcatggctctgttgcatgaggggcttcagcgcgggaaagtcgggtctctgttgcgatttattcgttcgacgttgtgggccatccgggtttgcaccaatccagtctcacgtcttctcttctttgtcggttgtctttccctaggcccacggaagaatgaccttacgaattattgggcccttgggcctttcgtgaggccttttacttctttagtggacccaggggatatctatcccccacaagcccccgatctttgggttgatttagaggtaatcgactcaaagatccaaggtccaaaaatgactccctgctgtcttctcttgctccgatcactcgttcgaccaaagtttagttttgtgcctgtgccttagaggtcggcattttggattgtaagattctggacttcattgggtgcaccggaggtgcacccaatgggtgtagcccccgacctttgagtagattttagaagataatctactcgaaggtcttctccaaagattatctccattcgcgctcctgcatctcggttgaggattgatcttttcaatcttgtcccgcgccttagaagtcggcgctatatcggtttagaatgatactccatggggtgcaccggaggtgcacccaatgggtgtagcccccgaccttcaaatggattttttaaggataatccattcgaaggtcttccttttgcttgaaaaaattggcatgaagctattcgcattatgctttggaggtcagcattatgtcatcaaaattttgctgcagaggtcagcatatattttgtctttagcagccgagtttgcaatccgtccatatcttgctaggtaatgcaatttatttgcttctgcaacttgattggacgtttgatggacgttctgtgtctagtcctcacatcgcttctgtcggtcatatcttgtactttgctggctatatttggctttcctctgatccttactgatatctcatttttgtcttgaggtatttactgcatgccctgcacggatgtgaccgttttgaaaaatatactgataattcctgggcgtccccccccaatgggtgtgggcaagggacggcttggtacgctgagtgttttagccggctacttctgagtagtaatgtgatgggacggctagtgtaatcatatcctttgcgctgttgactggagtcccaatgggtgtagtgttgcatgaaacggcgtccgccgtctgacgtgtcttcagatgggtgggagtgcttattgaatgctttgcgactgttcagtgaccgcggttggaagtgagcggttgcctttcctttctataaataacgtccttgctcctctggttttttcgcatcctttgctgttctctgcttcttccctttcttctctcccaaagcttccacc

SEQ ID NO: 2836 - DNA, 292 bp, Zea mays
ggttcggttcgggttcgggttcggttttcggttttaaaatgcccacccctagcagtgtgaatgactgaatgggcagaaaagtaacggcaggcagaggcgagaagcaagaagaaaacttagaaaagcgaggcgagcaagcaaatcgaggcaagaaaacgggggttaagggcagggcctgcagtccccctccgcggccgcgcctcgccgcggtttacagcctgtcgttagggattgctaccgttggtcaagtcgcgctgaggagacgagggcaggaggggcggtgggctgtggg

SEQ ID NO: 2837 - DNA, 1500 bp, Zea mays
acggccgacagctctcgttatatatggtctggtgcctttgtcagcttagcaaagtgcaaggctgaaaaggggatcatgtggctggcccttcctctcgttgtccaaagcagcattgcaaggcgcaaacatttgtatgagtacaagggtacttatagccttttactacatccataaaccggatcgacttattccagcttgagttcgattcaggggtgctactgtgaaacttttgacacggccaaaaaccccgcaaacctagacgaaactaatgagtcaatctatagcttgtttagtgtgaaccaccagagtgaacatttgaatccttcgaagtgaggtgacctgctgctgaacgacgccgacgcacgtcgttcctttctttcagtggtacggcggtgagatcggcaacgattgtctattcgctaccagctagaaaataaattgctgttaagtgggctagctcaatgaccctagctaatcatgtgtcgcctgcgtcgcctcctggccacctaatcgctgaaagcagaggaatcgttcagatggagtgggaaaaaaacgggcccaattgacttaactttgtcaaacagcctaccagctcctgcaggctgcagtgggggggggggggggtgtgtggttaggattctggggggaggttctgttactgcaaagtcttgtacttgggaaatttgtatagtgtggttaattgggcgttgcgttttttcccagcaaaactggtgtctgtggttgcaaactttcttggttttctgtttcgcagcctcattaagattcagagtatcagtcccaatcttcgtgataaaacgcgctgtttcttttctctatgttctttgtttcttcttcttgttttttttttggcgagatgtattattgtttcattagtgcttttggtggggcgattttctttccgagaataatgttagcgaaggaaattcagtccgcaccggcagatgacatttatcgatagcaagtaggcaactgaacagatggcagtttctggtcaatcaagaagttggagggcagaaaaaggtggagcgaactccttttctgcaggtaaaaggggggaaactagtatcaacaaccggagcagcactgcagcagcagcagctaaatgttcagaacaggtagaacgactgggcatggtgaaacgaatccctctggattgcattcgcgagagctagacctagaccagtgggtgcaacaactccaccgtcagcattcaccgttccgttcagcaacgcgaggtcgtcgaactatacatcgtactcgaccgccaccttaaagtccaaaaggcgtcatgtcgcggtcgcacggatcaaaacctaatcttccaaaccccaaacaactgcactaccctcgctccctctcgggtctcgggcggcccatcgatgctacctctatatatcgttccgtcctcgcacttggtcaccaccaccagagcagcaactagcaagccagccagccagccagccattgccgaccggagcg

SEQ ID NO: 2838 - DNA, 687 bp, Zea mays
agtgagtttccccctcccccaatgtacatgtaaccgatcaattttccgcccgttggtcccgattttttctctatcccgtgggggttccagagccttgtagacagggcttgtttgatttgtaactgctagtgtaaagaggattcgatccacccattgattgattgatatcagccattgccgtctttatatcgtgagttgggggcaccagtgtcttatctgttcactggtcgagctcttcacgctggacatttccccagtaagttatgcagctgatctggtgctcgtatgaaattactggcctcacatgcggttctgaagccccggtgcagcacgtgtttggggagcagctgcagcatgtgttgggtatccagtgcccccagtagcaaccatcctggcacaaaggatttatcggacgagacacagggttcgcggtccatgctgccgtgccgccctcaattttcgctgtggaaataggagattggcagggggcaccacaccattcatcttcgtctcaccgccaggaggaccagcgcatcgagacgggaccaggtgggcctgccgtgttgtcatcatggtcagtccctcctttggttgctctatggtcctcgactgcaacggttactgtacggagaaagaaaaaaactatcggatgggcactcctgtcagcagcaggtcatcaattcgcaa

SEQ ID NO: 2839 - DNA, 1004 bp, Zea mays
ggtcaaaaccccacaccgaacggaggccatgggcgtgtgtgcgccgatgcgcgccctgtgcacattcctccagtacaccacggctcggcgaccatagcagtaggctagcagggggcaggggctggcagacagatcctgagcaaaatccatcgggtcttcccgttgccaaacgacgttttctgatctctccctgtggctggtcgctgacgcaccgggtcccagcgggccgtggggatccacgcccggcgtccgcgtgccggtgctggccggcaccgagcgggggcactagactctcattttgccggatcgctgctcgtcccggcctcccccagatcaggatcatcgtcatcgatcgatcgcccgcccagcccccagctcttgttaattactgctgccattaactcccacgctgctttccatgtacgggcgcacgtgctcgcccttcgatccccgcgcggcggtctctgtccggcgggctccaccggccaccgccggggagctagccgttgggggagaccagaccacggcacaggacagggtacagacaccccgcgcggcagcgtcactatcctgtggcttaactcctgctgccgtgctgctcctgcgctgaatgggataaagaccggattctttcccgccgcccgggacccgcgcgtgtcagcgcccgcgtccgtaacgtataggacgaccggtttttaaaacttcaaatcgtctgtctcgcccggtcgccccgccctgcaaagaagcactcagatagctgttagttagcgcatttgagttgaatcggcctagcagctaaaccattccctcccttttttttccccttctgccatgctcctgtcctacaacgcttatatatagcggcccggtagcatctgctttccccgctagccagaaaccaagaaaagctcctagtcctaggttggagcggttgcgttgtgctagctacactagattctagctagagagctagtagccacttgcattaggctactagccggcct

SEQ ID NO: 2840 - DNA, 992 bp, Zea mays
ggagagcactatgcttcgcttattttcagttacattgtttcttatgttattaattttgtttaagccctgtaatttgataataatatgtattacggtagaggaatgatcagagacggactatatgtaggaatttgtgtagagagatttagtaaaatatattaaaaatatagataagaaaggatatatatatatatatatatatatatatatatatatatatatatatatatataggggatggttgaagatagtctaagatcccatgtaataacaatattgttgtgtatgttacatataataaccctagcagagtagcagtcttgcaccgcataacctgttacccgttgcttttgcagtagaacctgcagtagaaaattaattgctcctatgttatcattgttctatctaaaataatcatagctcattaatgacgagccgttgggcttattttataggaacacatgccacatttcacacttgtacacctaacaattagaccgaccccagcatatcctccgtcggtgctcaggaccgacagtgagcactcactgccaagcgggccctgcacggcccccagttcacccttcttccacctcccgcctcactggcacactctccccgacacaactcggcttaaactaatccgaacccatcccaccagacgcgcgcaaattaactagaatcaaaatcgtctcgctgctgcaataatcttttatcaattcttaatccctcgcgtcgaaagcgacagcggaaccaactcacgttgccgcggcttcctccatcggtgcggtgccctgtccttttctctcctccacctccctagtccctcctcccccccgcatacatagctactactagtagcaccacgctcgcagcgggagatgcggtgctgatccgtgcccctgctcggatctcgggagtggtgcccgacttgtgtcggctcggctctgcctaggccagctccttgtcggttctgggcgagctcgcctgcc

SEQ ID NO: 2841 - DNA, 1500 bp, Zea mays
acatatcatgttatgaaccatagttcatcaatggtaaaaacaggaagatagccaggcggagtcaacttagacagagaccagattatggattggaaatggatttatgtacttcatccttgattgattctcgtgtgttgctggctgcttttaatgggcaagtcacatcgtaaaaaaactcacctagcttagtatctaagcaacctgatcctaataacccatatctaatcctattccatgtgataaaaacggggacaacatccttcctgaccataaccaagcacatgtccctcctctagccatcatcagaaatcatgtttgttttcgctccgtaccagcagctgctagtgacatctgattgtgccagcgtacttcccatgattggattagtgccaaatgttacccattctcatgagtgttgctgctcgagcaaggctggaaagattgaaacaaaggaaaatatgaatgccctcttaactgaaaagatgttttaacactgaaagtagtggggatatttgacagattttcttgattggtggcatagaaaaaaaagggatgttttgcagtattagaattcccaaccttttttgttattaactatttctgttgtatccattttctctctcaatttggccaccatttattatcctgagttacagcaaacgcttccgttttcttttatgaataaaaaaaaggagggccgacaagtacagataatgacatacactcacaactgactcatgctgtattctgtgaccatttatttatcatttgttatatttttttatgattgtaaaatttttgataattggataggatatttgaatttaactccaactttatcaagtttgtattacaatagttagaagttgctggccaaattattggtcaaagattgtgaaatttgaatattgatatgcatgcgtgccttataaactgggccggagggagtattaggatataactaagaaatcttatctttaattgcttctcgtagttcagagagtgttaagatccatagggtgacagacacggtatatatcctcttctgtctttggttagacgttcatcttttatcttgtttacaatggccagtgctgctggagtttctgtgtcaaattgttttgatttgttaacccacatcgaaaacatctagatcctttagtttcagtgtatctctgttatgagaccatccaaacaagccctatcctcctagaatgccacatgcgttatattgggaatgaaaaagtgagcttaaagaatagcatgaggattaaaattcccttacaaacccattccgtttattcatgatatacatattgaatgtcaacaattttgctaagcatttttttatttgttcttgatgcaggttcatacgtgacgcacgagacaaactactttgtatatttctacatcgactctaaagctgtcttgctattcaagtctgggtgattgctcgcagccgacgcaatcaaccttgcacgcctacgttccattgctccc

SEQ ID NO: 2842 - DNA, 249 bp, Zea mays
attcattgggttttcagttttctgttctctcttttggagcgagttcagagtcgttgcgttggattctcttggcagagtgctggccgtgcacaggtgcatacgtgcagtgcagtgcactcccgccaacctcgttggcgttcatctgggccgacgtgtacaggtggtagtatataattgttgttagagagggacaatacgcatggctagaattttataattctagagttacttctatcaccacacaactga

SEQ ID NO: 2843 - DNA, 1500 bp, Zea mays
tcctcgctgaatcaattcataataaacaaataacattgaatgttaacacatatgtagtacaaaaccggtagggattttctaaagctatatatatacacacacacatttgataagtcttccacaaggtacaaaaagtactagatatctccctgctgtggttgttgcggcgatgaccatttttttcgacggtgtgtaccttggcacacctaaccttgagaacaatgcttgcttgcacaccaagggctcctccccttgacttgtctactgttctcgttcggccaatgctggtaatctttggtacagcagaagccagacgtacgagtacgactgccgactgcgtgatgacaacatcgatcctcaccgaacgccagcctcattacatttaatttgtcgttttgctgatcgcgttgcattttttttccttctatcgtgtctctgttcattcagtttcttatcgttgaactagaatattttctatcgtagtctctgcatcagcaacagcccaacacgctgtaatcgcgcttcaagtagaacagctagctgcatcgacctaaaattggggggcacctttcatccagtcaagtaacagcagaagaccagcaggtaatgccataatgacactgctaattaccatgcccggacggccggaccaatttgtggtgtacacgttttaccttgctgcacgtcatgatacaattagtatataatatacatagtggatagatagattatagatagtagatagatagatagatagatagataagagaatagcggctgctctgtctatctatttttctttttatatacgtgccactgccacaataatggtaagcagagaaacctgcgcgcagcctttttttttccctccccatcccatccggttgaccctgtcggaataaaaaaaatcagtggcgaagatgcacgcaaagattgcaaccagattcctgatgtgagccacacaataataaacatgtgtacaggcggacagcgactgcaatattattggagcgggagcgggagctcagcaacaccagcacaacgcccagagaccccagggggctgggactgggacggcggcttgcagattcctgcggattcttaagtaggcgcagttgttaattaatctgggttgaattgtcaaacgccatgatgggggacggacgatgccaacgcgtcgccgtcatgggggggcgtccaggtgtgcgctccccagcgattcgctaatcgctagtcctataggcagccggcaggccacatctttttcttcctccccagtccccagtcccccattcccatattaagcagagccgaggcgagcacccccacccaccgagatgcaatgcaatgcaaacatcctccctcttctcctgctcctcacagacatcttatcctagctcccggtcgaaggccgtaggtaggattcccttctattcctcgcccgcttcctcctccggcagccggacctagctagctagctttcttgccgttcgccgcccat

SEQ ID NO: 2844 - DNA, 730 bp, Zea mays
ctccagttgttaatactgtatttccaagataaatactggcgctatataatatatccctccgatccactcccattcagtcacccacaatgcccatcaggaaatccttaattctcgtagcatccgatttctcaatcgcccataataatattttccccgtctcaaaatagtagttaaccatcatctctttatttcttctaaattctggcgtccaaacttaaaacgtcaactaattttgaatgaaggcgtgagtccattaaatccccaaccacatgagagagaacgagagcgcgcgcttagctagcctagccggcatgagaattcagaagagaggcagggtggagctagctaggaagcaacagggatttaaatgctgctgttcatggcagtaatgaaaaccatcacctcctcttcacctcaacgagcatcatcggcaacctccacaagacatcatcatcattatataacgcaaacgggagttgcaccaccgctccacaaatacccaggcaggcacaccgtcgaggtggcctggctccattccagtccagcagcaccacaggaaccaccacaagcacatgcgcgcaagagtggccgcggtctcctactctcctccccgtagctccacatccacagtgcatgcatacacgagctagctagctagctaagctagtactgatctcggttccgtgcgccgtgcggcagtgatcagtggttaattttactttgttggaag

SEQ ID NO: 2845 - DNA, 267 bp, Zea mays
ttttaccattaggtagggctttatgataagtccgagctagagtcgttcaaagagtcgcgccaaaagagcccttagttgtaattggatctactagatgattaaacatcaacctgattgcacacgatattttctaggcaaaaacctctcatgctaccttttgtttttcgccttcttccctataaataacggccaaattgcccacaaagaaaccacccacccgcgcgccgtgcctcggttttagggcccttccctcaccgccccgcggcc

SEQ ID NO: 2846 - DNA, 149 bp, Zea mays
ggtcagagaatgtattggcagcgttcgtatggaataacaaaacacccacctagggtgaagttctttgcatggctaatgactcaagggagaatacagagcaagagaaacttgctgcgcaagcggattgtggacgaagatgtatgtgaaga

SEQ ID NO: 2847 - DNA, 947 bp, Zea mays
gcacatttaaaatggagggactagaaggttgctaaataaattacttgctctggttgctgaataaactctttttaaaaagaacagtactacctgatgaactttactatactccgacctgcagctgcaggtacagaagacacgagctttctatatatctgaagactgaagtagtgagaagcgtcctccgttttgattagcgaggtgaaaaagctagctagctgtcgcgtgatctggtaacatgcactccgaatactctagttattaggtgaagattaaccgggtcgtagctaggctggattcaaactcccgctttaacagcatgcgaacgtacagagcggggagagagagagagagagtcgatatatattctccccatatattccttgtcaatcgtcatgaatttcgacaggaaaggtgaaaagagggcagctccatgcgagagaattttaccttttcacctttattactgctcctgcttttcgtggctccgctgatgattgcgattcaccaccaccaccaccaccaccgctctagctgctgctgacgcccttccgatccatcagcaatctccacattccctgtcgcccgccggccccaagaccatgagctagctagagcacgcctttacctcgacatgcatggtcgtctcggtcgatcgcacaacactcaaaccctcgctacggctacgtacagcaccggccttgcttcttagctttctttctccagcgatcgatcgtctccggccggccggccggtctccccatatataaactcgcgaggacgctcgatcccttctcgtctagtagtcgttagcatagccctagccctcagctttccgtttttacatatatagtacgcactctctcgctcgatccgctacatcggtcgcgcgcctagctctacaaagtttgaagctttgtagctctacatctacagagttcattagc

SEQ ID NO: 2848 - DNA, 414 bp, Zea mays
tggacatagacgattgctgctgctccttacttcctctcctttaccttatccgtctgttgggctgtcagttataggcctaattgtccggagccttctagcccaaattttaggcttctaaatgggccggcctataaacagcgggaggggaaaaaaagcgaagcggaacaaaagcgcgggaaaatcctccccgaaatagcgcgcggcggcgggaaaattccccattctcatctgcacccagcaaccgatctcgctgcctctccctgttccccactcgggtcactctctgctccgatcctccgttgcgcatctatccttctaacttcccctccgtcgccttcgctccgcatccgtccgaccgtggtcagcttcaactgcgcgcaccggccaggcggctaaaccctaccgtgcgccgcc

SEQ ID NO: 2849 - DNA, 420 bp, Zea mays
ggacggacgagagaaggtgctagggaacgtggctacccttaactgtcccagtgtctcaaaccaaacataacctacatttcacatttgcataattcttcttcaccaaggaacatctacatttacataattcctcttcaaggaacatggtcatagtaaaaacacgacaggcgtgtattgttcctcaagccaagaaggtgggggctataaatgtaattttcccgcgcatctccttcgctggcgttcggaaaacccccttgaagcctctcgatttgaaatcccacacctcaaaactgaaaaaaagggaaaaaaggtgctctcgatctagggaatagggatccccttcccggcttctagttcccctcctcgtccaaaaccctaggccagcctagcggcggagcccgcgcgcccgcctccaggacc

SEQ ID NO: 2850 - DNA, 864 bp, Zea mays
ctctataccaactaccatttattatatcatatttttaccatactctataccaactccatcacacggctgctgtactgcttccttctactgctactgtactggttctctaggcccacctcgtctgctgggagagagcagtggcagagcgctacatttggcgtagaagaggcggagagagagcgtagagtgagatatagagtgcaccgttgcagagcttgtctactgtaaaaatttagcgtagcttttccagctgaccactgcggctagcctaaaacggattgggggtactcagtgcctcgccgtgggcggtacgtcgccccaaataattaaacggtgctcgatgtacctctacgggacctttttcagccttttttctttattttattattattattttcctactacacaagggaccttttgagctgagatgatgcccaaaaacaaaaggacgctcatcatcagtgacgcccagtcgtcgccaagcagctagctagcatgccaataatttttttcttgttaatgttgtcgcagctggtactatactactactactacgccgtatatgaatgcgcttttgtctgcatgctcaggctgattccatccaacttgtctttcttctctcctctccacccatgccccgtccgtcgcagcaggggttatatagtgcccgcgaacggacgcgcaggcgccacgaagccgagatcgagcagctacctctccgatccgaggcctgagcgagcgagctgaggactgcagcctatataatatctagactagagtacaccacaacgacgaggcacatatatatacacgcggcggcggccagatccatcttggtatacacgtaatatatatacacgcacg

SEQ ID NO: 2851 - DNA, 481 bp, Zea mays
atttggttaccaaagtaaacaatttgggttccaaagtgaactcctttttgaaattctctatcaaacaaaagaaatgctccaaaggatgaatgcaccacataattcaaattctacttttaaaaataactatccccttctaaggtttcatatttaaatcaaaatgttctaaaggaaggacttgaggtgtttacagtaacttgtgtcttcgccagggaagtgtggttcaggatcttcagcttagtaaatctgcagctattggctcctagcacccctcatattgtttttcaaaactggtgggctaatctggaaagcaaggtacctgttgtgccacgcaaggggatcgattctctagttgtcttggtggctttgaaagcaagggagtggatgtgtgtttgagggggcctcccctagtaccaatcagattattcaaaacatcaaagacgacgctcatcgatggtgccttgcaggtgctgggggctgc

SEQ ID NO: 2852 - DNA, 1500 bp, Zea mays
tcttcttcactacaaacagtttctctaaataaaactgtttgatagaacttctcctcgatcgaaagctgaagccgagagaagacatgcatggtctaaataagttcactaatttagttgacatattcggtatcacaaacttgtatgtttttagtacagaaaaaaaaaggtgaaaacagttgggacttgttggacccgttccatgaaaaatgggccccggccccgcacaccgcggttcggagatagacacagaaccgtaccttagcaccatcatggacactacactacgatcccgatcagccctttttgaaccagaatcatttattcgtggtagtggtagtggtagcacccatgatctccttgaaaaggtatcacgcgtcagcgtcaccatatatataaaaaaaatcactctccgctatatgagatatgttatggcctacgtacaggcgcgcaggtatattggccgctatgagtacaatgcaatgatgagagaagcaggtgcatgtcccgccgcgcccaaaagctccgatccggggacggacgagagcgagacatggaagccgtgaagtacccgaaagatccatggagtacgccttaagcaagggcctgtagcttttagctttgctactaccgtgtgtggtactgggaccgccggacgtacgaaaggcgaggacgagcgaaacatgcatgccgggtctgcccgggaaaaagcccatgcacaggctgcatgcaagcaagcgctgcaaacagcgactgaagaaaaaggggtgaggaaaaaactaaaacgaacaccttgttgttgtgccgttccggttccgggcgcacacgccgaggactgccggtagtaacggcgtgtggaacgggtcaatttaacaagcgggacgagaggatgagcttctcaggcacaacacaaagcrtatcgatgtcatattgttcgaagtgtggtctccgtttttcgagcagttttgaagatggctgtgcttcacaatcacaaacagtgctcgaataagcccatttacctgcccttcgaccctgtcctgaagaaatatggtggaacaggccgcagcccacgtaataagctgaggagtataggcccatcttggacttttaagacagcgctgcggctgcgctcgatcgaaccaaaaaaaaaaagaaaggaaaatccacatgcaatgcaaaagatctcgacatatatcttacgatccgatgggcctacacgctgacacgccgacgcttttgggtcttgagtcttgaccccatgggccccgcccgcccgcccgccaagtgcgcgtctgcttcggatcttcgtcaccggataagccacctgcttccgatcgcacagccctatcaactctcctcgcctgccgtcgccgcctcgcgctctccgatcccgcgcatattctccaccagtagtcctctgctccgccacacccaccactgctagggcgccgcgccgcaggcccgcagccccctaatctccgagtgctgatcacgcggaaacca

SEQ ID NO: 2853 - DNA, 1500 bp, Zea mays
gtctctgtgtagtccaccaagcccagccggccagcccaacagggtgttgctgctaaggtaaccaaaagtggtcgcgccctcgtgactagattgattcaaactatgcgtggttatcatctaattatatgagatctgtcggctatcgctaaagaacgggtttagaccatcctcttatatatatgaagtgctacgaccggttgagaactctcgaacatattctaatcgaaccaatttactttttttaccattcctgcactaggactaaatttagcgtagtcctagttatagctttccgcatatccacctccaaccctattcgaccccaggatctggcctccccgaggagcaatattagagatggcaatgggtctcgatccttgatttcccgtggaaaaattcttccattaggggatggatatggagaatattcttcccccacgggccacggggatgtgaacggggaaattttgtctcacaacgggtaaacgggaattcccatccctgtttcccatgcggacccgttaaacttatacgtgatgatgttgtcatgtaatagttaataataaaaataaataattatcttatcaagagatcactcattatacaaatgtgttcattttgatgtacatataatcattttttacatctgacaatgtgtataagtgacaatggtttgcattaatagtaaaggaagtatgttctatttataatttaagcggggatgaggatcccaatggggatttatccccccgcagaacagggatgggaaacaaatgtccccataagtgttcgtggggatcctcgcgggaaaatgttttcatcgcggggacgagggaggatgtggagctaaaacccgatggggaatttcccattgctatccctagacaagatccacccatttcttacattatccttgtcatttgttatgattttaaacataattaattcacagtataatggtatttaccattatatatatatatacaaataatcttaaagatcttctatatttttagctcttaaaatgaaatagtgtatgggttgacacacatgcactattaggtgttagtgccgtatatatagtgatgatacgacacgattaggcgcttagtgcctggcccgctatttaggcactagtgtcagcacgacacaacatgattacgaatagtgcgttaatagtgtcgtgcctaataatactagtgccagtatgtgcgggacgatccgtttggcatctatatgacactctatctaaactttacattttacccttatttttttctctctctcccccaccccacacacacaccctaactagaaaagggcagtatcccccgtccatccctctacccgatcgagcccgagctcaagcctccacaagtttcatttcacaaacaaaagaacgggcgagagagaaaggagaaagacagcgctctctcactcccttgtctgcaacaagagtgtggtttcaagggattgcaagagagggtgtgcgatcgatct

SEQ ID NO: 2854 - DNA, 325 bp, Zea mays
aaatttttgcgccctcgccagccaccgctgctctggatatatatatttttttgctgatattgaagacgtatgactgtacagtacagcagtgctgatgttttgcaggacggccattcaggcgttctgctgttacttatgagaggcagattgacactggtgaagcagccttccacaaaagggatggaggtgactgactggctgtggttcctgtctgtcatttgtatagttcaagacaatgcagcaagcagtgtaatagttgtagtaggagaccatattgtatgacctatatatgtaaattacgaatgttgttttgtaaaacaatgaa

SEQ ID NO: 2855 - DNA, 1500 bp, Zea mays
gagctcgtggccagggatccaagacccgttgctctcactgtccacagcaaagcgcaatacgaagaacggtttccctgctgctgggcttatctactagtagcagatagagtaaaggaggcacgtgtccggcgrtgtggcgacagacaggaccggtgtttggccgggcctcgacacggcaccgttcgtggtcgtggcgtgggtttgacgtggcaaaaagcgatgggacggtgggccagccgacggcgccaatccgtcgctgcgcttttctactcgctatatccatctgagagcaactccagtagttctctaaaagacttcctaaatcaataatttaggtagttaacatgaaaactattctccaacagttctctaaatggactttctaaatttaacaacttgtcatctaacctcattttctctctacatttggcaaccatttaacaactctctaaacaaaaatgttgactgcattatatagttttttgtgacttattttttatgtggataaatacaaaacaaaattacaacctatatttagagaactattggagaactcacatttttttactccaaaagtcatttagcaacttcttaaatctgtgatttagagagctaaaatttacataactagccgtgccgagcggacggagcaggcgccgagcgcgaaagcgggcagcggataggatcagatttcggcgggaaatcctaggccccagatatttcggaggagcagcagcgcaaagtcaagctctccgagatagatagatactcataatgtgatatttacaacctcatttggcttgataatatattctacactaacaggtgcaggtatgtctttgccagactaatgcccatgataatttcggaaatatttactgagaatctcagagaagtatggccttttgccttttccggagcttcaacgtcgatccaacaacctaaccagtaacccacagggcagggcacaccaaagtcgacgacgggaagccggccgcgctccccgggtaaagataagaccgccacgacgagcccccagcataattgtggtgcgctgccctgcgctgcggcggtggacgagcagctggcggccgacccggggagcagcgacggccaccagaatcgagcggcgaccgggcccccccccgtaaagaaggatagattcttcatccggcggcggcgtgaggacggacggaaaagcgcgcacggaaaagggaagggcccagcggggagggaaaaaaaatcctgtccgacgtggcgccctggccccgcccctttttcttcgccctctctccccctctcgctgcaccatccagcctccatttcgtttctcgccttcgcctgcctccctccctcttctcctccactcgtgcgaaaccggcagccctcaggagctggtggcttggccttggctgcgcacgctctcgccttgtgctgctgctcgattcgtgctcgctgggctgacagactcggtgcttcggccggttcagaaatctcgag

SEQ ID NO: 2856 - DNA, 1500 bp, Zea mays
ttggtagcatgcatcaacacaactagaatttcactagatcttgtataagtatgttctaattttttggccgtttgcataacaatttctgaaaaaaatgacataattctatcagaacatttacggtgttcttttattgttgaataaaacactgaatgctaaggcatgcattaatccatacgttttgtgaagagatgctacggtctagggaaaaagtgtgtctaaaaaatacgacaatcttttttctctagaactgatatgtgacatttgtgtatttttttgaatcttagaagaacttccaggttaatatggacgaactgaaccatctactcgtatctaagaacctgcatgttgcaggttaataggatgcctgatgtaagctttgttgggttcatgttgaatgtatttttttgaaatgattttgtttttggtgtctgtaaaaattatgtgagcctgttagttgattctctacctggcgtgagtttgggaaatggtttgtatgaatcctgcccatgtttgcatattgtttgcttggataacaacttgtttggattcattagcgctagatgctcctctatgccagtggaagtgagtaattatgtcaccgtcgcaatacacgggtattttatcacgatgcatgggcatttttcttgtctcgtggcaacgcacgggcacgtacctagagctctgccagggctctaagtccgttggaggctcacaatttgtgttctgtggcatcgcacgggcacctacctagtatatattataagactagttagtggcccgtgcgttgctacagtttttacatatcatatagatagacatcgtttaaatgaaacacttattcaaacacaattatattttttatttttaaattatttgtattttttacaatttctatcctttaataaccgaacctgcactacagtggcctagcagtatatattttggccaagtgacaccaaaacaacaagtaggtatagatgcatcccaaatggtatcacaataaagtacaaatggtaatttaaaagttcagccacacaatattatgtacataacagcagtgaaagttatccacacccaaatatgtggtacaactgaacattctgacgctccatcgacatgtaaatacatttaacaattcaccataatagtggagagtgaacattgtttcaataataatcaacctagtcacatctcctattttaaacttgtctttatctttagatgctatggattacaaaataggaaaagtatgtactgtaaagaacactttagggaaacaggtcatacaattaggatttgattaggagcaagaacattgtacccttgatccaagttcatcaaaattgcagatttggttgcttctttagcatgatcaagttgttcttgtgtaactacatgacgtaaaagatgaaggaaaaaaaggaatgtgaatgataatggtcaatccagaatagtaacagtctgcgtgctacatgcaaatcataatccgaaagcata

SEQ ID NO: 2857 - DNA, 627 bp, Zea mays
tgctgcgctggcccaaacggacgacgtgacaccgacgtggtaccgagctcggcgccatagatcttggcgccgagctcggttttgttacaaaggttttctagctcagttggtagagcgtaaggctcttaaccttgtggttgtgggtttgagccccacggtgggtgttttttttgtctttgtcactaatttttttttgttgtcccgattttttgtttatgtcgttgatttgtccgtccaaatttatttctcatcctgttttttgtttttgtgactgatttgtttattcatccagatttttttttgtttatccggtaaagagaagcacaaatattcatgaattgactatcctatacgatggcctatttgaaatgcaagattattatataaattaatacatgaattttgtagtctcaccagttcgattttatacaaaagcacgtgaagaaaaaaaaaacctgaatatttctacagataagcctgtattctataatccgaatatgagtacatatatattccaacgttgtggatgcgtcaaggtttagatacttgaatatttctggaataacgaaatgtgagtggctgaacagtgacaggtatttcattcttgtgttttcagtaggccgctta

SEQ ID NO: 2858 - DNA, 275 bp, Zea mays
tctccttttttttttgccctccaaccaaagtccacaaaaacaccctgacctcgtctctcctcccgatcaagctggtttgggttgtgctcacgcacgaaccgccataacaacccgcgaacttttttctcgctgcgtgattctattcttcagggtttgcttgcgtacgccgcggcgagtcgctagccgtctcaaaaagcagaaggagtcctcctccctggtcacatctgactgaggagggccgagggtttttagaggaaggaacccgtccgcgaccg

SEQ ID NO: 2859 - DNA, 944 bp, Zea mays
cgcagtgtacgcctcttgtgtgccacagtggcaagcgtgatttgtcacaataaatgtatgagatcccacgccatcgagtacaacgagttggtagcccatgtagctgcacgcactgtatagttttcgtgggtatgcttgtgaccttaggcttagctgtagtgacatcccatgtcagctagtctggcatacatggtagccattgtaaccacatgtattgcatagtgctcgtggatatgcctacgacatcatatgtggctatagtgatgtcttttgactgtaacatcatctcgtgcaataaatgtgaaggatgggagacttatctcagacactctaagtcgtgggatctagcggggcacatatggtgtcgggtccgtcctaccttggaggcgtattggaaagtgactagggttcatacataaatctcttggcttgtaaggccacagaatctagccgttatgaggctcgactctggagacgctaagatcctagagatgctaggcttccagcgctaagatcctagagatgttggaatctttttcgtttggctttaatctgtaccggcttctactggttatacgttgtttttgtctctatagattgcaactgtagcagtctaaatagttggatttaatccgaagcgaacaaatatcctagagatgctaggctagcaccgaggtaaatccattggatatatgttataccgatagagttttggagatcattttgctaatatttgggtgtatggattcctcataacgcagacaatactcattgtcaatcttaaattttgtgtatatgtgtattccttttaaaaatcaaggtatttagcctaaacatgttttctacctagaatgatggccggacccacaccaccttctatataaacatgcagaatagtcgacaaagcatggtgcacccatcaatcatcacacagagcgcgcgcc

SEQ ID NO: 2860 - DNA, 305 bp, Zea mays
aatactaaactagcgaagtataactacggagtaataactggtgaagccgcgcgacgagattgttacaatatcaaataactcggcgtgttgtgaagcttcgagaggagaggaggccaggcaaaacccaaatcaaatttcgccttcgtcgtcgtcttatcgtctcaggtagcagtcgcgtgatgaatccgggggcgtgcagataaaaccctccctcgattaaccctaattccttttctcttcggggatactcctttcaccgagtctcttctggttctcggcgtgtgctcgtgtgcagatttgactcc

SEQ ID NO: 2861 - DNA, 917 bp, Zea mays
cacacttgcggctcatttcgcgctacggctccatagaaataggatccaatctgttattgtaatttatatatgtactgatgctcatcaattcagcaaacactcttctcctgcatagactctatgcatgcgatgtggcccctctgcgcgacacgaaggaatcattgcagacgcgcagtgagtgcagtgtagcctactaacactgtcgtactcagcaatgaacacagccaaccaccattccatggggtgccctaccgggcgctgtcccacacctctggtctctggatcagactcaagggcacgccgcgtcgccgtcacgccccttctttcttttcgtcgctctccatacagtgagtggcaaaaaaaaacctgtaggctaggcatgtgtacagtgcgccgtccagctggacccggttcacaaaacaaggcgcattcttcagttgcccagtgaaccttccggcggccggccatcgccgtttggtaattgccgaattggaattgggacggaacatccggtcgggctagcaccgtgtatcacacccagccaaccagccgaaaaatgtttgaacttttcgaattttggctccgggttttttcaaatcggcggccccatgcggccatgcctcagccaacgcctcgttcagcaacagcaccgttgcactgcatgcatcatgcatgcagctggctccagctcccagcctcccacacgcaggccgcatcccattggtgccagttggaagccaacaaccctgccactgccatgccatgctgcctcactcgcccaccaccctttaataccccaccgctccttgctctcacttcactcacggtcggaatgagcgttcaccgtcacaatcactgaatcacacaagcacgaccacgcacacgcggtaaacacgcgcgcgctcaaacagttcgaa

SEQ ID NO: 2862 - DNA, 667 bp, Zea mays
cccagtggcggagcacgacctaaaaataaggtatggcaatgacaaaaatatatcttgcagtaaaacaaaatttagtataaaaacattattaagaagtaccttagatgaagaattccttgtagattatatgtcaaatcagtaacttaaccaaatataagttgtcaaacaaagagcaagcatacattagcattaaaataaagagctaaatttaataaaaaaatgtatagacaatattgttacacataacacaactacctctttctagagcctttctttttgccgatctttgctgagcttgaatctattgcaatttgcaactgcagggcagctaaatttgcaaatagcaagcaacaaagcaagcagaaactgcaagcagcaacgcggccaacgcaactacgcgagcaactaagccaactagccaaagccaagcaaccaggcaagcagccggagcactgtagaaggctagcaagcagcaaattgagcaaagcaacttagcaagcagtctgcactataaactacactagccttgcagaactcagagggaacgaatagagtagtgctgggagtttagtgggtcgaggtagctgaagagcaaacaaacacgctgttcggtgttcgccgctctcccatttcaccgagaaagaagggactaatgagaagagagagc

SEQ ID NO: 2863 - DNA, 1246 bp, Zea mays
cattcggggggagagagaagacgatagcgcgcagctgcaccgtaggggctgctttaggggcaccgttgaagcaggtagcgtcttcgtgtagcctctaccgtaggggagagggagctccggcggaaacggtgaagacagtctaaacgcaagcggagaatggaggttcagtgatggatgggtctgtggcctgccacactttccccggagagcgagggccatagttgaattggccacattcaaatcctagagacatgtactctgtgattttgtttgttttcattgcaattgcgtcaaaagctgcatgctcgctcctccctgcaagatgttgtcagattgttgtgttgtgtgagagagaaaaggtggatgcaggcagcccagacaagagagtgaggggagagagagagagagagagaggacgccagagcatcgctagctgctattggctgcaaggtacgtacgtctttcctaccgtgccaaattgttatcgcaattagacgcaaccagagcaaaagcaatggttgccctactagctgctgcagtgcacatacacacctgtcaatctctctctctctctctatcataagtgccacactaccatgtccctgtcctcagctcttgtcgtcttctcctgactgacccctctctcctcgctccattaacgaagaatccaagtagtgaggatgaagagagagaaaagggcatcatcatcattatcactaacccttagcttcaagggtgactgattggttagcagcgatgagaatgcgatggatcatggtctatggatggatgaaaatgaaatgaatggttccccttccggccttattatatatacatgcattgacggaactgtacataatgcaccgtgcattggcatcaacagtcgccggagctgtacctagtcggtgcccaaataaatacatagtatcgcttggtctcactcacctctgcggttctccctcaactgcaagctagctttaggaccttaattaggttagcttaagtgcttaatttgatggagtgagtgagtgagtgagtatatatatatgcagctgcgggcggtaaaaaaaaaaactgttgcttggatgatgatttgtgtatgactatgtgtatgtccatcggcatcgacggcttgcttgcttgctccaacgccaactacaggggggcgggggtgttgggtagctagctagccagatagtgatagagcgagctgctagtggaaagtagaaagagcgagcgcaccaca

SEQ ID NO: 2864 - DNA, 1500 bp, Zea mays
ccatttgggcctaaaacgtgcatcataattttacttgtcgatgctcactcgaaacacgatgcatctttccttatttgtactttctaatatatttgacaatcactctttaaaagattctctccatatagtcggtctttcttcgatcattctctctatacactacaactataactctactaattatcatgtatttatcatttttgaaattttaatacatatttttatcaagttgcgaatcttaaatgtgattaataccagagcaattaaaaataaggagaacatagtggttcccttacatagagagatcccttttcctcctacgcacaggaaccgacagggacatcgttggacacatgtgatgccccgttactttcatgggctgtttggatccacaagcaaaaatttgagtccttgtcacaccggatatttggatgttgtgatgctcaaagaatcgtcgcaactctaaaatgaaactaaaatattcttcaaaaaacctcttattggggttgttgctagaataatttcgtccaaaaaaatcttaacccgcattagaatgctgatatccgattcccaaaaatttgaaacagcctacgtgtttcacggcaaacctaaacaacgtcattcgcatcgtcaccatttttcctcgtcggcattactactcgctttccttccattgcatgtacatccaacaacatctgatcatgttgcaactaatttattagcatcttgtcaccgttcaactaatttacttgccttgccttgaccttgacatctatatgctaacgagttacggcaggtagctagaacttcctgcctggaaagcagaatgtctagggcacataacattctttcagcatcttgtatcaggcaggatgtagcctgcaagaaagtaaatatttaagccaaagttgaaactgggaagttaaaaaaaaacaagtaacctgtgccaggtctcaggcagactgcagcaggagccagatacatacatgatttaaaaaacacacgcagacacactagcaacatgctgaagatgaacctgaacaacttgctgaagctaaacctgaacaactagtaccatgtctcaggcacactagtaggagccaaatccacttgcaaaagctgaacctgaatgacttgctgaagctgaatttgaaattgccggaggagcaaagtggcatctctatccactcttttggttgtgcatatcagctagagaagctataattcaagaagaaaccacagtgacatatttaaagagtggtagtcgttttatgtctatattcagatggacgaatataaaacacatgcatcaccggcgtcgcgaagtcaaaggatgctgagggctcatctcgctgcttctgaacagtgacactgcaagtggatggaagtcggcccctgcacaagaaaactaccttccacctgaaagaggttagaggtcctaatcactcgcaaagtctcaacaactacgcacggcctcctctccctccgccggccggcacg

SEQ ID NO: 2865 - DNA, 940 bp, Zea mays
atggcagaaatgctgaccggataactttgttgcttcccaggtttctgacggtgatcgtcgagctcggtccgtgccgacctccccagtcccaggtttctgtcttgctggctggctgacacggtcagcaggcgtggatggttaaaaaaaaacaatcgccgtgccggtcgccacctgtccttagcttggtcagggctcttgcgactttggagtctcgtaggtggccagacatcccaactgccgaaacggattaacatatcccacggcggatgaggtcgccagcccacccaaacgcaggccgaggccgagcctgacgctccgcccgccggagaaaaacccacccaaacgcagcagcacacagagacggaccggaccggaccggaccgggtgttttcttacgaatggcacacgcaataatttgcccccgccaactaccccggttcccaccggagagtagcgcggttttcgttttcagggttggtggcgtttgtttgtccggcctccaccctctggcactggtagtctggccccgctacctcctctctcaagttgaagtcccatctgctcttggcctcactagctgaggagtggtaggtaggatgacagaggaagataattataaaatgaaaatcatttttagaaggcaattgatatcgaaacaaaaaaattagaaaacattttttttgctttgagatccaaccccatcgtccaccaaccaccccactccagagcagcaacgtgctggactcacctaaacccgcccacccggcgtgcctggccacggcccccggccatccccctatttaagcgcggccagcccccgccgtttccctccaagaagagcacgcccactcctccggctcttcttctccaccggcaccagtccaccacctcccacctcctgccaccgcgcggccccaaccaaccacaccgcagcgcagca

SEQ ID NO: 2866 - DNA, 741 bp, Zea mays
gccgcgcaaagtatcgaacaatcggcaggcgtcaacggcgctgcgcaattcggcgcggtagaggagatcacggcgggggtcgcggcaccaggaagctgcgccgcagcgaccaaccaccatgggagatgagcagcagacctgcgcgagctggaagagaaagggagggcgcagccaaaggaacttcgcgcgcagaaaagccggctgggggaaagggacttggctgcgacggccatggccgagctggagcagacgcgcagggagccgaagcttgcagggagaaacggctgggcgagcaagaaaccaaggacgcgcgtggggaggaggccgagctgggcgagctccggcgtgcagggagcaaggagcggctgggcagagggatcttctttcactagagccgagcagcgcagtccaagctgaggcaggggcgagctcgagggagatgaggaaatggggcgattgggcagggagatgtgctgggggaagaaccgctcggcgagcttgaggaagatgaagaggraaccgcagcgcacaggcgctgactgggcgcgcgcaaggaggagctccacgacgcgttgcttgggagagcagggagaacgcagatcgttgagccagggccgggagacgcgccatagggaaaagggcgaagagctgggcgcggcagggagctgctgggtgcagccatggcgacgagctcggggaatatgcgacgcagggacgtcatgaaatcacagggaaaaagag

SEQ ID NO: 2867 - DNA, 1500 bp, Zea mays
taataacacatggaaaatgcacatacgataaaatcctaggatgtacctaccaatctcattgaagacactgtttggaacccctagagataatagttagccatctaataatacattagtagatgggttgaactagctaatgagctaattgttagctgtgaggtagctaaattagctaatgtattagttgagggtgtttggaacctaacaacaaacttttagtagcaaattagttctaggggttccaaacatggcctaagacctattcaaccatctttagtacgtctttaggatcaaatatgggtgatcgaccgttgacggatgaatgaaggttagagtaagacaggagctcgttcaaatgagtggatggttacgactcggtaattttcctttcctgtattctctttgtatatgcagcaagtgccagaattatctatttcatgacaagagaaggaagggtgttaatggacctctgatagtttggtttcatatcgaattataaggtgtggatgcagcatgtcgagttgtggcatcaacatgtagaagtggaatagcatgacatgattgatgggcaatggttggatgagcgagatgcttgatgctctttggatagagtttgagctagtggcgagcgtgttcctatggtgtcttaggacccctatcagtttgctcctgacatgaattatcaaaatgcacaccaagtagtgtagtatgagttttgagtaagattagtctatattttccgtaaataaatgcattgtcaattgtattttatgttgtatttaataaatttatcaaatgatgctgatgtttatatagtgtcgtttagttcacaaattggtaacgtaatagataaccgataacgttaaattatgtttgtttataaatggatatctatctattcaaacttgttatcgccatgtgaatcattactattatcatttacgttatattttgtgaaccaaacattatttatatttttttataaacttaatcaaaactttgtaaagtttaactcaggatacaaccaactaataaaatcacttacaacatggagggagtgtccttgtactcaacttaaattggtagatcgtattatcttaaatgcccaacaatcacatacgcgtaaacctaaattgtgttgtccgatgattcttgtttgtgtgtgacaaatccgagttggggagaagtatgataacgatttgcctgtcttgtggtatcgtatctgggttgtagagaaacgtaggggccgggcgtgtgacatgtcacgcccgacgtcatcgttgcccgaacccatttcttctctcccgtataaataactgtagtgcagcggtggcgttgtatactccaccactctgctaaagagtaaagacccaagcagacatagatcagtgggtcctcgtcaagcagcacggtgatccacgcttccacgggcgcacagggctttttgccggccattacagaggagaggaggccgacaaaggcgtggcagaggtcccatcc

SEQ ID NO: 2868 - DNA, 331 bp, Zea mays
tgtaagtgtaatccatagaccagagcatgcacacaacgatggcacctcggccggcgtcgtctgaaacaggagagacggcatgtattttgtctgacgcgtcacggtgaaagcccgtcgcagacgagcaccgccacctggctcctcactgtcttgttgttacagttacagcagccagccagcagcatcttcttcttcttccccacacagctagcgtcctcagccgccttaaatacagcaccgcgctagtcctctcctctctcgcgccgcacacactgaccaacagctagctcagctgcacgcactgcacctcccggcccagccgccggccagc

SEQ ID NO: 2869 - DNA, 829 bp, Zea mays
ttgtagaaacacattccccacataagaacttgcttaattagctcatatcacataactaagctttaggtggattgaagttaagttggctaaaacccagtctaaatatatcgtttgtaaactaaaaacagactagaagcaaaaaaaaaaaatcacgaaaactctgtgcgtttttagtccatttgaacccatatttaccaactatttactattaaactaataagtagttaggttaagaactaaatgttactttacttgtttatatgtccataccatgtctaaagtttaaatgacgaaaacaatattccatggcatccaaagataccctaaaacggccaggcattcgtgcagatggtatgtgctatttgttaacagaagaaagacgcgtgattagcgtgaatgatgatcatcgaagagagagaaagaaaaccaacaagacaggtcagagagagaaatccagaaaaaaaaaaacagagacacgcaaaggaggggtccataaagaaaatctaggtagagtaacacgcaagccaagaccaagtcttctccttgttagcgcaaatcaatcagtcactccacataatcctcgcgtttcgagagcagataaatttcccgaaaaccccaaagattaattcatcttcccttttcgattttctatattccttgcgggtttattttggtttaagtccacgagagaagagaagggaagcaaagcaacactgagcggaggcgagctgtgcgcctcgctcccctcccctgctctcgtcagatccaaaccccacgcgggaacacaaaccctagcacccgttcgcgccaccgcagaggctaagaggcg

SEQ ID NO: 2870 - DNA, 1500 bp, Zea mays
gatgtttcaatatgaaactactttaaactatggtatttgtatgttgtgagcggtttagtgagattatatctccgttgagcatagtttagcctctcctaaaaaatttcttggctccgtctgcgttgagcatcgtccctacatcgttagtgtaccggcagatggatcggaaatcggatagggtgaccccaacacagcaccagcagctagctagcaggtggggctcgagccccctatcgctcccgagccaatagtgcctccatccccatatagcttcccgtaaaattacatcctacatttcttattatatattttatgattttcatcgttcatcgatgtttcaatatatataactactttaaactatgatatttttaaactatgatatttgtatgttgtgagcggtttagtgaaattatgtctctgttgatcatagttcagcctctcctaaaaattttcctggctactttaaacaaaagggcggcgaagctagctttagtttatgcggcagatggatcggaaatcggatagggtgaccccagcacagcaccagcagatagcagcaatgaagaataataccagcagcgcgtacattattgtagcagtatatgcacaagaaacaccctacacatacatatgctgcccggccgggcaaatcagtgttttgcacaggcactgtgaaaaaaaaacactaaaaaaggtgaccatgaaacttgcgcctggttggcagacatactctcgacagattagttggggctagcgctacggaactgatcgtcgagaagctagcatgcagcagctgcgcgcttaagattcagattgagatggacagatagacgtgtacgtacgtgcggtctgcaggagctagctgaggagaagctagctagcttctagctgctatggtagccactgcttttgggccgcgcgcgagggtcaaaagcgcgcgcgcgatgcggatgccccggccccgcgcgcatccagcatactagttctgcatataccgagtgtgcatagctagtgtcatcaggtccacacaagaagaattggagatagagaaaatgactggagattctatgggggacatgcatgtgctactagcagactcagacagcagcagcagcagcaacaaaaactattaggaacagcacaacgacatagccagcagctagccacacacagtagtaaaccttaactcatatcagccaatagcatgcagaagcagcaagttggtgacggtaccatgcatcatatatactcctggtgagcttgacgtaccggccaccggccactatataaactggccatcgatcatcagctagctagccagcagcaggtagtaccttggccaaacgacttagctatcaagctcgaccgacgaccgaagctaagctaccaagctagtagccttcttggtcacgtaccggccgttgttgattgcagcggtcaagcacacacaagctaggcagctagctagctagagctagggtcgtcggatagatcgac

SEQ ID NO: 2871 - DNA, 573 bp, Zea mays
gcgcaggctggttggtaggtttcgatcttgttttttttttctcttccgggcctagctgtccatcttctttggattgtctggttcatacttgcatgtcgatcgtaagcatttttttattccaccgctttcccctttctgtactggtaggtaaaacatggccttttttttttctctgccgtcgctctggaatccgtagtagattcacttgccagctgcagctgctgattggaattcttggcctttgcttgatgctagtgggagacattgaaacagacgatgtcttcttcttttttactactggaacagtagaatatactatgactgcaataggactcctcttggttgatactaccattttatggttcagtcagtgctcggtgctaatcatctgacaccatgtgggaccacgagggagtggtcctattgattaacttaggagggataagactgtttggtttgaggaatgagctagtctatcatcttctcactcctcacttttttgtttggtttgtgtaatggaatgagttgatccatcatcacctcattccttatagttagttagttagtactaat

SEQ ID NO: 2872 - DNA, 298 bp, Zea mays
atttgaaagctgccatcgacaaagcctttaacgacatgcgaaaagacggtacctacgacaagattgcgaagaagtactttgatttcaacgtttacggcgattaagactcctgttcctgaacgggtgtattgagtcacgctaacgtgggtcataactattcactccgggcgcttacttatgtaaactcccggagttcatacgcttgccaccatccttccgtgattcacatccctggtcaggactgtccgtgtgttgttggacagcgtttgtttatttccctcacgacaggatcgaaccc

SEQ ID NO: 2873 - DNA, 251 bp, Zea mays
ggtatctcaattgacagagttatatatggcccggattgtgtgatagagctggagtgcccgatctttcggtgagtggagataattccgatttggtggaagtagaccctcacgatccgactacgacgagcgatcccgaagcgccaatgcaatcgctgaaccaacttccaatggttaccgaccttgctgatgcgagatcggcctgatcacgaagatcgtttcctgtgcgcaatcgaagaacgaacagaaccaag

SEQ ID NO: 2874 - DNA, 1500 bp, Zea mays
ctgcaagggaggttgagttttgtcttaatgtattctgaggcctgtaacaggcaaggtactgccctgtagggtacacttgtaagaatacacctatgtgagtttgattgtgaggtcgcagtctatgagatgtgggtaatctcaaataaattcactaaaatatacgggagcatgaccgtaacgctctaatcagaggcatggctttaggcggcctagtatcagtgatgcctataggtgaaaccatattacacaagactagcaatttaaggctttgtccattgcaaagtcgtgagagtacattatttttattgcaaggtgtagctcaactcatatagtgtttgcactataaaactaatatatgaaagcgtagagattgagtcaattggagaccttggctttggcggggattgttgtaattaggcccattagtgtgtggccgaattcaataaggaagccaagatggtgtgtagagatggcactggactttagtcccatatcgcccatctagataggagagaaccaacttatatgtgggagtgttccctactcttcacatgagacaaataaagggctatggaggctgccacacgcgcgctcgctcgcgtttcgcgttatttatcacgtaacttgtgacttgcgacaatgcgcgatcgcgtcgtgacgtgttctaaacagaagtttaatttttgccttttgtttatttggttatcaaatatcacacctagactgtcacgtcaaccaggagtaacgggcatgcacgttacgtgcgagatcttcggacggttgcacgtagagatattccaggggggcggttcctggaattagcagatcgaatcaaggggttgcggcggcccgtctataaagggcaggcgttcttcagtcggagaaaagaggccaatagcaaccgactcgtactcttcttctcaattctctgccatgtcgtcccttcgtttgtcgtgcagtagatcaagggagagcggtgtctccgaaccaccgtcagcgttttgatgacctgcgcggctgccggcgaatcatgtttctgggaagtgcttcgcgcacgtccgctcgggttcctctacaaaactcgtggaaatcactgtgagtaaacctgcagttttagtttgttgcaatgacggtcttatggttagatccgttgtcgattattattttattcgttaatattgttgagttagttcagattctgttctgttctaatgtcgtggatattatctgtcatagatctggttatttcattttatgctgcattatcaaattaatcttaggttattattaattttccaacattagtgttaataatgagatggtaaggtgtaacacttattttcttgcaagtatgttaggagctcagtgcctgacttcaacttgagcccatttgttttcaactttgttgtgcctcagtttatgcagtatggcattggttatgtgtctcctggcatgtccacaaaccagcataatgtgtacttttgacagcctgatctaata

SEQ ID NO: 2875 - DNA, 89 bp, Zea mays
ggtacctaagacccaagcctaaaattgccttgcaggtttatgcatccgggggctcaagttggattatcgacagcggatgcacaaaccac

SEQ ID NO: 2876 - DNA, 1223 bp, Zea mays
tggctcagtcatgtgagtctcctacaggcacaggaggcgccatctctcacctctccgcagtcagcatcggcagtgccatggccgctcctcggtcctactagcaaaggtacctctccatcctcctccagtcctccaccgctcgccggctgactggtcgaatgaccgccggctgactgactgactgattgattcgggtgtcattttccccaggtggggatgaccattcctgatctgttgcttgctttaatgcctccctccccatcactttccagatccagcccacctcttcccttcctcctcctcctccacctcctcctcccccgcgtctttataaatctcccgctgccgcattcactggccaccggagttagtgcccccatgtcctgacgcggacgcgcggggagcacaccacatgccgacgtgctgtgctgttgcctcatatgatttcggtgtgctccatcatacctgcctctcttcttttttttttcccggtgggggagaaaagcgggggcagcgagttgtgcgccttgtgagcttgcagctgttccaggttgcaatgcctgtgctgctcgtgctttagtctaggctgccccctttttcttcccgttcgctttgggaacataaaagattttttctccctttctttgctaatctctctggcgctggcccacttcgcccccctatttttgtggggaatgccggggtgggggcttgtgatttttgagccctcgttctagtgcttggccttttggggagtgttgatgcggcgttatggggcgatggatctgttgtgaaacgcgagctcgtagcactagcactagcttgtccgggaccgggagcctgcgaggtaatttcttggccatggatcctgaaaaggcccctcttctctctctctctctctcttccacacacacacaggtatccgccgccgtgtgtttgctgtgctcgttttctgtctgtcttgatcgttgtggattagttctttcgttttttttttgttgaattgctcactctgcagcctgtttttcttgcagaaccttttgtagttctattgctaacgtggccaattgatctttcagatcaggagctggggattgccctgccactctgctgaaagttttggagaagttgtggtgtttccctgcctattagagtctgcgcttctgtgttcctgatcaactgctactacgcgattgttgtcttctcaatctgtctggccaagc

SEQ ID NO: 2877 - DNA, 1500 bp, Zea mays
agaattaggatttagattcagtgctctgtatcgtaattttcgcttacatttctgtaaactgtttttatttggccaagaaataataaaatactgtaggtcctccctacggtaacttaacttcaaaaaactagctagtggccagtgggtacatatgtatattgacttcctcgtccaaaaacccatgcatgtatatatggttcatcatcagactagctcataccactccctccaccatgcacgcatcatctctcagcgagatctcacggagatctggagcatacaggacttgtcactctggcaaataaaagcggcccaccgtcgagcactggataaatggagaggctgatgacgatgacacaccacatgacaacacgagaactagccatcgccgtatactcgcgctagctgccgcacgcaggggccgggggcacctcgcgtcggatatccccaagatgccatgctcgctcatgcgtggacggccggccgggggaaagtgaaagcgcacgcagcagaactaaagaccgaacgagaaagtcgcacttgctggtggcatcatcagcccccgagaaagcgctaatgctcgccgcatatccgccggaagatacccttcccctcccccgcgggcgccgcgccgagcgagattattatcctttatctgagctggtggctggtgctcgatcgtgtgctgctgatgccttcaccacatggtggtcgttcacgcgaaggcaaaatcctggacgacggattttaggtggcaaaggcgcggctctggctttggctttggcttttgggatggaaacgtacgtttggtttgtgcaaagtgcaagcaccccctctcgaatcctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggtagggcaacttgtatcctttggcaattgttctcatctatctgggtctgtctgttggctgcccggtgacggtatacggtgatgttctaatagtactcaattggtcttggatcggagttcatgctacggctcctctgttatatattacacggctgacggctccttattaatgtgtacgttgatgatgtcattaataat

SEQ ID NO: 2878 - DNA, 353 bp, Zea mays
tgaaccaaccgaaggtcaacagtccacacacaaggcccgaacagaaaaggcctggaggcgacccgtaacaacgcggagcgtcagcctatagccgtcgctcccgtgtcccgtccgccgtcccccttcctctcgtattcgcttcgccgcccaacccactgtgcaccgctgccttcccgaccgttctcgccgccgccgtctccgcgcctgccaccccgcgcgctcggccaccggcgcccacggtgcggctcgatcaaggccagatcagaacccgccccggtccgcgtcacgccgatattttctgttttttggtacggatctagggttttcctgctgcggattcgttcgattcgctc

SEQ ID NO: 2879 - DNA, 156 bp, Zea mays
ctcgtaacacagaaactgaagaggaaaaaaatctaaaccgtagaaaaactgtaagctcacagtcgcctccggacagcaaccgacgcggaaaaatgccaagagagcgcaaacgtaacagaacacccgcgacaaccactgagccgagcgggggtggat

SEQ ID NO: 2880 - DNA, 252 bp, Zea mays
ggttattgttgctcatcgatgaaacattaaccaataccatcacgagttcactttaaacaaacacaaacggacgcagttacatgcatccggcagtttcttctaataaattctaataaatagtactaaaacaaacaaatggcaccaacgcctcagtggcatctcaccatgctgcccagtatatacattgacactgccgccgccctcaaactggcgagcaacaggcttggttcgagcttgacacacgtctcgagt

SEQ ID NO: 2881 - DNA, 891 bp, Zea mays
tgtagttctcttgttatcacttggtatattggcagaactatggtcgtgaaataaattgaccatctccgaaattgacatggcatttttgaagaatataaactttttgaccacctctctaaataaatgggctgtccagtaaaatcatttcatagtagtgaatagtcctataatttttctctgcttcaaacagctgagtagctcaaaatttctaacatatgggtcttcagaccaggtcccatgtgaatcggttagttgatatcatcctatacaattcttatatactatatatggctacaaattagctcggaaaaatggactagcagtagtgaccaataagcaagtcagtttgcacgcgctagccgtcctacagcctcgaggtagtagccctccctctctatcgttgttgaagctaccggccgtatagctgcttgtagctgcagctgcacacgcggctgaacgttctcttcctgcctctaaatattgttatttattccctaataacgcgaagtcgccggccatcggcatgacacaaataaataaataaataaatatttaaaaaaggcgcatcacaagaaccaaagtaaacaccggccagaacgacaatgcatgccttggttcccttgcaaaccaatccaagctcccagtgtaaatcagtcccctgattgattggattagttgagctttcaaaataaacaattatttgacacctaacttgttcagctataaaaggctcaggggctacacagcctccaccaccatccaatatccactgcaccacttctgctaatcccttgttcttgtgcctccgatccggagctctcaccattgtcatcgtcaatcgatcaatataaagcgagccaattaccccaaggagctaccgcttgcgacggt

SEQ ID NO: 2882 - DNA, 1500 bp, Zea mays
cgttgaagggtcagatttaaggatctatatacatatatagctaagctagctagtattaggatccaaatcgaattattgttcctggacctgacctgattaaatcattgacgatgattgttccatgcagctgcatgcattggccatgtggattcgtttgctcttgccccccacggccttcgttggcattttctcttacggtgtgcccaagaagaagaagaagaagaagaaaaagatctaataacaatgtccaagaaatgtagagacgtgctttatattaattctccattcgagagcgtacgtcgagggaggaaaccgaaaacgatgtgcttaatctggcgaacacccagatcattgcaaacggaaatcagacagcacaccaccaccaccacacgcctagacatgaaacttagccacatcgcaaatttggttagccgaaccgtttttttttagaatttcgaaacacgaaaaccgtagtaatgcggtggtacagggaagttatcagcacctttctcagaaatcaacaaaaaaaaataaataaaggaggaaaagagtgaagttggcgcatgccgccgctcacatgcaaaaatagaaaaaacggttaggtttcacgtgcggaaaagcgatagagcaaaaaaaaaatgatacacatataacatggaacaccatcttcttcttcttatatacaagcataacatgttttgtatcatctcaaaaatctacaaaaaaatatatcctaaaaccctatatatattaatatatatagtagataaaaatatctaaaaccccctatatataccccgttccaagctgcacgggtggctgcagcggatccaccaggttggttgccacacagccacagccaggcgcgcaccgggttgtcggacagagcagatcagatcactcgtctgctaaacaattcggaacaccaaacaccggtacggaccagtccccgtcggccacgtgcctaccacgtccgctttaaatactcccgcaggcaggccaacagaaatccgaaagagcttcgcgcgaaaccatccgaggcctccagtccagattcccaagccgccttccgttcggccactcgcgcgacggttcgttccgccgccgccgccgccaacgccaacgctcggtcgtgtctctgctgtgaatcttccctccgccgctcgccgaactttccgccgcttcctcggggaaagaaaagcgccgaattttgcttcctttttattccccccctcctcctccgcgcgcctgatctattccgattctccggacgcggccagcgcccagcgtcgtctatctccggccgtcagagtttttcctgggttgtttgggcggccaaaattagccacccccctttcttccccctccttgcagtaagttaaggccgggggctcggctaaacttcgcgccttctccgcggccgcgcgcgcgggggattggattcttctcccggccgcccttctgcctacctgcctgccggattggaggagggcgggaggc

SEQ ID NO: 2883 - DNA, 768 bp, Zea mays
gcgtttgctctaggtgaattctagttagttgagtgagtttagaaaaactacataacccctcgatttattatatacgttttattttatataaacatttttagatacatatagaatattcgtcgataatatacacactatatttatgtataatattaattattgttagaaagggtagattagcacggccaccagctggcggcggggagcgaactcaggggagagggccatgctcggccagcgcggctagcctgtcatatgcctgacgtcatcgcaggtggcagtcgcagatctttccgcgcacactggggaaactgcgggccccacgtggcagtctcttatgcagtagaaaatatcggtaccgagatatttttcccgagcacccccacgccgccacgtgggaaagtaccgccacgtcacggaaaagcctggaggacaagggggagcccaccgcggctctctcccagtcgcccccccgcacctgcacacaaacaccccccacggaccagcggagatgtatcagctctccctgttcgctttggcctccgcttgccccctccctctcgcgtctctatacatcgccgctgctgtgttgcagttcagtttgcatcctgagctctctcctggaccagccgagatttctcgctctgcgcatctctgattcatcttcgtcgagaggagctgttcctcttctttgccgcctcgaatctgggactggtcggttttctggatccctgctgcctgtcgggttctcgagaggtgtaaaatcca

SEQ ID NO: 2884 - DNA, 232 bp, Zea mays
tggcctcgaagaagaagagcctgccgccgtgcgccgtggccatggcgagagccgagggaccggccgcgcggagagagatggcagagctgtacctaggctgctggtgagccggtgatgagatggcgtgggtgcgtgtgcgtgtgaaatataagtgaggactcgtcgactagctcggctgatcagctctcctcagcctggtacttcccataaagcttggttactcttaggagca

SEQ ID NO: 2885 - DNA, 190 bp, Zea mays
acacctggctgcaactgaaaatgggcaggacatggtcaaagctttgattagtttgtccaccggtctctttctccttcggtatgctgatggtgcacgactgcacccgaacggtgaacttaactgttaactcttgcgaagctctaaatgtctttgctgcgttgctttgagctctcaagtctgaactgtgaac

SEQ ID NO: 2886 - DNA, 944 bp, Zea mays
tggtgccccgcgtccttttcttcgctagttcggttcttcctccttttcgggctttcgattggccgtcgtctttctggatggggcgaagtgatggacagggctttggtaatgggctgcttatcttccgattactagtactgggccagatggacggagtactgggccaacgaagcgaatgagtacctgtaaagcagataaataacccttctgcatgactgcatctgagatgattgcgcaggtaaactttgcgttggagaagaattacgacgacggagtagatcctgttgtgattgtgagacaagatctcgatttgtattccggccggtggcacttaagaaatgacctcttgacccggcccgatcggatcttgaaaaaaaaagcagcagtttttacgagtttaaaactcagcggggggtggggtggggtggtggaaatggaatctggatggctcacactttaacattagagcaactccatggctaatacaataccaatagttcacacttaacattagagcaactccactatactcggcaaataaataactaaatttattgatttagctactctctaaaataggttttaaaaaaataggttaatcaaatatactctataaaccaatttattagatagtgagtgaagaagactataaaaaaatagaaagcggagacggaggaacgaagagcagttaaaattgaaaaatcatttacagagtttgttggatatttttttcatctaataataactaattttaactttacaaaatgatttgtctaatcttttgaagttgctcgtgaatactacgactaaaacatggtgatgggtaacaccgtagcaggcaatcatatctatatggtaatccgggactcgtcagcagaggcacagctggagcaaagcaaccagagggagcgcgagccggccactcccctccgtctctctcgacc

SEQ ID NO: 2887 - DNA, 442 bp, Zea mays
ctaataacttttgctgcagttgttgaatcaaatagtctgtgatttcccaccagaacatccaatcatttcaacctttcggccactacgggaacctcttggacacagcccacttcaggtagctctactacatacttctatcttctattcatggatgcaagtgagtataaactataaaccccatttgcattcctatgtacatagttaatatggcacttgttgagttttcttgaaatgaaacatggtggaatgatccacctttttggtttggcgcctgtttgtattaatgtattatactgttgcctctgcataacaaatggcctaacgatactaaaatgttgtattgctgctcaaatgtgtctccttaactgtgtcttgcattccagaatctaatctggaatatttcatgctaacccaagaaaacaaaattttgggttcttagcct

SEQ ID NO: 2888 - DNA, 657 bp, Zea mays
cttacatgctgacagtgacagcggcacttcagagttcagatcgctacccctgattctggaatcagaaacaacaaagatctgtagaggttaccttgacactgcagaacaagtgtttttcaaccgaactcagattttaagacatgtttttaatccgtcgttagaaactacatgaagtgtttggttcctaaaaactaatttatctttttcattttattttattttattttaatctctaaattattaaatacagaaaataaaactctatttaatttccgtattatatagtttatagactaaaataaaatatgacgaaggcactaaaatttagtgaaacaccaatgcgggcagtgtggcactatcgtaatacggctctcggccaggggaccatcccgtacgctgctgcgcctacgcggcctggggcgggtatatccgaggaaattcagccacgcggtaaagcgaggcactcgctttcttccacaccacgtctcctccgcctgcgtctgcgtcccttcctcacgcggacgccctcctaaaatccccaaaatccgatccgaccaccaaaccctaaccccatcccgcactccccccctccccccctcccccaacacgcgcgcgctttcttagccgctaagcatatccctctccgccacgatctcg

SEQ ID NO: 2889 - DNA, 1452 bp, Zea mays
tggtcaccggcgcgcgggattggggctcgtcggagtcgctaggtgacacgaaatacagggtcagtggttaatggtcctcccttgcatttttgcaatcggcaaatgttgtcggtttattattatgtcacatgtgtctatgattctttgatttgtgagattgtctgtatctataatttataggttcaatcataaagtagcaaagcacattgtatactatacgctactatgattttatttataagtatagagtataaaacataggtatatgtgtttagttggttggatgagtagaatgtaagtttagagcaagcattggtaatttggatctcttttatacataatttttagattaaatttagctattttgcgtatataatagagattgacaaatataaaagttcagtcattttttagtttaaagcctattttcttattgaacttgtcatacatcagtggctaaaagaaaaatcgtgtgctcgattggcatttagatgccatgtgttagcgttctttggccaatcacctaatgcatcatgatttagctcatggggaactagaactcgagtactcttcatacgagcgtggactgtccgctctaggcgtttggatcgttcacgacttacatagaggatgtcgctcttctctgcagggcggcagaccgtccgctcagaacggccaaaccattcacgcgtgcgcagaggctacgataatctccttcataatctggatctcgttctcgaaagagacccgtcaagaagaaaagatcctaaggttgtcttgagatttgcaagccgcttaaaaacgaatataaacaatgtcaactcgagaatgggtgaagattggagatggagaagactaatctaagctaagttatcgttactcctagagcaagaatgcaaaggtattgataataaattgatttgatcaatgcttcagtcggtcgtacttctcgtatatagggtagaggtctaaatccatttctagatgtaatagattcacgtacgattagttggataagcacacaaaataaaaaatatatcctaaattaatctaatcacagaccttctaaactataacttcgaggttatgacctcgaaccgtcctaagcgcagacagtccgaaacatatagccggatagccttgtctgaccgttcgatcatactaagatgacaaatcagctgctcaacatcatgtctgtaatggtgggcgtgagaaactgactgatgcggtactatacaaattcatccataaaattcttgtgcaatttttgtgcggaaaaaacaaaataaaaaaattgggtgtttacaacgaattttaggtcttggcctcttggcctcttggtccaagcgattattttccgtgggccgttgggtccgtggaacatatccgttgcagaagactacagattacagaagcgctcgctcgctgttgttgctgctgccaactgaaggg

SEQ ID NO: 2890 - DNA, 291 bp, Zea mays
ccgagcacgttcgtcttgttccttaagccaagaaggtgggggttataatggtaatttccccgcgcgtctccttccccggtgttcggaaccccggtccggtcccctcgagctcgaggcctctcgatttgaaatccccacctcaagaccggggaaaaaagattaggagaggaaaaaaaaaaagaacgaagagctctcgatctagggattcccttcccgggtctcgttgctctcctcgtccaaatccccaggccagcctagcggcgcagcctgcacgcccccgccccccggacc

SEQ ID NO: 2891 - DNA, 709 bp, Zea mays
catcgcgcgaatcatacgtcctcctcttgtgatcggcaatcttggcaccaccacggcctttcgctcaaggagccagccgtgtgcctgccgaccagccgtccagcccagaggcgtcgaggccgatgggcagcaagacgacgctgcccctattaataaagccgccatgcgtgtgcccggcactgcacagcatccatcgtccatcgacccacccaaccacctcctccgccccgcgcttcgcctgggtaccggcgtccgccgcgccccgtcccgtccaggaacaggaagagcaggtacgcatcgcacgacccgttcgccaccagcccaccaccttgatcgcaggcgcatatgcgcggcaggatccctgtagtcgtagatcgcgctgtctgatgtgatgccaccccttttgtttgtgctctgcctcggccccgctctagcgtcgcggcaggatgttgggttgcctgccggatctgtccctgatgctgggttcatttttcactcatactagcgtaatagtgttgtcacaccgtggtattttttaaacaggtgataattcccaagatgtccatacgaattttcgatttccatccgcaattttctgtgccttactcggtagtagtagtagtagtgatccgaaagtgacaccattccccttgtgctttcttgccagtaacccatccacccatccatcggggatcaccaggggagcaag

SEQ ID NO: 2892 - DNA, 1425 bp, Zea mays
tttatttggagaattgtccaggtcgcctttaatctgccctatactcttgctaatgctccgcacttatacggtgactggattctgtcttttaataagtcagttcgcaatctggtgatggtgggctgtggggcagttttttgggctatctggagaataaggaataatgcttgttttaatggcttgttggtttttgatcctattgaagtaatctttagttgctgcttttggctcgattcttggtctgttttgcagagtgagacaacaaaaaagatgttgttggaagggagtgtgcgaattcgaaggacgataaataagttctttgcgcacgcgaatggatgggcgcctatgtcgagaaggatcacgggatgaaaaaagtcttacatatctctggcttaacgttgtgaggtggcggtttagtggctttcgttgagtcaccgggcttctggattgtaatacgtcgctgtgcttgtttctctatggtctaagttcttctcgatcctgagtttcgctaagtcgagctcaataaaaaccctagggatttcgttctttagtaagtctggttagttgatgtctacctgctagggcgttgaagactatagcttcttaattaaaacttccccatgtaaaccgtactgtaaacgtatcctgtgatcatggagcttttgtgctcatatgaacactttaaatctggtacattcatttctcatccagtggcagtggcacacaaaagagatagacggcgtggcgcaaaaagggcggcacagaagaaattaggaaatatctattcacacttgaatgaaaaatgaagacactagatttaaagtactcatataagcacaagagctcaatgaatacaggatatgttaccgtatatgtttcctattttctaatgaaacaggggtaattccccttcctgtcaaaaaaaaaaagccaactggtctcctcctttcacctctcgcatcctcatggagagtcactgacacgtgggccgtcgtccctgtctgaccccacgcgtcggtgccacagcggcaggaagcttccatgcccgtgccgagcgccgccgtcgcttggtcacctactcacctccagctccaaagtcgcggcgacacgcttctagaaccgcgtcgcggcgtgtataacgaacgcatcatgcgtgaggccatggacgatttcatttccgaatcgatcccttccctttcggtcgccacctctagattacctcgcctcagctgtcaccgacggcgacgcgtttcttcgcgcagcgcgctgcgcctttaaaaactcccggagccggccagagaccacgagacagagcaggcacagagttcattcaccgccggctccttcatagttcattcccgaggcagagattttttttggggggtgaagcaccgcgcaactccttctcagttctcagcggcagac

SEQ ID NO: 2893 - DNA, 730 bp, Zea mays
gccagctatgtattatgagtgggttttggtagtctttacagatataatcacggacgagttttttgcttcactcgatctaaatccgactcattgccatcccagtctaagacattttaactttttggacagtcaaagaatcttggtttaactaaaattataagaagaaattatgaaggattattttgactccagaatttaactaaaattataaaggtttataacataaaaagctatatacttactatttgcgattgcgaccgatgatgttacatcaaacaggatttcctaaacccgagggcctccatccctccacgttctcagaaaagtcgtccacgcgtctataaaccacaccaatcttttggcccttcgcttctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccaccgcttctcctccgcctccgcctcgggcagccgcctcctcc

SEQ ID NO: 2894 - DNA, 239 bp, Zea mays
taagtgagtatctcgtatctattttagagtttatctgtcgtctgcgtctccaaaacagagaagccaacgccaacgcctccatttcgtcgaatccctttctctcttctttcataatggcaattgtctccctaggcccggtcccgtgtcgcttcgtagttcgtccccttccccgcgcccccagcagcagcggattcccctcgagagatccggcccttggcgcggtcgccggagagagcggc

SEQ ID NO: 2895 - DNA, 1500 bp, Zea mays
aggcacacccgaggcagacgttggtcgtccgtacactgcatgcctcatagaggcacactgaaacaagggggagagaagacaatagcaaaataaggggccatgaagaggtatgcaatgtagtgtttggtgtgcttcctgatgccgctaaagtgtcgtaagggaggggtcgcgagatgcgttcaagacggtctcaagcccacagacctcatgtagctacccgacgaatagctcaggcgactgccacgtccctgctcaggcctcaacatgaaataggagtgatcaatgtttattttatataattacgctaatcaggatctgaactgaagacctctaacttaatttgatactatatatattaaaattgcaagcattgactagtttaacttaaaactttaaggcttgtttggttattcccatcatccatgagggttggaaggtactgggaggaattagtaggaactttgacttgctatggatttatacccacttaggccttgttcggttacatgggatataatcccatcatggatttaatccgggtatggattgggtgaatccatatctcacacccaatcccatggtgggattaaatccatcaacaaatccatgtgactttcaaagctagttattcttttgatccatggattttaatgtaaacttgtgcaatatctcatggatttgtttcatacctaatgggctatggatagaatccatgtcttccatagtttaaaaaattcccaaacctttgggttatattccatgatgggtttaaccgaataaaaaaaattaagtagtcatggattattttggggtatggattgagacatggatttaattccaattcatgctaatccagagcgggattggtgtaaacgaacaaagtcttaatctatacattaaggttaaaacaaaaatgatgagacctgaaacttcctttgctttcgtggaagaaagctcaacggcagcggcgacagttgttgggcaccctaaagtagggcgttcgaaccatggtttctaaagattgtgtcttacgacgttattgtccactgtgagtgcccttagatagatagagcaatggagtttaactagcactcacattcaatacgtatcactagttaagctagtttcactagtatatagaagctctatagagctggtttattagtaactgataaattattactgagcggataaatatcaaaagaaaaattgaaatacacagctagcaaaatcttatgtagaatatatgagttcagcgagcatattgggtacctgctcactttcagccacccggatggagggagtactatcaagtacttgttcacgtgtccatgcagtcacccgattagagttgtcgcgtcgattgcacagcggtttcactccacatcatataacatgtggaaaacaacgcatcaccatcatctggagctctatataggcacatcaattgtttcctggtttggtgcgtgtttaattatataagctcaatcaatatctggc

SEQ ID NO: 2896 - DNA, 681 bp, Zea mays
tagaatttcatctctagaacctaaacgggcttttagagaacaagagggtctatgcatgtttggttgcatgcttcaggcgccaaaaattgccacacagtttgtgtcacatttgactaagattagacgttcaaattctacgctacattatgacatggctaaaggaatcttgtcacacttttatcaatcattgatagtgaaacaaagaaaaattatgccatatctatggctctaaatcaaacttgcgtctaactcgatcaaacttggttaaccttaaacgtattaaattgtgacaagtgaggcaacaaatcaaacaagctctaaataattgcgacgcttggaatggcctgtctggatagatagatatcatagacaacaataaacataacgatatttttagaattttaagtttccctctaaaatttcttatcctatatatttgaaagaaaaaaaataaataaaaacggatggaaaatgaaaaacccgcggcgagtggtgtcgtactgtcgtctccccgttcgaggggatcaggggaattggacgggcttgcttcgactccacctcgcctccgtcggcgtctcatctcatgctgggactctggtggggtggggattgacttcgctatagcccaatccagtcagcagcagcttccygccgccccatgcctcgtcgcggccggtggcg

SEQ ID NO: 2897 - DNA, 303 bp, Zea mays
cgttgcgccgctggtctccatccatcgatttgttttgttggcttcttcgcatgtgattccgccagtaggagtgttgcttatctacccctcctcctcggctcctccacaacgtccagatcatcagagccagagggtaaaacggaatagtctattcccagtagtgataaacaaaacaaagaatcttctctgtcttcgtgcggtgtgcctgccatttccaggcccagctgttcattctcgaggctccttctcttgtagttcgtcgtccttgcgcagcagatcgagaggctgaggggagagggatcc

SEQ ID NO: 2898 - DNA, 299 bp, Zea mays
ggtactttgggaaagagcctccctcagtgttgtggtagtgaatttattgtgaacaaaaaaggtggtaagagtaagaaatttgcaacagcataggagagaaacattactgcattctattataaaatcaaaaggagagaacattgcacatatcagaaataagatgtgatcaattagttctttttcaacactcttgtgcctgcgattgatgtctacattttagctatattgaaagttaacacttatttctttgtttcagtcatttaattgtttgttttctcgagacaattgtgctgtaagac

SEQ ID NO: 2899 - DNA, 187 bp, Zea mays
ctgcgacacacaccacacatacacattttcaaatctagcttgttcgctaagctcaagctagctgagctgatctgagaaacgatcgcttcttcagtttcagcttcatcgctagctcgctacacagatcgacctcttatttagcttgttcctccaaggaccgagatcggttgttgttgataaaccagcc

SEQ ID NO: 2900 - DNA, 622 bp, Zea mays
gatgagatgatatgctatggttttcctttgcaggactttttcattagtgttgcacatcattcaagaccataaatgagaacaagcttgggttgtggaaaatttcagaaaataaaggtaaaggaattcttgacgacgatggctttgggcgcttggcgcctaagtttgaatacataggaaagaaatgaatatctaaacaaatgaacttctcatatatggcactctctgtctccctctctctattctgtgagatagttcaaggcattctttttacatctattgcaacttttttttgtaatttcaggcctataactctcgttgatcatttcagaaccactggaatcaagacatatagcaccacaagccatacctttgattattttaaaactactgcacctctttgattcttttagtcagctgaaacatatttgcatcctactgatacattgttgcatgagaaattaaggctggcccaggaaggctcaacatatgcttgtgaataaagcttttagtgaaagatagtagattttcatcagttcactaccacgaagctgtctcaattggatgagaaccgccatggaagacagtgacctaaaagaagacagcaacctcatctaagttgaaa

SEQ ID NO: 2901 - DNA, 1500 bp, Zea mays
tccatgcatatcttgtaagtagttatattggctcaattccaagcaacctttacacttacattatgcaaactagttcaattatgcacttccatatttgctttggtttgtgttggcatcaatcaccaaaaagggggagattgaaagggaattaggcttacacctagttcctaaataattttggtggttgaattgcccaacacaaataattggactaactagtttgcccaagtgtatagattatacaggtgtaaaaggttcacactcagccaataaaaagatcacgttttggattcaacaaaggagcaaagggccaaccgaaggcacctctggtctggcgcaccggactgtccggtgtgccaccggacatgtccggtgcaccagaggactccaacttcaaactcgccaccttcgggaatttccagaggcgactcgcgctataattcaccggactgtccggtgtacaccggacagtgtccggtgcgccaaaggaggtcggcctcaggaactcgccagcttcgggaaactccaacggctagtccactataattcaccggactgtccggtgtgcaccggactgtccggtgcgactccggagcaacggctatctccgcgccatcggctctctgccgcgcattcaatgtgcgctctgcgcgcgcagaagacaggcgcgcccatactggcacaccggacaggaaacagtacctgtccggtgtgcaccggacacccaggcgggcccacaagtcagaagctccaacggtcagaatccaacaacagtgatgacgtggcagggggcaccggactgtccggtgtgcaccggactgtccggtgcgccatcgagcagacagcccagccaacggtcaagtttggtgattggggctataaataccccaaccaccccaccattcattgcatccaagttttccacttcccaactactacaagagctctagcattcaattctagacacaccaaagagatcaaatcctctccaattccacacacaaaaccctagtgactagagagagtgatttgcttgtgttctttcgagctcttgcgcttggattgctttcttctttcttgatcctttctttgcaatcaaactcacttgtaattgaggcaagagacaccaatcttgtggtggtccttgcgggaactttgtgttccaagtgattgagaagagaaagctcactcgatccgtggatcgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctctcgcggactcgtttctttattactaacgctaaccccggcttgtagttgtgtttatatttgtaaatttcagtttcgccctattcacccccccctctaggcgactttcaattggtatcaaagcccggtgcttcattagagcctaaccgctcgaagtg

SEQ ID NO: 2902 - DNA, 1500 bp, Zea mays
gacccctttgatttgctcatcagatcattcgcaatgtgcatagagaaattatgacctcctccagcatctatatcttgcccctcgggaggaccccgccaggaaggaaagatcatatagttgtcttaggatcgaccgaccacctaagatgtctctagacgatgtagagccgaagagaggtgaagattgagattaggagactacaaattgagctatgcaacgtctgttttcaagacatgataatgtaattagattgattcaatggaattgtgtgttagttctcaatcgtctgtactcctttatatttatagggaaaggtctggatccgtccctatgcgagatccaatagattaccgtggatatgttaggataaccatgcacaggttaagttctcttgttcgaattaatctgatcatgaaccgtccgggctattctgtggactatccggactccggagcgaaccatctgatccatatagccgaaccatccagccgagtctaggtaccaaatatggtgctcaacattcggcaacatatttttcgtttatcctactatctatttttaaaaccgcccatgtcatttatttgcttgcatttttttgtcgatttttgacttcttccgccatccctcctctcacgcagtttgagagagtgcggtacttacccgtcgggtagtgccattctatatccatatctattaaaaaattctacccaccagattacccatatattaaatagtgcggttaattttacaaaacccgtacctgctaggaaagtcttaaatttcaatatatcaatcactcaaaatattaaataaatataaaaaacaagctcaactttacatataacaaatcatatgattatatgatttgatagctagacaaatgacagctagagaaggtttttattttagctaagatgcattctattagatgattatagtgatattgatgtgagtatattttaccaattggtagacgggtatgggtagtaccaacccgtactcgtacccgtctacctaacgggtagaaaaatcattctgtatctgttttagggctagtttggcaaccgtattttttcatgggatttttaatttccttagaaaaaataaactaatttagcttgggaaaacggaaaccttagaaaaatatggtttctaaactaactcttaatatcggtaaaatctatcgggtagttaggtttagttgggttttatgtaactgttgccatctttaagtgctgctgctccgctcgtgcagtcgtgctgcgctgtgcgctcgccaacgccgtcgctcagagctgtgtggttttgtaaatgggccatggcccaactgaaatgactgaacggaggcctggtccaccttagagcctcaagaaaaccctaatccctgtgtccatcggcatatatccacacctgagtcccctccgccgcctgccgcactctcctgcgacgccacaaccacacgttcacggtagcgagagcttatcgtcgtcggcggtgaag

SEQ ID NO: 2903 - DNA, 1500 bp, Zea mays
tttactatggtgctcctcaattacaatgatgaagaggatatataaagatggagggggaaaggctcgtaagtacacattttttttgtgagttcgacatgatttgtaggtcgacattagttattttagttcataaatttatagatccacgcgtggttgctgcatttcatgaacctcgttgatggcaacgacaataagggatcaacattctgggagcaaatagccaatacctataactccaccatagaagctcatggtcaccataccacaatatcctaaaggatcgatggtcaacaagcaaccgaaagattatagccacagattactagatagtatggacacaccacgttccacagctagagaacgaacataagtactgatcggaaacaaagtaaaatactagatttccttccgattgcatggctcgctactaaggggtctttttgtaccggtttttatctcaaacccagtactaaaaggtcactcttttaaaaaagtaaaatgactgcaggtaaagtttgcaccaattgactggtctaaacatgatatgttctgtagaagaatttgataaacaattagccttgcgagactgcctatatagaaaacacttgaaaggaaataacgagaataacaactaaactctgtagcgagcaaaagaaaaacacgtagcatgcacatcaaaactttatttctgcgagatacataagatcatttgatataaagaaacatgtagcttttatttttttaagaaagaaagaaaggttaaactctaaatactcccttcgtatagaaaaaatgctattccatattaattttttaattttaactaagtttacagacaaactgtttttattatttatgtctttaaatagatttatatgacaatatattttacaattatataaaaaaacaggagtcgtatttgtttagcaaaacaaccaagacacgtagtggcggcactaacgcgttggtacttgcctcggtagggcgtgtcgcgagggcattggcccttcaagtcacgtaacgtgcatacgtgacactggaactaggcaactagcaacagaagtgttctcctactctctatactagcaacactgcaacagaaacgtagggctggaaagtggacagcatctaggcgtacacctgtcctgtccagacagacaacccaaacgggaaaccataccaaacgtccaaacccttcaactgtaggggcagcggcccgggccgtggcgagaccgcgagagcagggctgcaactgcaacatgaagccagccgagggcgaggccagcacggttggggcccaacgaaccatggtgggcccagcctgtcaacgagtccgctgaggtcacggtaaccggcggcgaagctatatgaggtcgcccgggtcgagatcgatctctcctcccaaatcaaatccccaaaccccgggccactgctccgctcctcctccttgccgccgtgcggttgagcgccgacgagcaagcccgacgccaccctatggct

SEQ ID NO: 2904 - DNA, 1277 bp, Zea mays
aggttccatatatagaggagcaacctttctcaccaatacggggtctgatgtggcccgtggggattgttaggctatccgcactcatactactatatttttgtaccctaaaagaaatattccatcctagccaacaaggttttctactctatccaacaattctctgcggtcacaattactctatatatctaccctataccaactaccatatattatattatattttccccacttttctataccgtcagcagcatgtatgtgtctgtgcccacctccaccaccgccgtctacaacatgcatgtatagccgcccgctcgatttaccacaggggagccggagcgctgtatttagcgtcggaagggtaggagagagagagttaagtgaggcatagggtcgtccagtgcagccttcagttaactgtaaaaaaaatttagttgcttttccaatcacccattacggagagaaggttttccactccaaacgtcaccttacggttttgttttgaccataatccacatgcgttgagatatattggagtgtaaattagtttaaattacatttgaattcatcttaatacatgtggttcgtggtcaagggcaccgttggaaaagtctgtgtcaacgggagatgaggaaagggtatccgccgtggatataattgggtaagccagaagccaaagcaccagaagatatacagggggaggggttcctttcttctcccaccgtcgctgccgccagctgcccagctgcgcctcgtcgtcagagggttccctttcctgttcgatgtgacgcagccccccgctgcgccccgacggcggcggcctcaccggctggcgatgggcacgacaaactgagacctccctttccacccaagttctctttcctccttctctctctctctccctctctctgcggaaggtggcggtgctgcactctgttggtacaagagtctggagtgcagtgcagatccacccggccggacctggatcgatatctccgtttgttggtaagcaaccttgacctctttggttgaattgctctgcggtctcgtttttgttattcgtgagatcttctgtgatagcatacaatcaaatccgaatctttggtggcgctgctgaacaagcctactctaattcatccatgtatgatcccgtcaggttctttccatcgtgcaggttcaataaaaccaataaattctggggttcaactgaacccccaatccgagtataacggccactctgtgctgcaaggtttgtctaagattttcgtgcaataacggcc

SEQ ID NO: 2905 - DNA, 1012 bp, Zea mays
gtgaaattggaaagcttttggtcctaaccataccatgtatcttgtactttcccccctttttctacattatgctcggacttcctgtgcaattgtctcggcagaagacagctggcgaccaacaactgtttggtcctgactattagcaccgtatttggaacagatctatggacgatccgccgtgtgttcttctcatcgtcaatttccagtttttttccccttacaagagccaaaagatgccatagcccatggatgggtcgtttgaacactagtgagcatgaggagacgcgagatcctccgacgtcaaaacaagcgacctcgccagtcgctaattgccatgatggttcacacagcgggctgcgggcccatcaaacacaccagattctgcagtcccaattgaaataaacgcgaccctagaaaccgcgggaacaagcgggcggaaaatggcgaatgcgtcccccaaataccgtgaaaccaaattcgtccacgggggcccatccatggtggagttggcccaggacgggcccaacgacacagcctttcttctgcctccttgggccgtccacacacacacacacactctctctctctctcttatgaattatgattacgatgacgaagaggaagaggtcagaagagttggcggcggtagttatcgcttccggcgatctcgcgcgtggagtcccgagtcgccaaggctgccgaaccctacggccaggccaagatttagtagtagctactataaatctgcagggtcgccagcactttggcctctcaacgcacgccccccgcccgacgtttccgatctcgtttctctcctcccgagtagcgaaatcttcgtacattctgaggtgtgggagtcatcggctcgatgccttgcaactctagtttttcttcttcctcttcttcgtccaattgaccgttctatttttctgccggttggcaaatggcaacggcattggcattgccgaacgaatgacgtttggttctttgtgatcgcattcgatgctaacag

SEQ ID NO: 2906 - DNA, 1500 bp, Zea mays
cagttgcaatttcaaccactacctgaaagtaatagttcagagtcggtcagtgaatactgtaaaatgcaaacaccagtgcaagtaccaataaactactcagctaaaaacgaaacagggaagtgccaaccaaactagccaaacaagtggtaataccacggcccttgtggcgacaggcgacagcaacagtgaaacgccccgctcccaagccggcaaacaccagcccccgcgacggcgccgcgccgtcctctcccgaccgacggcaacggaaaccctggtgacttgtgagaattttttctcgtcccattctcttcttctttgcaagatccgaaaaactataaccctaattttctgtgatctagatattggttgattacttatgtatatgtgctccgattggcctttccaaaaatatttttttaccgtgtattttttggttatgcatatgtgctccaatctgatatggctttcccaaaattttctcattatttgtactgtaatttaagaaattattattattattattattatgctatttagtatttgcatatcgaactgtggcacaattttgatggtgtattactgaattgctaaatggtttctactggtttgaataatttggatcctgcatacccacacaagaatcctagatccgccacacacaccaggtayaaccaccccttgtcttcycttcctgctgccctaaacagagcacccaaacccaagctatctgtattcggatcttatctgattcaattacaagtgtagtatgcatgcattatgcctacaaacttgttttttcaatttttttttttgcaaagaagtattgggtgtaaatgtgtatacctatgtcctttactgattccacctctaggtgtcagatggatgtttctgctgaatccactcgtgttggtctcttggaaaacaaaatatgaacctagatctaggcctctctgccctacctcacagcttgcatagagcttaaccatgtgagataatcttgaatccttatacatgagaatatagtctttttagatgaatcgaatgttacaggagaagatatcatttatgtttatgcttttatattttattaggataataaaatgtattcacaaattcattgatatgttgcttagacaaatcgagtctctttataaacaaaagaagccatattgattttgtaagtgcattaatttactggttcatggccaaatcaaatgattggacatgaaccggaggatcaattatgctttttgctgcatattagcaaaagatatcatgcaatttgaacaatgggcactgatgctgatttaacattttgagtgtttggtgttcatgtcgtattaaagtccaaatcagagatcttaatctgatctagaattatccagtcagaaaatttgaactatttaatgcctttacaagtactttacaaggctctggatgtttctctgcagctgatacaggaagattactttaatctatactccaccttctttggtggct

SEQ ID NO: 2907 - DNA, 519 bp, Zea mays
ttgtattcttcatctgtgttgggcttttgttagctaagtcattagcagtaatctcgtgtatttgggcctaggtttagtcagtccaatgttttggtataaagagtctgtaatagagaggatttgaacagaatagaaaatacagaaacagaaagcagttgaacctccatacctgagtattgacgggtcggtggatgtggctcacgcctcggcgacttcagccggcggccaggggcgttagacggcggcactgtacgtggtccgcagctgagcaattggcagatgtagtgataagctgatccgtcgtctcccgtcttcccgacccgggtcccgcctcgcccgtcgccgccagatccgacgcgctggatcgccagcggcctgctgctgtcgatccgacgtgcggcagtctgctcttcctgccgtttccctgcgcttggggtccataatagcacgcatctggccggctcaagagcatagtggatctgaccggaggaggccgctgctgctgcttctccctcaccg

SEQ ID NO: 2908 - DNA, 618 bp, Zea mays
cctgaaaatggcatagcaagaaacaccatcagaaataaaagttactgtaaacataacaattacccaaagacttacttcagccaatcagagcataaagtgatctacatagtatgtccagatgtattttgtatgatgatctttaaaaacaactgtgctttaataatatatcgtagtggagatcctaaggtcctgccaacatacttttgcaggcacaatagtaagctctgatatacactttccagcacattgggcatgcagagtttcccagatttctaaagtaccgccaagtggaaagaccacggcagacaagtgttgctgaataacaaatcatgatgtgaagggtcattttgaagttcctagtggaaaacagacccatgagcaaaagctccttgccttgaacgttgaaccccagaattcattgatgatcaatatatggagaagcttgaatacatatcattatgtgatagagattttgtttgcttatgtcatctgattgggatgataatttgtttttgtttatcttaaaattagtaactaatgtctaatacaacttctgattagattggcaaacatcttggactcaacaattcaaaaaaacttcataaacgagtatcatcc

SEQ ID NO: 2909 - DNA, 412 bp, Zea mays
agtagatccaccctggcgcggaagctgagaagctgggaggtggcttcagctacggcgacctagctcaacatgggccactagagcagagaccaccagttgtactcttcatttaagtctcaccagaatgtacgagacgagttgttcatcatcaacaatcttctttgcaaataccatctcttctgcaagagagattatcttgacaatatattctagtgtcgatggagctgtatatttatacaggcaggaaccgcctattacaagaggaattctgcttggttacaacatctgaaccgattctgactctaaataaactggacacatgcaattctgttttgttcttatttgtaatctataattagagctggttttttatctagcccaagagaatcctgggcaactaaggtcgtagcct

SEQ ID NO: 2910 - DNA, 366 bp, Zea mays
acagcgattgaggctgcttgcatgcttttgagaatagatgacattgtcagcggtatcaagaagaagcaggctcctggagcctcagctcccaagcaaccccaaattgaaactgagggtgatgccgacaatgagcagatgatcccagagtagaggctgtgaccaacctgcactgtcaaagttgtttactagtgccggaatagcactttgaatagagttcattttatttgagtgttggtggttagccttaggttttatatatagtttgatacactcgtccgagggttttttgtagtgtggttgctgcgcattttgctttggacagatggacgaactttacctgttgtatgccgtaaatctacctaatac

SEQ ID NO: 2911 - DNA, 849 bp, Zea mays
gctcgcacccgctgcgcggtgggtcgcaaagaccaaagtagtgaacctgcatggtgggagcgctacgcgctcgtaaactgtatcgtttctcgacaacgagctcagggaaggtgtttttcggaccttcggcttcctgaagcctaagagacttttttcacggatcaagatcgttacgaaaaacgatctagcaccgcgaaggggctactattgggaccatgcttcgtcgccgaaggtcctgcaggaagaaacagtttcggttgaagctgtctgtacgtgatgccgaagggtgccgttcatgaagcttcggaattacaaaccgacttaaagatagaatgaccttttagtccataagagtttgagtcgatgttgtaaacttttatgaggggtatgattgtaattgttcacaggctgtgtcctgtgcctataaatagtgaacagtattcctttactgttcacgcattcatataattgcaaccacatcactcggaaattattctttgccaaggcagaggtataaatgtacctaaatattgtatttgaatatcttaagtttatataatatgcaaatgatgttgtttacttctaatttacttgtctttaatgctttatgtcttgtgttattttatattatctttgaaagttcaattacgaagatacaaccttcgtaattgtgtcactataaccttcgtccgaagttcattaaatccttgaggaaataatgcttcagcggacgaagggcattaacatttaacattttatgttgccttgttcttaattcatagcatttgagaacaagtccccaacattggcgcccacctctagtgaactcacttccacttttttgagccg

SEQ ID NO: 2912 - DNA, 495 bp, Zea mays
ctgcaggagaaatattgcacgtggaactgatagattgagatggcagttcttcgactggaattagagaactgtgccgatttttggtgttgccaaaatattgggctacgagttggatactgttggagcagtgattttttcgccttatttgccaaaactagttttgggggacatttattaggagctcttggagatgctctaatagtcagtgcaccggactggatggaaacacaagaaaatctctcataacctaaaatttcttgtatggtcacaattgtcaattatctttatggtaattgcgacatgcacgagtcatgcatttttattagcacaagaggttcacttgctgacttatgtgcagtgatggtggactgtactgtacagctttattagacaaaaagaaaggctgtcctgttgtagtgaatggcttttcatgcactctaaaaaggcccatactgtaaaggggaaaatactgacgttattttcttttccccgtct

SEQ ID NO: 2913 - DNA, 97 bp, Zea mays
ggtgagtgatcgggagaagacattagacgcatttgtatttctgtttctcctttgatcacacaaactatagtcactcaggaagaagccacatactgtg

SEQ ID NO: 2914 - DNA, 1500 bp, Zea mays
aggttgtgacgaacatataacttgtgtacttggagtcagttcgcctgtaatggacaccagacctgctgtgaatctgtttttaagcttccattrtaatacagcaatacaccatatacttgtatgttaatacaccatatacttgtatgttaatgggtatcttccccggttccccctaccattgggttgaccggttgagatacaggcttacaaatcttgtcttttaggccatgtttggtttctttagtctagggactaaagtttagttaggggactaaagtttagttcctaacatgtttggttctaggggctaaaaatagtaaaatgtactaaatgactcataagaagactaaaatggtctttaacattctcctgctattagcataattaaactaaacgagggataaatgtagaattaatatggtttagtctcttttagcatatatgtgaaggactaaagattaaatcattttagtacatattttagtcctagtgtttggcaaaaaagagactaaatgagactaaaaactagagactaatctttagtctctttaaccaaacacccccttaatatcagatgcctaactaatgaatggtactgcatatttttcttccgatctgcaaaccctgtatcgggaaattgtattgttttcagaagcactgtataaacttacaggtgtaaaattgacatgtggtgccggggctacatgtaaagacagacaatgtgtctaatgcactttttttcaatctattttcgaaattgacataatcttattatcatagatttcatggattatttgagacttaatttcaaactaagcttaacaagttgagccgaaattaaaaccaatctatctttgttctgaaagaaaaaccaaagcttattcaaaattaattcatctttattctaaaagaaatactgagttcaaccagaacattttttttaaaccatatatttcattgggatgctacttgaggtcgccaatctgtatgagaacaatgctattgcagccttgcaggggtttgattggaacaatgctattaccaacgaaaaatgagataattggatttttaacactcacaatgttatcttcttgttataattaccactgtgtctatgaattgtgggtccagctgtgtctatgaaatgtggatctgatggcaattttacaaacctgtttgttgctgatgacaaatatcagaatctctcaaaatgcgaagcgccttgtagaagaaaatccaaatttctgcaccaccgcggcggaaccaaccgtggcaggggacggccaagggcggtcgctgccttgcctggcgttgacagtttgatgcgaccgcgggagcgtccgcccgaccgccaccgcgtccgcctcagctcccctcgcttccctctaatttccagcccagtagtagggagactagaatcgtcggcgcgacgccttggcagattcgtccgccccgatcccaccaccaccgtgccccgcgggtgacgtcggaccggcggcg

SEQ ID NO: 2915 - DNA, 400 bp, Zea mays
ggtgaggtaactttgaatacaatattattttcatatgcagagttttatcactagaatgtgaaattctgcaatgccgtcttattatagttgttaccaccctctatcccgaaattataagttgttttagcttttctaggttacataacttttgatatgcacctagatatacaatgtctacatacatagcaaaagttatgtgccgaaaaatgccgaaacaacctataaattggaacggagggagtatttattgaggaaatgagatctcagataagttaagattacaatcgcttctgtaactcaggtactagagggaggcttgagggataagcctggaaagaacagagatcactatcattcatgctactgcctcagtggcctcgcagttagccagtacagtgcc

SEQ ID NO: 2916 - DNA, 106 bp, Zea mays
agagtgatctaatgttagaacctaagaacaattggctaaggttgtgtacgattgtgttatttgcacgaatgatggtaacttagtcgtattataccagggtatttgt

SEQ ID NO: 2917 - DNA, 400 bp, Zea mays; identical to SEQ ID NO: 2915

SEQ ID NO: 2918 - DNA, 607 bp, Zea mays
cggcggatccgtcactccgttcttctccgctgatctggaggaaggaggcgaggtacgcactgctatctccttccagttcgttcgagaagacggtcgttgggtgattcggcgggcgctcctgttctgtagtaaagttgtttgttttttgtctcttgtatgtttggtttcttgatcggaaacagaagtcccaaattctttcttttgcttggtcaagtgccaattgggaggcagaacggaagacagaacctccatgcgaactttagtcgcgctgatttcgatggaatcggaactgatttaggtgtattttagctctgattgttcttggcaggagtacaattttagtagcaccgtttgatggtacggttcttctgggtggtaaattgcccttcctgcgacgcgatgtcagacttcgatctctgttggaagacgctagacattgcagacataaatatttttactgcaatcatgagctcgaaatccaaatgttaatcagttcacagttcagacaatcgcttgaacatgtttaaaagctggacgaggtttcatctactcgattgaatcctcgtcttcgccgctaaatcgttgcaggggagttgcaaatccatca

SEQ ID NO: 2919 - DNA, 1342 bp, Zea mays
tactatttttaatgttttttcccttgcaaaagtgcctatgcaaatagcacggataacttgcatttgcaggatgacattttgatctttcttattgatagatacttttacatttaatatggtgtttttgttagattgcatatgtcttccctccatgcgccccattgtatctatagccaaacttttatatggagtccaattagttgctcttacataagactcctatgaagtctaatacagtatatctgtcgttgctagtgtttcaactgtgggatgttagatgtatttgtgtttgtgcagggacggagctagagtttattactggagtctgctgacaatataaattctagaaagcccaatgtaaaatattgtttaaccactgtttataacattgatgacatcagttagaaacaatactggcgctagtgaacttggagccttcgccctggtttgtgatattattataataggtctgggcccatccaactctaagcttacccatggttctatccctataactatatttaaaccatactctgtaaacagtacaatttacaatataaaacaatgcaaaataatttactgaagttggactaatatattttccaaccctatttagggttatagtttccacttctatcaggttacatttagataacgatctacctctctgatacgctcgaagatatcatatccatggtagacaaatagcccatgtagcaaagtaaatttcataatcttcaattcagaaactagattatgtacctcaacaagagatggtcttattagcagagaaagtttctatgaatttctttttcttgtgttcttactggattcatactttctagacgagattatattttgtttagccctccaattctctggctttttggagcgacgaaaccatgccctccattcaaatttcgaaccgaaaccaaaaccttccaaaaatggactgctccacagtctccacgccgagcgctcggacaggaccccgaaaatttcaaaccagcgtagccaacgtttttcaaatcccgcccgcgcagcccgccactgactgacgttgtgtcctcacatgtcagaggttaccagggagcgtcatcttttcccctgtccatttcccttcatccatctccgtaatcctgcctttctctctcttctgtcttctcccctgattctccaagccgagctcgagcttccaaaccctaggcctcaccggggagccatatccgccacgccagcgatgcctctcgccgcagcggcttgacggggcctgcccccaaatctacctcttcagcggagaggcgctgcgtggttgctgtgggaggcgcggcgcgggtcggaa

SEQ ID NO: 2920 - DNA, 298 bp, Zea mays
tctaggataatacaatgaattaataatgttatgtgattatttaccttgcctattatatttcatatacttattattttattaacacatatcacattgatgaaggtatgtctttcataaccttcgtccgaagatcattatatcctaagggaaataatgcttcgagggacgaaggacattaacatttaacattttgtgttgccttgttcttaactcatagcatttgagaacaaatccccaacattggcgcccacctccggtgaactcttttgaccaccttcggcaagcactgaccttcgtc

SEQ ID NO: 2921 - DNA, 89 bp, Zea mays
tggcggcggaggctgatagggtttcggcgaggaggtgagattgggggaggggaggaggagcgtgcgggaatttgaatttgggagaggtg

SEQ ID NO: 2922 - DNA, 1158 bp, Zea mays
tgtgtctagaaagaaggttgccctacccttttataactcaagggggactttacagtaggaactcatattctaccgaaagggagcttggcttgctgcctctaggtggttcggtcgtggctcctgcaggggatcaaacttctagtgcccagtcttccaccgctccctgagggggtcgccgttcagtgagaatgataccttgggggcgccagaggcgccttcgagtgcagaagaaaggcaagaaagccttgcaccctatcgagttgggcgagggaatcgcctcctcttctgactcagagggtgcgtcctccacaccatcttccaccgctttcggaggggcgaaagtcatagcgttggtgggtggcccgtcgtgtcgtggcgatgcagcagttcgctctaacgtcccggccgagacgggtgggccgaccatggatcctgccctggtcatggtgacaccgaccgtgggggtcaccgtctcagttggcatggcgccgcgccctgtggtgccttcggcgcccgaacgacgacgcgcggggaaaaacgtccgggcttgattagccccactacgtagtggtggtggtggtgggctcagtccatacgcggggggcacacggtacatgccctgatggcaactacttggcacgcctttgatgcgggctagggttctatacttctatcctcgcgggtacacttggtgaaaacttgatcgttcgtcccgactcgtgaacttactcggtgaggtctttgtcatccatgtcgcattgtggatttgcttgacagagactttatatagtccgcctccggcacaaactaacttaggtgttgtttggtttacaaaatgtaatgtaaataataatggtaatgatttacactatagtacctgctataacaagtttaaataggccaatatccatttttagtgttgtatctaattacagttgaacttaacaaacataatttaacgttatcacgccactttttttttttgatcgtcttcatcccgcatccggcacaaaccaactgcatcaagctccaccagagaagacagcccgccgaggcgccgacggccgcagccgcgggcggactcgtgagtcgcgactacgccgctgcagttcccaactcagggtgcctgcccgtaacctacccaagagcggccccgcc

SEQ ID NO: 2923 - DNA, 623 bp, Zea mays
cggtacccctggtccgcgcctctacccaccccgccgccgcgccgtacaggtctcctagatcaacttttccgtcggccacctcgacacccccctgacgttggctcctcccgtcagtgccgtcctcctcgctcttcttcccctgacacaaacgcacggacacggccggaaggaagtatgagagagagagagagagagagagtaaaccagatacaacatggagagggggcgcctgtagcgctacgcgaatcgttcgcaccttgtcagacgacaacgcatcctcaccggcggcggaggacatcgtcggagtctcggagacgacggtagcggcggtcgaaggaggagatcggagacgaatcgatcattcaacagacaacggagccgtcgagctcttttaccaggagagagttggactgaaccacacagaaactggaccaggagcttcatttcggcccaataataggactaagggaactacgggttactcggcccaatcggacatgctcaggcgttagggtttagctcgcggcgtctgctatataaacttccgcttctccaaacggcaccgccactctccatctattcctcacgagtgatttcggcggcggcggcggaagtaagaggcg

SEQ ID NO: 2924 - DNA, 757 bp, Zea mays
tatagtgaaaacaatactactatacaagacataaaattaggtgtagtttatttatttactggtactacttctttagtcataattaggtgtactagcagcagctacgccctgacggagacaagcacacacaatagaaaagagcgccctcgtgctcagagtgctcgcctttagtttcgtggctactatatactagctgcgacgatttttattttctttctcttctgggctatcattagcacggccatttaggggtaatgagcagcggccaataaacaaagccctgagatgcatggggtagccaatcgggtgtcgccgtgcgcgcgcgcgcgtctggcctcctgccctccctttccttgctaaataaagcaagtagcagataggggaaagtctgctcgcaagttgcatccgccctgcgccaagaaaagccatcgttcttcccacaaacgcacacatagaagcatcattcccctctcggctagcttcttcctctctctccctcctcctcctcttcctcttcctcctcccttgggaaacctgctgcctttgagctttcttcttcgagagctcccaccagatctcctcctccttaccttctttggcacgttcggcggcgcgcgcggagaaagatagatcccgccatcgtcgtcgtcggtccttgcttccgatcggagggccacaaccacaacctctcgctccatagcgtgcaagcgcgagccagggtcaagaagagagctagctagctataggccggagatcg

SEQ ID NO: 2925 - DNA, 326 bp, Zea mays
tcgcctcttacttccgccgccgccgccgaaatcactcgtgaggaatagatggagagtggcggtgccgtttggagaagcggaagtttatatagcagacgccgcgagctaaaccctaacgcctgagcatgtccgattgggccgagtaacccgtagttcccttagtcctattattgggccgaaatgaagctcctggtccagtttctgtgtggttcagtccaactctctcctggtaaaagagctcgacggctccgttgtctgttgaatgatcgattcgtctccgatctcctccttcgaccgccgctaccgtcgtctccgagactccgacg

SEQ ID NO: 2926 - DNA, 1500 bp, Zea mays
ttatcttacatttgtatcatcataaatctgacatgtcatctcttatagtttagtttgtctacatcaccttattatctataacactatataccagtttaaactttgcaaaacccacccaatcaaatcactcacactcttaatctccaataaatccaccaaataaattgcacctaaacttaaacataccatcaaaatcaacggtttagaacgctagataaccccctatcttttactcaaacctaatgagcaatactatttggatcctccctcatcactcactccctcccacataaccccgccgccccagcccccctcccccgcgtcaccgccacgccctccccctctctcgcgtcgccatcgccgtcaaaccctctcacgctgccaccgcaaccactgttgacccctcccctcctcttggatcgtagcgttaccacgagytatatgctagtacttactctaagtatcgtgttgacactccaattgctgacttgatcctgcctcatctaccaacaagcaaatctaggccctcagttgtttaggctgtagctaggagtgtgatcgaactggcaaggattattagcacagaaatcatcgaaccttgaaaaatgagtgtgtcatctcttttctccccttcaatattaatctccacgcatgtgtttgacattcatacattgcttatgttgctagctcaccaacgtagtgtttttagttgttggagtaactagttatagtgtagttagtttagtagctagctcttatgtggcaaaatgttctaatgtagaataaaattactaatagtctcagtagcaaagctagagaaaaattgaggagggtgcgtttagtattttgggtgcataaattttttagaggtgcgtttagtatttttgggtgcataaattggtgaagactgaatatgcttttgccttatccaatttggtcactgtttctattgtgtttagaactgatgtacaccttttgataaagaaatcgtcactttggggctgtttgtttcggcttctggcagcttctggccaccaaaagctgttgcagactgccaaacacgcagcttttcagtcagtttctataaaattcgtttgggtaaagaccattcaaaatcaacataaacatataatcggttgaatcgtcgcaacagtagtaatccatcactttatagatcctgagccccatggacaactttatcttccttcgcacgtaatctaattatactcagattctctacacagccagattctccccacagctagattctcggaaaagctggtcagaaaaaagctaaaccaaacggggcctatacctgggcttctattcgctggcccatcgagctcacttccactttaacttaccctattacctttctgctcgtggtgagtgctgacaccacctcacgcacacaagccgccggcggcgaccagaccgaccacctcgcgcactagccttgctcgcttctcgtcgccggctcgttgccggctcgtcggcacg

SEQ ID NO: 2927 - DNA, 1500 bp, Zea mays
ttggtgtaatgatattttatttattgtttgtttgtattgctacgaatagacaaactagtgaacggggattctgaagcccaatagtttgaaggatatgagttggagctcacagttaaatgcaagttgtgtcccttgatcatattgttgacctaataatattaacttttatattcctcaccctctcatgtactgttaggttaaattaatgtgagctcaataggttacctagtttgcttcaccctacaccttgtttaataaaaagtgtattgttttcgactgctagagcttactcgctaaaaagaacacaattatttttggtaggtacctaaccgctagaaaataaacatattttcgacgtctactctctagctgccaaaaataatacatttgtttttggcggctaatgtagagctaccggataattaacgtggcttcctaaagttccttgatttactgtattgaattcatattacttatgagaaagtgaacttgactcaatttgtcaggtgagagttgtggtcatgcacttagccatattggttgaagtcctcattaactcaaaattaggtggcagttttcatcttattgaatattgcaaaaccacgtaattctttattgattggtttcgtctctctacatagccattagagtctatcgtagcaacaaccgaaaacttcatgctaggatggtaaattaagtctaataatagactaacaggaaagcacattgtcaatgcagccccgtcattcttcatttttccttcatgtcatacaacattagcactaggcataaaaacactcttcatagatcgacattgatgcatgatggttctagagtatacatgataaattaatgatgcatcagttattgaatgacttgcaacatggtttgcatgcttatcaataataatctaaataaggactatctactattatatataaatatatacttctatacacttggtctttcatggcatctcaaattttccaagagatatatgaactttgcattttgtagctataaatatatgttgagcgaaactctgaactattggaggaaaccaaaacaccatgttttgacttccacatgtagaattgataagtaacatggtaaggaatgtcacaataatagaacaaaacagctatatttttttctccatcgccccaaaaaactcaaaccctatgattgatatcttttcactaaccaacttcttgatttatagtcttcttgaggatgaagtaggtgttgcagttgctggagtacccaaacctgacgtagctggagacgacgctcaagacgatcgaggccttgctgccgatcgtctttgctagggagacacgacacttgaatgagtgcctcgtcgataccgtcatgggtcgtgccttcctcttctagggtgacaactaagctgaaagcttcaaagagttcaacatcgacaacatatgtggcaccatctgcgtcctcctacagatatttgtcgtgctcacgttcggtacccaa

SEQ ID NO: 2928 - DNA, 666 bp, Zea mays
atcaataattccacctctgttgattcgtgggtccactttctatcggggttgaaaccgtctggaaaagataatcgcaataagattttgccactcttgcgggctcatttaaagcaaaactgtctcagcccatgaagcccaactagtatcctggacagtccacacactcacctgtacgctacccgaaaatgaaaaagtcactgagctcagccgaactgacgccataaaaaccatggctaccatgccgccgccgtccccgtcgccgcgtcatcccccgcgtaccgccttgtcgcctcgctgcactgcccttcataacccatcgacctacgtgtaccactgccagcttctcaacggcacgccccaggggcatgcgccgccgcgccacgcgcgcgcgcggccctttcgggagcaggagcgggacctcgccgcttcctacgcgcgcgagattggctcctgcgtccgcgtgcggcgctggggcgcagcgtgcgaggcgtttgcgtcaatgctcaccgcgggagccgccccagacaggttcctcctcccgcaggtgctccgcgcttgcgccggccttgggtgcgccccgccttgcatccgccgcgcatgcgctcgccgccaagggcggggccgagctagcggggggaccccgttgtcgggaacgcgatcgtcgcc

SEQ ID NO: 2929 - DNA, 659 bp, Zea mays
attattggagacatgttgcatcacttgaatatataggctcaggttgtctttcatgtttaggatttaaaatgtagaggaggaaaaaagagtgagtcacattctggttgtggtcgatgaggtttttacttaaaaattcacaattggataaagcatgtctgctatttgcttcttgcagttccaaaaggaactcctgtaatgtaaaaaaaaatacttttgcttgtatacacttagcttcttgtaacatgttgtcttggaaattaggttgtataccacaagagtctgtttgcttaaattcactagaatgcttgattgcatgatgttgttcctactaaatttgttgtcttattttatcagtagaagtttgaggttccttgatgcagtttgcgctagaatggaaggtctttctaactactaggagcagttcatttatcctatttggctgttggagatctattaccagttgatgttctgtttgctttttgaagaggaaagacatcctgctattacctctctgtctgcccatttgggacttttcagatatcccttaacttgtaatctacacctttcgcaggttgggaagtaattttccaccaaaagcaaatctgcctccatttcgctgtgcaatctgccaagtggaccaagagccattcgaaggttta

SEQ ID NO: 2930 - DNA, 1220 bp, Zea mays
catgcgtgtctgctttacacgtgtgggatgataaatagctaccaattaaaaaccactttccatccaatatagaatacaaaaggagtttagtcctttcaatatattaagcatgtataatatagatacagcgtcacggttctccaaatataaaatacatctaagacacagttaaatataaaggacgtatataaaaaccttgtatcttaaattaatgcttcgtattctttatattaaagaatgattgatcaactacgcgcgtctactattggtgttggcaatgtgagatttggaagacacaggttaactcatacgacgcaacaccgatgttgtttcttcactcttgagcgatgatctagagtcgtggcttcaacaagagccgtttcttggttgtttttgcaattagcccctagacacgactcaagatatgggttattaattagttttgtacatatcctaatcctctcgctcccaaacaaatcgtgccctcgggaagctcgggcccaaaaggagaacaaagaggaaagagctggattaggtccaggtcaaaatcagaatgaacggcaccggttaatgatgatatataaataaataaagtaaggcgtcgacatcggagccgaattttttgcattttggtccttaatcggaaaaaaattcacgtttagaccctagaaaattttaatggtatttttggacccctttactcggcgccgtagcctgtggcgccgaggtaacacagctcggcgccataggctatgggcgcgaggtacgtgctgcgttggcacaaacggacatcgtgacgccgacgtggtaccgagctcggcgtcatagatcttggcgccgagctctgttctgtacaaaaaacttgcttagctcagttggtaaaattatttaaaaaaatagtgttttttaagtagccctaacttactaaaaatatgcagaaaaaatctaaatatcgtggagattacgtgtgaaaaagataaaatagtctacaaatttgagaatttagaaaacaacagattcttataatcgtgattagacggtttttgtaaaaacaagctaaaaaacttagcggtcataagctgaaaaaaggagaacaaaccggccaaaaaagccgcgcaaatccacccaccagtccactaccccgcacgctataactgcaaccagcgtagcgtaggctcgcggcggccgccgacaactcgggcgggacacgggagacagcc

SEQ ID NO: 2931 - DNA, 1020 bp, Zea mays
tgtccggaccgtccaatcttacaatgtcatatatggtgctcaacaaaaggcaaaatcataattgttttttgtttacaattattgttttgcccctacttttaattttggatgttcattaattatgactttgcccctatatttcacgccgtcaagtaccttcaatagaacatgcccaatgtgatcttcgttaaaaaaaccctaaaatcacaagcgcgcttccatctttgttgtaaacggtttgtctttttcccgacgtgtacatgaaagccatttaaaacgtgtctaacgtggacctaaatagtaatagtatgtcttatatgtaatccattgctctccctacgtccttaattgcatttaattgacatcaactttggtttccccctgcatcaatgcttgtaccgaacccaaacggaagctgaagatgctaaacatatttgacacaccaaattgttgaacgttgctccgtgctattaaaattcacacaaattagctttacagaagcttaaatataaagatgcccttcaaacatcatttacaatgtttgtgttggactcctggaacttccaagataaatacgctsattttcaggatttctgtacgttataggaaaaaaaagattctcatgctactgactccgggtataaacaaactaaaggacatcagtgaatggacaatagactagcactagactaggccatcagtggattttcttttctttttttacttcaacagactgcacaaatttcatatagttcgggaaagctgatgcaatttacagcaatctttactttgaaagatcctcgtttcaatacaacgacgaaaacatatttcatataaccaggcaccaggcagtggcagaaacaaaaacgaagtgctacgtatagtcctaggtatagcacgtatacagagtagaatggcaaccctgtcacaaatatgacaattgtctttcactgtacatcagactacgccgaaggttgatcatgctggggagcagtagagctgctgccgttcttgcgggac

SEQ ID NO: 2932 - DNA, 295 bp, Zea mays
cgtgctgaatccagacaaggcggcctgcataaagtcgtgcccagcgcgcgggcggccgtacaccggccggggctgcagtaacatataccagtgcccccactgagctagcagctccacaagtgattgctctgcccacgggtactacacgcatgcgtgattgttgatcggttgtgttgtgcatttgctggttggttcgaccatcgagatcttggttgctagctagtagcatgtcttgaaataattatgggattatttacttgattgtgtcagctaattgattctgttattgaagtat

SEQ ID NO: 2933 - DNA, 800 bp, Zea mays
ttcgctcggctggaccggtccttctgtcaagtctccatgcttatcattcgctgctcccggtcctcggcacgaacctgtatgacctacacattcgtcgtcgaccactgtccatgtgcccacacctgcacaccacaagccgacagacatgattgcacaacacatatattcaaaccccggttagtccacgactcaacctgagatggaacccgttgacaatcactcatcatcaacccgaatttaataaatttaataaaacaataactatgcaagataaatattaatattttattgtataactcaacatgacacactacccgttaacaattactcatcatcaatccgaatcataaggaacaaattaatattggtttcgtatttaataaatttaatatgaaaataattatccaagataaatattaatattttattatatattcaattaaaattaaaatatatttgacatcttggaaaccatcagcacagatgaaaagagacggagagggagctgtagagataagacgcaacatgtcagctgttggatgattagcgaggcatattattgaggtgggagtttcagaaagtagagagcaaatcaacaagttgaaacaaaacgcacaaagagaaccaagatggccccagcacgaaaatcgcccaatacacctaccagcccctccaatttataagtgcccccgctaggtggaagacgtccaatacgcatycaaggcactaggcagcaccaactttcctagctaatttgcaaatcgcgtggaagagggagaaagagagatcagcgaccgagc

SEQ ID NO: 2934 - DNA, 295 bp, Zea mays; identical to SEQ ID NO: 2932

SEQ ID NO: 2935 - DNA, 1500 bp, Zea mays
cggcggatccggcaccgacccaccgcccctctgctcgctccttccgccggaatcgctgctcctctctgtgctgtcgatttgtgcggcgactgttagtttggttcggtcccatccttctgttggtaagtgatactaccatgccctgagaggaagaggtgcttttgccttttgctttttagttttagattagagttgtttcatttcagttgatcctgccctgagagtgagattttacctttcactcttagttttagattatagttcgtttcatttcagttgatcttgatcataccttgccctgagaatgagatttatgtcctaatatgcagcagtaatcttgctagcttgatcggatcctgtactaaccagttcgtgtcagctagtattttccgctcctttgatcaagaggggggaggaggcagtgcttcatgtgtcatacccggataatcggaagcagaaatggatttgatatgcggtggaggcgcttgttactagtcctgggtggctagatctcatctcatggttctggtttcaagtggaaagtccgttactcgtgggaaacgaatgactcgcatagtttttcgttggatgtttttgctcatcgcgtggatagccgtgggcccacaatagtttctgtaaatcttgaggccaggttggtctagatcccatccagtgattattgtggctttgggcttggcagcctaactaggtgcttagtgagcttttattggacgaaccttacatagcttttcctagctaataaatatatgtatattcgtgtcaaatcttgctaacccgagccagaatctttgtcaggttatcttggtctaaacagctcaatctttcaaccagccagctattgtttttcccccccttcccttttggcataaacaatccagtttataatctcttgctagctggaatcggaatgatgggcgccactactgtcttcttgctggcacatggactttaggctcccatcgtcttcagctaaatgaagtatccagcataggctggatgtgcagcagcagcaataattctgatccagtacagcttcttcattttgttaggctcagtagcacatgggcgggcaagtgagcatgtctctgcctgacaggacaccttatgccagattataaaaagtattcagaggcatgattaatccactttatgattgattcagtgttatatgcttttccttcaaagtcgttagtcctatttaccagctggtccttgttcagagattcattgatggtaataatcttgctgcaacctgagttcctgacctagagacaaggcctgctaaatacaaccttgcattccttttacttggctatcacaaactgctcttagttatcattatgtgcctgaaaaccatatggcctttctcttattaacttaaatttccaagccatctagcatgaactaggttaaaaaaattgtgctttaacaagtgaatatttgagatggtctctgaattcagattgtctgtgcagatca

SEQ ID NO: 2936 - DNA, 528 bp, Zea mays
gacctgcagaaagttttctccattggcaatagaataccttttaaatttggaagttggaaacgctggaatgcaggaaccatgtatgctttccatgacttctaaacttgctgtgtttaaatctaattttggtacatgctttatttattagcataaaacagcattgcaaatatggaacttcttgttcatttaaaataaaggttaggcccacatgtcatcgagcaatcaagggcatatccaggctgcgttgtgatggattagccattaatttgacgtgccacgtgttattctgcacttcttgtcattttacctggaattttggtcctggtaaagctaattttgtgtttccactggtcctttgtccttatagtatgactaagttgattaccccctcgccctccatatttttcacatttcatgtactgcggacttgtcttagggttatattttttctgtttcgatgatatgcatgcaagtctggtcgctaactgatggttaatacgattttgaacctgttcttctttttcacag

SEQ ID NO: 2937 - DNA, 100 bp, Zea mays
ggtaatttgcctaataacatgaattctgctacttcttcttgaactgttgacagtttttttttttacccctgacaaataatcatttttgttcttttgtatt

SEQ ID NO: 2938 - DNA, 1500 bp, Zea mays
cgcagttggctagagcgtacgtctcatagctgttgaacgatcctgaggtcgagagttcgagcctctctcaccccaaatttcggacgaagcaatgatgaaacgctcacctgtcatcttcccatattgagatgcgagcaccttctgagcttcgttcttttttttttatttactagacttgctgtgtgggtgagggaaattgaacgaacgaaattttgtgggtaattgtcatagtggatgaagatttaaaagtttatatttaaaggtgcgttttgttggagtaactagttttttaaaaaaagagttattttattatacgtttgctaaatagaatagagttactttatttttttggttagagggtagaatagaacagagttgctccgagatgtgagaaccttctgagcttcgttcatttttttttatttactagacttgctgtgtggggtgaggaaattgaacgaacgaaaatttgtgggtagttgtcatagtggatgaagatttaaaagtttagatttaaaggtgcrtttggttggagtaactagaattgtgtggtttcattctagttttttttaaaaagagttattctatgcgtttgctaaatagaatagagttactctattttttttggttgaagagtagaatagaacagagttgctccgttctctatttagttggagaaccatatgagtgtagatggtaggagagagatgagagcgctcgtatccgatggtattttggagcgggagtatttcaattatttatgatagagtttcacatgaagattctaggagtcaatctgctccttttgttgaaaactaaccatccaaaaaatagtaataaagtcactctattttttctccacggctcaatcaagcacacgattaaggttgaatgtgcacaaacacctccataaaattttcgaatttaacgatggtcggtatccatcggttgagattggtattgatggagccatccaaccaaaaaaaaaatataacgtcgcgtgaaaccgatcgatcgacaccgacgaaaccatccgagagaccgatcggtggcaccccaactgaccggtcagtcccgatcctggaccaaatcacaaccgatccgcgctggttgtctgatgctcatgcaggcgaccgaaaacgagagatcacaccgctgtgcagcagcgctgagccatatccctgaccctgacgccgctcttggctgctattgaggtgtcttctctctttggagtggacaagtcctctttgcgtgcgaatccggcgcaaacggtgaatttcagccactctctagtttcgttctctctgtcttccgaaagtgaagtgcaggaccggaaaacacagcgatttggcagggtaaaaagctccaacagccacagccgtgatcattatatcctatctatctacgctccaggctttgaggtgggtattcgaccgccaagcgccaactgcttagctcactcgtacatcgccacatcggtgaagtggtgtcgtggtgacc

SEQ ID NO: 2939 - DNA, 128 bp, Zea mays
ggttagtaaaatcattgatagaaggtataaacatacatactgtgaattttattccatcgtgaggatcatttagttaggcaagtgcagaatctcccaaaaaaagggtgtgccttatttatgctgattct

SEQ ID NO: 2940 - DNA, 1500 bp, Zea mays
gcctgccacggtctccatacgaatttgaactcgggacatgggtacatgacgcatcctatccttgtcggactaacttaggagtgttatctctccgtctgcgagtttcatcgtgacaaaaaaaatatcacaaaaaagaacttatccacatttttgccatttcagaaaaagatcaattaggctatctccattaaatcccatattttaattttctatttcaaacttcacccatcgaagcagtaatttggctataggcaaattttagtctttccggtacaacaagatgactacgccgacacgaaaaattcgaggtaacccgaacgccattcggaaattcctactttacggtcgtacttttttgattccgtacttgtgtctttcacggacgggcaaagtccgaaagggacgcccatttccgagcagtctgcgcgtgccggcgtgcgtcagtctccgcgaccgcccgtgagccgtgatctgacgaggaggcgcacctgcttcgcccgcgctgcgacgactgacgactgacgaggcgtgcggcgcgcgtgaggaggaaggcttctccatctggcaaccggcggcaggaggacgatcaactccgcgactccacttcctcacgcggcgtgtcctctccccggtgctcatccgtctctgtcatcctgctcccatgctttttttttagttcctcgcacggttcacgcgcttggcgttctgttccgtagccgtggtgatgattgccgttgttgattgggagcagctgcgattcggatttggattcggatttgatccggtccgatttgacgtgggtatgggttggttgctgcttcgtcagagagggtgtgcttgtcgcggcgcggaacgagcttccttccagtcccatgcgggccggtagccgccagcagagctcgcgtctgcctgggactgggagcgacgtctcgctcgctttcccccctttcctgtaccctgtgtgatgtgaggaatgacggtctccgcactcatggtcctccccggtcgcggtcgccctccacggttgctcacccttgtacggccctttggttggtccacactttttctccgccccccccaaaccacatcgattattgcgttgagcgcttagactcttgttgtctttgtttttgtggtcggcgagcatggtgagcagctcgcggtgggaaatcgccgggggggtcttttaacgctgatttcggcctcgtcaattgattcgctgttttttttgcctgtctgatgccacaggaggaggcggaggcggctcacgggctctgattggcggatggcgcgtcggatcggagcagtcgagcttcggggatttcctgtccctctggaagggatgaaatgcggcgactacctggtgaactgggtggagctctagtgccagccagtgttcctgctgacgcctgcctcatctagtccccccttcgttcagttcttgtggcgagttgttaatccaccgtgtccgggatccgtttggcctggggttttgaggag

SEQ ID NO: 2941 - DNA, 1500 bp, Zea mays
cgcaaagaggagaaaaaaaaggctggtgaggtgtgctcggtcagtagctgtagctggttggttggtgaagctgggatgggaacgggacggtacacgtagtggaagccccacacaacacaacgccaagtgtcgacgtcgccgcgcgacccaccagtccacctttgccaaggcgttcggctcatgcgtccacgcgaatccatccacacatgagagtgatccgagaggagtatagcgtgtggctcacttggcttggttcgcttcgacagtgggaactggagaaaaaaaaaagcttgtggcgctggatgtagagcgccacttttttcctctggtggtggaaagaggaggcggcgcacgagagacacggtacaagatatatagagagataagaacaccagcaaaaactctaaccacaacatgcggttcatttctgctagcttgctgcgacacttgacgatccttgtgatctcccgtcctgccagctcgaagcttccccaaaattccaaagcttttcgccggcggtggatacgcaacctaaacgcctggccaaaccccagctactaccgaccggctcacaccaaatgataaaattgtcgcggggcttgggatggagccctgcactgttcagttcagtgtaccagaaacctaactgcgcatcagtatctcctagtcctattctatatccatctctcagcagttcagtcacccaaaatattgttttacactattttatattttatattacattatttataaagtgtagtttgaatatgggttatgtccaagcttcgaacctacgctgcttcattgcttgtcaatactgcttatcgctgaatcttttgttctgggtgcgtgcgtgagagcatgacgacccatcatcatcattcatcagtggggagttggaaagtctctgtttcgctgcctgcacttggctggctctggctctgcttctgtccacctcaaccgcactagcaatctagcattcgtgcggccggtcaccttctgttggtgggtggaaggctggaagcatgggagggtttcagtctccagagtcaaagggggagccagcaaactcaccatgaacgcgatctccggacctctctctatctctctgtttttttttttaaaaaaaaagaagcggtgtggcgttgctgtaggagcaggcgagcagctgcagttctcgttgcgctgtattgcagtaggagcaaagcatcgtccaatcaatagactatacaagcatacaacctccattactatacatacaaccatacactcactccactttgcaccaacacaatttcaatgccacatctactacttaacttaagaaggtcaaaaaaaaaaggttagcttgaaaattttacctactacaggtaattacaacaattgcactctcttctttcttccttttttttcctctctctttctttctctctcgctttttgattcgacacgcaaagaacggcaggacgacgcacatgtaaggagcaggaatgcaggacg

SEQ ID NO: 2942 - DNA, 236 bp, Zea mays
ggtaactgactccacacttcacagcgcagcgcaggcgcagcacacacccatgacccatccttccttctcatggctttggctttgctctgctctgctttgcttttggctgctagtaggtctttgcgctgttcttgaggccgaagaaggagcacaagtaccgggtgtactggaacgcgtaccaccactcggtggggtacacggtgatcgtgctgggcgtcgtcaacgtcttcaagggc

SEQ ID NO: 2943 - DNA, 423 bp, Zea mays
gtaggggattcaatccctctcaatcccatggatttgataaaaacgaacagggcctaagatgacattcatcagcgaattttcccaccgctcagcagtgacctcgttcccgtcctcctcgcatccctctcgtccgccgccgcctggctcgcgccgccgacagtttctcggcccagatcgagacacgcccgccatcctacaccaggtgccgaggccttcgccgatcaaagagatcccagacagcaggtattccctcccacccccttctcttccctgctgctgtgcgacgccgagttccccacccacctcaagctatttggctgttcgatgcctagtaactttctaactatttgcgaaaattattgggtgtccatgtgtacacccatgtccttctactagattcgtccgtgccctgctcctcgaacc

SEQ ID NO: 2944 - DNA, 1500 bp, Zea mays
ctcttgagccccacctgaagcctgaatcaaagttcagttttcttgggttcctggacaccctggtttcttattggaagattccacggacacatgaacaggatgcaggctcaaggggcttcatcaccttgtccacattattatatgagctagctgaacaactactgtattattataggggaaaaaagattatgatgcatgtgcagatcacactgaggcaacttgactcactgacctgtgactgatcatgtagcagatagtaggtgaatcttactagtattgcatagcttccacttttattttgtttcagtctgggtactgggatcatgtgggctgttgcctgcagtagtaaccagtaagagctgccggcatcctgcttcttgctgaagaaagtttttgctgtgtgcttaagaaagttaagaagtgtcgtatttcaatacaattacttctttggagatactaatccacaaagataaagatggcgtgctactaaaagctggagtttgacatccataggtgtttcctgaagggcgtcgtttattctctatagctacacacaagcaatttcgttgcttaaactttttgttcaaggaaaacaccacatgcacatccttccaagagttgctgcctttttcaccttaaatcctcatgaacaccctccaatgaacctatgagcaataatttgaaattctctagacagtgaccagagcacataggagaaaacaagcacatggaggggattagcaaaacggcgcgaggaagcttgctgggtccttctcctggtatcctcttcccccagacagctgacctagagctggacctggcagtatggctctgccctcccagggcaactgagccaaaatttagtattttccctcttgttttttttctgttctttttttaactgaacaatacactggtaaataaactagctgtgacacttgctgcagcagttacaggatcagaagcctacaggtcacacaccacactggaacccctcttgtgcctttttgctttccgtgtgctcagctcactcagcatccagcaagcctcccctggacagttcttgagcaatgcatatttttcagggtaacttttttgctttaaacgtttttttttttttgtaccaagatttcttttgtgaattggcagcggtgcccctcctccgccactgcctatatatgtgccctcaaacccgctccattgctctgtagctcttccctctgctgctctctctgagcctggcccttgccctcctctccctccgggaaccagccctgctctctatgctcctcttccattcatagcctcggccttcgtcttcctccatggatccgcgctaaatgcattgcgaggttccaaactggtagcacttctccctgctccatctgccgcaagatgtaagcacggcctcacgccctcacttgacactccgactggccatccagaatataccttcagatcttcctgtctgcgaaaagcgacgcccttttggcccgggca

SEQ ID NO: 2945 - DNA, 277 bp, Zea mays
attggcttgttacaaaatgtataggagcgctgctgggtctagggccagcgggcctagcacccacctgtcccccgcagattcgctcgggaatccgtccaagactccaagtagccaaccatatcgcaactgctgctccccgccggcagcgtcagcggcgacttctccctccgctcccctctctctttcgctcgccttatcgcccttctctcgcccgcgacggggaggtccgccgttccgatcactaccccttcgcgccgctgacctcagaggaggaggc

SEQ ID NO: 2946 - DNA, 86 bp, Zea mays
ggtatgttctcttatgtttactcctctgttactgattacacattctttccttatagtacgatttttctaatttacagcttataagg

SEQ ID NO: 2947 - DNA, 354 bp, Zea mays
ctcttctatccctaaccaacccaatattgccggccgctctataagcgcacaggccacaggccctatatatactcacataaggtgtatatgacacatgccaaacaaaaatgatgttaatattttcattatgacataaacagggtttggcatttttttaggatccacatgacaattaatggtatgtaaccattagggtgaacaggtgaacttttgatgtcagatgatactgtatgttgtctttaatctgtagtatagtttaaagtgtgttattgattttttttgtatttacagcttcttggttttgctgagctgaaactaaaggaagcaatctcaaaggagccaacccttctgatt

SEQ ID NO: 2948 - DNA, 580 bp, Zea mays
tgcattacaaataatgaatagcaataagaaacctcagatgaactgctaaacttcttcaagtactctgtaaaaagaggcaaacccagtgccggaggctcccatatgagcgcttgttcggttattttcaatccatatggattggaggggattgatacggattggaggggattttgacttactagggattgaaaccccctcaatcctccctaatccatatggattggggtagaactgaacaagcccttattcttcagattcatactgacaactttctcccctccctattctggtgaaacatgcagccatgccagactttgctcgtgtatacaacttcctgggaagcatatttgatccagagacaaatgggcatttgcagaagttgaaggaaatggatcccattgatgctgaaacggtattcccttcactcggtttccatttaaaatcaaggttcagctaggcgctaggcggaatctaggcggtgacccattgcctagcgcctagtcgggagtactcggtcttaggcgcttctaggcgcttttctaggcgttttggcaatatagccataaattatatatatatt

SEQ ID NO: 2949 - DNA, 201 bp, Zea mays
cgtgagtttgttttctagcattataacattacaaatacatgaatagctcacaaaaggcacaaactcataagtatccttttggctggacctttgtctacagctaaaatatcttctccagtgagtggttatttccttgtaaggaacccaagatacacaaatcaagggaagtttttgaagttatctgactttctagcaatcgca

SEQ ID NO: 2950 - DNA, 585 bp, Zea mays
actaacgaaccaaaggctatagcgaagaacaaaggttaccatactatatcaagaaagaaatgaatcactcccagaaaagaagcgatcaaaaatcacgttgaaaaaggaagaaacatgaaagaaatgaaacggttgccccgagccacctaggaaagtcctagacgccggcgagtttttttcggtggagttaattgaaccgtctcgggatcgtccttgtttgtggcggtgcggcgtggtaagagagaacttgggctagcggatcaataacatgttgcctcgttatgttctgtgaaagagagccgcgatttgggcctccctctattttggcccatgagcaaataacccacccggcttctctctcacacacacttgcctaatccagccacccgactcctatcggttaccggcgacctcaccggcggctaaaaggatttgacttgcggccgccgccgcgcgtcttcgaccgtgctctcccaccccaatctccgggttgattactaccagagactaactcgaatcgtcgatgagcgctcgatcgatcccgtgacggagcggctcggttgctccaaagctccgttctacgcc

SEQ ID NO: 2951 - DNA, 1141 bp, Zea mays
gcggactagcagagcacacaaggcatgctcattgctcgattaagaacactcctaaagattcttccaaaagctaatgtaattggtaaactagcaactataccaaataaataaaatcaaataatttttgttttttatctttttctatttccatagttagcttcttaagagcaagctcaatgactaaccaaaaagagcttcttaataagaaagacaaatctttatactaaactcccaatcgatctacactcagaaaacaggtgtgtaagtatgtgccagccaacaactaatattccctgtcgatacaggccggttaatgctgctgcaggtaaatccgatggaccgattcttcagtgacatatcctcttactatacggtgcaatttatttgatacagctacaagaaggaataaaaaatattgaagagggtgacaacaaggaagagcagcttatcaagagtatatccaagagagaaaggatgcggtgctcaattctttatggaaaattaatgtggtcgatattgagtcaacgctttcacggggtctgccaccaagcaggaaaatgaagtctgacaactccattttaatttctgtttttactctttttctccaggttttgagagaaaatgatattcccagtgacatactgaagcaataaccaaatatagaaagcctgctattttagaaatctgaaaagcaataattcaaaaatcaaatatcctccatctttattcagaattcagactttaattttgctatgatagattcattcattgttaaaatatatgagactgaaaccagaaatttgctaccccggacgaccatgtgaagaagataacgtacgtactcctcctactcccgttcattcattcgcctggaacgttcagagaaaaccaacgtggcacgcccgtgacacgcgcctttctctcgtcatacgtcgcgtccctatgtgcctgcaatgcgcgcgcgtgtcctcgtcctgtcttgcgcatgccgtctctatcgcccccgttcccggtactatatagacacgggcgcatttcgcctccattccgctacagctaccagacaacagtcaccggcacgcagacgctcagcaagagccaacaggacatcgtcgctcagcaagaaacaaggggggcaata

SEQ ID NO: 2952 - DNA, 154 bp, Zea mays
ggtaaagtagttgtgagtcgattaatagattttgattttttttaacaagtatacggagcactagtacttcatatggagcttcttgtgatattggttctatgcatgtactgaggaaggcgtatggccggaatccctgagcttccaaaacgatacc

SEQ ID NO: 2953 - DNA, 872 bp, Zea mays
ctatatcaatatgtcacgccctttggaatgcatgaatttcagaataattatataggaatcagttcatcagaaaaaaaaacacggaaaactgaaaaattctgcaatccaaaaaagaccctaaacttattgatttcaacgatttattatccctatttgtaatcttatatgtaaatccggaaagctattatcatcgtcaccttttcttttacttggacagtacctcgtaacaagattgatctgtaaattcggcttcagtatttatcaaaaaaaatattgaactgatcacatagacatgtaacagtaggttcaaaaatccaattttaacttaattttaatatgatttcatagtgaataatagtgccaaatacatagtagtacaggagaattcgctggagcaatagaacggtggaccaccgtcagtcaccaccccgcgcggccatgttcaacttccaaagctgccgcacagcaccgtcaccgcgccggtgtcctctgcggcgcccacctttttttccccgtcctctcccgcccgccacgcctcccaaggtgcccgccagaaaacccgtgtccctacgtggtagctcagcgacttttccagagcacggcgtggcccaccatgccacggcgccgcgcgccccaggccccagcccagccccacagccgccaaccaccgtccatccccgtcccgcccacgccctgcgcggcccggcaccacgcccacgcgcaccgcgcgcggcggtttgaaacccatccgccgcccccctctatttatcccgacacacagccccaccccaccccacatctcctcacttcacaccactcccgccattgtcctgcgcctttctgcaccgccacacacaccccgctccaatcca

SEQ ID NO: 2954 - DNA, 658 bp, Zea mays
attgtcggcgtttcgagacaggggggtccctaagccgacgagtgagtgtgctgcgtgccccagcccagatgggtcgagcgcgtgggcgagcgcgaaggggggagaggcgaggtggccggagtcgagcgtgagagaggtggaagtcccgcggccttcgtgttcgtcccgcgcccaggtcgggtgcgcttgcagtaggggggttacaagcgtccacgcgggtgagggaggcgagcggccccaagagagcgcctgtcccgtcctcgtcccgcgcggccaaccttctctaagaaggccctggtccttccttttatagtcgtaaggagaggatccaggtgtacaatgggggtgtagcagagtgccacgtgtctagcggagggagagctagcgccctaagtacatgccaatgtggcagccggagagatcttggcaccctgctggtgtgatgtcgtggctgtcggaggagcaacggagtttggcggagggacagctgtcggagcggttgagtccttgctgacgtccccctgcttccgtaagggagctgagagccgccgtcgtcacagggctagcggggcgccatcattgcctatctggcggagctagccagatgggacaccggtcttgttctttgcagcccgagtcggctcggggtagggtgatg

SEQ ID NO: 2955 - DNA, 1500 bp, Zea mays
tttatttgtatcgccgacatgggcctaaattgttggaccatatcatgcagcacaacatgactgaatattatattacatacgtactacataatagaatgtatctagtaaaataaaatgagaggtatagtatagccaggggtgggtgggaccgcgctagcgctgcctctggctgccacagacagacagagacatcactggcaaccggcatccatgcatgtttcacgtgtagcaggcgtggctccaactgcatgcatgccacacgggccgtcctcgtgctcgtgcacactttgaggctggtagatattttttagctagccagcttcatcagctagctctcggatccttgtgtactgagagagcgtatgttagctgggacatcgcatcgccattattcaccaatcacatctggactagtactctaactcacaaaactgttagatttgtgtgtgtatgtatcgtaaaaggtagataagcaagtgaattagagccgttgcttttgttaccaaaggaaacaaattaaggagaatatgcttcttggagtggagagaggaaagaagctagctatagctggcgacaattgggtgtcctgtttgtcatatatcaagcatcacgtactgatgcaatctgcacaaagaaaactgtcggctccaattcgagaccaaacactaggtatatactctcctgtcagtgctccttgtgtgagccggacagtcagcgatctcaccgcatgagcggatcttttctgcgtccggacttcggacgatccacgcacaaggattcggatggtccacgatgacgtagagcgtccgttgacggcgtggaaccctagatctcgcctcccaagaggaacgagtcgaatagagattcaaaaattaggtcgagatagaccaatactaggttaattactgccattcctaagtgaactattcttcttattaagccaacttaacatggtatcatgagttcaaatcatgtttagcacaattaaattaaactaaaataattattgttcacttctattacacgtctaacacccagatgaagtttaaacttttaggttgaataattttttgccgacttttatgctctatcattgcatagccatatatactagagtttttttaataaaaatattagaacgtttatgctctattcaacggttggttgaaatctggtacgaatatattgcaacttttttagataatattttttaagggtcaattatatacgaatctagctagatactgttacaaaataaataattacagatcccgtcgccatctcgcccacacaagccggtttttctttccttcgtttatgtatgcagggcctgcggttctatttatgtatgcagggccggtggtatgtcaagaaaaaaaaacgttttctttccttcgtttatgtatgcagggcctgcggttctatttaaagcttgttatcgcaggtagtagaggcacatcccagttggaagggcagccaataaggtaaggggtgacgaaa

SEQ ID NO: 2956 - DNA, 246 bp, Zea mays
aagcaaatgaaggttctgaatatctgcaaagatctagcacctgctggtttagctgaggacgaagttctgttgcaaacggttttagatgaaaccattaacactctgagacttaagtttgaaaagattctgggaattcttcacggatcacctagaatggatcacctagaattagttgacgttgccctagtctggacactaagttgcgagagagaaacatgttctttagttgcacttttaatttgaaat

SEQ ID NO: 2957 - DNA, 1190 bp, Zea mays
ctagcccaaaatgagcacttccatttacagataactggcatgtcataactcataagacagggatattgggttcacagaaaacaattctagcgccaagatgagatatcaatttgttgatgtatgctagtgcagagtcagttttagtacttaagaactgagaatgaggaatatctgataaggtgactagtgatttgaagaataaagagccaggtggtctggatcaaattttggttagtcttgcctcttatatcactgtttccaggatagaattttcagtactgcaactgatgttgtatttgaataatggaaaatattttttctccctgtaaacaatagttttgtcagatgtaaatcttatccacagtagaatatgatgccatataatgctgttcagattcattacaatcgtgaagtttattgcgcctttttcagagactggagagttgatgacacttctgcaaataattcatctgctactgttgttgaacaacaagaaaatcattggttgctgcatgctttcaagaatattttgctgcgtgatctatctattctcctcatcaattgatagagaagagtcgctgagagaggtaatctttatgcttattcattcatttcgatgagacaaccataccaaggtgaattgggtgatccctaggtctaggcttttcttttagcaatagaagcttccaagtaattcatggaggtctaaggatgttctcctcaagaaaaatagggattgtctgtgtctttgttatagatgtggcaggtggagtaggactatggtaaacaagggttttctcttatttttggctgagaaattgtagattagtggggaaactatcctaattatggcaacataatgtcagcttgctttttgattaatagtcatgtttcatgacctttttttgttctagtcctcttctttttttttccttggcattttcccagtgatctacagtttacattgcgcaagtcatgtcaagatcatgacagtttttatatacatggtggtagttgagatgcttaaccatacacatcaacacaaaaaccatgaccaatctaatactgtaaccaatttgcttcaacctcagtggctcaatttacttagtacttaagcgaagaagcttgagacgtcccataaataggccagcatttgcaatccaactttagctgccatctgtttctgaacc

SEQ ID NO: 2958 - DNA, 62 bp, Zea mays
tgcaggccgcggcaggagaggctgccgtggcggcgccggcgagggctccggctcactgggcg

SEQ ID NO: 2959 - DNA, 188 bp, Zea mays
tgtgtcaccccaccacaccgccctctccgatgctgcctccctcatgataaccctctccctggtggttgttctttgccttgttgccgtgcagcctccacccccaccctcctcattaatcacttgctagctccctgcctccctcccggctcccgctcccccttctcgtgcttcgcgcccccgcagcagcc

SEQ ID NO: 2960 - DNA, 951 bp, Zea mays
tgatattttcactgtcggtttctttaagaaaaacgtcagtaaaaataagccagtgtaaatagctctaggaccgtcactataaagcttatgtgtactagtgtcagtgagtaactgcaaatacttcttttttttgcctcacctcgaatccgtttttaacgcctcgtcgctctttgtatgaccatatttacgtgatatacatgcattcacatggatgctcatttcatagccccctctctctctttacatggtcctacaacacaactacaacacacacaccaaactctcaaaggccggacgccaatgacattgcagtgtgcaacgcaagtctttgttggcgtcattgtcttgccgacgcgtcacgtacgtacagtagtaggacacgttgcgcgcccacgccacaccacaccacgtacaaccgatgccaacggccaacctaaggaagaagtcgaatgattgtactgatacgatacgagactgaattctctttggtttttttccccgattttgatttttagtacgactagtttaaaaacttaaatctcctctaagattctattctcggatacgtattgagtgtgtttcccatgtttgacagcaaagaaatagaggggattactgctaaataagcccttcatgagatgctacatataaattgcaatatttataaaaaaaaataaaagtaaaatagaaggctaaaaataaagatttttttggagatactcttagactgaagcatcgaggagggccgcatgcaatagagaattgatgggccgaaggttactgtacctttccagcggggcagagccgcacagttctctcccccggctatatacacgcgcgcgagcagctctataaattcagccagtccaaggctaggacgagatcagttggtagttcaccagagttcacaaaaaaatcacaagcaagcagttgcgggtgtagctcgcaaca

SEQ ID NO: 2961 - DNA, 373 bp, Zea mays
ggtattgttaggattttgtaaaattattcttcaatcattgagctcgtttacactattttttttaattatgtaggtggcggccagagacacatagttttcatcttccttttggtgagatgacagtcacattatattagaggatacacagaagatacttggactcgatgttggtggcagagcagtgacaggccaatgtgactctgacggttggagggctagagttgaggcttttcttggtagagagcttcctgctgagggcgttgaaaggactgctggagtaggcatcacatggctccgtcagtcttttggtgtgtgccctgctgatgctgatgagggtacattccagttctattgtcgagcttggatcctgcac

SEQ ID NO: 2962 - DNA, 1500 bp, Zea mays
cgatctggactcagaaacgtgaaagaataggaagatcgatctgtgcggacattcggctaccaaggacaccgaacggcgaccaaaaccgaacccgaaaccaaagctgccgagtttggcagcggccggtacgggcgttcctgccataatcgtgcgggattccccaacggaacaccgatacgcatccagcatccatcctatactgaggaacggaaacctcagaccggttggataacaatgccagtctcggacatcgccgccgctccacgctcccccgctttcggcagcgccacggacaccgatgccttgtgtgcggctttcctttccgttgccttcgcccaggcctggaagccatcagagtcagagaacggcggcggaaaggagcggaaaaaagggggaaaaaagaaaaaaaaaggcaaaaaaaacccgtcgctttgcttcgtcttgagttgagccacgacgagcgcttttctggtagtggtaccatgaaagaaacccgggcaatcttctccccagtcgccatccgtgaccttgggcgctggccccctaccacgagacgagactcttcctctcccggcgcggcgcctctcgtcgcgccgcgccgtacttagcagacgcacgcgcgcgatgcggcgtgggtctctgtggagtgtggacgactgactactgtaggcttgcccgcgcatgcagcaagccagcagcatggcagcgggggaggtgccgagcccacatgccatgccatgtccttgtcctgggggtttcgaacacggcgcgcgcggcctgcccgccggatgtacagtactgtactcccgagtcccgtctcggacggcgctccgaggaacagagcgtggcgagcgcctagacgggctggacgaggtgagctggatggcggagggccgaggacgacgcttgctgggacagtctacacactgcagaccgtgcaagctgccgagacaggagtcaagattttaacgctttcgaggctggccagtgcgagcgtgtatactacctcacctcaccctctgaacgctgtaaaatctactcgcataaacaaacaacgactctaactctatcctcacccctgaagcagagcattgcaagagaaagggccagcaggacacgcgtcgtccgcctacgcagcgggagcggcgtgcggcgccgttggcccgttgcatagaaggatttctttttcccgaaggtgttagtcaggcccggccctgctcggcccagcccatctatataagcgcccgcctctctccccacttaaagcaagcagccagtgttaatcatagtagctccacacgcgcggaggtagtatagccgggaggggcacagagagaggagcgaacgagaggaaggagcagcggcaactacacgccagagagagggaaggggaggttggccagagagccgagagcagccctgcagtcgagagcatccgactgctagctactagcaatagcataggcagataagctcgggccgggccggggcacgcgcaca

SEQ ID NO: 2963 - DNA, 1500 bp, Zea mays
gaagggggatcaagatgaaggacgggctgattaccatgctgtacgaaggatgatgcacagccgaagctatgcgcaggaaagcttcgtcgcgatagcagaaaggggaaccgacctaaagatgaaaagactacttaggccttaataaactcctataagtcatttgcaaatgtaatgggcatgaatgtaattttgcatgggctgcgtcccacgcctataaatagatgaacagtactcccgtactggacacgctgactcggcattcgcttttgcgtcatacttgtactttcatcttcttctcaactaaaggtacatttgtaattcaatattgtccctattttttctatgacgatttaataaacttgatgatgatatatgattatttatgttatctttcatgtttcatatgctttgtctttcattagtgaatattgtgatgaaaaaggtctgtctttcatgaccttcgtccgaagatcgttatatcccaagggaaataatgcttcgaaggacgaaggactttatcgtataaacattttctgtgttgccttgttcttaactcatagcatttgagaacaagtccccaacaatccacacattggtactgaagctatataggcaaacactctccacgtcctatcaaagctctagagattagaggcaagcgtgccctgcatctttttccatgccatccgcctctgacccacgcgccacccttacgtggcaatcggcggagccaagccggggcacgtgcctaggcaggctggaaagtagctccgccactgaataggctcttcctagaaagagaaaagcttctctaaaaattaataggagccgagagtaaaaaggagcttcaaactgcccatgtttttctctagtcggtgctatatcgtaggaaaaaccatatgatgagctattcaacaaaacgtgatgttctttctaaagctttttctttaaataaagtggaagctattttttaaggacaagagtaccaaaaggagccttaaatcgactcaatcacaactaacataaatggattaatatcaaatcgaaccatcggcgaccgtttcggaatgctgcgtgtggttgtattcctccgaccttaacgcgtggaaaaagggcaacaaatatggaagagaaaacccaaccagcgaaaagaaatcgggtgtcgagtcgtcgcacggtgttgctcgccatatccccttcccccctcctccctgcgtcccccggctccggcgatccgccgcacctgaacccttctccacgtcgcctcgccggtaatcgactacgttctctttctttaggcagtcggttcgtaccccaaactcggattcctctttctgatcctcctatacacgccgcgtcgattgtatcgtcttaggttgggttgaggtgagccgatcagatccgatcggggccggtccttgcgccactgctgcgtgagctcatctcggtcgcccgcctgctcggctcgatcggccggggacggcggcggccagatctgca

SEQ ID NO: 2964 - DNA, 969 bp, Zea mays
ctaatgttttgatttaaagtactgatatacatgtcactatattgccttgggtcaagtctatattgtatcctttaaactctaatcataaatactaacaaatatcgttagttcaactgattatattgattatcggacaccaagattcattaattaaataggtttctatctatttttcttacactagttattagtttttaaaaataagacatcaatttattccgttccacgaacaaacgagcaaataaacaaaatgagatggcgatggactatctcgttctttaacacaaatgttccctatagttaatggcgtcgaccggaacaggacatgagtgacgtttttttttggctttggcttaattgctccatagcccctctcgatagctgagtgctggactgctggctgctgaaacaaattgcgacatgccgattcgggaaccggaatttttcttaaggctagtttgagaactcaatttttcaaaatatttctattttttaagaaaaaataaactaaatccctttgaaaaaatataaaactcttagaaaaaattctaaggttcccaaactagtactaaacattcaaagtggggtactagaattcttcccgtaccttttaaaaaatcacagtcccaatctgacattcgaaaaaagggatatctgatcaacgcgaagctttcggtgcgcacttcacggggcatcgtcatcgactcatcgtcattctgaacaacacgacacagcgccacagagggtggagaagatacgacgtttcagaattcagatgcacgctgcagataccagtttgctcaccggcaccatgcgtagcgcatgatctattttcaatcctgcctttgatcgccattcctaccaactcaataatataatatatcccgtcaccagttcgatcgacataattaacgcgacgtcgtccagatctcgatcggcccggtggccgccgtggtcagtaaggcaggc

SEQ ID NO: 2965 - DNA, 547 bp, Zea mays
aatttatttgtactagtctatcgcaattaaaaaaggtgtaaattttattttaaaattcagacacctgaaatataagagagacgtcataatgatataggttgattcttaaaactaaagttgggccggacattatggaacgtcttgtcctagcttgtcctgatgccattctctcattatattcccggtccaggtcaacgcggaaacacggccatggcaagctaaaaactttcttcagagcttcgtcaatcttctctttgaatgtgtacgtgatggaaagatacagtaacagtacctagcaaagcaacaggtaccgaactggccggcccgcttcagcttctatataaatgctgctccgctcggtcacatccgaatccgctaccaagatactcctgcaccgattaataaattcatgcagctctataatttatttgcataaagcagcgagagctcgatcatcatcaggaactatctacccccttcaatttgcagccgcaattaatctatcggtcgtcgtcagcttgcgagcgacaaggcgcgacagatcgag

SEQ ID NO: 2966 - DNA, 586 bp, Zea mays
tgagtcttttataaaaaataagctgaaataagcaccctttgatgagcttataggattatcataatctcaaatgctaaattatataattttattagataagttgcttgtttgtttccccactagcttatttacattggattatataatctacataaattataatctcaaacaaaaagtccttaatcagagatcagcgaggtctcacgagtgagaaggcgagagcttgtccaaacgagcattttcgggcgtgtgaacacccatttcagcaaagccgtcgttgtccagttcagcgaagcgcattctgcggctttggcgtgacccattctgctagctcagcactgagaatacgcgtccgctgcagcgttggcgtacaggccggactacattagccaacgcgtatcggcagtggcaaaccctcttcgcttctaactccgctgggccaccagctttgaccgccgcctcccttcccctccgctactgctcctccccaccccactcccccgcaggagcggcggcggcggcggcggcggcgaggtcgtaccccacatcggcgagcggcggcggcaccgccggaggcaaaggcaag

SEQ ID NO: 2967 - DNA, 530 bp, Zea mays
gtcatccttttcctttcgttcgcctctccctgctccaacagagtttaaatggtaaaaaaatatttgaaccatggttgttgaccacaaatacacattgacaccaaagaacatgtatgtcgttatgtcccagacacggcttagagatgccccacccacctgtccggcgcagtccaggagaaagaacacgtgcatgcagttcaaaaaggcccaccctgcccctgctgtccgtaagtccgttctcctctgctagaatctgaggcatatgttatatgtatggtatggtaacaagaatccgaggaagggtggtacgagggagatggaatgaacaggctgtgcaatgcaagcaacggcggcgatgcccaacctccccgtccgtctcacgtattccttctcgccatgcatggacatggagctagtattcatcattcataaatccgcataccgtccctaaccggccattgaaggccctctaacgtctggttttgcggaggattattattgggacaagctaagggcccgccggcagcagc

SEQ ID NO: 2968 - DNA, 1104 bp, Zea mays
gtagcctatgattaaattggcattcaagtggcatacccctggcacacatttgattggttatctgcaggacaaactgcatattcagaccgaatttctcaagagaagagctaaataaggaaaagtaatactacgagatgaaaagttagatgatgcaaggctaaattcagtaatcttctcaaacaaagtgccatacataatgaatttgcaacaacatttgactttctgaagtcggaacatgttttagactcatataagcctttcactagagctcaataaaatgatatcagtaccgctctccgaatttgattgtacataccaaaatctctgaaactcagaactcagttaaagtcctccttgagtcattgtacacacgatcccacgagcaaaatgatcactgaaaagtgaagactgaaccctaattttcttcccaaatccgagaagaaacaggcagcaaagtgcccacccaaaactagactttagctgtggaccagaccaagatatggccaaaatatcttagcctaatctgaactattctagcataactgcccagaaagtgttactgcaaccgagattatccttgcaagttgcaaccacgcagagaagtgaagcgtccgattaagggagttgcttaccttgaagctggggctaacgagggccatggtcgcagttctagcaagggagctcccgacgggagtggataactccattgagctccgcctcggaggtcgcaggctcgcagcagcagctgaagccgcaaactcccagctcccctggtccccactcctagctctgaggggatcggacggttgacctgatgttgtctcgcttcttaatccatcctagccgttggttttcatatactagcccacgagacccagcccagccggcttggatctcaacccataggtggcgctctcctcttcggcttcggttgcaagaaagaaaaaggtcacctcttaacaccaggccgccgccattgctgctccctttgttcgtttctcggcaccctcgatcccgagcgcggttaacccacgcatcgaccggcgaacgccaccgtctcccatcgagatctctcccatctagaatacctccgtgctcagcgtc

SEQ ID NO: 2969 - DNA, 331 bp, Zea mays
  unsure (1)..(331): unsure at all n locations
gtaagttggtgaaaatctataggtatatttcattctgaggtgattcacgagagggacacaaactttactatcgttaaatatagacatcatctatgcttaaatgagtaaaatatttctgatggagtgcatgcattagcttgttgactaacactgtttccttaatgttatgctacagattactctgttcacttaacagagttacacacttacatttcctaatgataacggacctctcttgaatcagaactttcntgcatttcgtaaattgcacatttttgccccatcaagctctcaaagtttaccaggcttttgaattgaatgctgaacacag

SEQ ID NO: 2970 - DNA, 1065 bp, Zea mays
cccaattctctctccttgatccctgcacggcgacttgcttgggaggaaaatgaaacatgtgcgagcccggctgtgtctgccatcttgaattgcccttgctgcaaacaagctcacatgacaataagaggcacggcttaatgcaaccacatgggagcgagacgcccccatttccttcatcctaggtcgttgccaccatgaatgttgttcctgctctacagacagatctcccagcgcgtcgtccatccatcctctattcctcgtttcctgttcatgctttcgttcttggatgggtgccaacgccatgctcctctgccccctcattctctcgcggactccaaccgtgtcctcctgcccgctccccctgacagcatacgcggcgtgggcacccgaagcgcttcaatggctctccctcggaggcccggccgcggggagatcttccccattttattaatcagtgttttaactatgaaattaattcttttttatataattaatgcataaaatgtgtattacggtactacaaatacgatgatattttttaaaaactccaaaaactgattttttttgcaactaccactgctctgatccatccacccctgcgagctactagctctcgtcccctgcgcactcacaagagaggtcggccggtagaccagacggcaagcggtcagctcggcgaccgtcgtggagcgggaggatcaggcgctgctctcgacggagatcgtgaactgcggcgtggagccgtccggcggcccggacgctggctcgccgacctagctactcggtgcgcgtgctccaccgcctgccggacatcatgcagtcggtcaacctcaagtacgtacgtgtgccttgggtaccactacctcaccaggcacggcgtgtacctggccaccgtccctgtcgtcatgctcgtgtgcggcgccgaggtgggcagcctcagccacgacgagctgtggcgtaaggtcgatcgggactcgggagaggccacctgcgcgatcgacctcgccagtcgccaccgtgctcgccttcctcgccggcctcgccttgaccatctctgtctacatc

SEQ ID NO: 2971 - DNA, 1288 bp, Zea mays
agaggatccgcacagcagactgcacgtactatgctagcttacggatggatgaagaagatgacacggttttcctttggtgacttcactgcttcgtctcgtgtctcgtgacgtgtgatgaatgagtacatcatgttcgaccgatctgttatcttgtggaacagaataattaatgagtatattgtattatattacaattgtttcagtggaaaagtaggtgattgttaacttgtgtcgtgtgtaagatcttggtagatgaacagcgatgaatcctttccaaaacaaaagatatggtagatgagaggttgttcaactatttgccactcacgttttggaagcatgcacgctagcggtacccctagggccctcacctcagcattgctgcatgagtgacactgtttcggtgtggtacattgaatttgttgacaggcagtcactagcatgctatattaggtctgctaattcaaacggtacttctttatttggataatctagtatttatctgaattcatttttttcaatctcatccaatacatatgcatagaaatagcagaacaagatctaaagaggtagattatttatttatttctctatgggtatgttaataggcataaatctctacacatgtgccctctttaattcatcttaaatgtagcctaagggcttgttcgattagcggtggattaaagaggattaaatccctttctagttaaaattgaatataaggagatttaatccctcttaatctacttcgagctccatgcaactgaacaatgcctaaattacagtcgtggttcaaactagctacaaaatatatatctacacctactgaattattaattgatacagttttgttactatgttatcattgtcaatttctgcttacaaatatatatttgtgggtatctggttcaatcatacgacctatggtgccgtcaggcccgtcaccgtgcaccgtcgtcacgtcgtgcgacgtgccatggctcatccgcagtgaccttgccccttggtgctcgctcccgcgctgcccgcgcaccgcgcgcccgctttggtcgggcgtccgctgcccactttgcgcgcttccccgctgctcccccgccgtacgtaaaatggacctatccacaattccacatcacccggcgcctctccgtcttcctcctccctcgccgtcgccgcgcccccaaccgtcactaccgacagcagcacggttcaccccgggcgcgagggcgacgctgccgagggcgaggggtgcgtcccgccggatcggcgcaggagcgacacacgcgacgcc

SEQ ID NO: 2972 - DNA, 67 bp, Zea mays
tggcgtgaagtgaaggccggctcgatcgggtgcaagagctagactgcactgcaagtgcaatggagtg

SEQ ID NO: 2973 - DNA, 1313 bp, Zea mays
tttggacggtatttgtgttgtctataataatatgaatattgtttgaatatttggatgacagatttatatgaatatttggacggtgttttgtatgcgtattgggaggatatatttgcatgggtattggacgggtggtttgcatgaatatttgaagatatatttgctatagaagacaggctattatggacctttttaagacgtcgttataaaaatctaacgtgcgcgtcctgtgtgtttcttgaatcttgagtcgtgaccgatgataaaaactactgtgtatttacagtccataggaagttagagctgctgccttgacgtgtagtgttagtaaatttttgtttttggtttgtgtgcaagttggcaaaataatctcgtacactttactttatattttagtgcgatttttcgagttcgagctatatcgtttatgattgttgtatgcaagacgtaggcgtctatacataagcagttattaaagattaaattaatcttttttttagaatcttgaaacgacccatcgtccacagaagatcccacctctgcctctatccacagaagtccgaagtccgacctgctcgcctcgaagcggaatccacctgaccccaccgcttccatcgtcacacgtaactacccacgcgaacagcgctcacgcctcatccacagaagatcccacagtccgcttctatccacctctgcctcaagccctcaaccggtatataaatagggccgaacgccacccgtttccaatccatcaggccaatccacaacaacgcatcttcatctcctccaaacaccagactccgagttcgaaggaagaaagcttgaaagcaaccacggtaatggcgtcccgccggttcttcgtccacgatccctacgactacgaccaatactacacagccgccccgtaccattacgagccttactaccagccgcagtccacgcccatattccgcagagccagggacgtctttgcgggcgccgagccggcggccgcgagagcgagatccgcgcccagggcaacggagacgcagacgtctttctcgatcccagtccacgggcccgactcaccggagagggagcccaaggcagcggaagccactcgcgcgggaccggtggcgccggcgatgtcggcggaggacgccgcagcgaggatacaggcggcggcgcgcgggttactggcgaggaagtcggtgcgggccgtgcgcgaggtggagcgggaggcggagcaagtcggggggaagatggcgtgccaggcggaggctctgcgcgtggatcccagggcgcgcgtcgccgtctgggaggcgctcatgagg

SEQ ID NO: 2974 - DNA, 251 bp, Zea mays
tgcctgcagccttgatagcttcgaccaaggggcttccggtcctctgcatccgcacggcaccggcaccggcaccggcaccggcaccgtgtgttagctttcaggaaatcccgagctgatctccgcgagttcccattcccacgctgtaggctgtagctgtagcttgtagtaggactctgtagctctgccctgcccaacccaacgcttgcatcgcagccgttcctgacgcagagcagctctacgaaaaccacgcc

SEQ ID NO: 2975 - DNA, 1211 bp, Zea mays
ccttttgttggggagatacccatagaatggaattaagagatttagggagatccttattcccttgtattgggagattattttttagactctcttggagatgctcttaccaccttaataagtagtatagatatacataaaaaatacccacctccctcgagcatctctttatttccttactagaaaaccacttccgccatagagagtaagtcgatcccaacaaagagttgagtggaggtctagagccaaatccaatcaaacaactagagttgaaaattaagcttgaggctcgcgaactggctcgagctcggagcagctcatgagactagcgaaccaagtttgtattttaggatcattggtcaaatgagtcgagtctgtattttaggatcattagtcaagtgagccgagccaagccgagctggctcgtcccagccaactaacgagctataccaactatgttgaattaaccattccacgaaatcataatggatcattggtttatttcttagtctttggctatggatacatgacaattcacattttagattattcataatattaattaatgattttatatttaaatactaccaatttattatataatgcaattatgtttataaaggtgtggcttgcaagtcaacttctagccgaactactaggatgtcgtttgacctttttaagattaagtttaatcaatttgtcttaaaataattatgaaaatataaaaaaaaatagtttatagttaaagtaaatggtactacctccatttttaaacagttgacgtcggatagtttattttctaactaaaaaacattaaataaattaaaatggaaggaggatgataaaataaattagaatgaaaataaatcgatagttataatttttctttgaataaaacgagtcggttaaatttaaacttaaaaaaaaagtcaaactgcattatttgtgggacggcttaaagccgacgacgcggtccgcagacacaggcgcgcccgcgcgaacccgctggcttgcgaaagaaggagcaccaaaattgaacgaaacctttggagggaaagctcccgccaacataaataccattccacccaaacccacttctttcgtccttccagaatccagacccgaaatcagatcaccataattcttcgaagccgcaagcccgaaaggaaccccaagaatcgccgagagatccgaagcgaggtggagagatcgag

SEQ ID NO: 2976 - DNA, 1179 bp, Zea mays
tgtgttcttgttggcacgcaaacaagtcgaggagctttactttaccgggctactggaaatcatggcgtgggctacccctacgcatgcatttcgcgggagcatggtgtggttggcctgatcctgcaatttctgcgggatgatgcaagacaggtaggtaaacggcggggcgcagcgcatcacgacaccgcgcgatccttggatttttgtaggcagtgtggcaggcaatgctcgaaatcaatactactactactacaaatgtaggtaggcaaggcatttgtttctcgtaactgaaggcacttcgatcgcgttcgttagcttgggagcacacatggcgccaacgcatttttcaagtgcagaatctctgtggcccgcatttgaagcgtgggatgtaatttttttcttctttcagtgaataaagttaaactggttcgttacgaaacttttgtgaaggattcctgtggggtggagatattggacagtggcagtgtgatttttagccctcagaaaaccgcgaaccaatcagcaaccgctgcgggttgtttccgctgcctgaggagcgagcaacctcgttacggtttgagcactgctagtaacataaaacatgcatgcaacaacaggatcgcaggacacatcacatgtttacacttaacgcgtggtgcagtgcagactgcagagtacggtgtgtgtgtgggtaatttacgaccatggccgcaccacgcgacagtaatcctgtacaaagatttgtactactaaaatgatgatgattctgtagcgtcctaaaccccctacgaccgaaatgattactcacaccctccgcctctcccggtcccggccaagagcgtgccgtgccctcctgctcctctgccgatgtgcccccgtccctgctgctctgtctgtcccccaccccaccggcgccaccgtcaccaaaccatcccccttcctgcagttacacaccataaaagctcccccgccccgctcgccgccgcggggcgaagcggattaatccagcaccgaaatgacgtgatccccattccattcaccctcgtcgttcgtcactgcacctgccggctgtgccgcccttgaaaaatcccaccaccttcctcgccctccaggcctccactcattcctgcccccgacactcccactgccaccagtcctctcaccgccaggcgcggcaca

SEQ ID NO: 2977 - DNA, 744 bp, Zea mays
cctgtaaaatggaaggaaaatgatttatatcatcatacatgttagtcttgttcaaagcattgctcaagcacatatatgtctagattgaaactatttcattatttaaaagacaagattcaaggctatttagattcttagaccaaaacaataatgacggatatagtttatacaaattcgatatgggttagatatatattataagcaatggtccatggatgctagctcgctggacccttttactggcacgcattattcagtagaacaatttagggttccaacaatttggatcaaaacacatggcttgattgaatttgtatatgtagatatccattaagtaaagtcaaacaacaaattaaataacagtccatgaattcaaagttaagcatacatacatacctcgtgacatctttccaggtgcgcggctgcagccctggcataagccctcgaaggatgtcggtcataagtttgtcacgttgttgtactgtcacaaacttaggtcccgtgcctatgggagccctcgtccgtgtcctaccggcggcgatctcgatcgcgacgttggagaggcgacccacggcgtcgacgcacacctcgtcagcgtagcagcatcgccactcgaacaccgccagcttgggtgcgcgtaagcggaccaatgagtatttggtgaatgcggccatgccgtccccgtcgcacatgaacatgagcggcttcgatggcgattcagtatagctacatcgccggcatgac

SEQ ID NO: 2978 - DNA, 737 bp, Zea mays
ctgcagtgatttcttaaaatgttttatcatcttaaaacaaagtgattaaggtgcagcaatctgtgttccctacacgctaattttctgttacggatcctaaaaagatgcttataaccgattgtcactggcagatctagaaaggaataagtacttctgaaaaggccaccacattgctaaacagatccttgttcttttgggttggtataaacagagttgctttgccaagcattgaattttgtggactttgcactcttatcatttgcacttgataatttgacacttgatgtatcatgggcatttggttcatggggacacatgttagtgaaacaattgattagtcaatcatcatatccttgttctcttcaattatgacctatcttggcatggtactatgacttaaaagaggaacttggtaacttgtcgtcatgatttataatttggacagcacaatatcaatcactgaccatgatattagtagcaaagtttcagtgtaacacgtaactttttcagatacttttatttaaattttagcaattatcagtattttctttgttatttggggaagtttgtggagccacaaaatctttcacattgttttctcctttttattcctgcgactttgtgcctccagtatttttttcatggaaccatattttatcaacccatatccctaagccttgttcccttatactrcatcctgcatacatgcactatgttctgatgtagtgattggttta

SEQ ID NO: 2979 - DNA, 1500 bp, Zea mays
aaaactatagggcactctctcaagtgcctcaaatatactacatcgtagtggactgtcctataatctagatttggggctttactgttggagcgggctgttttgttggtgccctaaattctataaaatttacttatttttaaattataaggcatttttataggtcacgttgtcggagatgctcttagtccagggactcaagttcagttagaggactaaaatttagtcgctactttatttggctctagagacaaaaaaaatattcaggacacattaaatagatcataagaggaccaaaatacctcttagcatcctcccaacattaatacaactaaaataaagaatactcaaaaggtagaattaatatggtttagtcccttttagtcattcttgaaggactaacgactaaaacaatttaattcccattttaattctacagtttgataatttagggactaaataagattaaaacatccctcaaaacaaatggagcctattttagtctctaaattgttaaataaagaaactaaaactctattttagtttctataattagtaatttaagaaactaaaataaaataagacgaggaactaaaaattagtctttaaacccaaacactatataaatccgacgtttggtcggcaaaacgacagcgatgcgtcgtccgtcccctctgaagcgggaaccaacgtgcaccatacccgtaatacaaaaagagaccacgctgaacaaaaataaacatttccaggtctccgcagaaactccacgtggctcgaggacccaccgcggtgtgtgtggatggtccagcctccgtgcgtgcgatgtcaccgccagccaggtccccggcctgtgggcccatccggcgtggcccacatgtggccgcccatttcgttccaggttgcttgcgcctagagtgttcgaatctgctactgtattgtaccaaccaactttgaggtaattctaccagcgtcatgttggcgtactggcgtaggatactgcgagaattgtttggtctcaggaatcatttcatctaagaaaaagtgatgtatcgtacgtttatttttcaagtttagtgagataatcttatttcttatgttaacattaactaattatagaaaataaggtgacgatggattaactcattatatttcataaacaaacaaaaaataagaagtgaaaaaatgatgaactaatttattttttaaaccaaacactttatatattctggttttgatttccggataatcttgtataccataatagcaatgagccattatttgtacaacacgcacggaatagtaacgtgttgaccccacaatyttttccccccctctgcatagccacataggagtaattaacgygatcctaatcgtttcaactctaccatcccaatttatttctcgcaggctctgctcggacattgcgtaatccaagagaccgtcaaggcaaggcaaagccaacaccagacgagtcgagaacaccgcagcagagcgcggcgtcca

SEQ ID NO: 2980 - DNA, 1353 bp, Zea mays
cgcaaaaaatgacataggaaaaatttaggaaaaccactgtgaatagtattagattgaatgcggttggtgggtttggatgctctaatagacctgattttttatacaaataaaacaggaaaatactagttggattttcttatataaagggtagtttgcaaacttaaatctttcttaagattccaagggaaaattaagttaatttttcccagccccaaaaatccgggagagaatttcagttttcaaaatagttgaaaatagccccaaatacggaattcaaaaatacgattggaaaaatgtttcagccgttttcgttcccaccactttttttagaaatttttttgttcctgtattttttttgtattcagcagttcatttatatggtcaattaaaatattattttgtataataaactatattatttataaaactgttttgtatttaaaactgtatttaaatatagagtgtaacatcggtcaataccggattttccgatgccgtttccatcccaaggtgtacggcagattccccgcgcaccgcgcacgccacggccgaacccgactggcgacgcgtcgcccgttgttcggtggagtgagccggggcccgtgcttgccgtcccgtgaggcccctgcccctgcccgtgaccgccccgcaccccccacagccgggggtcgccggtttccgcgactccaaatccgcgtgcgccgcccgccctctaaatctgcctcgccggcagccgggcgggggccaccacgtcacacccagcctctcctctccgcccgcggcccgcccgcttcttcttcctcgccatcccttcttctagcgcggaggcgcagatccatcgggcttcgggggctcggttccatccctctgccagctggtaaggccgccctggctgggacttctctctggttgtattgctgctactacaagcactcggggtactcagatctgttttccgatcccggtcgcttcacctcgtcgcgcttcctgtcgtctgctgcgtgttgtcgcagtaatgccagactgttctcaccaaaatcgctcggatctcatgcttactaagttgtctggtcgtttgcgtccctgtgctcaggcagctcctcagctgcagaggttgtgacggtcggacaaggttgctgaatgcacttcctttctgtgccagggattggattggagcatcttcccagcaccacccacgcggaagccatgaccattcagttgctccgctgacgactcctctgacgacagcacggctgcgctgacctgcaggcctctcgcccacgctgccctgacagggtaaagtcagggggtggcgtgtgtgggtgggggggggggacaatcaggtgaataatc

SEQ ID NO: 2981 - DNA, 471 bp, Zea mays
aaatacctgttcctgatgccgtgcgtgtgcctttttcactaacatcgtctttgcctttagccgccctgccatagtcagacgttgtccgcttatggccttcgcagtgacgatgctgacgagcgcgtgtgtcatggaccttggcggggtcctgtgtacgtggacactggacagggctgctgcccttgcgcgctgcggacctgcagtggcagtgtgtcagaagtgctggcctcattcttctgtcagggcacggtcaaatgtggggtccaggtcaggggcgcttccgcgcttatataaacaccaccaaccaacccaagtcaccatcctccgcacccgattcacctcctgggaaagtggaagggagggagaagcaaggcaaagcggagccgagggtcaaaggccctcgtcctgcttggccaagcaagcgtcgcgcacgtacgtagaggccgaccggccggccaggttgaagaaggc

SEQ ID NO: 2982 - DNA, 982 bp, Zea mays
tacccttctctcgcggcaatgaaaataaatgagacacaactagtgaaattaatattgtttagtcccttttagcagcgaggtacaaccttcaataaagttctctttagcatgcctcttttggtttattgttctcttaaagtcggctagtatttgcgttagatcattgatcttctagcttatcctcgccttccgggtcagggccaagtcctgaccttcggcataatttcaactccttaatcaaatccattgccactttagggtctattcggttgtacatggaatggagaggatttaatccacttctatttaattttgaatatgagagaattaaattacttccaatcttcttaattcctttacaaccgaacaagaccttaagggttatcccaagtaatttaaaggctgcaattgaaactttatataaaaagtcaaaatatctcaagtttattaaatttataaaaataatataataatattaatgatatcaaataagtataatttagaatatagagggtggagataacattataacaatatttgttgatgcatggaaattctctggatcgcgccagtttatttcgaggagcagctgagcaaggacaaacagtaatagcgacacctttgagctcccaacccccattgtgcggcggtagctgattttcgtcattttgatattgttattaatgtcctctgattctcctactaatatttgacgtaaccgtaccaaattgaactcgaaacacatcacattgcatgatgcatgcataacagataacactatgcatatatttaggtggtagagatcaacttgtagccacaagtttgcaagaacatgcaccacacctaaccccgacgtgatcatcggttaagcaaatataggtaaaattagcatgctaggggggcactcgcggaaggcctggccggccggagcccggcgatccatcgtcgtcggttaatcggatgagatgggtgacgaagccaa

SEQ ID NO: 2983 - DNA, 273 bp, Zea mays
tgcagctgcccgctcgggctccgtttcgataagactagggacctgtacatcgccgacgcctacttcagcttgctcaaagttggccccgagggcaggctggagagttgctgtgaaaactctcaagtgagggaacatgatcatgtgcacgcaagatcctgatgactgttggcagaatcaagtcatagttaaataaacaggcccccacccgacggcgcgagcgaggcacgcggccctcccggcggggtggacgcggcccctggctgtgaggcgacg

SEQ ID NO: 2984 - DNA, 385 bp, Zea mays
ggtacgtgcttgttctgatcgcgacgtacaacatcggccctaggcacgacgcctcaggctggcctgccgggcgcggatcacggccgcgacgccgacgcgcttcctgctcgtcccgacgttctacctcgctgggctctgctctgctcgtcctggacgctctgctctgctagtcgcggtgccgctctgctctactattcacgaccggcttgtggtagaacgcattggaatatttgttttagatttttatttttttacagcaatatgagtgatagtgccgattggaatgaagataatactgctctagtgtgtgaattgttcgccgaacaagtgaaggcgcacaaccgttctggtacccacttaaataaaaccagggtacaaaaatgtg

SEQ ID NO: 2985 - DNA, 870 bp, Zea mays
gccgctaactaacaactatacgtgaccaatgggttgtatcgtgctggcacgctcgagcccgtcatgagtcgtaccgatttaatagggtcgaggcacgatacagataaatagcagaccgtgttgtattcgtccatagaccaaagtatgagtctaagcatgacccgactagttttaaacgggttatgtaaggctatcatgcttacgtgccgaacggtctaaggtccaccttataataaagctcgaaaatatcttatgttttcctatttttattgcttatttttcttattttttgtaacagaacttaaaaaatagcttgaaagtggggatcgaggtggtcatatatatatggtgggttagactaggacaagtaagattgaaccataaacgagtcatgttggcccatgctcgatttaatgggctattcgtacttagcatcgtgttaaataggacaacagtaaataggtcgtactcatgatgctcaatgagcttttacctaagtccaaacatgaccaataaccggcctcgtgccgtgtcataccaaaataatcgtatcttgtgtcgtcccatacaacccgacctatttgatgaactatatatacaaccgtgtccccgggtgacgtccccttcccgtcccttctcagcgaggcagccgcctcccccaatttccaactcgtgctctcacctcggatctctccatccctttcgtccaaaccaccgaccacaatcagaaggtaaactgaaagaagtcgtcacatcatcctcgaatccacgttttccgtacacctgatttttctcttccccttcataattttcttctggcccgcattgccccgttccgaaccgtgaacagcgttggcggcggcgcattcc

SEQ ID NO: 2986 - DNA, 85 bp, Zea mays
aatgcagatttttcacgtgcattttgctttttttaactaaaaaaaaaatctgaaactgcactggactgctgccgccggcaggtac

SEQ ID NO: 2987 - DNA, 1500 bp, Zea mays
ctggctgtccataaaagaacagtttgaaagatccatgttttgagtttaaataagcttattttcatgcatgaagttcgtgcaaccccggtgccctttgagagcttcaagtttgaggtttgattatgcacctttatttgtgatgttggaacagtaattaccatttgtttaagttctcaaatttgcttgaccgaaactggtttgccagctctaaaactgaactcaaacttcagtcctttttttttaccaaaatttgagttactctcttccgaaatctgttgatgttttggtgttgctcttatagtgaaagttgtagagcatacattgaagaacaacatcgatgtttgaggatcacagggtcgtttcaagtggagaggtagggagggagctacctcctttcgtcgctgttttatttctttcagatttcagagtcgccgtctcttccggcggccgacgacaaagtaggctatatataatatataagtatactccaacttgactatattatatatgtagtcaaaagcaaatagggggaaaaaaggcgacgtgacgtcatcgttatctctggtatcttaaatcgtctgcgtcgtattcaggtgaaaaagaaacctagtacctacgaaaaagttggttcttcagtcacgtgaaataagcaggtactccatggaagaatacaattttaagcgtagtaccatagtataagaatatcataagtttggtaaataatatatgaacagatattagtatgtacggtattaaaacaatataatactattagattaaagtatgaattgcatttttgataataaattagtttaaagctatagctgtgaatatactatttactacttagaaggttggctaaacataaaactattttaacccataggtaatttaggggttgtattctttgttgacagatgaagcactacgtgtttgcgtggtaagcaaaacaaacggcgggcgtgtggttagcacgtgccacagtgctaggcacacgtggcaggctacytgcaggcgtgcatcaaagctagcagtaacagccgtggcgacggagaaaacgaaaacagaggccgccggaccggatcggcgccggcggatcccaaaccgtggtccgcacatcgtccagcagcagcgtaatggtggtcctgtgccgttgaaaaaccgccaccgcagctccggaagcgaggctcggaacacacgctgcctgaactgaacgacggctccggatttgggagcggcccacggcttctcgtcaggaagctgccgccgttcgttgcctttgccgcgtcagcactctccaccgcagccccggcacacgcactcgtcgccagccagacgcgcctctattgtctatataaggcagcgcgcccgccacacagctccgagacacagcaacctcccactccactgtccactccacccccaccacctttgcctctcctagcttttccttggcatcctagctcttcctcctcagccgcagcagatcgactaggaaac

SEQ ID NO: 2988 - DNA, 609 bp, Zea mays
ccttccgaggggccggccttcgaacctctgaccagtagtgggcgcggaacccaggcgctctgaggcggctgttgaacccccccgaggggccagcctttgaacctctgatcagtagggaggctcgaggcctgttcccatcatggggaaggatccttttcagggtatccccctttcctggtccctgttgtaagagagagaaagaggaaaaggaaaaggaaaaggatacgaaaacgaatgacgtggcgtaccttttttgacgcggtcattatggcgaaggcaaagcgtcgcttgcttctccttcctgaggcgccgcctatcccgccgcggagttaatgcaacggggcgagtggttcgtggggcggccgttgcgcgtgcgcgagccgttcgaggaacggtcgtttcgctttgagtctttgaatcccgcggcgggttcgggcgacgcgttgaacgggtcttgccttggtctttatatactcgggggagggtctggcgacggttctttgctctgcttcttgcctccttcttaggttttcgcaacctgagagatttagccagagaaaaggaaaccgcccacccagtcctttccgccgccaccccttctgctcggtg

SEQ ID NO: 2989 - DNA, 198 bp, Zea mays
ggtgatggataagttctccaaatatgggcacttcttgattttatcccatccattcactgctgctcgcgttgctcgggtgtttttggatcacatctataaattgcatggattacctaccaatattatttcagaccgtgatcgtatttttacgagtacgttctggcagaattattccggctcaccgacaccaagctttgt

SEQ ID NO: 2990 - DNA, 604 bp, Zea mays
catttgagttatactagatgacagcctgtgcatattgttactgaagtaaaatatcttttttattaggttccccttatctcgctgtgttgttggtcaatggttatggactatctagtttgtcaaccccattttttgaagaaatttttattttttaaagaaaaatcagttcattttaaaaaaatgagaatctctgagaaagttgataaacaagcccttaattggtaaaaagactctaatgaactacgtgttttagtcccaacatcgtgatagaatagggtcacttttataagtatttgaacaactgattttctgtcggtggttataacgctccttcaaacggcaacgcaaaaattgttttacaattcggttttcatctctatgagtaaaaaatatcaatagacttagccccaatccgttttagcaaaatttaaatttgcccaacaaatagacttagtccattgataaaaagttaattttgtcttggctggggtgcgccatgctcgggcagcagtgcaacgtccgagcgacactcaaggaccccaatagcaagctattatgatgggttctcccccgtaaaaaataaatttaatatcgaaatgaacac

SEQ ID NO: 2991 - DNA, 1500 bp, Zea mays
agtcgcttgcgtcggtttatataggttcaatgacttggctttgactagctaggcgtcccagacgatcttccgtatcatctcagctatagtattcgtcatcttaattaaatacctagcccagctcttctagcacgatccttatcctgtgctgattgagctctcactcagtggcaaaattacatattcacgtgtgtttcgtccccatctctctctaagctacacatacgagagaaaaaaattctctctctctatctatctctattttttaaaactaaatattgggatacgtaaccagttttgtgcagctaatttctttgtgcacaaaactttattggtcctgatttggttggtggctgaaaagtgagcaagctatggtttcagctaccgttcggtttgctactaaatttttcttgtggctttacctcttatgtttagcttgccacgtttattttttttgcaagtatctgtattcatcttaaaatgcttgctaatttttggcatgacaaactttaatagcagaagcaaacttaagttgttgcgttacacttccggaacccaatacacagcgcatctgagccaccagcgcgcttgcatgcgccaaagcggtggacatgcgtcgccaaagcggttgaaatttgcttaagatttctatttataagtatagagtataaaacacgtagatggatatacacctgctagattggtgttaatatgattttgaaatcaacgacgttcaaattcctatttatacataattttacctttttaccgtttaaatgtttgaaagcacaatgattgcagaaacatgctttatatattagagatagaccccttgggtttttgctcatatatgtataaatacttaatataaacctccacttgactgaagatgagtttttttaaggaggacaatctatatctatcgatcactgaagatgagtttttttaaggagaaacaattcggttagaaatcaaggacacaaccgaccgaggcctttaagttgttgcgttacacttccggaacccaatacacagcgcatccgtacgaaaggcaggccgccagaccgccagaccgccagaagtcgttccggcggaacggaatcacatcgacgtccgcccctcgtgctcgtggtagaacagttcgccacgataaataaggtcggtgaaacagcaacgtgcgcgccgcaccgccaccaccaccagtgcaggctgcagcagccagagccagcccccacccccaaccaaccaccgcactcaaagcgggcgcaggcgcaggcgcaggcgccgtgccgcgtgaagccaaagcccatctatccaaccaaccgcgtcggggctccgtagtccgttgttgagtttccgctcctcgccctcggtcgccgagtccaacagggagggggaggaggagcggctgcgctcgcaatccattccataccattctccctagtctcccggactctccctccatccctccctccctaatcttctcgtccgtcgtctccc

SEQ ID NO: 2992 - DNA, 459 bp, Zea mays
gctggattacagggacacccatgatttttttagcgcctgaaggcctaggcgacaacttgaaaaccatgaataaactagacatcatattgtaggaaattaaataatttagactgcatatggctggaaaccaagataaatcagaatatcccactcgttggaagacttgacaatctgcatcctgtgctgggacttggtatcacttaacactgttcgtcaataagattttttgcctagtgatccctggttggggtttatgccttgacttatctgcatgcaacagttctccctagttatagacttatattagaggggcataatttctctttgtttgatgtaatcattgcaacaggagtcaatttgaaaaatgtttgactaaattctccaattgttctacaattttgcaggttgaaattaagaaagctgaaccaaaaaaacctggtgtgggtgattcaagctcaa

SEQ ID NO: 2993 - DNA, 1194 bp, Zea mays
gcgtcgtatggtgtcatgatctattgcactgagctatattacatcggtgtagtaggttaccacattgaaatatttggtaaaattggatttatgaccatcaaaagtgtaaacatggattttttaggaagaaaatattgaatacaaagaattcaacccagctatggctaacyagactaattaytcatggttgttcgcgcggtgaagactaggacatgtttggatctcatgtactaaaataaaatgattaaagtttatgccccattcaaatatactagatctaatagttactaataaaattagtataagacatccaaacactataactaatagttccgttattagccaactaattttactagtaacttttgaaccaactaactattagttgtattgaattacagtctcttagtcagtttatataaactggattccgagtttcttaaaaatcaagaagcttgtctgctctagytaaaactagtttatgaaaattgattggcttcaaacaccattaattagttttttttctaaaaccagtttctagaaattggaatagaaactgcattcttataaaaaaaaagctagatctcttgccttagtaattttggtttagctcgtagaaccccagcggacctgctgtccgccggtcgctagcaggtggtttcccagcgcaaccgtcttcgccgcgcggcacgcgagcaggctgggccggtgccgtcgcccatcggcttgggacagtgacgggcattcaataacgcatcagccagtcactcaggtgggggacagttgagttgccgcgatacagttccatatgggccatggcccatggccgccccggtcgtcttgtctcgctacggctctctactgcccataccgctaccactgtacgtgcctgctgaccgccgagcgccgagcaatccttggagccggccgatcccggcgtggttcggtggtggcactctattaccgcaactgctgtctgtacctcagagctgagcagcagcggtgaattattgatccctctcctttcatgccaattaattctctcaactcccaatctacttactccctgcttttggttataaatagtggcaagtgccacctgctgcacggccatcgtctgcaactgcatcgctcgctctctcctttcactgggaacatctatcagctcgcgctcattggccatctttggcttcc

SEQ ID NO: 2994 - DNA, 1500 bp, Zea mays
cgtcgttattctacatattaagtaatttagcacagctcatgagccggttcgacttggctcgctacaacaacgagtccaaaaggatggctcggctcggctcgcgagtaggggtggagccgagccagctcgatatccacccctagatgtatgtagaggagtagcacatccggtagtgcaacggctaggtgtactacctcgctgatgagctcggggtgcacttcgtttggcagcccaaccaagagtcatcggtactcgccatgtcgtgcgcgttcgatgactgctatatcaaggactatggcgtcatcttggcgccagaggtgacgtagaggaggaccgacaacaaagaccactcgtcatcgtcggggtagcttttgtgccggtatgcctttagttctcttcgcaaacacatacacttgctttttttgtttaagcaagcgtgtatggtggtgcgtacttgataactgacaatgtacgagggaatttctaccggcaggtgtggcacgtgctctccaataatgagaccatgcaaatcatgacatatatcgaagtctgcatgatactgatggttgcaatgtagtagtgaaacaactaaattaaaataacaaaatttatgtatggctaggatcacaaatggattatgaaatattttcttataacaatataagacacattttgtatataagttatcatggtattatatgttcccgttgcaacgcacgggtactgacctagtttatgtaatatgtgtctataatttatatagtctatttgtgttggtaaattcctaaaacctattattttaataatgataaaacaacaaatttatctgtgtgagctcggatcgcggaccgtcgggctgacctgacctgcgggtcgtcgggtcaagccacaagcggcttgtactgaggttttgtttatgtctaaatatagaaatgggtacccattatttgatatctaatggatatttattttactagagtacgtatatgtgttaaatattttatttatgggtctttttttagacaaaaacttttactcatggataaatggatattagaacgttcgatgctcatttatacctttgaacccgtaggtataaaataactgacataaatttagtctaaaagtatgaacttagtcttcaatcatctatttttttaactatttaacaaccttttgagcgataatgtaatagaaggtttaacaactactatttaataaccatttatgaaacttttaatgtcttatgtgatgttatcttaatgttgctactttattcaattatctatagtattcttaataaatggttgaatgatgctagaaattttgtacagtaactagatgaataaattcatatccataagtgaatatatgtgatccagaaaaactttttttttatcatttcaacggagcggcggattgaacaggtttacaggcgcgctcccgcacgcatgccccaacccttttttgacaagctcagcgtccaccactaaacgtaag

SEQ ID NO: 2995 - DNA, 562 bp, Zea mays
taattttcaaaagaattataaattgatcgtgtggtgtgctagtgttactatttgcttcaaaatgatgtagccatttaatacatgaatgcatgattatccaaaagcatttctcagtctgagtgccaaacctttcaccagaactcccaacacctgacaggtcttctttctatcattgtacgcaatcacaccaaaatctcagttttggtgtgaatgtgagaaagttctcgtactagacttgaattcttagtagcacttccaagttgatttgaattacagtttaacacagtatcatacttaaattgggaaattggaactcagtttcatttgttgactctttgttttgcagtcattcaggggatggtgacaacggcctgatggtgggcacgctgcgttcgacagggggtacatcttacagcggctgcaactaacaggcatatgcattttcgcggaaacctgcttgggccttggaagggcaaagcagatgtagaactgtgcatcttccatgttggattaacacttgatgtaatgtattgttatcggtttttactgtgcggatctcctt

SEQ ID NO: 2996 - DNA, 404 bp, Zea mays
aaccgttgccgatgtactgtttaccgagacctctttaacgagtgccacaatcaacaaaacatttgccaagtgttgttatcaaggatttgccgagtgcggtacacgtccgcactaggataggggtaacttgtatttacgcaaactaatactttttgtttgtaatatattgcatattggacgctctatagttttagaggccatgtgcagtcgcacagcccgtaccgcggagacgcccctaatatacactgatacacacgctaccctctttggctttgctcgtggtacctatataagtctgtgtcctgcactcgatggtctccacataatccgcagcatttcttgcactccattctactactgagcggccagcagaaatggcaattgaactggacctgcaggaaacg

SEQ ID NO: 2997 - DNA, 480 bp, Zea mays
cagttgcatcctcggaccgggagcgcaggcaggctgggtcattgtggcaaacacggccaaatagtccacgtccactgaaatagttctcggttctccggtccgtttctttctctccggtccagcgcaacagagtgaacagacagtccagcaagggcaagggtttccccgcgcgcccacggcccaagacccgaggcccagagacacaacgaccgtacggcgccccacacgaggcgacgcccccgctcaccggcacccgtttacgcgggaaaaccattaaaaaaacagggagcgaacgccggcttggccaaaccccgcgccgcctccgggcttctttcccctggaagcttcctcccctctcgcgccgtttccaaaacttgctccaactcccggcacgggcacccaaagccaaaacccctcgcgtcgtcggccgtcgcggacgcttccctccattcgtgcgtctgcgccgtcacgttttccgcg

SEQ ID NO: 2998 - DNA, 1258 bp, Zea mays
tgggcatcattcgccttttacagtaagtaacaatttccgtggaattcaaaccatcacgtgttaagtgaattaacacattcgcctttccctttcttatcactatttgttgttttgtctagtatgaagttgattatgaaagccgatgtgaaaactaagaatggttgttagtttgctccgaagtatcgagggatgcattttacttatggtgaaatcctcaacaaggcttattcccacatagaaaatcagcacttttgtgatattattattattaattatcattatcaccttcatcatcattatcaacatagagctttacctaaggttagtttcatgcaaaaaaatcaacaaagtttcttgtgtggctaggttgcccatccatagattgtgcttttggtgcctttaccaaagagcatttctattttaatttctattctatatgccagtcaataatatataaataatgaaatattttttacgagttagttgtttcaatggaacaaatggttgagctaatggaacgtatttctagtgaaataagaacttttcccccaacgtaggacttcaagtaatctatgcttttttgtgaacttaggatattttaatttaaactgagattttcttttttaggaatgagcgattttctatatagaatcatagcatttttcttctgtaacataaaatctaaacataaaacaatttattacgacgctgaggcattttctcgtgaaagaaaacgcactcccgactcccgagtgatcccgagtcccgacggccgacgcgcgcttaagggcttacggctaatccggcggctacgaaaggaaacatctaccccgttcaaccgttccatttcttctcccgttccgttcaccccccccgcgagctctatctttcgtggcgcagctcggcagctgggcggccgccccccgccggcgccacgccctaagctacgccaggttcccagttcttcgtccgtccttttgctaggtcttcgttggacacttaaacggcgacgagcaccgccaggtatttatctttccctcctgctgtgcgaaaccgagtacccgaaccctaatctaagctatttggctatttgtattcggatatgatctaatgacaagctactaactactattttttgcacaattattgggtgtacatggtacacccttcactctatctcagacgcgctggtgcctggatccggcgggagtgcttcaggttttgacggttcgtctctctcgttgtttccggcggggtt

SEQ ID NO: 2999 - DNA, 1500 bp, Zea mays
gagcagctagacagccctaccttcacgagcgcaggccacgcgctcgcagaaccaagaccgccgcggcgactctacagaaccgccttaaatcccccattgcacgcacggcgcgctcccaaccagccacgcgccctagacccagtgccttgggcagcgccggcgccgagagtcatcgctcggcgagcacgggaacccgccgccgagctcagggaatctccgtcggcagcgcgcggcaacggccggcttcgagcatcgggtcgcctcccattcgacgccggcggccgaatcgggcagcgcgaccaccgggtgggagcggaggaagcggcaggaggcgcctgggtgggggctgacagggaaccctagggggcctaggccgccatggctggatcgaggagggaagtggagtggagtggtgcggtgctccttgctttctttcttcttttttcccctctcttttggtttatggggaaggaagaacagcagagagagatcttctcggagacagtaaaaaaaggtagatttatttcttccctttatatcttttaattattagaaaaatctgtattgtggctcggaaggttttgggttttgactgactccttcaagagcaagaaccatgtggattactttttggagaaaatgttgcttacacgtcgtcatcgtctttcgcgtagtttttatagttgtggtttttgtacatcacgataacggcggtgcatctgtgcaagctttaaatgagaagtcttaggccccgtttcaatctcacgggataaactttagcttcttgctaaactttagctatataaattgaagtgctaaagtttagtttcaattaccaccattagctctcctgtttagattacaaatggctaaaagtagctaaaaaaaagctgctaaagtttatctcgcgagattgaaacagggcctaattgttatccagcatcctagcctattaatagcatgcaatatctgacacatatgttgcacatgagaacttgagaagtaataaggcatatttaaaatatacatagatgccaaaaaaaatacagatatgaacatatacatgtatttgcccccttaaatggtaattaataactttgctgtaactaaatatagaataaatatagaatatggagtatctattaggtctattattttaaaaggtaaataaagataaaaacataaaatttaatatagacactctttattaaagatgtcgacaacttgcrgtgggaaataaagctgtcgactttggcatggcatgagaccgtcgacaacttgcggtgggaaattaataaagctgtcgactttggcacctcatcaggaccgtcgacaactttcggtgggaaattaataaagctgtcgactttggcatcgcatcaggaccaatcaattaccagaacgccatataagcatacgtcggtcctcggcgctgggcaacatccagccagcagcacacgcacactgttctttcgacttccatctcggccggagcagaag

SEQ ID NO: 3000 - DNA, 590 bp, Zea mays
tatataataaataaatagcctaaaaattcatgraattttatagaggcacaatatatccccatataatcytcaaaaaaaattggactcaaagagtaactaaatgattacaacaatcgtgatatgtgtgaaatagtgttacatggtatccgacaaaaaatctgttaccgacctaatccgtgttcgactagttttatatttattatacgactatctatatttgtatccaaaaatatctatatttatatttttgaatatacgtattcgaatttaaatctgaacaaaactacgaaaacaactatggtttcgcgatatctatatgcgagccaaaaggtaaggagacaacgaaaaagattgatgactgtggtcaaatcgcggtgctccttgcaatataggacgagggggctctttcacagcacaacggggcacgactctgaccaccacgccaattcgatcttcctgccggcgcggggcgcggcgcggggcgagggctcgagcggagcaatccatataacccgtttataccctacctcaattccactcatcagctcactccggcgccatcatcttccttctctcagttcctcacctcg

SEQ ID NO: 3001 - DNA, 891 bp, Zea mays
ttaacttcttgatcaccatgctcaacatcttgaatactaccaaatggcacatatctggaagaatttccagaactcatcaggatctaaaccgtgaaggtcaactgggttagtttcttttttcaccaaatctgcaattttctggaatcgggttgtgacaagaatcatgttgccagtggtatcattctttttgaatggagctactagtttctcccactcctcattattgctgcattcccatatgtcatccaagacaatcagaaaccttttggatttcaacctctctgcgatggatttctgaagcaggtcaaagttggttgtgtcatttgctattttatctcctgcattttcagttgcgggtaggcagctcaggatctctttggtgagcctaagcacatcaaaattagtcgatacacatatccagaccctaacagtgaaatgtttttcaaactctgtgtgattgtataggtgctgggtgaaggtagtcttcccaatgccccctaggccaaatataggaagaacggacaaggttttgccactatctttggctatgataatatcctctatagttttctgaaagatggcgtccctcccaaacaacttgtcttgtgtgatttgagagcttgtcggggaccttttagtggaggagctactgtcttgagggttactagtgtctgacactatcttgagcaagtcagagacaggagtagagttggattgcagctcctctatgaggagcttgattttgttggacatagccactcgattaaatgacaactttccaacatggccaccgtcaccagacatggcatcggtagcagcagcatcgtctcggggtcggggacagcagccagagaagcatgagagccagttaccagcagtgtggcgagcagc

SEQ ID NO: 3002 - DNA, 748 bp, Zea mays
taaatcttaaggctggtttgatgaccagagaatcagagaggatccatgggaaggaatcccctttctatttaaaattgaataacaaggggattctttctcttagatcccctccgatttcctggtcaacaaatcagtcattataatgtaaaatttagtggagaaatgccctccaattccatggtcaacctttataatgtaaaatttagagctcattgtcactcctgacaataggtgatccatatggtggatttagttaattgagtacatgaaggatgagttgcgatagtgtataggacaaagaaaataagattagatgtgttcaagcagccaaatcgctatattttacattctatatagggtggttgatgcttgtgatgagtattgctgtgggccctcctctgtagcaaatgggttatagaggagacgaggaatttggcccggcccgacgacgtgcctgcgctgcaacttgggcttgtcatggaggagtcaagcccatcgtctcgtttctggactctctctgctctgctctatagtcctcgtttttcacaagtcacaggggaggaaggcggctggggacgggggcgtggagcggccagcgcgggcacgccgtcgaggcggcgcggcgttggctgcgctggtgcgccctatacgcgtcggcgtacgtgccgctcccactcgctgtcgactgtcgagctttgctgtcatctccctcccctgattctccgccttcccctcctcgccgcccaca

SEQ ID NO: 3003 - DNA, 348 bp, Zea mays
cgtgagtagaaacgtctcaaaagatgtcacggccactctatataattatttattgggaaaataagtttttcagccgtaattaaccacggcatgtatagtatgccgacaatcttggctgcccacgtgtccgatgcaccgaagcatcgagatcagcataattgctccaagcgtcgctccttcggggtccctctcggtctcgcaagcatcaatgattcctcgcctctcactacacggcagacggcactacaggcctacagcacgcggcgcacgcgcgccttttggtaaacaattccaggagctacagtcacaccaccaaagcaactcggccagcgcgcgggccggggtcgc

SEQ ID NO: 3004 - DNA, 270 bp, Zea mays
ctcacatcttgtaccagaagagtcttgcaaatacacaccacacaaacaaatgatttattgtttcagcttcctggttacataaaggacatttgcttgggtgattcagatctctcttagccaatctgtcatgtaatgtccaaaggagcttgaccccaagaaaagatccttataagcagcctttgcggtgtatctgccatatgaagcaatgctaaagatatgcttatcctccctattgggctgcagttcaaaatctgagggaacttcctaaag

SEQ ID NO: 3005 - DNA, 467 bp, Zea mays
gatccattcaccaaaaaatattcagctccaatccaaaatctttttaaaaaagtctccactattcctaagctatccacataataagtattctgtttctttaaatcattatacttgcacttgtacctatactgaatgagaaatcatcacgatcgggtaaagtctgtggccgatttgatttaaccaatccaaggcgagaacgcacgagcacgacgccaggccgctccgcccaccgcctgccgccgacggtggcttcaagctcacgccggttctgaccgccgccgctgctgaagcttctgatttctgaattggaacgacacggtttttcttgggccgtctaaaagcccagtgggctcaaaaaaattaggcggcgccaccacgtcctcctccgactactcgctcgctccgccccggcgtcccgccctcagccgccgccgtcgccccctccctcggttcgcctcgtcgtcgtc

SEQ ID NO: 3006 - DNA, 1249 bp, Zea mays
atgtttcagtctcattatggcataattatacacatgtttcattgagattaatgtattttcactgtagtttgacaaccgcaatctgctgccactattcatcatgcaacaacaacaaagccttttagtcggtggcgaaagcaggacaaaaatttaagtgtgaccaaacaaaatcgcaaagcaactagacaaaaccgtaaaactgatgtaatattgtatatagaaactagtgatcgtacaataaaacttagaatttgaatgcatgccattctcgctttttttgaacattttaattatactttgtctttttaaaattggatctacaagtatttcatctagattagatgctcttcgaatatttaattgttttaaaattcttgtttgcgcaatggtcggccgagcagagcgacaccctgagcagggcaaggctgttttagactctctctaacagatgcgctataacttataaaaaaataaaaataaattatgcctctaatataagtatttatgcatagaggacgagagttagaggacgctgcaggagagggatgagatgtagaagaataaatcttttaaaggatggatatagagaatgaatataaataacgttgttggagatagtattaacagactgtggagttggagtgtgggctagatcagtggaagtggcatttactgtagttttggatccatatacttgctatttattttttcaattttacagtatattcaacatatatataaggagacaaaaaacagttttcgccaccgtcaaaaaacaatgctttaatgaacagttttcgaaaaacaatgctttaatgaacgcacaccgtcgggagcagcaaaacggagcatcaacaagctcctcatcacggcaccgtatcttgtgcgcaaggagcgctggtgctcccatgagcaaaatcaacccagaccacaccctccacattcaccggtgctgcgtcagggagttttataaaatgttctttgcaactctgtacattttacaaaaacccccctgatgcagcaccgttggatgtggatgatgtggtctagattgattttgctcatgggagcagcagggctccttgctcataagatacggtgtcaacatagatacatagatatagattaccaacatggctgcatgcccccaagctctcccactatatatatctctgctagcacatcatcccaattcacaatgcttacaaaacccatccatcattttagctgttgatacaaagagaaggga

SEQ ID NO: 3007 - DNA, 600 bp, Zea mays
catggtatttgcagtgaaatctatgtcgagtctgatgaattctatgtttgttttcttaaaagcagagtaataatcccattaaaaaaacgacctaggaatttttctatttttgttcctttgaataatggctgactccacgagaaatacagtctttagcttgcgttgtgccgttgttaccgacttgccggtcatcatcgtctgaatgacgacttggcgtttgggtaactgggggaggctcaccctctgctacagcaatgagccaagtgtattcagattgattggcgcaagcttatgcgcagttgggcctggcccgtattccatccaccgccctattgggtcagtaccagcccaacctgacaatgcaaagctccgtctccgtctcaagggaagcaacggccaccatttgacgaagcttacacgcaggcgcagcacagcgtggcaggaagaaaagggaagcatccagccaacattctccctaggaagaaaggaacccaccaaagcttcaaaaaaagaaaaagagctgcacactggtcactggaaaacgaaggcaaaccctaatcgctactccaccgcagcgcccactacaccgatcgggctccg

SEQ ID NO: 3008 - DNA, 841 bp, Zea mays
ctccgttctccccttcccctaaaaagccagcagcgagtagataaaagctcgggtcggttgtggtgagtggtgacactggccttcttaccctttgcttctcttctctgccgctagggaggcgctgacactgttcctcttccctcctcctgctctctccccatgtcctcctcctccggtcctcggcggccatgactgctgcggcctctttcgtccgtgcctgcgcgctgcatggctgctgccagctctagatacacactcctagctaggcagctgttgccttcacctgctgccgcgcgctgctcgatcgactgcacgtcttcacagttcacaccacagagtagagtggagagagaaagccaagaagccggcaggggagagtagggagagagagagggggaggagtcgtatgatagaaagaatctggaattgctttccctctcgttttgtcccccctgcgcctccttgattattgtgttgcttgctgttcctccctgcctgcttgctccctgcttcggcttggaggccttctcatgcatcaacctccttagcatctctctccccctctcccatacatacccccttgtctgatgcctgcttctgcttgccccatcctccttcatccttcacgagttcgtctctcgatttattgtctgccacacctcccttcagctagctatcttcccctagctagctaggtaccagtagtgtgtgtatatatagatagatttatagatatagacacacacaacaagtgcaagatcaggcgaaagctactagccgcccttgcagtcttggactccattcgtcgtcgtccttgggttctcctcctcacctagctact

SEQ ID NO: 3009 - DNA, 48 bp, Zea mays
gctccgccatcaccgtatcgagagagacagagacaggctagcgaggga

SEQ ID NO: 3010 - DNA, 1500 bp, Zea mays
cactgaccacacagaaaaacccaagttttattgaagctcatttcattttacattcttatttcatgtaccatatatttgatctaaatagaaacatgtgtttaccaggtattgtgatttattctacttcaaatccataactgatttaaaatcaatactggatggttttattttatacaatatacaggaaaggactatatattagtttattgcattcgttatttgtaacttatttccttgttggttatttgggtatcatatttctattttctgtttccattactttgtgttacaatttaagaaccgatgacttttagttggtgtatctacttcagatctcttctaaatctgctaaaactaattttattttttatattagttaggtatgaagttctttaggaacattttcagggacagggattttggaagccgtgatattaaggtgatttctgcactcattttcgttgtgcttgcggtcccattcccattttgcaggttgcacttgaactatcattttcatttatggaagcagttcaaggatgcagcaaaacgatcaacttccaaacgtctgtcacgtgcgaaacctgcagtatgtagatgcagtttttatctcatgtctccatttttaggtatttagccttctgtttttttattgtgatgatatatttttcagatggatcgagcyggcgtgcctcctggaaccaaacctgaaacatgtctagcttgcaggggttcaggatttgttagttcttcaccacattgcttttgtctatccagtttaactagtattcttatttatgttagtttttgaaaatattgttgacatatctacttccttaaaacttgaagcccttccgagctctgtccgcgtttcacgcgctcacagccctccacggcgcgacgtgtgggcctatagtcggactctacgtccatggtctgtcccaccctctccaacccaccaggccaccacgacaccacccatgcggtcctggaccggtctacggcgcttgcgcgttttgacgtgtggtgattcttttctccgcgtccactcacattactgggacaggcaggtactgctgcagtaaagtcatgacaggcatgggtgcagccatgctcgagtgatggcagatccatgacgcggaccccgcctctggtccatagcggtcacctcatccctcttccttttcgtgaccacaaccttcacggacacaacggaaacgcatcagatgctctctctctctccttgctcctgccgtcccttacctccccttccatcctcgtcctcgagcgagccgctgcaggcgtcacaccgtcgccagaggcgcctgctgacggcgagcctgaatccaaggcctgtgcaactggcgacgacgaccatcagagggccgacgagtggtccctcgcctcctcctccggctagatggtcctgtcgcccatgtatctcccctttcatggccgtcctcgagcgtgctgttgcgggcatcacgctgccgctaaaaacac

SEQ ID NO: 3011 - DNA, 527 bp, Zea mays
ctctctctctctctctctctctgtgtgtgtctctcctcttcttgtgttttcgatccctcttctctcctgttgcttgcttggtgtggagaaaagatagctcactttccacagccccatctctcacatcctgcttcccctccaccctacctccttttctgccccccacaaaagctaaacaagcttgctggttcgcttgcctgcttggtattagctacccccaagcagatcgggccaacctgcaactacttcaagagatcgctgtccctgccctagcagccttctttctccttcgtgacaacacatgcatgcacccaggctgctgcttcctgtgctgtgcatcacacgggtcttggaaagctagcctcgttagcttcttggtgccagttgattggaaaggagcgagagaattattgagcggttggcatcagccgcttgcatccactatagaggcagcgagcgagagcgagagggatcggcaaagggcgccctaggggagctactactagctgccgcacgatactacagcc

SEQ ID NO: 3012 - DNA, 141 bp, Zea mays
gttgatcgatctggccatggcacaacactgagatcctcgtcgtcgtgagccgaacgttaatccggcggacgcgggggcggggccattgcggcggcggcggctaggaggacaatcacgtacgccgccgttgacaactgacgg

SEQ ID NO: 3013 - DNA, 1500 bp, Zea mays
attcttcccctatttcttctcttttctaatcatcccctgttcagctcctctttattctttaactaaactatttgacttttatacctcagtttttaaagttttaaaaattaccactatatttacattatcataatacacagtattatctgttaattaaactcaaagtagattaattttacattaaatataatcaattagccgagaaggagagattagagctacactctcgaggggaaattggctaacccccttacatgcagggagagggagggaacgccgttggacggcgagggggcgtggccgggcacccataggccatagccgctaggtggagggggcgggggtgccgttggagcctggaggcagtcttgggtagccttgtctttgtggtgcgtgggtgtggccgccggcgtttggcttgtcgttccctggttgcaacttgcaagtcgcagactgttctgcaggccttgcagctttgcagggggaggccgggagggagcaccgagcacggctggactgactggtattgcgacgtgcatgaaacgacagagacgtgtcgagggctgagcctgagcagtggatccgtccatcgatccatatcacctacaggctacagtgctcctacgatagcgtaactgggcaatgtacgtaggagtagagtcgtagtcgtagagagctgagcagaggtggcttctacataacaagtacgcagacacacctatgagagtacgagacagtagacgtgacccatgtgctttgctttttgtttgcttttctttttttaatttctttttcagataagagcaaccactgaaccacaacgtccaggaaaagataaaacctctgacaataaatgttgctacagaaacactcctccacctaggcatagatccggatacttattcaggtgtagattttttttgtcatattttcttcgattatgaactaataggatacataatttgttatatataaattgatattcttgtttttagcattgagctaattgatattcataaaaagtaaatcccaaaatttattttatatctttttaaataattaatataaaattcggatacggatacgaatacatattttttatctttttgttgtagggataaaatattgcacacaaaaattatattagtgtaatttataatattcctaataaaatggtaaaatttagttttaaattatatatatatatattaaaatattagatttgtcgtataagtgagatatccatctctaaccactctccttagagcgctgtggactggcccacacgtaagccttatggcgaggattcgtttccctaccgtctcggctcttggtctcccccggcttgccccttcctcccctgttgcacacctctttcttcctcgaacacgaattctgtgccccaccccgacgctacctataaatctcatcagcacaccccgaatcccggcaaaacccaccggcagaagctaagctcgctccgcagcatcggcagccgcg

SEQ ID NO: 3014 - DNA, 360 bp, Zea mays
ttgagctgacaggaaactctgcgttgcaacttgaatgcttcatcaccgatcggctctagtcatgcttccgtgattaagtgaatgtgcgccgccgcaatttcgagccaagctaattaaagatgatgggatcgcatcgcatgagcgttcaaaataaaggaatatgtagaacaatggtcgcagatgattaaattactcatattatgttcagtcattccctcagtattttctagcttgttttctcctctgaattgcgtgtccattctgtggttcacacaaatcaccgtcgggttgcctgcgctccgttttcgtagacttcggaggcagtagggtagctgaacaactcagacgaccaggtggttc

SEQ ID NO: 3015 - DNA, 65 bp, Zea mays
tatcataaaagagtttcattagtgaaataaacatagaattgcatggttatgagattgagggtggt

SEQ ID NO: 3016 - DNA, 431 bp, Zea mays
agcagtggaggagtgctccaagggggagacccagacccttcttcggcgcgacagcgtcgggtacgtggacatagcgtgggtgcagactgcagacgagggacctgtagtgttgtctggttttgagcatttcgacgccgacaagaccctgctcctggccgcgtggatggagcgccaataacgggcaccaagctcggccacgtcggcactatgtcaaccttttggatttcagattcggaatagttccatacagaccagggttccggcttttaagccaaccacacacgcccgacatccaggacccacattacaaaaatacgcttttctcacacacaaacgccccacgctcggctgagcactttcccgccgtcttcagaccgtcacaccctcggtcgtgacaggtttctgcctccactgccttccccaccgccgcc

SEQ ID NO: 3017 - DNA, 148 bp, Zea mays
accattggaatgtagtccttgacccaacatacagtttagggatgatgttttcggttttgcttgtaagatttttattgattttctggaaattacctgttgtcaagctggtgactatccgtcccgaaagggttcaagtgagatagggtcg

SEQ ID NO: 3018 - DNA, 632 bp, Zea mays
actacagtaaaacagaatattttcgacggttaaagccgtcggaaataaactatgtgcggcgcccggaatgagcggcggcattggaggtagaatgaaacgactagttttagctccatgggattaaaatcacttaattccgacggtctggctctgacagccgtcggataagctaatctccaacggctgtcagacaggccgtcggatgtactaccttaagtctgacggtttgtttggaagccgtcgaagataacgcagccgtcggatgttcggtgttttcctgttgtgattcacatatcttgttttaaatttctggtcatcacatttcacttgctacacatcattgctcgtccagaggtagttacgttttctttagccaagatcggagcaccctgcctgctagctgtgtggcgaatgccggccggtcgcatgcaatagattcctatcactaacaacctcaatcattcatatgaagcctgcagcaagcyaaagtacgtactattgagcgagttatcagcctataaaaagggaggccttacagtgctcggtcgcatcgtacgtcgtgtcctgcagtggctcacattcgacgagacacagtagagggtagctagcagtggtgctcctggcctgtgacg

SEQ ID NO: 3019 - DNA, 1500 bp, Zea mays
gtgtaacaggacccgggctctcggtcaaattacattccagcccgtccagcgtccgtcattggtccatcatggtttatgagaatggacaagaaacgagaactggtacaagtaaccgacgtgctgctgaaacgtgccaatgcgcgagcgcacagtctggcatcctacactacagacatgagacacgagacattacatgaatgcagcactacgtgcctgtctggtagtgatggatrgtaaccgcgttggtacgcctaggcctaggcgacttttgttgttcttaaaagcatcaccgcacccccgcacgcggatgcatgttgcaaagctctttttttttggtctctctgaaaggagcaatggccatactacggagcaatgatcgctaagacggctgtgttgccagttgccaccttgttctgtcattccgcgtcctttaaacctactgtatcatgaatccacgttaccacatcggcacgcgagcgcgactagtatagttcgtcgaatccctcctttgttccgctccgtgaatacgcaagggtcgaagatgaacgatgcagatcggcaccgcacctgcctctgcctgccgagcacggcgctggcatggcacctcggacgaaagaagttactgtagtctcgccggacccgcccggcatcatctcatcctcactgtactgtatgtactagcagtggccccggtgctgtatggcgctcgtcccagctcacctcgtcacgtcagtgtgacgaatggggccggaatgatacaggcgtcggtcacgtgctgggagtgagactgagagtgaggtcaagcgtagccgcggtgccggcaccggcaccggcacgcgtgggcatcccgctccctgtccctccgaggctccgacaaaaaagattcgcgccaagtcaaaaaactcctccgacgccgccggggacccgcggccctacccacatctgctgtgaacataacagcagcgctgacaaactggccgtagcctgtagccacgagctcgcgcatcagacgggccccagtcgctgcgggcaaggccagtttgatttttttgccctgagcccctgacggtgacggcctgagccggttgaaactttgccgcactcgtcggcagccgagcaccctgtttgccgctcgcggccggctgaggtgctgctgctgctgtgcaaatgcgatgagcaatttctgcggtggaatttgacactccagtccaggtgctgctgtcggtgagcaatttctgcgtgatgaaaaacaccacacaagaactggtgcctgaaggccggcagcgcccacgcatgcttgacttcttgcgccgcgttcacaaccaagccaacgtagaggggaccgaggaccgaggccctcggcgaaatccgtccacgcgccatttgtaaatcgcgctctcccggctcccgcaccccactccccgtttttctccgcaccgccctgctccccgaccccaactgctgtctccttcctcgggtaatgcgaccgcgcgccagagc

SEQ ID NO: 3020 - DNA, 411 bp, Zea mays
atagtatgtgaaatgattcttgaggagttcaaaagtgaagaccaggttgggagcgaaggaaagcaagttcttttggctcccactttccaatacaaaatggaaattatattaactccgcttctactggaacgtggcgtggtgtgaaaagcagctagcatggaaaagtggcaggataaatacgagaccaaccactccctcccttctattgtccgttgtccgtctctcaagagaactgaagaacacacaatttctcattttccatctctagctcatctcttacaaaccaagagtctgcatatagcagtatagaaggcgtgtgtctgcctgtcaatttgttgatctcgctagcgcgtgtggctttggcgcatgcaagcagcaggttagctgattgctatcatccgcatcggatcc

SEQ ID NO: 3021 - DNA, 509 bp, Zea mays
gatgctagtgatcatcggtattagaatctgtagcgccacgggaatcgatattggatgtgacaccccattgtttttgagttgctaaggtctttcgatcctttctgagtctttttagactgggaatatgacagtccaggacaggcaaggatattctataggactcataatcagatcgcattgaacacactgcattcttttcgttgtaacaaatgctggtgctgtgaacatgctggagatacagcaatggctatctgacgctttttagctatgatggtgcgctatatatgctactactgttctgttgcgaatcttctgacatgttgctcactgctcagtaatatatttgttagagtcgtatgttcagttatgtttgcttgtgagattcctcttgtgcagatgaaatccgcagcatggctattgatcatatactgctgtacacggaggatgcaacattattttagcttcacctgccctcctcgctgttgaccatctttgaaaaaactctcctc

SEQ ID NO: 3022 - DNA, 341 bp, Zea mays
cgcctttgtcggcgcttggcaaagatgtatttgccgagtgcatttttatgccgagttttcacatctcagtaaaaagggtgttttccgagtgttcttgtttggtgagagggagactcggtaaagtaatgtcgagtgtatgacattttgctatcggcaaagcactgaacatttgacaaacgatatcattagaggaaagaaagtgtttactacactcatagctacaatacatgatataatcatcggtgtccaccgttagtttccccgcatcccatgatctccggcgggagactggcgacacgttgaatgccttcctcgaagacgatccccattcccatgaagaa

SEQ ID NO: 3023 - DNA, 1121 bp, Zea mays
agtggcagcccctgccaatgacccttcatcatcacagatctgtcacacctttagctggcaagcgcgcctcagtcacattgcccacttgcatgaaatgcttgaccttggccttgtgcctgtgggctgcacacatggacacatgcctcgcactcttgctgctatgctgcgccacacacgcctgcagatgtcacccatgtgctgttcatgccaagctcaccgcaccatgtgtgcatgcagctcatgccctgatcgccgcacgctagcctggacccatgaaccatgcagagctaaaatgaaaaatgacctgtgaaagcctcctcctgcggctgccgggccgcacagccgtggccgctggcctcaacaagcgcagctccttgtgctgcagctaccgtttggaccccacacacacctggccttgtgtctgcctctatcgcttcatgtgaacggaacagggatgggattgggctcggtctctttgtgttgcttcaatgaaacaatgggacttgacgaggataatggtcactcttgcccagggtcaaacaactgtttagttttcaaaatgcaagggtaaattacgaagttgaaaaaggaagggtaaaatctcaccaggcctctacagcaagggcaagaatacccaaatccccaaagtcttgctctacctgccagtttggcagctttaccacctttaacattttcatgctctcaatcttagcattaattccatatcatatttttttttatttgaacttgaagccatatgttgcatgtcaatttgtaatacttactatatatgttacaagagtaactgttctacttttgtaatatttcttatcatttkgtattcatattgtgcacttgcttacatcaatcactttcttatatgaaatttctgtatcactttctctggtgcaataaaatttgtttgaatgtcttgtgctttgctgtagcttcttgtgtaagttatatcttgacgtcctttcataaaaaacggttttatctcaacttarggttttacatatcctgtccggagtcattttctggaagatattcttgaaattactgggcactggttaactccatacaatcaaattgatgactatggtcaagaaaaaagttggaag

SEQ ID NO: 3024 - DNA, 108 bp, Zea mays
agtaagtagaaaaagttttcctctgtcataaatatgccataggtcactcctctaaacttgtctttttcttgaaggttgtatacaatgaggacccctcattgatgttcc

SEQ ID NO: 3025 - DNA, 242 bp, Zea mays
cgcgcccgcgcaagcggcaaggcaaacccttgtgttggtccagccgcccctcgccccgccgcaccaatcccccaccccatcccaacgctatccgctgccctcgccgcgcccccctcctcttccacctcgtccgccaccctccccaatccatcacatcccaccctaccccaccggccctgccgccgccgaggaggaggtgtccccacccccgtccgcagaggcagcagggatctctaccgggc

SEQ ID NO: 3026 - DNA, 469 bp, Zea mays
aaacggcccctgagtgaactgttctttcaaatttttattcagccatgatttccttatgacattcatctctagaaatatgggtttgtagaattgacaaaagtgggcaaggacaatttagcttgcagtacaacagtttgtaagttactaattagttcatgatccttccattgagtaactgacgacctcctaaaattagaagagaaaaaagtgaagaaatcctcaaacacgggttggtaggttaagaacttccctcccaaccattcagagtttctctcttctagaattagcaaataggactcctaacacctcctagcctcagatcccacccaacatatcaaaccccaacctatcttgccaatggcggtcatccaccatctcaaccgctactcagagggacactgtctcggcccggccaattgcccggccggaccttcgcccatgatcacagggagaacatcctttgcttccc

SEQ ID NO: 3027 - DNA, 252 bp, Zea mays
cagtccgggttaccctgccaccaatgccctcgattcccactaccatgccatccattccaactacgattccaacaacaatccctaccattcccggactccaggtgcctccattcactgccccatccccacaaaccaccagcccttgaagttcgatgtagcaggagacttttctttacatgctgttagtcaggagtttggctcatcgtatatggtcgttttcagtgtgtgtgccatgtttgttctgctattttg

SEQ ID NO: 3028 - DNA, 880 bp, Zea mays
ccacaaggaacaaggatgagaaagaaacgtgaggatcctcgcgtgaaaatttttacacgaggaggatggatatagaaaactatttctgacattctcattgccatccctgtggagtgtggagagtgcaatcggggcctgtttgaaagcacgtgcatgccagttcagggaggcgaccgttacgaccacggctcattgccatccctgtggggacggccggccctctggagctgtccagtccaacggctcacgctgcggcccactagccgttgggctccatcgctttcccgctttcaaattcgcccccttccctctcaggctctcacgcaacgtcgccgcatgcccgcatctaggcattccagcccctagagcctagaggcctagacaaaacccaggcccccttcggcccttcctcgtacactctctcccaatttctcctccaagaacaaacgaaaaacaaaataaaaaactgctcctaaatcttttcaatcattcctctctgttctctctctctctctcttcctacagtagtccagtactccagtccagtcctcctccttcgaatcccaaggtggcggccagagagtagagatagagagagagtgggactatagagacgttaccgttgctgcttgttattattaacgccgccgccgcctcctgcattcgtatggtccgcgtcgtcacggggctcctccgtccgtaaggcaccgccgcagcgtctcggctggatcaacaggccggccgatccgtcttcttcccctcctcctgcgggtgcgcttgacgaatcgctgcgctctctccacgggcatcggggaccgtttcttgaatcgaatccctgagccgccgactcgtactgtgtgcaggtcggcgtttggggatc

SEQ ID NO: 3029 - DNA, 567 bp, Zea mays
agacgaagggttgcaccgacttaaataggaaaataccgatcggtccatgataatytgtgtcatgattgtaactagttgtaaaggacataaatgtaattttgaccgggctgtgtcccatgcctataaataggtgaacaatacccccgtactgttcacgttgacttgtactcgctcgtgcgtcacgcttgtatttttgccttctgtcaagccgaaggtataaatgtaattcaatattgttcttattcatccatgattatataataaggatatacaaatgatgttatgtgattattcatgttatttctcatgtttcatatgctccttctttcatcaatgtaaattatgatgatgaaggtatgtccttcatgaccttcgtccaaagatcgttatatcctaagggagataatgcttcgaaggacgaagggcattaaccattaacttctttctgtgttgccttgttcttaattcgaagcatttgagaacaagtccccaacattggcgcccacctccggtgaactcacttccactcagttttttgagcattttcggcaatcataaaccttcgtc

SEQ ID NO: 3030 - DNA, 1500 bp, Zea mays
ttcttcacacycgtgttctcatttttttcctctttcccacgcagcgaggtagccaagctcgactcgattttttccctttctcgagcagcgaggcagacaggtccgacacacgtgacacaagcttcttctccatcgccggaccacagctgccccataggccgcactaccagaccaatgctcccccataggtcgcgcaaactggccttgtcctccgcccttgacaatctctactctcgacctcattgccaaccagctccgatgggagcaggcctaccaaaactagattcaaaattgaattactccctatatactagaaactattggagaccaagctattttttattctcaatagctatttagtaacttgctaaacatgagtttaggaagcatttttctagagaactactagagttgctcgatgtttggtttcagtgactaaacttgactaaagagaattaattactatgcataaagactacattacccctatttaatagggcgcagtgaagaagggagaggacatatgtagtaaaaatatcaatttagtcaattttagggtatgtttgggagggctttactttaaaagtatcagatttgttctagcttcttccatccaaataggtctatctctacgagctctagctttgaaaaaaaaattgaaactagagatcagcttcaagaaatccatgaagctcttcaaggggtgattcacaaacactattttcatacctcttcataaagacaccactgatcacacaacatagcgctcagttctctcgtggcagccactaaccatcaagggtaaccaaaaaactcacacaaaccaattgtattacagaagtcgaagtccatgtgcaagtcaaacacttctcgaacccaggccacttcaataatttgttggggctattttatggtgaagttggaaaactgaggctgaaaattttgaagtggaacccttccaaacaaactctaaataaatcacatgtagttttgaagagtttaaaatctagtaatttgtgcggcaaaccaatatgtgaaatgcaatggctacgacttccatggagatggcgcggaggaagataaatagccccggccccttgtagattctagctgctggtttcaaaaacattttatatataggcaatacatgcaagagtcgagttgtagctagacggaaccgtctatagtcttgataaatccctcacctcgctcgtacaataaggatgaatgatacggtacgtactgtatttattattatgttgaggatagaacgtactcccattaaaagtggtctaacgaaacgaaagcgggacggttggcttgctatctgtatcatttacacgagccttgagttgaggacctttcaactcgctcgtcgcctgcagctggctataaataaaagtgaacacgcacatatacaaaacagcaaagtggtcggcgtacgtacgtgaacacacatcgatctcgatatatctgtctagttagctagctagtagacat

SEQ ID NO: 3031 - DNA, 1025 bp, Zea mays
ggttttgattaacgccttccaaaactagccgttgctcactacacgacatcactattcagtactactatactatccgctcctcggatctcttcatctattccccctcctcttctctctccgccggagaaattcaaaaccatactcctcggtactgtctctctccctccccccgtctttccgtctcatcgtttccttgcgcggcggttgctgctcgcccgatctgccgccgtcagccggcgcccgatctgctcctatactgtggcgcggaggcgcggagcagcaggcaagtgcccgtttccctttccccagtaccgcggtagattaggaaaccggtttgctccgctctgggtggatttgttctagaaaggaaggtagtttgtttatccgcggctgccggcttccgggatttcttattttcggcagcacgagttcttcggatcgggtttccatattatgttgttataaatccagccagtcaccactggcatccacgcgtcccctgttgtctcagtgacgactagagtctagttctgtctggtcccctttccttttgacaagggttcggagcggacatcacctcgagttcgagatgcagtttcctttgtggggattttgcgagatcctggaatcagcaattcctcgtctatgtccaccggagtctagatggaatactgacgtggacattcaaatttcgtgcggattttttccttacatggaaattgtttttgtttgattttgcatgaaccagtgcaatccctgtcaaatgctactaacgtctgtagttcatttctgctgctagaaattaaacattgtttatttggaccggaagtcgcagatacggtgaacgatgcaattcgttttatattcatatatgattgcatacaactaattacactcggccgttgttgcattttcgcacatccagtatcttcttccagcaagaattttgtgacaagacttccagttccttattcaattcctgatatctttgctttagattgtaaagctaggaatacaaatacaag

SEQ ID NO: 3032 - DNA, 289 bp, Zea mays
gttgtggacactctagataactgtgagactgcactggcttactcgttcttgtacctacatttcaaactccactccgcgagtaatgtggtctacagtgtaaaacagtgttttggttaaccatatgggtgaactgctggacacgatcttatatgagcatatctggtctttgacttcaattctataaattctatagtcttctgcatctgtagttcttccaactattttctgttttaatcatttattgtagccttgtatactaaattgttttctttcatttccttagtggaaa

SEQ ID NO: 3033 - DNA, 1500 bp, Zea mays
caacatgcatgtcgtgttgtgttaattgagattgatgataattggaattttacccatgggtatcgagcgtagtgagcctagtgtaccaaagatgaagacaatatggcctgccaactacttccaggacaaatatatccaattatgtgaatcatgggatatcctatcactggaaatgagcaacttagtgacacctattgaaagcggattcatgataactttcatttcaatagaatttgcattcgataggaatgcaaattctctagagcataggtgagagagagagagttcgcgaagagtgtcagaagtttcaaagtttatttgaggaggtcgaacgtcatcatcctaccgcagtgccatacaagaaacatgtaaaaacctttttttattaagttgtctcgtatcatttttgtgaaaaaaaaatgtacgaacacatgtctttgatttcagttgtcagaaactcaaaatgcatatgcgaagaatgatccaaagaagaagggattttctttccttcattgttggccgaagattaggcatagcgagatgttcttggccgtggcatcaataatggatgtgttttgacgtagaagatggcgagggtagaaagggtcaaacctgtgactcctccatgcctaatggtaaatggcctatgaggagaaaacaagcaaagggggagctgaagaaaggagggggcacaaacaaaatatcacttggtagagcaatttcttacagagaaacaaaaaaaaagagatgataatttgcacgagcgcaaattattgctggggttggtccggtagcacaaaaatatttctatagcctggcctattatctagtacagcacataataggctatcccataccacattttcaatgcttatatttatttattgaagttaataatacaatacaacatgccaacatccatgtcgttttgttaggttcaatagttgtcccatattttcgtcagaggaaaccgtttgtattgtcgcaattatcccatccagtagtctgcgaacacgcgcggagcccgaacgtcgcaatctcgtgacgctagccgtgacgattcgaaggcaccactcgctgtagcgtcacctgcgatgcggaggctaccgtacttttcagacagtcagccagctccttccgcgaccgcactgctcgggcctcgggcgcaagcaagtggcggatctgtcgtccttggctctgtcctctgtttgaccgctcctgctgagctgcagtactctgtcctcttcgcccgttgacgcggacatgtgacgagctcacgtacgtcatcgcctgagcacaagtcgatgtcttgccttggcctccactctccaactccaagcatctctcactctagtccctctataaaagcagcagcaacggctgcactcgcccgtgtccatttcaactctgctccatccatatcccatcacgaacccaccaaaacatcctctccgtccccggtacatgcacagaaccagagtctgcaagagaagaaggcca

SEQ ID NO: 3034 - DNA, 329 bp, Zea mays
accaaatagagttgcttggaaagcaactgcggctcgggagcggagatgatgtctttgagaaaatattttctaacagcttacatgctcttcaggtatgttcattctttgagtggccttaatgtttgctgtcgactgaaagacgtcaacatcatatatcagtcgtccttccatcatttgttaccaacacgttgcaggttcaggatgcacttatcttaatgttattctctaaaatgaggtgtaaactactattttcaccttttgtccttgtttttttcagcgaagcactaaccatagtccataggtgcacaataatgtcatgttaagttcac

SEQ ID NO: 3035 - DNA, 412 bp, Zea mays
gtatttcagataaaataaagcggtacgagcgaataattcaagaatcaccttgacggggaggatggtggccagacggcagcgaccgcaacggtgtcatcaacgagaagcgcgacgaggtcgatgagcgccttgcgcgggcggcggagccgaccctcgtggacctacagcggcatccgccgcctcaccccgagctgtctcgctagggtttaaccgccgtctccatgcctcgccgcagtgcatgcctcctctggcgcctccttatggcggtggtggggggaagagaaggaggagtagctgtggtgcctcggttgggaggatgtagcgatgcaaccacggcctagctgcggtgctgcgacggcggagaggaggtggctagcgaggatgcggcgggagtcacaccgacaaggaatac

SEQ ID NO: 3036 - DNA, 1500 bp, Zea mays
tatttttatatagaaaaatgaactaatttttctttgaaaaatagggttcctaaactatccgttagagtagaaattgacccacttgcacatgttatccaacttttccttaaacttggcatattgtatcattacatccatgaattgatatacttgatatgctatgccaattacaacacatagatggtgttgagctccattttgagcgggcggacggtccggccctgaggccggacggtccgcggtccggacagtccacgcctgtgggccggacggtccacgcatgcgcagagcagtttagggttccgagttttgtgctatgtttgttggctagatttgcagaattagctcggaatccagtcgtgtaaagggtccagcccccctcctctataaaaagagaggtctacggccgatttgtaggaatcaatcgaatcaatacaacttctattttgcattttattctaggagtagttctagtctagtttaggtttagcttctcgatccccaaattctctgcctttcctcgactctacgtcaattagaggagtctaggtcggtctacccaagcctagacaactcctaggatctctcctccccgacggggtccctcccaggagcgagatccaggcgccgccggcgatcttccgccgcccctgcgcacgcgcggaccgtccggctctagggcgcggaccgtccgaccgtcaggtagggaacccgagctcctgcaccaggtcgcggaccgtccggccctgtgccgcggaccgtccgcgcctgaccagagagcaccgccgcctcgcgccaggtcacggaccgttcagcccttggccacggaccgtccgcgcctgaccagagagcaccgccgctggttctcttgagtaattgacgcctccaaaaaggtgtcaacaccgtcatataatttattttgtttagttattttgtacataaattttattatataataaagactatgatattgatttctttagactgagtcatcgtatgtgtatgtgtgaaatttgatcctgatacatatatgagatgtatatgtgtttatccttaaattcgagtgtgacaaaaaaaaaacgaagcacagaaaaaactcacacaccctcagtcatgtggctggtcgtcaattcgttattcgcaacaggtggtggccatggcccatggtgtgccgtgtgcgtgccatatgcagcgcataccgacttgacccaccgtggctgctgctactggctcggtagcgctagtctccggcgacgacctgacccgtcgccgtcgcctctgcccgtcaacgtgaagtgtctcgcacggccacgccgaagcggaataacacgtctgcaccggccacttgtccctgtgcgcaggcagcttgcacgagtatctcgctctcgctcactctcccaggcccagcttataaagcttctcgcacgggccaaaagccgtagtctgtgccaagaacagagccggtgtgtgtgcccgcgctgacgtgcacgggcggcggcc

SEQ ID NO: 3037 - DNA, 248 bp, Zea mays
ggtcatccaccaacgttcgctcattcttctgaccctatggatgctgaagattggctacgcactgtggagcgggagttgcataccgctcagtgcgatgacagggagaaagttctgtatggtcccgtctgttgagaggagcagcccagtcatggtgggagtcttacctcgccacccatgcccaccctgacgccatcacttgggaagagttcagaggaagctttcgtcagtaccatgtccctgcaggtctg

SEQ ID NO: 3038 - DNA, 268 bp, Zea mays
tcttcggccacctgcgcagcgccatctctctttcctccctatctcgctgctccctcccctgccgccctgcttatttacgcccatttcttaagagaggatttgatggcctgtcagaataaaagagctcgaggaaattgcggcggccggaaatcctggtgatggtgccacacaaacacgagaatctgcttcgtcctcggcggaattgccgtcggggtcgggcgattcttcggaggacaagtgcctctgtttcgttgagctggctaggtcc

SEQ ID NO: 3039 - DNA, 623 bp, Zea mays
gttgtgtcccttgagtggaccgagccttaacttaatcgcacccatcaggcctttgcagctttgtgctgatgggagttaccggctgagattaggagtcttaagggtacccctaattatagtccccgacagttacatatataaatatataaacttaattaattttatctaaattataattattaaaataaaattcaattacaacgaaacaaaccggaccttagatatgcttttagcatctaataattaactaaatattttttgctagctaactaactattagcttttgtccgttcaaacttccgtagtttgcttgcttgcctgcgttgccatctcaccatgatttgtactgttgcgcagtcgtgtcattgtgtggcgccgtctcatcccaaaactacacgccaaaccaagtaaaaaccaaatctgttcttctgtwaaaaatccgaaatgggaagaatcccacacataaatatcccggagataattttatcttcccagactgacctaaaaccctcctcaccttatcttctcgtcgcctccccttcccccaccctgcttcctcgaatcctactgctggtgccgctgttttcttgcttcgttgcgtgctggcggagcaagaggcggac

SEQ ID NO: 3040 - DNA, 1500 bp, Zea mays
ataaacaatactctaataagaaagcaccgcgagggcacatttatcgtagaatcaatttctttaaatttaactatatatatatatatatatatatatatatatatatatatatatatatatatatatatataatataatataatataatcgtttatgtcttcaaataagtaacttattataaaaatattttttaaattaccgtatctcataaatatattttataaccaaacaaatttattataagtgttagtactactgtttatatatttagttaactatagaagggaaaaatccggaacggaaatagtactcagcaggcacaggcacaggcacaggcacaggcacaggcagcaaggagagcgctggcaccgacatgctggggccgcgcagactctactgctagcagattactgggttttcgaaatcaaacaaatcatttcccggtcagcacgtcgcggagatgtcaaatatgaatatatgatggagagccatatgcgcctgcatatgctaaaaaaaaagcatacgctattgctcctatgtgcgttcggcgaagccgaactgtggacgtggtgtgtggtcgggccggccaagagggccagccgtgtccagctgctcccctgtggtcagcatccgccacagcagatccggcacaaataatagtaacaattaacgcacaaaaaacacgtttcaacccctttttggtctctgcagtgcccagctgttcgctcgatcgatctgtgcctcgcctcgcccgcccagtcggccaccgccagccgccaaccaacggaacggatcgacaaccagaccaggtgagcagcgccgaataaatattggcccagaagagaagagactgaacgaagcatagcaagcaaacccagctcgatcgcctctcgcactccgcgatccatctctggcaattttttttcctctcgaaattaaacgtctgtttccatctctggctatatatacccctcgttaggtctctcactcgttaagccatccaaggagcgaggggtacaagcacaccgcagtctcagccctccgccctctctctctctcccttcaagaactactcgaggtctaattgtcccagtacgtctcagctcgttccccttgcgaatctctctactcgcttgcatgtgtcctagcaaatcaagctcatcgttatatatattgctcgatcgatccagtttttattggcacagcacgcgcccggccatacccttacttactgcatgcatcatgactcatgagtcctcgtcgtcgtcagttgtcaccggcattcccatccatgatcgtcgtagaccgatcccctcgtgtcccctctcaccatcacccttgtttcttcgcgcgtcgaatgcatatgcagtcacctcggtactttcctcgctctcagctgctgagccgaccgttaatttcttcactgttgcgcatgcacaggcctgccgcgcgcgctcggcacgccagaaggaaggacgtaccagaggcacacaatttcaa

SEQ ID NO: 3041 - DNA, 255 bp, Zea mays
tccgaatttccatcggcgtcgtgttgcgagcgagagagagagagaggagggtttccagagcggcagcggctgcggctgcctgccaacccctctacccccagctctgcaggctgcaccctaaagcagcgagcctttttaccactcttcctgctaccaccccacacggcgcacacaccaccatctctygtcgcytcgcctccacttcctgggctacgtacccatctcaatcgcttcgactcctccgccgccgccgcc

SEQ ID NO: 3042 - DNA, 1500 bp, Zea mays
ctctgctgaaattttgtctagcctagactgtgctgccactaaaaactcaagataggctctaatatatacttataacttcagtgtgttccaaaacataaaattcatgtgatttattccttgctttcatctcttatattatttagggtttaagtaacatgtgtataaaccatttatctggatgtgggaaaataaaggaaacacacaaatggattgatacacagtttgtccaaaagatcctgaattctggacttggtaaaaaaattcttccttttgcctttgaaatctaacactacgaatatttcttgaagaataatggactgaatttggaaacatctcaatgaaacatcttttatttattaaaaaataacagattttagttccctaacaatagttcatgttcgttcaatgtgctaaagtttgatttggaatcaagataataaaaaaatgttgtcttagggcctccacctttgctttgccccatgccaccaaaatcttagggacggggctagctgctactggtgggcatttttaactttatagatacagtgatgatcgaatacaaaactcaaaagaatcacttgacatcacataatttgtatccagctagttgggaggtgcaattgttcatgcattttgtatttttccattctccgcacatacgaaggagcacgaaagcatattatagtaatctaactgttaaataaagttaggcaacccagtaataataataaagatactaatgcgccaatttgtgacagtgccggaggtatatgtaattttcagggtcaactcatgctttccaatttgaactgtgaaaccatcaaatcactcttccatataagcaaacaaaaaaaatgttagaactgccaagcccagtggccagtgcctgaccccagtggcacaagcacaatactctggctccgctactgggcagtgccgcagtggcatgcttatgcgcactagcagaacaactcattctagatggatgcatgcactcctacatgtcaatcttttgtttctatatacgtatttaaataactgataacattgcctaataagcatatcgaaattatgaaacgagggcatcgaatgattaaggagcaagcggagaagaattgaccccagagagacagagatagataataatacctccgagctagaggctgcctagttgacggagcacagaccagcgacagcctctcccccgcagccttcgcacacgccttcatctccgatctctcctctttttccccaggccgccgcaagatatgagaacgagcggcggagcagaaggccgccgcaagacggcaaaaggtttcgaggcggggtcaaacgacggcttgattatatccgacacgggtaaggggtcccgtgtttctctgacagctgggccccgcgttactcttgcctccaggccttccgggagtttggcgacccgtctcgggctcttgtgggggctagggtttaggcactaagcggcggccggcggcggcggggagg

SEQ ID NO: 3043 - DNA, 917 bp, Zea mays
gtcgtctcggccgcacatgcccgcgcgattcccgccactgccgggaacacccacagccacacgcgagagtctgtggctcacaactgtcttcttcaattacatgtgggaccgacggacgatgggaccgacggtcagtgaagacgaggtagatggacccgtcgctgtcgtaggatggctgcctttcatgggcggttggatccgtagctggcacgccgtactggtcggtgggtttgtttttctacccaagcgtgcaagttggttgcagaggctgctttggtttgcatggaagcccctagaggtttcctaggcgttgatatttacatgccgtaggctgtagctgtacgggtatactatacgcgtgtgtatattcggcaagatttcgctttcgaaagatctggcagagtcacgtggacggagtaagaccttcctcgcattaaagttgattattttgaccggtaccactataatttataaaaataaaaatattatagaagtattaaaatctggtacggattaaaaccaacccagcatctagctgaacaaaacaaaataatgaaacggtgtcatggatagtatattctttatataacgtttttggaaaatatttagatgatgtcacggataacaaggtactgtaaaatttattaagaggtgtgtgtggttaaaaaattagcatgcctaaagcacttgctaataacaaactcaagtcgtcgactttcaagtcaaccacgccaaggagtttcattatattaagagccagcgcggcgtcacctccgagatagccctcgcccggataggagcgactagcgagaagccaagcggcttggcacctcagcctgctgcctctgctcgctctcttcgccctctttctgcactaatcctcggctcaggcagccaatattctgtctagcgttgag

SEQ ID NO: 3044 - DNA, 928 bp, Zea mays
tgtttgtgtggcgctgctgctgcggggaatgcggcagataaggattattctgcattctgtaacccgagggcacgagaaagctgcccggcgcagcgtcgatcacgcctcgttttcgctgggttaattgcaggtgcaggtgcaggaaggttcggctcggacgtggacatgcgtcgtggtcgtcgagttctcccgcgcgcgagctcgagaacgctggagacgatcgcttcgcctggcccgtcgcttttggcgtcacggacgacacggactcacggagtgcagtgcagtggtactgctaagctcgcccgtggcctggtcagccgtacaggatacggcgccgacgcgccgtgcacagctccggttggatgcacaccggttgcacgctgtacgagacactgcgtacagtacatggatcagtagtactacgcatacatggatttacagggtgttttctacagtagtacgtactagcatacggatagatccggacttgcattagccaagcgtgcagtgcagcgcatccatcccacgcgggcggagcacgcgtgcacgcgctgccgccatcgggacacgaaaacctagtgctgctgcccgtactggtttgcatgcggggtctgagcacggttactgaaacgaaaccagctcgtttaccgcaaaccatctcttcctttcttgcacgcacgcacgcacgccttctcacgtgatccagccatattttaaacaccgtcctcgagcgagccctcgaggaatcgaaatttccaatcgcgctgcagtgcacagaggagagagagccggtcgcagagaagatactcctaccctacccttccaccactggaggaggagctgactacgcagacaccagacagcctcgagtaacgaaaagggacagagctcgtttaatggtcacggcagcggcaaggggagatcgacg

SEQ ID NO: 3045 - DNA, 241 bp, Zea mays
tttgataaccagtatagacaacaagtgatcaggtgcatttgctttgtttctttatcgtttcatttccagcatgttatgtgttgaaaaaaaatggtgggctaatgtttgtagataatttttgtttgctcttataatcaagttttccgacgtggtgcaatttacgttggttatatattgtagttctcatatcatgttgttctagttgcatttattggcatcaaattggtggttatggcttggt

SEQ ID NO: 3046 - DNA, 825 bp, Zea mays
tgcatgcctgcagggttgcttgaacaaataagggggtgtttaaatgcactacaactaatagttagtggctaaaattagctggagacatccaaacaccctacctaatagttcaactattacctatttttagtaaattagttaatagttagctagctatttgttagctagctaattccactagcaattttttagccaactaactatcagctttagtacattcaaacaccccctaaatcagcaaaggcgaacatatgacggctgagaggcttccgtgaggacagtgctgcatcttgtctccaaggccatgaaaaagataaatcagcattaggaagcaggagggcaagaatataggcagtttaagtaagcatcaaatcaagcatgccgaatagaatgggtagtttcactgaaaaccaaattctaaagaaccgtattctttttttcccccatttagatccagaaaaaaaaagccacacttcctaattagaacttttgtcatctagatgtttttttcccacagtaaggtgtttccacacttcctaattaatccttcgttggcttacttggaaaaaagcggtacaagcttcctgttgccacttcagctgcatccacaccatacccaactaaaagacacccatgcctcctatcctctttttacatcctacactcagcagcaggccagtagcctcataaccgctataaatagagaggcttgtcctctaccaatgcccaataaccagctcacagtgtcattgagtgcattcgcttgctctgttcagtcagagcgagcgattcacatgtgaaacataagtacctgtccctccaacc

SEQ ID NO: 3047 - DNA, 575 bp, Zea mays
ttcttgttcaatttcgatggtggattgctaacagttccatttagaagtttgtcgaaacaattgagcagatgatccagtgactgatttgccgttgacgactgaaacaatgaaatataatatagtaaaaatatccaaataatgcaacctttttaacgggacttttttttttgccatccttacagatggcaccaattcaccccaaatcaccagtcactgaccagtgggaccaggttagttactgacagagcatttggtctgccattctctctgtaagaatgacaaaaagattagattgtcccttccttaagtagcaattcttggatggatgaatttatttatggttctatcttgatggcagtggaaaccattgtgtcttgtaggaatggatggaaccttcaatccccggtctttgctcgacctgcatctagtggaggattactttgcctcttgtttctgacctcagttttattccatggttgcaggtaatcaatcgccagacttttgggagctctgttgggggggaccgggaggaagagccaagttactgcagaggctaacatttcggttgtcgagtg

SEQ ID NO: 3048 - DNA, 1500 bp, Zea mays
aaaagctagggctcaacaactccaataacgtggtgcgggggaaggagaacacgcactactactagctgctagtgctactactattcgcggcaggcggccgggcggatggcgtgtcaattcttcagcgaactcggcacccgtgtagttgcgtgcagtgcagtccgttgctactgttatccagaggagagagagaggaagagaagtgcgttttaactgtaaaccagattaacggattgtcatatcaagcacatatcgatcgcgtcagacgactgtttgattcagaatctaattagtcatctgcagatcagactgtttgtttcggaatcttggatggatggatggatcaaccacaaagaataattaataaggtaggtaaatgaagagcatcagtgtactcagagatttcagctgtgcagctagctagattagatatttctagcaaataaaacagaataaaatcaccaactttgggaaggaaggaagggaagggacggaaggaagtacattttaacaagattatctgcatgcatggcttgatggctagccgctagctcatcgtcgtcgtccatggcccagtcgttggccgcgtgatcgagggagtagagtatagtaatatatctgagactgagaccgacgtcaaacaaacataatttaaaaaaaaagctcatcttttgacgatcgacccctgcaggttccgccgtgctcctccttcaagtcactcatctgttcatcatcatgcatgtgcccctgtcccacattccaagaaagcccctaattgcgtagtagtagtacgcatcatcgatcatcatcatcatagaggatcgacatctactcctaaaacaatcgcgctgctatgctactgtacttgtttaatcggttacaacctccggcgtcgataatgcatgcatgcatatgcatacgaacgaatacgagcaccagttaggaagccaccaaacgatgaggaacccccaacaacccgagccgccgctagctttaggaagacgccgccggggagcaggtacgcgtacccggaggcattccatcatcggctgcaatgcaagcggactccagtacggtctctcggtgtggactatataacgcgatgccaaagccaaagagagcgagccgtcgctgtcggccggcgacgtgcgtcgtgctgtgtcttcttgcaagccacaacctgcctccagcccggcccggctagcccccgatttgattcgcctcgcttttctaacgcccggatttgggctggagcggaggagtgtgccggaagcaaccgcctctcgtcgtgtgtgtgtgtgtgtttggtttggtgctttttgtatggtgtttttgttaataacatgcatatactgttggtgtcctacctagatgatagttcagaagaatcccctgatttgttagtagtagtaagggaaatttggatccataccattaaaagatcaccactttggatccataccattactatctcacttacatgtgggtccacatgagtca

SEQ ID NO: 3049 - DNA, 1500 bp, Zea mays
ggatgagcttgtgtgtgtgtcaccagaacacactggtctgcttaggccccataggcaagcctaaatatgtgtgaagggggggaagaacaagttgcacatccaaatgttcttgcaaaggtgatcaagtttttcactgcttacattggctgggaccatcattggcttcgagaagttgattttcaggctacttgagtcactgaaagactggaagattcctttcaggaagaagagatgtgtagctgatgcttctaggacgaccagtgtgtcatccacatgctggataattggaaagtccagtttgggggctgctttgttgattatggacctaaggaaggttagtagctgatacaaacagcaagggagagagggggatcacgggtcaccctacctgacccctctcctacaatgaaatgttttgccagggagccaagaactcgggaatccagagcatcaaagctaaccaaaaggatatttctacttgtatgaggtgtcagccacatagattatacaggttagtggagaatgattaggagggtaaagccaaaggtgttagtttcagtaatgaaatagtagcagctcctaaactagacaagcatcaaacatagctggtccaacactccaacctgcactgtatactatacgcgctgtcccatgcttcatgccttcaatcatcttgcttttattgggcacggattaggaacaggaggaaatgtctaacccacattttcatgccccattaaactaccctttcttgtgggcagcatctatttcagaaattgatgacgacaaataacaccgctcctttctggtctcttttttaacatacatgatattcgggaaagatctatatatcttcccgataaaaccagacattaaatcatctctattcaaaaattaataggaagggatttaatcctctccaatttctgtttattccagctctcggtctctaacagaataagacctaagtaagaagcacgtattagagtttcgaaaatgacccgtgcaggaccaaacctcctacgcttgacccatttcaacatctcattcccagaatacacaaacttcttctctaaacaaaagatacatcttaaaaaactggacagtggttaccaaaagcagagcaagatttgatactgataggataaaacacgaggaaaaaaaatactagtactctacaactggtagaatagaaatgaaaagacgatagaaagcatccaatgggagaaaagcacagcagcccatgcatcatgcacgcacaacaaccgagtgacggacggcgggtggactagtagtagtagttaagcaggcaaacagccccggcgaaggagactgccacgaggtgggctaacgggcgcaacagctacgtcccaacccacgccattgacgccctctatataagcggggagcccctgcaagcatggtcatcagccaaagtataagcgcagatcgagtcatcaagctagctagcccggagcacgcctagacacgccagcagca

SEQ ID NO: 3050 - DNA, 1375 bp, Zea mays
gcacctgtgtcgtttgttgtaaaaaatcatcgcattcttttccttccaaatggtccaattaaaggcttgttcgtttcactgttaatccatatggattaagtggtattgagtcggtttaaatccatagcaagtcaaattttatttcaatccattctaatacactccaatgcacatgtaattggaataaccgaacaaggtctaagggcttgttcgattagctcttaatctatatggattaagtattattgggtaggtttaaatcttaagcaagtcaaatttcttctaattttttcttaatcctatctaattcttatataatgggaataaccgaaaaggcctaacaagaattaggagagaagtacgtcaagaattaggagagaagtacgtcagtacttatggctgcacggttaaatcccgacagtgtgaagtacaagccaaacctttgtgtggctctgtgagctgtttcttgacacaacacaacgtacgagtcgcgcctttatttacaccgatagctacgtttctcaacgtaattacctatttacctgtgccgtctgcttgttccatgtacaagtttgtatggttctgtttgatttcacttatgtaattactaattagtatccaataaactttaaattttagctaacttaaaactaaacagtccagcttttaaataaatgttagctaaaatataaatttcattatctcattgttttctcaaactcagctgatgacagtttatactaaacgatcgacctgtttatctacggtttttaccattatctagaaaccaatcacttttaacccaacttgctaccaccaacacctggtcacggagcgcgtgcattgtgacgcacacacgtgccgggcctctgcaccattgaccggcggcgacaaatgccgtgtcgtcaactgctcctagtcccagcgccaccggcccatcactatcgaacgacccagcccaaaaccacagctcatcaacccacgcagatactacctcgaaagacaacccgccatcaactgacatattgcccccacatatgaccggccccatctttcagcgacatagaaattcaaacgcgaaccacagccacgcacggtaatggcggaaaaagcaattaggaccgtgatttaaaattaattaaagcgtgctagtcacaattaagcaggggcctttcctttcccggtggtggcggaacggtcacttctccggtctgcagcctgcccgaccgaatgagcgcgtgcaaattgctaaaggcaccccacgtttataaagcggaggcccagcctgtcttctgcccgcacgaattcgaatccgccggaggcggaggagacagcagccgggtgattgggttgggtacgcctctcgtctcggccg

SEQ ID NO: 3051 - DNA, 532 bp, Zea mays
cccatgattaaaaacatattattaggcaattctataatgtgaaaacatcaaattatacatattgaatagttattgttttactacgtaaaaactacaaacaagacatgcaaattgcaaagtgagtaataagactattaccattcattctccatagcttcacctgccggtcatctgccccagaaacaatgagtggcaaagtgggatgaaatgaggcccagttgaccccacgatcatggccttccaggacatatttcactacagcatcaacacctccaaaaagatctgtgttcatctgggtgagacggaggatgtcatctgcaggtgacactgtcttcttcctcagagctccgatatcccagacacgtacagtctgatcaagtgatgccgatacaaccaggtcttctttgggatggaaagatgcacacatgacgtaatggttatgcccagtcagcacagccacacaggtgcgtgactgccagttccagatccggattgtctgatcgtcactagcacttacaatccatggatactc

SEQ ID NO: 3052 - DNA, 118 bp, Zea mays
ctgttctgggtcagcactagcccgcgttccgagctgcctgggatttgacgaaacgtgtccgccgttacggcgttgttaactgcagaagaaggagaacgcggtgccggcgcgccgggag

SEQ ID NO: 3053 - DNA, 578 bp, Zea mays
gggagagagaaagaagagaaatgggtttaggggtcacttttagtttagtttagcatctttggtagagctaaagtgctaatgggtattaaattttagcacaacacttttagccactctgattgtttcttcaataactgaactttagtaaaaaaatgtagtgctaaactttaacaagagaaaacaaacacagtctaaagctgaaattattgaagtgaaccctccttaacaagcctataattcgtgaacgtcctcctcacaagtcacaagtgacaaccagggcgcacaatctccaacggctcagatcataacgccccagcatcaaacggttatgacccctcccaccatttcgaggttcatcagaccccttgcgccgagatctaaaacacgccctctcctgtcatccattgcattttcctccccctctctctcgcgcgggggtcccgagtcccgactcgcccctccagatccaccaccaccacctcttctcctccagatccaccaccccatcctctccgcagctacagccaggtggagctcggcttagccgtcgacgtggctgggcacgccgggacgggagg

SEQ ID NO: 3054 - DNA, 640 bp, Zea mays
ggtcgcaatagatcataaatagattatgaaatggatcataaatagattatgaaactgttcaatctcaatttattttgttctttttatttagtatcctttccttttttgggcaatgtcttgtttgataagaatcacttgattgtagtatggatggrcctatatttatttagtagaaaaatatgatcgtagatcaaaaactactgggtgcctgggttacatagaagttggacttctcagctttttccagtttattttattttttttatttagtagcatttcgttaattccagttctgttcgttacaatgattcctgttggtggaagrgtgtttttcacaaatatgaagatagccttctcagcactgagcttgattctcttcctaacaacacacacgaattgtccaactgtaagatctgcagggacgaggtacctgcaaagtgatggccatcagaaaatcagaacagcttatggctgcaactcgcgtttgatgtgtgcaataatgctttaatgcagtagcatttcttttcgtacagaacggtaacatgtctccttcagtcctatatgaaactaaaatcaccttttgtaattgtagaccacgaaacatggaaaccataatagatattaaactcagcatggaacg

SEQ ID NO: 3055 - DNA, 181 bp, Zea mays
ggtaatatttccgacccactgcattataattagtacaagttatgtaataaaactaatgttgatcatttatttgtacttattagttacttctacccgatagagcttagaagttggaagtaataatttcttggttgattgtatccttaaccatttcttttttttttgacacgaggaactcatc

SEQ ID NO: 3056 - DNA, 899 bp, Zea mays
tagacaatatcttgttatttttcttcccttttcaagatgtaaggtgtggtagctatcttgtttcaccttgttagtgcaggtgttatagatcttgcttccttgattttttcttctctattctccaccctgcactcatatggtgtgttgtggcccacataacaaaccacagtttttcccatataaacttatttgatatttttatcttgataaggttgggttgactatgctttgtatttttgttgagtcactccgtggtaagacgagccacttatttagttgataattcttcattgttccatgcatctgctttaagcatattaataccattacattttgtaagaattaacaactttttttttgtatgagggtgggtctaaatcaattagattattacaaaaagtagagatatttttttattttttattacttttgattgtttcaattttaagtgccacttgtagattcaactcgttttttaatttgctaagaattttcattctagcgaacaaaatttttgaggttttaaaaaaaaagaaattggactggcgagtcggcgagccatcattagttttggcgcgaaaaggccaagacgccgatccgcatgatcccgcggtgtcactcactcgcatccgaacgccggaacgcgaagctggctgacagacggccccatacgagtcggacccacacgtcatccacacgaacccgctgccagggacccacctcggctccgtttcattcatcggttcctcctcctcggttcctccccttccgccccgcttgtacggttgatccaacctgaaccacccaaccggtaaacgcctcctcgccgcccccgcgtccaatgccaccgccaccgccgccgccgccgccgctgccgtccgtgtagcgtccccgcggcg

SEQ ID NO: 3057 - DNA, 818 bp, Zea mays
ctcggtacccttacttgcttcaaacattgaagtactgttttaaaatattgttttgaaacgttgttttgggatggtgtatgctcagtttttttattactatatgtgaatatgtgagttctgcatgaaatactaggtcatcttgtattattcacaaacagaaaaggtgatagttgatcaccatttgctgaacagacaacaacattcgtgaagctaaaactgggttggttccatcaaccagtgaccatccaaacaaaaactaagtcggttccatccacaaaaaatggtgactattagggatgactctaccccaaatcaaggatgaccctagctcattatattttgaccttaaaccaaacatatccttatatactgaaactagcatatattatctcgcccccatccaacaaacaaaacttagaaaactatgtccaaccaaataaacaaaagcgcaaatggaagccgcttcacgtagcagcccgtgcaaagcaagcgaaagggacccgcgagcagcgaagcaaccaggccaagcgcaacacgacctacaccgtggggccggccatccaggagacacgcgtattccgtcctggacaaaggaccgcatccacttgctagctcgctagtcattacctgatttcgccgcgggcgtcgtcgtctttctccttcctcgtcctttataaaggaaggtggcaatggcctttccccctgcaccgccaagttagcttgcctagccacatcaaagcaaagctagctacggccagctttggcgatctctgcttgcttctctctgagcgtttctttacaactaaaccaactgagca

SEQ ID NO: 3058 - DNA, 1500 bp, Zea mays
gttatgaaaatactcatgttggtctgccatgagtaatcgagagtggctgaccttcacggtttcacgggcactaccgtgagtaactactgcgggttcgggagtggcctagatcatagattatcaccaataggcccttgctattgaatttttttcgtaaagatctattagtgttctcatagatagtaatgattcttagacatacatatattaaacaatagtttccacacacctcaaaatgtaataaaattgtactagagatgggaatatttcctaaacgaaaaatgtgatttttatggtggcttccttcttggctagcctccgaggaagtcatccttgacatggccaaaactacctagggaattcatttttgttgtcgtcaattgttagatgactttggttgatggcagcatgtggtttcaagctatctatctacactcaaatgtcacttagcttatggaacgctaacaataattgttgttggtcacttccttttgatcactacgaagtatcaaaataagacaacacaaggtagaagatcgaaaccttctccctttatttatcttcccttcgaggagataaatgaaggaagaagacataagcaattaaaaggtgtagacaagtaaaaaggtgtaagaatataatgaaaagacgaattatattactcttcacatatgccttagcatttttcattacattcttcttcttatgagattacaaacagtcataggaactagctcgaaggtacttcaaaggctaacgaaaacgaagcttagtgccctcaaaaggtgaatttatgcatgtcactattcacttacttatatgaaagttgtagagctttgtatgaaattacaaacatgtccacaaagtctacacacatgatttacaaatgatataggggcatcactgtcttttctatttttttctgcacaagtcttcagcttctttcccttcgtcgctttgcggtcgaagctttctccacgccgaggctagtgacctcggcttgcaccttcgctgcacgcacgtatagtcgaagcttcttttataagctgcttcaaccgaaaaggctacattcattcattctttactatttgcttgaaacacatttgcttacaccgaaataaagatgtcttgaggaccttcggtaagacaggcctcaacaattacctttattattattactactttggcttaatttttgtagtttaattaagcgctcatggaaattatatatcagtcgtctcaactgtaggcaataatattatgttttttttttcgaattcgggaatggactgaaaatgtgtatccaaacagacatgaatttacgtgtaaggcgcgtggacagtggtttatttttacacgtacaaaacaaggggtttattattacaaacaagacgcgtcgtcgtacagacataccggccgttaattattacacacttaactcttccccgttggtgcatgcatgggaggtcgtttatttaggtacgtacgccattattgggg

SEQ ID NO: 3059 - DNA, 1500 bp, Zea mays
atttggaatgcatcaatagaaatcacaaggaaggcagatcattatgaaagaaattaattctctgtccgatcagtataagcagaccctaaaaaaacaaaaagtaaatacaaagtattgaattcattataggcagctggagcgcaggatatgtttttagggtatttgggatggctccagctccagcttccagcgtgaagctgtagtttataatatcaatttaaataattttaaaaatatttttagtctaaataataaacaaaatgacttatctaaatgtcttctaaagttttacagctccaactccatgatttttttaagcacctaatgacctatattccactaactctaccaaatttattggagctgaagctatcccaaatagggccttaataggtagtaataataaagcaaatctggttccatgagactaaactttagtccatcttttttggtccctaaattatcaaaaaaaaaaggactaaaagagatgggaggaaatctgatttattcacttttagtcctcatatttagtaatttaggaactaaaatagacaaaaagggagggactaaagtttagtcccatggaaccaaatgcccccttagttacaaagagttcactagtacaaagaagctctatactgacggttgtgaacctattttcactggcgtttcttataaccgtcgttgctagtggccaataaaaaataattatttttactggtgggtaactgaggaccgcgagtgaaaatcgattttcattggcggttgagttaacaaaaccgcaagtgtaaatcgatttccgctgccgatcgacataataaaactgctagtaaaaattattttcagaaacattaaatgggttttaaaaacagaaaaaaaactatttaaagagaggactcaggccatgcaccccacccgcccgtcactatagatttctacatgtggttccttaagtaaaccgtcactagaaatcatatatttttacaagcggttttcttaaggaaccacatgtagaaatacaatttttagtggcggttttattaaggaatcgacactaaaaatagcataggcagttgataatcgaatccgcatgtaaaaatatatcgcatcgcaggctttgagactttttctactagtgtaatattcattatgtccgagaggtaataatgcttcgaaggacgaaagtctttgatatataacaaatgcgttgctttgctcttgatgcacatcaattgagaacaagtgaccaacagtaccatctcatcttggatgaagtggtttttcaaaccaaacacaaacaccccttagtagtgacctaacgaaaatcttatattttcagcactctagttagctataggcagtttgttgcctataaataccagcaccttgcatggaacggccggcacacagcaaccagtaagccatcgctcacacagtcagaccgacgcactcactaacacacacacacggacacacaacttctccatacacgccgtagcc

SEQ ID NO: 3060 - DNA, 238 bp, Zea mays
gatgtttcttttgtatctttaaattggtagatgtgatgtaattttacttttgttatgtaattggacaatggactgtatgaacttataaactctatctagagctggctgtactctttttcccttctgaccaaagggttttttaatgaggcagccattgcacagctctagtaatgttaagttactttttggtcaatttcgggtgtatctctaattgtggactgtctaattgtgggctgca

SEQ ID NO: 3061 - DNA, 924 bp, Zea mays
ctcaggaaattaaaggctttattatatttgtctggcctacctaattaatcaagcttagctataacatttcatgctacatgcatgcacacgtacgcacgcttataagtatatatacgtgaaaatgcaaacattcataggcaattagattgcaattaaagatggagtggtgtggagggatattggaaattttgtaaggcgatcaaaagggcgaattcgtattatctgatgatagtgatcagtcgtgcatgcactactatgaatttagtgatttagctactctttcaaatagatttaacaagaaaaggggtgtttgggacgactccaggttctaaaatgacttatataaatgtcttttataaggtttatatcttcaacttcaaaattttctagagcatctaatgatctagatgcatcaaattttctagaggcaaccgtgaacatacaatccagggccccacatggacggggcggagtaggttggcccctgcgggccccaaaccctagcattggccattgggtgtgtcatgtcatgtgagatgaccaacctaactaacaataatcagaagggagctgggaacaggtagttccttgttccgtgctcctccttgctgctggggcgacacgtgtcaggtcagctaggtcgcgttgaaacctaaatctcctcttacacgtgccaaaccatatgcatgtatatatactagtatgtagtataatgaatacgtatacggttgcccatgcatgcatgcttgtatatgcatgcgctatgcttttgccacctccgtatgtaccctaccctagctttggttggtagtctatataaccccctccctgccatccacccaacgaaccccaccaccaccacagcttctctctagctttgatctccaagcccacgccaactaattaataagcaacgtacaagca

SEQ ID NO: 3062 - DNA, 1029 bp, Zea mays
tgtgtatttcaatatcaaaatgcagccagacaaaactgcaatgtggacagaaatgtctttcttcttgctcactgtttggacaaaactgctatgttttttctaataatctagattcattcatggttgtggcatgagttataacctttgtcagttggtctcactgtttgggtgcacaaccttgatgatgattttttttgaaatyccttgatgatgaattgaatggaagctgagtgcctcactgcctcttyagagttaaaaatggactgagaaacatagcagtggtggcggtgggttacagagagaggacrgtggatggagtggagcctgcatctcatacaggagaaagggggttcggatacaggagaacgagaaggagcaggggcagaaaagtcctatgccatgagcagcattcgtgtttgttgtgcacgcgcaaacagttcgaaacgagcgagcgtatggctgtctccgtccggttgtagcgaagtccgacggcgggatccgattgtggcgaagtcacgcccgtgcagtgcgcccacagcaaaaagctccggcccacgggttagtgtggggctgcaggcctgcagctactagcctacaacaaatatctacgagctgcactgcagggtacgctcgtctgtgtctgcctactccctcctccggctcccgcgaagcgactccaagaagcagcaggagcgtcgagctcgagcagcagccatggatggcgaggaggttggcaggaggggtattcctactctgctgaagccgtcttcctcctccagcgacggcagtgccggggaacaagagcacatcgcttctgacgtcactcaggtgctaccctctcttgccacccaacctttttggctctaatctcctccctgctcccgtttgttgctgctgctactagtggttgaattagagatttgactgttcttgcgcaacggtttccctcagctcataggatggacgccgctggtcgaattgaagcgaatcgccagcgaggctgggatcgatgcgcggatcgtcggcaag

SEQ ID NO: 3063 - DNA, 1500 bp, Zea mays
agccactgtgctgtgcctgccagccctgcctgcaactgcaacagcggccggccgcagccttgcacagtcgcattgcaccgcacaggggctaaaatgggaggctactgcctactgccccgctacagctactcagctagcgcccggcaggcttggctaggtgccgtgccaggctagcggccacatgctgggcgacggctgtatgcctcgcatcggatcctagagcctagcgtttgcgctggacgccggcagtgcggcccggcgcgtggcgaggctgcgttccggctgttcccccagtagctctagtagcagtagggaccggactaccggagacaccggacaccataggaataggatggagcgagccatggagagagagacctggaccctcccgtgccgtgccgtgcgcgcctcgttacgttgactcatgtgtcaacaaatgccgaccattctgtgaggtctgtctccactgtaagctgcggctctttcaaaccgaaccagtttctacaaaaaaaaaaatccatgctgtaaaattctctatgcacaggacatgagtacacacgtcctaaggctgcactcgagtgtcatgagtcctaaacaattccaccctgtgactgtgagatgatgctagcagcaacggtgacatgccgtagaaacaactgctttggacgccgtagtcaaacccacgtggtttgggttttcgctccccctttctttcttttttttttcctttccccaccaccacccctctagctttggagcaggataaacagatcttttcacccgcgcgcaaaaaagtaaaaatattcattcacccgatacgatcgatcgcaaaggggatgggaaaagctgggttctacacgaaagtactcctgctaccactacgggaacgctactgttccaaatccatgcgtcggcctagctgacaaagaaacaaagtgcaagaactccccgactttttttatataatatatataataaatatgcggaaaagaaaaataaatgggaagaccggacgaggtggctaaaatatagtagtagtatagcgcagggccccaggtcaaggaggccgagaccgtcacggagaggaagacgagcacgcgtagcagcagcaggaggcagtggtagtaaaggggcaggtagtagtagtaaatgccagcctcctcgcctcaccaaaccaacaaaacaaaccatctgtcctcggctgcccccgtgcgtgtttcttgggactactacgacctctgctggtgctggccctggcctgcgccctcaacagaagagcgacgagagagagcccgggggcagaaggccagcgcccagcagcaggaggaggaggcgtgaaatgtaagcaagcggaggggagggacacgccgagctgaagccgcagagaagctgtcgtcaactgaactccgtctcccaacgagagagagagagagagagagaggtagcacagcagcagcagggcgagcggcgccgtgtttcctgcgagcccgtccggccgcc

SEQ ID NO: 3064 - DNA, 1500 bp, Zea mays
tgtgctcaaacgagattgaaaaccctgccgccggctcccgttcccttttgtcgcgaacaacggaagttggtgaacagacggcaggtgggagaaagcgatccctgccaacctcttttcttctttatcaaaatggaaaactctctattatccaccttattttaaaatcataacaccaaaatattttataaaatatatcgagttcagctgtgtgtcataatcttattgtgcatgcaatggtgcaccttaggccttatttgtgtattttagtattcagctcaattcacattgtttaatttgcactttaatccagctcaatatatatagaatgaggtgaatactaaagacccaaacaaacccttaggtattagggtaatgtatgtcttgtcgtagaatttgcgtatgggcggctagaatgtatctctgccgcctcatacaaaagtacttacaaagccgtagcaaccctaccaaaggggccctaaatgttggttaggttgtctctatcacattctctattttaaatctcactctacagacaatatcatctaaagtgtcacattccctattttatatgatccaccgaagacaacatagaaaatctaaagtttagtgtaaactatgcgggaaaattatttatggcataccgataaaaagtggctttagatttttgacacataaaactgtactatttatcaggaacacagagaaatgttgttcattatctagtgcacatctagtgcacatcgcagcgactaaattttccatttccagcaagactttatctataagattattttctaaaatgatatttttatcgatggagtgtgccgccgctaataataatcaatatctgtcattgtgttcctgagaaataataccatttatggtgtccaagagctaaattaactatttgttagtgtgccacagataatttctccgaatcatataggatgttgtgatgctaattataaaagctaaatataaagtacaatgattgagcaaagacgaaaaaatgttgtgcaattaagtgtttcgtgcaatcatgattttttgttgaaaattttatggacgctcttcatcatttactacagtggacagattgtactattttttatatcctttaatataaaacaaatcaaactttgatactctaatagagtaaataataaaatgtatttataacttttagtaatttaattaaacgagaaatttgattgtacaacagtagctgagtcgaggaaaaaaccacgaaacccattacaggacaggcaacctattttgaatttttgatttgacaaaaaaatatctctacgttgggcagtgggtcccactcccgcgcctcgtttaaaaccgtcccactcctcaactgatgatgcccccctgttcctcctgtcatcttctcctcctcagaaacccaccaaccccgtccagccgccggctgtctcggccgccgccgccgccgccgccgccctatcccggtccttcaggcgaaccaggttggtc

SEQ ID NO: 3065 - DNA, 1500 bp, Zea mays
cttgttcgcgtcgtgtgccgccaacatcgtggtcggatgcgatccggaggggatgaggcagggatcggtgttgggttgtgtagtgacggaaaacaatcaaaccggaccattttctgttccaattcaaatcaaaacgaatacatgtaatgcatcacaccaaatttgaaaccgcccagtttgttccacccggaacgaggcctgtaatagtccaaaccgcaggaaatgaacgagcccttaggtcttggtctgttacttcccttccacgttgattagacgtgattgaaaaaaaacacttactatagatttaaacacatcaaattccgtccgatttatatggattgaatgaaaacaaatgcttgttcgttcgtcccgcataaatgcagaacagaaacacgatgtatatgcacacacaaggtgaatcaaatcgaataaaatattgctttgtaaaatctaaatattattattgatacttattctgttttttttatttatcgtgatttagttcaaaaatgaactggtgggcgataaatttttaagaatggagatagtattattttaaaacatctacactaatatttacgcaagatgcaatagaaataatcggttcttattaggaaaactaacaagaaaatattaaaacatcttggcatcattataattctatagaccgttgacacatggattatgctagtctgattaacatgttacatctcgtagcaaaaaaaatgtctcgcgtaaaggtgacagatcaatcttaggcgttgtttggtagatcgttagccggccttttgggttggctgtttcttcatgcgcgcacaaaagctatgctattgactacatatttattgttttttctaaaatagattatgcatgaagtcatatcaaacagtgtaaagctgtttctattctgtcgtcgtcgtaaaatagcttggaaactgaagcttagaaattagcatagaaaacttagaaaacacaaccatcgatcgggcggcgcggcgatgcgaaaagtggtcttggccatccgccaaaggggaaaaaaagagcgagcgtggttttgccggccgtaccggagggacgcgcgaccgcgtggctttgattctttgtgccgttgcagaaccaaaaccgaagtgcaccaaaacccgtgacgaatctcccaatcacctgggaacgacacgcggaccgcgtgctacacggcgccgcactatcactagtacatgcgatgcgagctcgatcgacagcgcgcgtaacgtaaactccctcatcagaaagagtgaagcagctcagtgggcgagccagtagctagctagcgcgccgcggcggctatataaaacctcacggacgctgcgtctctttgcctcgcgcaatcccacccagagccagagaccacggatcggagaagaaaaggaatgtaagcctcagcacacacgtatagacgacgacgtagccttcgttcacagaagctgatcgcgcgagaccccgtccgtcgtcccgcgcgcgcgc

SEQ ID NO: 3066 - DNA, 1500 bp, Zea mays
aactactgcccgccaatgaagacgttctgatcctccactgtgttgccttgatgtagtagtagtacctgcaattctgcatgtgcacatccacgtcaagcacagcatcctagctggattcctagtacacagataacccctatatactacaggtccagccagctgcagctctcggccaagtttcaacggctgcgtaaactctgaatctgcaggtacgtgtgcgctgctagctggctggcattttgactgattcaacggacgtacctgattgcctgcgatagacgcagctgaaactgaaactgttccgtcgagacattgccgttggattagatgggccggccgctactactgctcaggcccacgttcttgcaacggctgcatgcatgtgttgttcagacgtgcattgaggccactgtttgtagttgttgttgtttagcagagtaaaaccacattctagcagcgctgggtagtaatctcgtttatttactgtggctgatcatcataggtagtgctagctctccaacgggttcttctagtctccggaagagcggtttaccttgcgcaaaaaaaaaaaaaaaaaatgcgaccaatgcgtgatgggtcattggatcccaacatcgccgcccctgcaggagcctggacctgtaatgagtaggcctgcatatctatctacttcttccactgcagcatcagacatatttaggcacgattcccctgcacatgcaagccatgcgtgctctgatgcttctgtttcttctacttctcttacattgcaagcaagcaagcaagcacgtctgtgtctgtctttcttcttgacgaactctgctctcaagccgggtggtcgtaggctcgtagccgacatatataaaagttggctaaccgcagtctgattaacattcagtttagtagggatggcgtacaactgtcgactgtctgccggctaccgctaggcaaacactctcacccgacgactgagctcagtgagatgcatgcagtaaacaaagttcgattcttcctttcagaaccagccgtgcttagtaattagcccttgatcaggcccttctaaacgccgcatcyatcaactttctaattttctttttttaaaaggaatcggcaaaagacttgactcttcaatatattagaagagaaatagataacagtctccagaagacggagtaaaagaaaaaacaaaaaaggagaaaaacatacactaactcaatctagcatacactaaatgccaccagttcagtagaagaatcgcacaccagctcctcggataaatgttccagcagatataataagctattaagctcctacggcgggtcccaccaccgccggccctgactagtgtatatataaccgcgaagtggtggtgcaaaccgagtgcagtaaagcttgcgacgctgtagtgggatctctctccgttctactgtgctgtgctctgtgcatgccaccattgctgctgcagagaaggtgaacacaaacagggagcgctagtggtag

SEQ ID NO: 3067 - DNA, 1268 bp, Zea mays
cggggaggatagatcctagagtgtgtcttgcgttggcaggccacccaagacgcctctagctagcgcagagccgaagagatgtgaagattcgatgtggtggaaggctaaactaggtactctaaatacataaggtaaaaacgacaagtagagttgatttgatcaattgtggggggtcaatcggccgtagtccttcatctatataaaggggaaggtctggacccgttacaagtcagttcgcgagttaatcctgcagatttagctaacaaatcccgcaagaaatccggaaccctaactaattctatgcatgcgtggatggtccatgctaccaccgtggatcgtctggactgcgcatagtctggctgtccaaaagtgtgctcaacacctacaaatcatacatttttcttgcacattccattccatctaaataatgatgacgcacaagaatcaaagtccataaacccacttgtaatcaacagaagtgtttcatggctagctgcaacagctaatatgtgtgacacttacgtcagctagatggaccaatcatgcaccgccatatcgctttcaccacatactattgcccacgccaatgcaatgtctgcctctcgcctctggcgacgctacgatacgggtgagagcgagacactattgcccactctcgcgaggcgttagagtcatcgtcggtcggcctctatcgtctccgtttctgatccactcttgttcgactgttcgcttcgaattaaagctatttatttaaactgttatagttataaaaacactgtagttatatagtacgcggtatcggcgtatcgtcctctattggcacccgcctggcacgttgttcctcccgtacgttgtgtgctcagcgagttgattggacgatctccaattctgattgtttgttggacttgtccttcgacacgacggcacctcgagattcgagcgctgctcccgtactacttactactcgagagtcgagactgctttgttttttttgttgatggaaaagaaccagaagggtagtactcgagagcacgaatcgccacgtccgccagaggatgagcttgagcagctccaactccaacgcgtgacaaaacaaacagaaccgtcacaaaaataaataaaccaaacggggcctaaataaaaagtcgtcgacaaaaatttggcagccataggccatagcccccgctgccccccgggcgcagatcttttctgggcttctggctcccctctcccgccgatcacgccgcctcacctcgccgggcggcgtg

SEQ ID NO: 3068 - DNA, 1263 bp, Zea mays
ctgatgacgtgtgcttttccgatttttcatcatctatctatatatactgcaatgaagcaaagcaaaggcaagaagacctgaaacagagagactgataaggtaaacgtaagtactccgtttttttttttgtatctgatctttctccttgctaagttatactagtgaacattagctgtataaaccttgttcggtgtaactctagtgacaactacgggaaaaagagagagattgataaggggccgacgacattttacacggtaggctgtactatgccactgcaataatcctcatttctatgaggcgcccaaaaaaactctgcacaaagctcaactggtcagctccttttgctaactctatgatcagttgtatccgtaagacctacacgtaagttctcaccggatcccagctctaaaaggtggaaattcgtcctcgtctcccactttgaaaagtcctggtggtctgaaacaatagaaaagtcaactatcgggatgcttcatataaggacagaattgtagccattgtatgtagcgtaaaagtgcatggaatcactatcacataacaacaaatctggatgccagacacacgtatcggtcttctgtgacagtccctaatccccatatactacaccaatcatacttattgaattttatgcctaaacaagggcaggtcttcggttgcaggtttgaagcagcctctccatgggagaaggtattacctcgatgattgttctttcctcagacccatcagcctccagcactgggtatatccttttatttaattctactatttaatttaattttacgctacttacaagaatgcatagtgtacactatataattcaatgctacgaactttacacttggaaattacctgattttagttgtggcggccctggacctctgtaacacaaatggagaggcatatgtaaacaccttacttgtagcttgtgtgttagtagttccatttgacttcaatgaggataaaggcagtgcaaaaggtcccaaaggtccaaactctatagtctccggtggtaactcatttttcacttgtttcaatgtgccattgataacttacttgtgttagtatatttttatttcacttgttcaaaattttttatttcaatgtgctattggtaactcattttttttcacttttttcatattttattcacttgtggcagccggccgtcgacaccaagcaggccttgagcttgtggcagccgtggtgatcggtcttatcaccagtggtgtcgttagatgccaa

SEQ ID NO: 3069 - DNA, 1500 bp, Zea mays
tcgagtaatcacaatactattgatattattcatattgattaaatttttatcattggttctctttgtttgttatattatcttgtgtcatcgattaacaactctttcaccggaygtcttgaggtgactttagtttcttgtcttttatatgtatcctgacataaaaccagtgtttattttctattcgtgcatgtgcaggtgttgtactgtttcttagaattttccagcaacttcgatgggaggaattttgtttgagcttgtgggcccaattcatatcagtcgcgaccctgggactatcccacgtcccgcggcgagcttgtgggcccaattcatattataattagcctatatttcatcaagatatatttatgtgtgcactatgtagtatgtactgctttgtcatatttgtattgcaacttccttttcagtatattatgtcaagcacaatgctctacttgtactgctttgtcatatttgtactgctttcttacttctccatattatcatgatgcatttagcgattttataattttgtagagattaaactgcagcatttcctttcttgtactgattagactacctgagactatggcttactgctgtaaacataatgatgtttgtttcattctgataggcatcctgctttagtcctcaacaagctaggacttttgttttagaacgtcgcagaagatctgcgagtcaattcattaagaaatgagacaaacagaaatggagcgactgaagagttagcaccgggtacaaagaaggccagaaatgtgcatgcccatcaacagcccccaaaacagccactttacagaaacacacacctacacaggccacacagctaccagcgacccaaattataccctaagagcgggttggcgagtgaggagctcctgaagagcagaggcacccgcagcacaccaaagggtacattcattggccacaacctgcaaaacagtatgaacaccaggccgttgcccttcgaacacaatcattccgatgcttccagatttcccaggcagccaacaaaaagctagaacttttgtgatcacattagttgtatttttggtacctgtgtttatcttatgacatgtttatcttatgacagatattcataccttatatgttttgaactttattcatatcttttggatgaggccactcattttgaagattacgattttcacacgtcttgaacttagaagctctttgtgtatcttacaagacatgtcctttcacagtgcttttatgattggggatggtaaactcttgacaaatgcgcattgcgttgagcacgacacccaggtgattattcgactggacaactttatctcttcatacaactttatctcttcatgtttttattttgctttggtttgtcactcttttttctcttactattttgatttaaagttttgagctactagcagttgaggatgaactaatttttatattttttgataaagtgctgatatcgatttaccattaatttttctatgg

SEQ ID NO: 3070 - DNA, 576 bp, Zea mays
gttttttttcttaaaaaacattatatgattgatttattactattgattatatattataaatattagtgtttgtatatattgggttgaatttgagattgaggttcgtgccagggcgctatggtataacttggctgtcaaatatgcaattccaacatttgaatcctccatgggagaggcaagaggaaagggcaacccaaaagacgatgcaaatgaaggtaacatttgtaggcgtcgtagcttggttttgcttcacgagcacaacaagccatccatctatgatctatcccgctccctccatccgcaagyaaaagctaatcgatcttcccatgatctccttcaattgctactaataaactactcctataatagaatcagttacctcagttgctcgtatagggcatgttctccaagctactccgtccccagtccccaccatttcaaattgcaaataaaactgcaatctcgcagcggctgatggattagcaagcaggacaagagactgagatccatcctccagacacgcgcacgccaaggatcgcattcgccaagcaacgtcgggtcggcggcgcgggggcg

SEQ ID NO: 3071 - DNA, 1415 bp, Zea mays
tgttgattacagctttccacctctttagatgtattgaataggttcctcggggtatttagaatttatccaaagagtagaactattgctagttcaactatttcatattttacctgtgaattaaagactagggatactaattagtccgaatgattgtgatggtcatcaagcaccaagatcaatctaagaaatggtttaaggccattccatttgaatcttcctttttttggtaattggtctcaatataaacaaaagcaaatatgaagtataaaaatgtatctggtttgcaactagtgaagagtttataagttactaagatgaaagaagttctaagcattcctagttttagtttatgtttacaacgtccctttattaacatgacgaacgtaaataagcagcaaaaatagggtctaagacgctttcaaatttatactacaatccagagaagctaaaccttttcagtttctgattttctaaaagcaaaaatacgttcaaaaaggcgaaccaaatgcaccctaagtggaaaaaactactcctgtatatatggtcacaagttagatgtctatacattgctatagtttctatatatgatatataggtagaccttactttaaaaagtatttatataaatataattatattttttcatttattttattattaaaatatataaaatatattagtcaatgtacatccttctttatataacacgaatatacctgaattatagtgctagaagccaaacgttttatatcgagccttatttcttttgatattccatgtggtagaaaaaaatattcattaggtatgctcgcgggaggagatgacgtatgaagaaactcatgttcatatggatgggatcgaaatggactttcaaacaaaacacgaaacaaagcctgcgctagatgtttgggccccagcaccttccgtgtgttttctttctcgtttccatgttgggtaaaaaaaaacctttaagccttgccttggtttagagcccaatttactccaactgccattgcctttgggtcgtggaccaacggtcgggtcgggtccgcacgggacgcggctgctgtcagccagcgaggccatccaaccgccgcaaaaagcgcgttccctcgggccatctcctccttccatcattccatgggattccccaaagcaactgtccgatcccatcgcgatggcaccgccgccgcaggagccaatccaccgccactgacgtaacccgatccatggaagcactaggatcttccgattacccccctcctcctcccaccttcctccgctccacccgccatatcctcgcctccctcgtcggcgcaaaccacacctccgcccgcttctgctcccgctagcaccaccaccagcaccggaccccttcccttcgcttcgcctccctcaccaggggtgacgggggc

SEQ ID NO: 3072 - DNA, 1500 bp, Zea mays
cttctagaactaccggcatccgtaaatttatgttgcttacaacggcggagcacactacagcgaagagagtgctcgctattcgcaattgcaagataacacacttcgtgctacaaccaacctgaggtgtgcccaccaaatgcgacactgacatgccactgtcattacgaatctattggccatagggctcgtcctctccatgctggtggccacaggggtctggtccccagtgtcaccgccgtccacagtcccacatcacgcggccacatcgtctggaagtaccaatgtgtagtcgtcgaccgatgacagatgcagcgtcgaagtcaaggaaacatccatgctgtccacgaacgcgcacacaatactagtttcttatcaaacctgtaggtgtaggattactcgtggagtgtttctcacttgtgtgaaaccgtgtgagctatttgaacaattcgatctggtcagcgaagggaaaacattttttttaaaaaaaaatctgtggggggttggatttgttcctagcattctgtggacttaaatcagttgaactttggagtccttgtttttgtttagcttgtcaccgtcaattaatcctacttcatttctggtcgcatgcaaaatctgcctaactaatcctaaatatttctggtcgcatgcaaaatccgcactgatcccaatcactggattgtattacaaacctatgtgattctgatgagatttggtcaccttgtaccaaaacaagcggaaatggttgtttttccttaagagaagctatttttttttacattttagtgagaataatacacgtgtatgcttacacgtgtgttgttataaatcctgctcgattgattctactctctgtccgagattgagatctaagctttagtgacatttctagttataatggtcttatcaccagtggttttgaaatgtagtcagaagcttgcaacactcaaatatgatcttctacttattctggtcaacagttgttaataggtttattgccttattgggcatagacttgtgaaaccatgctacctcactctggcaaagggctgtaatttggtcctttgcaatggaatgagcaaagaaaagatccaaagaatattgtgtttatggaagcaacttgataggttctgttacatgctaggctgctagctaatccatttgtaccagacatctgtaatcgctccatatttttttgtatttcctagatttgtctagaatcttacatttatcattgcatgaacgttcattttgtgttatatagtattcatttatatttttccttctcccagtatatatatatatatcaatcaaaatggtcctgtgatatcgagcttcagttgatgcagaggtggtgaaaacatcttctcttctccaaagactgctgactgcaagttgcaaaagtttgtcttcagcttgctgtgttctttcttccctctctggcggagtacacgagaagtttgtagatataggcactaggcagctcctttcagctcttct

SEQ ID NO: 3073 - DNA, 1254 bp, Zea mays
tctctatccctgtagtgtgccactctgaacagtggttaagtacttaagtttggggaacctatagaaattagtatttggcatcagcgaagttcaaaacttgcagggcagcaaaacggactaggatttttttactctaccttgctgcaagtcagctaatttttttttccctacaagtacaagtacccccagtaccaaaattttttttgactgaaagtttgagcaaaaatagtgataaaagggtctgtattttaagtccatgattaaattttcgggggaaatacaattttagtgctgttcgtggcttcgaatctccgtcaattcgctccactcctccaaactgatccgcacaggtacttcagacatcgattcctctccttcttagcttccgatcgagctacagttcacggctcatggtggcgtggggtggcagatcgagggtctagggtttggggtgccgccactgggataagcttgtgctgcttgcccgcccggagctgctcttcctccgccacgctcgccgtcggccgccagatctcgcccgcaccgacggagatcctcttcctccaccacgctggctcgctccgccgtagttctcagtattcctcttgcggatggctccatccgcactcccatgacacgcggtaggttcgattcgagcataattggtggggtggggtatctgctgtctagtgttgattgcggattcagctgctccgcccctcctttcgcggcctggcctgctaaagtttgggtttctaggttttctgctcctcgtgtgcagctgtgctgcaagtcccatttccgtgcaaatttttgcaactcacgcttcgtttctttcgtctgttctcggatattcctcacgctgtcacattttgtgcaggttgtgccgctgaaaatccaaactttgggattgatgcgactgtagtaacttgttgctcagtggatggtcttgagcttttctgttccagccaggagtcaagatcaaccgagtactgtgctgaagatgaaggtgggtgcagacccaagtacccaagatgtgatggaggaggcagccctcaaagcaaagcatgtagcagagcgcaagttccacgcacgtaacaccaagggtgcccggaggtcagcgctcaaggctcatagcttgtgcccatcacttgagggcatatctcagatgatctccacacttgatgttcaccttgcactgaatcgaagattgatggggagagtgactggtacaggatactgtctctcaatgcc

SEQ ID NO: 3074 - DNA, 1168 bp, Zea mays
agaaagggtattgccagcaagcattggacctgattaggtacttggtggttcacaattgttatagactccgatggatggactggtataaggtgatcacagtcatgagtgtacatactctgtcggcgtattggcctcaccccaactttcatgcttttgggttgaaacatggtttacgttcttataataagttccgtaaattagctggtaagacatttctgcgacagcattgtattaagctgttccaggttatgaggtccggtataaattcattgtgagaaaaaaaactgcaatgcctgtaaaccaccttgatctctgaagattagctcatcgcatgcgcaacaaagggtgtgaaagacttcgggtctgtattcttttttagcttatatatgctctgcctaattggctagtacatattcagtatccgaaatgcccatttatttttgtttagatactgattggaagcacccaaattttaagaacctgttttatgaaaattaaggtggttccaaacataatagtttatatcccagtctgtctatagaaactgaattctttcttaaaaaaactagaaactagtctcctaactaaaacctgtttatgaaaattatggtggttccaaacactattaactagtttttttataaaccagtttttaaaaattagagatagaaattagattttttaaaaaaacattagattaaaaaaacatatcgatttatatatcagtttataggaattagattctcattttcttaaaaaccaagaagctggtctaaaaaataaaaactggttttttaaaaactaggtccaggtcgcatcccaatgtttccgttccctttcggcctgcatatgcttctgctatatatatggcggatgttgtatttgttcaaatattcgtcaaactccattaatgaaaataattcagaactaccggtaactaatctcacggtttttattgttttggaaaacacgacaactaatcattggtaccggaggccctgaactactgggcctaatccgattcaatatctcggcccacgatgcaacgggtgatcagtttttcccgttcgaatttcggagccctcctctcctccccgctccagcgcccctgcagttctcgctccactgacagctcgccgaggggccgcgccgcgctcgagacccgtcg

SEQ ID NO: 3075 - DNA, 169 bp, Zea mays
agctgcggttttggttctgctgagcttttcatctcagttttgtttgcttcttggcttgaggtttattttttagttagatataccagataggctcttaggttttcattttacatttaccagatgtccagttccttctgaagataaatggacgagaactgtaatataaaaa

SEQ ID NO: 3076 - DNA, 128 bp, Zea mays
agtgagggttctcatcaaatactctaccgcctgcaggtgcagaagattggaacaaggatagcctttcttcctgtgcagccactccagtgcacgccgccgcagcttgctacacgtgccgggcaagggca

SEQ ID NO: 3077 - DNA, 299 bp, Zea mays
caccctcaactggtcctggccgggagagaaaaaaacaaccggacaagcaaccaggaggcacacgacgctaatgaataatcttaacagtaatactgctccatgttgactagatggaaaagcttgagcctaaaccctcctctacgtccgacgaactccttaaaccctacccgtagtcgctacggccgatgtctaatattccatcggatccgaagcagctacggttagttaattaaatccactgacaaaaattacagcgcgtgactaggcatttgcttgttgggttgattgatcacgagagg

SEQ ID NO: 3078 - DNA, 54 bp, Zea mays
aattaatcgaccagaagtaggagggagctgagcgtgtgtgtgcggcatcgcagg

SEQ ID NO: 3079 - DNA, 92 bp, Zea mays
ttgctggtgatcatctgtaccggatggactacgaaaaattcatttaggcacacagagaaacatatgctgatattactgttgctgccctaccg

SEQ ID NO: 3080 - DNA, 293 bp, Zea mays
tggacagcggtgttcattgcctgtccaacggcccatagagcgagttgggccagcgcgcccagagaaagcagaagcaagcgcacgctaggcttctactctagtccagtggatgccgacctaccgtctcgttacgtgatccaattgcagcctttacgggcccagtacggggccatcgccgttccagttccagcaccaccgcccgtggccgttgtagcagggctgcgccgccgctctgactgccgtaggctgctgcgtgggcctcctaggcacacacacgggcgtcggcgctggcc

SEQ ID NO: 3081 - DNA, 476 bp, Zea mays
tgttatcaagcacattagtacatatataaataaaatattatataatttgttttatgtattatttgctctctacaacacaaaaggttgaaaaaaatatcgaatttgttttcgaattcataccgaagttcatatctattatttgagaaaatataggatgaatttgaggtttagcttttataaatcttaacaagctggatgttaaaaacaagaatacaaatttgtattgtatattctatatcctatttattcgcaatcaaaggaaaacaaaaaaactgattaccgaatcaatatcgtttccgaccgttttccctactcctgagccctgaccgcgacgggcgctgcattggctgcaggatcgacagctcagagtactcagcgtcttcggacggtgagtccgacgatgaggaagacgtcaagaagagaggaggcttcatcgatgaagcaccccgcaggagcacgacagcaagaagcacaac

SEQ ID NO: 3082 - DNA, 239 bp, Zea mays
agggtctaagctcggaattgttgcaaggttgtgctagttggctgaataccacacggaaatggaggaagttttgggtctgtcattttcaattccaaactttggccctaaatactgacatccaaacggggtgttagccaactttagacgctgtccggcacccaaggagtcaaggtccaaagagacaaaacctcgttttttcttgacccatgcttggctaaaaaaagaaaccaagaaacgcc

SEQ ID NO: 3083 - DNA, 1500 bp, Zea mays
gccgatcgatcatcaaccgcaaactgacgacgatgtctgaccagtttgcttaaattctagctgactcgaaggaatctcgagtatgtaagcggcggagcaaattgcaaatacataatatatctgcacattggaagaacgcacgcatcaactctctgcagggtcgtcgtcgactggagctggagcacacgttaggcaagacgtactgttcgacacatagcttttcgagagagggacagtagtggaggaggagggtgcaaaaggatacggtggcatcgctttgcgtgtttccattccatgtgccagcctaggaaccgaaccgaacctcctctcagcagctactctctctctctctctctctctctcactcacgctcactgctcactggactggacgcagccatgctaacaacttcttcttcgctctcgccgtctgtctgctccgggtctgctgcaacaactgccagtacgtgcccccacgatcacgatgagccgtgagcgcgcgcctaaccgctctggtccaatcatccggagggagggcccccaacttgtcacgtccgttcggggtgtttgggctggaaaggtcaatgccactgctccccctcacgctgtctgtttttttgttcccacctttgaattccccactctttcttcttggtttctcggcagaggagacgacagtgagatgcaggatttcagtgtttcaaaacatcaagtaagcaatgaaactgttacaaaaaaaaatattaagtattggtgaccactaccagcgatgacgacggcggcacggcactactcggccactcactcactcacttcccctgccaggaatttcgccttgcgttggactcaaaggcaccctctccttgccaacctaacagcgacccgtgagtgaccacaccaagactccctccccgtccatacgcgcaagcgcaatgcaagccagcagctatgatggacgcagatcgggcccaccaaccaggtcgctttggaaggttggggtgggtggggagagcgaggaagtgaagacgaagacgaccaaaggcaccagggatctggatgtaataaaagattaagccagggtgttggaccccgtgactgatctctgactacgacgccgcactgcctgcctgagtgcctgggtggagcggaggtggtgggataatggattggggaggcctttttatagaccggtaggcatgatgctcttctcattactgacaagcgccagagcagagagggagagatcgaacacacaagggagaggggtggggaagggaagggaagggaggcgcactcgtcccgtctggtatcgtctcccccggcagtgaaggagtagaaggaaggagagtaggagtaggaggggagaatgcgtgtcggcggcgggcgggacgacgacgacgaggtgtcccgaaagttcaagagcatggacgtggacaagctgtagaacggcgtcggggagaaaagcccctggcccgccgtcaagtaccacggctggaaggcc

SEQ ID NO: 3084 - DNA, 80 bp, Zea mays
ggtcgcagcttgtggtagctgccacaggattggaaggggatgatgatcttcctctagtaaggtttgtgcgccctagccag

SEQ ID NO: 3085 - DNA, 312 bp, Zea mays
gtttttttatttttttacagaaactttgattaagcagagacgatcaaatttagtaaaaaaaaattaaaccaaacaagcgccttttgaagcagtcaaccaaacaagctatacggtcacttttattttccgactatgttttgattgttttcttttcgtccactccaagacgaagcaaccggaccagccaacccttccgaccccacccgctgacatccgacgccgacgccggcgcagacagccgcaccagcgccacccaaatcccgcaaaaccctagagacagaagacgcgaggggagagagagaggcgcccggc

SEQ ID NO: 3086 - DNA, 837 bp, Zea mays
agctcggtacccctgctagctatagctagtacactaaaactcatctctgtgtcaacgtcgagttgttatagaggacgatatatagctgtaaaaaattaaaaactgaactctgaatgagtaatagtgtggcgtacagcagcaagtactactgtcccgtaccagctaaactacaaaggccatggaacgatcttgcattgggaaagaaaaaggaagacggcgatcgagaggtccattccagataatatatcacggctattatattagctagaaagggccgggatgccctacccagatgacagttcactggaaattcttgcattggtatcatatcgatcgatctcctagtgggtcggagactcggagtcgtccaataagtagtggtggggttagtcaactgcctccgtcgtagccctctagctagacatgatgcatgattatgcagatgccaattaattaacaatcatccgttattattagcctatcatgcatatacgaatacgacacacgctgcttgcatcagcatctctgtcgccacagcctgctgcgccgtgtatatatataactcctcctacagcagggcagggccatgaaatatctcaccgcccgcgcgcgcgcgccggcaaatatatataaagcaattgcattagcagcagctagctcagtgctgccaaagctagctgagctgcactgcactgcaccacagcatatatccaagcagcagctagaaagtagaggaagcaccactacgattacatatatccaagccaagcgccctagcttgctggtgttgttggtgctccggccggccctctctcgtctccttactagctacccgtc

SEQ ID NO: 3087 - DNA, 330 bp, Zea mays
ccctgattccgtgctgggcttcgcgaggtgctcctcgtgcgagacacacgcccgatgcggcggaatcgcgcggccggcgcccgagacccggcgtgattcggtggggaggctgggtcgcggtgcttccgcgtgcgggaaccagtgacttttttattcttctcttccccagcggctcgggcggctagcgggcgggccgcttggtgctcgtcagcgcgtgaggcggagattacccggcgccgatctggtgctcttgccgcccggagaggtggtgccgggggccattgccgggttctgattaggaggaggcggaggaggtaagtccctagtctt

SEQ ID NO: 3088 - DNA, 633 bp, Zea mays
ttatctgtaatccatagagatgaaacattgtaaaaacaatagaagttgtttcatattaaaatcaagtgaacaatttgataatgaccaaaccctatgctttcgcatcctggtcttcgtctccacacgtctcgtcctcggctaatcgtcgtcactttaagatttgttcggttagaagaagataagagaagattaaatctccttttaatcaaaaattaattagaaaataatttaatttccttgatctcctcttgtccctatgcaaccgaaagtcttttgggggcgcgcctccatctcctcgcgactgccgcacacggcacatctcagcgcctcgcctccaccagtccacctccacaacgtcaccttcacctcctcgccgccagacgcgcccgccgccaccccgtgagccggcaacctcccaccatctagcctctgcgcccgcccggccaccgggcactggccacgtccggccgacggccgcctgaggcagtgaggcctgaccacgccctcccttctccactttgtgtctgtgcccggtcttggattcgtggttgtctccgccactgatctcctcctagcacggcagcaccccagagccctagcgcaagcctggtgctccagatctccaccctgacc

SEQ ID NO: 3089 - DNA, 409 bp, Zea mays
gaactggatgaatcgctcgtttgccctcgaaatttgctctttgtgctgcatcagcaaacggtgttgtgctggagtgaatttttccttcgatatgttgctttctcgctgccttttccctccattggcactgacggcggcatgtctaaagaggctgcgtactggaggagtcaaataacaataggagaaattattgggccagaatatgggctataggtacaagtctagcaaaacgtagaggcccacaggcgcacggcacgtcgagcgagagggacgcctggcaaccgttggatttgtgattgacgaacgcactgcagcctgcagtactgcagatgatctggttccgtttgcttagcccccccccccccaaacccccccagatttcgccgcgagattatatgggattcggtaa

SEQ ID NO: 3090 - DNA, 943 bp, Zea mays
ctccatacatccaagtgtttaatagaatcactcagtcattaacgtaagtgctttgcgaagcgctaaggttagttagaccgcttaaacgtgcttaatctaggttgcatcctagttaattgggtggggttagacaatccacaaaacttctcagctcttgcgtgactataatacccaaaaaatcatgcttggggatttattaaaaagattctttcgagacgggatgaaataggggtaggataagaaacatgttggatataaccatagactgtatctagtaggtcgtgtaaaatagatgacgcagaactgtagacactatttgacactttttgtagagtggagtttaaaatatgagatcagataagatatgagataggagatctgctggagatagtctgagcatctctaacaacacgacttataaaaatgccctatattaatttaaaaataagtatattttgtatgctttagagtaccaataaaatattttgtttcaacagtaaaacctcaaatttagattatagagtagtccactagggtatagttatttgagacacttgagagaggttctataatttttaactaaattttataaaataatttattgttggagtagttttttatatatagaatcctatattttaatttgatgcatttgatttatttctggagaggcttacggctcaccgtgcgcaaggttcaccccggttggcacgtcattcgctcaccactcccaccgccaccggcctcaagccaacaccaccagtccacacatgcgcaggcgcacacgcacggccgttgagacttgagacagagacgcaggagcgcggaggaaaaggaggcccagaccaccgacggggaaaaaacatcacgaacaccgttctccatagcgggagtagtgaggaacgaaagagagggggcggcctagggcttcgattccgcagcc

SEQ ID NO: 3091 - DNA, 533 bp, Zea mays
acatgatcatttaaacgtttaggctaacattggtctatattattatagtaaaaacaacatatatagaaaatccaaagcgtcttataatatggaacggagggagtattttatttaagttgttgcggtatatttttccaaaagatatgttgggaagtcatttatttagtttcctactaggatctgtttctttgtcatgagcctgaattttctgaataacgaggactgccaattatagttcctcaaaagaaaaacttctatgcaatgtatatttcttcttgcatatatgtacacaggggcaagcctagtgcagtggtgagagctgtctcacttagtcaccagtttgcggctcgaagtagcctctctgtatttgcggagagaaggcttgcttcagtttattctttccttagaccccactcatgtgagagcctctggcactgagtcaatccctttactttctgatgcttcctcaatttttaaagaccactttctatgtacgatgtgtattccaatgattgactatcatattgttgttg

SEQ ID NO: 3092 - DNA, 1500 bp, Zea mays
ttgaaaatgcttcttgcaatcttattcatatacctttgactatttgcaaaagtgctttaaaaagattttctaaaagattttgcaaaaccaaaacaagtggtgcaagcgtgatccaaaatgttaaaagaaagaaagcaatccatgcatatctaatgaaagtataaattggtttaattctaaacaacctttgcacttaccttatgcaaactagttcaattctgcactgatatatttgctttggtttgtgttggcatcaatcaccaaaaagggggagattgaaagggaaatagggtcaaaccttttcctataaatattttggtggttgaattgcccaacacaaatattggactaactaatttgctctagattatatgttctataggtgctaatggttcaacacaaaaatctaagttagggttcaaaagaaaggagcaaaagaaaccgaagaagaaccctcgtctagcgcaccggactgtccggtgtgccactggacagtgtccggtgtaccagggtggatcgacttcaaactcttcaccttcgggtttctgaggccgcattccgctataattcatcggactgtccggtgggccaccggactgtccggtgtgccagcggagcaacgactcccaagcgcaacggtcgactccaacgaaaacctgaaaagcgctacagtgcacggacagttcgcacagagtcagagcaggcgccagaaggcgcaccggacagtgaacagtgactgtccggtgcaccaccggactgtccggtggcctaggctgtcagagctccaacggtcgaaccctaacggttgggtgacgtggctggcgcaccggacagtgtccggtggcgcactggactgtccggtgcgcccatcgacagcagccacccccaaccaccaccacttcaagcatccaagtttccagcacttcacattcaataaaagagctagtgcattcactcctagacacaaatcaaaagaatcaaagcctctccaagtgccaaatccactccaaccacttagtgacttgagagagtgttttgttcttgttctttgcgctcttgttgcttggatcgttttcttccttcctcattcttgttcccaagtgaattgtaatcaaagcaagagacaccaagtgtgtggtggtccttgcggggtctaagtgacctatttgattaaggagaaagctcactcggtctaggtgatcgtttgagagagggaaagggttgaaagagacccagtctttgtgaccacctcaacagggactaggtcctttagaaccaaacctcggtaaaacaaatcaccgtgttcatccgctttatttcttggttgatttgttttccccccttctctttcggactcggattcatttctaatgctaaccccggcttatagtgtgtgcttaagtttataattttcagattccgcctattcaccccccctctaggcgactttcaattggtatcagagcccggtgcttcatttgagtctaacaactcgaagtg

SEQ ID NO: 3093 - DNA, 150 bp, Zea mays
agagcgcctagagggggggtgaataggtgatcctgtaaaacttgaaacttaagccacaaaaacttggttaagcgttagcacaataatcgccaagtggctagagaggagtctcaacaaaacataataaccacaaagatatcaatcacagag

SEQ ID NO: 3094 - DNA, 981 bp, Zea mays
agtcaaacgaaaacttcactatatgtggagtatttacggaacgtcgtccgtagacggcgactcacaagaggagtaaatgatgacgcgctgcaaactctaattaggatcactaacttcggcctaagcctcccgacgacgggcctccactgtactcgccaacacggtctccatatgcagaattttggatcatgttcatgagaaaaaaaaactcaattcatgtagtttattcgggtagtcagttcggtagttcatgttcgatgacagagatagctcttttgtaaacttaattagtttgagatcgttcttcagtgaagcgttcaaatccagtggcacctcacagccatagcgatcactaaggccttgttcagttattgctatgccacatggattcgatgagattgaaaaatagtagatattttgacttgcaatagaaccacccaattatcttcaatttaggacttttcggttattcctaaaccttatggatttgaaggctttagataaaattatgaaggatttaaacttgtggtatgaattaaaaccaactcaatctcctacaattcataagggtttttgataaaaatcgaacaaaccctcacatagaatgagataaaaacgaacaaaccctaaggtgaaaaaaaacatgagcctgtaagtttgcactgtatgttcagcagattgctgaaccaaaccccccaaaaagcaagtcgttagaacaaaagccagctcgtgatagacaagtgtgtggcccctctttcacgtgctcttccagcacgcttgggtgttagctatcacaactttttagggccgagcaaagtgggaaacaatgatttacatctttgaatctgagcacaagacaaagcaccacatcgttttcagatagaaaagggtgtccacagtccactaacggcgccatgcgtgcatggcgtgctagctaggtaccttgcggcccagagcgaggcggaccactacaagcgggag

SEQ ID NO: 3095 - DNA, 491 bp, Zea mays
gacctctggtgtggccaccggccagccacccggtcccggatcagcctcgctggctgccgaatcaccagcgctaacacaagtgaccagtggactcgcgagttgcgactggaggaaggaagatacgatgggcccacctgctcccgggctaggccggatctttatcgggcctgcggcacctagcccagcgcttgcacctcacccaggacgaggcccagggaggatcctcccgactccgacgctgcgtaggactccccgactccgacggcgtccgcccgcgtcgcgtgccacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagctccagcgcacggctcgggtcctcctcaccgttcccggcg

SEQ ID NO: 3096 - DNA, 1500 bp, Zea mays
ttcaataccaaaccaactatggtattgaaatgagatgtaattccaattctattatttggatgtcactgaattggagtttagaattatgcggtctaatttcacgcaataccgaggggtgatgctctgtattgaaacactgagtttctagttatagtccaattccagagatttgggtctctgattctaaaccttaattctacgtgtaaccaaacaacaaaattttggaaaactgatttcagttctcaatatgtgttccaatatctatatccaaacgagtataatattttgacatatatatatatgtatagaatttgaagctatttttagtcatgttattaataatattatgaagtacaatatttttttatattttttgtgtgcgttattttctccctaaaaaagttgaaaaacatctgaatccgtgtttgtatccatatttaaattttatattaattatttaaaaatatgtagaatgaatttaaggtttaatttttatgaatattaataggtttaatgttaaaaacaagaaaataaatttatatagtacattctatatgttaatcgttcacaatagaaaagaagataaaaattaaatctgaataaatattcggatcttccgcgaagatggctactctattactgctacagtctccatcacacggtgtaaaatagaggacatataattgtatatgatactgtttacaagataaaacttgaaataaaagatgagaaatgagatgtgatagatagactgactatttggtcccactttctgtgatgcgtaacgcgcacggtccaccgccaagaggcgagttgccggtggccggtgggcgggccccgcaaccaccgcgacaggtcaggccgcgccggcgccgctctctttccccggaaccacgcggcagtcctttccacgcgtcgcaagttacccttccagccctccatgtcctggtcccgtgcacccggttcacagatacgggctggcctgccccatcgtccaaaccacctcatgatccgcgctcccagtgacgctgtgaccgactcatgcacctgatccactcagggaccttggtgcccccgagcccccacgcggaggacctgcccggtgcccgtttcgccgccgcgtgctcgtcccctccatgaaccttccgcatgaaccggtaatctccagccaccgtaagttccgcctcgcgatttctgtgacgcgggcctggtccatgcgacacgtccacgcggaagtgagccgcgcagcccccgacaggccgacactgtgctgcactactcccaccgtgaccgctgcaggcgcacctaccaaamcaacacggcaacacccattccggcagcggcaggcatctcctctcccgccccgccccgagcaacgcccgctaggctcaggctgctgctacccgcagtccccatccaccctacccgcagtccccaccgcaaccgccgcctcggcccgggctgtgttgacccccgttgacctccgccagcccggccgtc

SEQ ID NO: 3097 - DNA, 987 bp, Zea mays
ctttgcattaggagtgttagaagaaacatttttaagtgaccttcgtataatctcgataactttttaaatatttttagatcttatggtgttacgtctaacgtgtccggaagtcatgaacttaaaaaatctggtcacaactgggattcgactaaggtttgaaaaccgtgtccgaagacagaagacatgtgctttagacctgattaagaaatttgtagcaaccctttccgttgagttccagtgcgtggtgtcaactacggtcacgactttccgcgcgatcgccgtcgggtcgtgtcagtcccggcgtcggcaccggcacacgagaactcaccagaaccatggcaggcttggagtggaccactcatcaatcactcaactccgtcacgcacgggcccattttattgtggacccacacggcagtcaggcattttgggcccatgtccctagaaagccccctcctttctcgaagcccaacgcgcggaaagccagccatcgagcccgtgagtcgccaaggtcgccgactcgccgttctcctcgcccacaagggccaagccgccaaggccacgactctccgttctccaaccgttgctgtagaaaaaaaaaccctctcgtaccgttcatctggtcgaatgacatatgggcccagagctcctcgaaccatacgtccgttcgagcgccgcggatcccgcggtccggccgccaccttttgccggttgctgctcgccgccgttcgaaatttgaatccccgctacacgaacgacgaacggttcgtttgctcctccccaccgtcgtggccgaaaaggacaacggctacctcctccaccacccccactactccacttgttgcgtctccttctattttgtcgcgtcccgtctcgcctcggcttctcctccccccacatcccagtgccgagtgtccccacacaaccaagcggaagcttcggtcgaacagagggagtaagcagttgcgtttcgcattgcgcggcgccg

SEQ ID NO: 3098 - DNA, 1255 bp, Zea mays
tgtaggtctcatagtgtaggaacatatcacaaaaagtttggtggccaaaatgtaaaaaacaaaaatatggtttgcctagtgtctatagaagacactcggcaaagccttctttgccgagtgccagtcctcggctctcggcaaagagtgacgaccgtcagctttaggacggctgctgacggccctttgccgagcgctttctttgccgagtgtttgacactcggcaaacatgtcttgccgagtgcagtactgtgtcgagggtcctgcactcggtaaagaggctcgttaccgagtgccgaactttgccgagtgcggctctcggcaaagccctctttgccgagtgtccgacaaaagacactcggcaaagagtccgacactcggcaaagcctcggattccggtagtgcgtaatggaggtagaagctacacagacgagtgcaaggtaggttattttgaagaacgttgattgcatccgcaaaagacgtggaaaagacctgtatcctgccgtgcagtgcaggctcgaacgggcctgcgcgcctgaatctcggcatccaaacacgcgacatgtgtccaaaggccgatgtgcgtatgatatgttaactgcatcaacaccgctagtgggcaagaggaggtagcaagttggctttacgcttgctagctacttagctaggatgcttgcggattcaccgtgtatatgcaagttcatggccaaaccaaccaccaacatgctagtgcattcctagacaaacaagccaacatgcttcacgtacaccatgatcgaacgagaaatagctaggagtcccacgtccagaagaccagaacaagcatgctctccattctctaagcatactacgccctagagctagatccgctctcatccactcataatttagacaaccacctcccattaaaaccgcactttaatttggtctgcctcgccaagcaacaaattaaacaaacaaacaaacttgttcccgtgcagatcagctgaaaacacaagcatctatccatggagaagaaggtgatgaagaagcggctggctgtggcggccgtggtgctgttatttggcctgctactggccgtgcaggaggccgccgccgccgaggaggccgcggaagcggcgccgacgacgcccggcaacagcaaggccgactgcgaggtccccggcacttgcgaccggaacctcaaccaagccgccgaccccaaacgcccgggtgcggcggccaacccatacacccgcggctgcagcaagatcactgg

SEQ ID NO: 3099 - DNA, 156 bp, Zea mays
atcgatggcatgcaagcatatatatacctgagtcgatgattgttcctgagtacacttgtttcttagaaatttttatatatttggaaatctaacagttatcacctgtatgtatgatagattgatagtgtcgcacggcagacagaatttctctgagag

SEQ ID NO: 3100 - DNA, 1409 bp, Zea mays
ttggagagttgttcctataattttaaaaaatgttttgttgtttttttgattttttcgatttttaatttgccgagtgtttttctttgccgagtgcttttcgacactcggcaaagtttttgtcgagtgtccgaaaaaagtactcggcaaagaactctttgccgataaaatatttgccgagtgctacactcggcaaaagccttgccgagtgtaaaatgacctttgccgagtgtcttggacactcgacaaacaacacgattccaggagtgcatgttgataatcgttgatgataatcctcatacgttatggccttaatttttgaaagataaatcaaaagcatttttaggatttaaatagttgttcgtgagaacaaaaaaataagggtcatttgagagaacttcacttcaacaatttcagcttcgattttccggtttcaacataaaacagtttcaacaaaaacattaaggtgagttcgaagagtgttttgtttgtacatggactctagcttctgtaatacaataaatttgtgtgaattttttagattacctttaataattagtaggctgtcacaagagaatcgaagtagtatgttgtgtaaccggtggtatggtgattaatttttgtgtaacttcatgatgatatatgaaaatagtgtttgtgaagtacctcttgaggagcatcgcgacctgtttgaatagaagaaaatgaaatgaatccgaaattcttagtctcccaaagaggcgctaaatatgtatatgtgatttcaatcaatttctggcataaaaaaattgtgtgcattttgaatgcaaatatactccattgtacctctcatatctattacttagaggcccataaaaatagaagaaaaacaaattaataaaatgttaagttactaatttccatctattttgtgagcctcaacatagtaacatagtggatacgctgcaaagcagcctttgcatcgggatgtacaattttttttttccctctaggacctgtatatattcatgtcccgagaacttgtcaggctctcttcctccctcgccgcggaacacgcgccccgtcctcgcccgcccgtgttcatctctccattccataccttggtaagcaattctagacgtaatcgttcgtttcattcgctgggattgggatctcttctctcatcgcgagccctcgaatccaaccccagattcgtctctaatctgccctccccgctctgtcggactgtctcggattcgttcgctgcgtggcggggcggagccgattagtaactatccatttgcttcccctaatttcttctctggggtctcggtcaaattcggctgcggcggtgacctgatgggatcgtctgtttgtttggttcctgtgtctgtgcagcagtgcaggtgcggtggtagccgagcgctccggcc

SEQ ID NO: 3101 - DNA, 347 bp, Zea mays
tcgccactcgctttcacgctccatcatcaccaatggctcgatgccaaaaccgcaattaaaaatttcggcttgggcgtatccgtcaatacaccgagaggaggaagcctgcccactaccgcgtatctctctcctccctggctctcatccccccaccgagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgcggtgggcgcctcggcggcgatctggcggggaggat

SEQ ID NO: 3102 - DNA, 120 bp, Zea mays
actcaaccaaactccaccttaaatagctgtagtgttggctgcgcaaatcccggtctgatctagactgaggacgcgggccatacaccaccatcactccacagcgtcggcgaggaagtcggc

SEQ ID NO: 3103 - DNA, 1500 bp, Zea mays
cagttggctgcccccagtagctgagcttagctcagcttagctcagctaagctaagctggtggtgccaaacttaccaaaggagacaccacaccaacaggcgagaatcctatgccttatcccccccctgttattccattcccttgcctttgtgccgtccgtccgtctcccaagaaggcgttcgatcttatacaatggccacagctcccggccgcgcgctttatctgtgtgtgtgtatgccaagcttttctcgcaattcttcttccggatggatgatgcctagctgcagtcaaaaagaagggaagtttcaagctttggccgtccacgtacgtaaccgacatccatcgtatggccatcccgtactgcttctcaactggtgcatacatacagcccaacagctagcaaccaacagtacgtaagctactacatgcgatcacggaccatggatcctaacaacaacgacgagcagctctgctagctagctagctagctggtcgatggatcgaccgcccctttcgtttcggcaaaactggaggccagaaactcagtggagactggaactggttctcgaactaataataagatatcgatatcatcgaggaatctgagctagagaggggggctgctgccaagtttctacagcgacatcgtcagattatattgcagaccacgcagaataatctctagggtttctttctttctttctttttctcctcctcctcctccaaaagaaaaaggaaaaccaaagaggagaatgaaaaagattgttgtgcttcgctttcgcccttcgtcgttctcatgtggcaagtaatttcaaccaaaagctgttcatgatgagaacacacaaggcaagagcgagagggggagagagagagagggccgggttgttgctggagttgagaaagaaaaaaggactgcagggtgtggtgggccgggggggaataaggataatatctctttttcagttgctgcagagattgggcagtcgatcaggggggttgagtgcttcttcagatgattccacattctccgatccagccggtcctcttgccttataagacagacagacggccgggggagtctgctgcgtaacataacatctcggcaagaggagacaggaggtcggtagtttagttttcagaagccaaattaaattaaaggctgtctgtctcactcactcactcactcccagaagagagaagaccacaccacacaaacaaacacctctttggtttctacaaatagaggacgcactgccactgactgagctacaccggtaaaagctgccaaggatatatatcccaccagtcaggaatgcccgcaaccagacatttcagtacataacaggagctgaacaactaacgtacaggtgaggatctcatgtgcttcgctccactctctctctctctctctctctctctctctctctctttacctgatgatgactggtggagcagagcaagaaacgtactgacctggagttctgcaggctgacagcagcag

SEQ ID NO: 3104 - DNA, 48 bp, Zea mays
ggcaaacaaccaacatttgatggtgaagattatgctaggtggagtgat

SEQ ID NO: 3105 - DNA, 50 bp, Zea mays
tgtgagttaacatatcgatcttgaattcacatcacaggaagacacgtggt

SEQ ID NO: 3106 - DNA, 714 bp, Zea mays
actgctcttgtagatgcacctataattctgatgctccaagtatatctcctgaaagataatacatttagacatgaaaatacagaaacaaataaacaatatagtatgatcacttttccaagcgactttctacaagcctgttgtaacatcccagggtccacaaacaccccggaatgctactgaactacacatctaacatatatatatatatatatatatatatatagggaaaatatcctatgcaatcacttatcctgatgcaagcatgcgatcaagcgatctggtgcatccgatctagatctaatgatgactattattttatatttaacctctttcacctaaaacatactacctattttacttttaatctcttccatatgaaaccgttagaactagattggatgctctggatagtttgattgcacgcttgcaccaaaataaataattgcacaggatatgtcctcgctttcccctccccgccccgccgcctctattttatctatctatttccaccacgcgctcgttgtctcttgtcgctgcagcctcgtcccgtccaatccttccaagtctctcttcttgctgcaggctgccccaagcccaggctcaatccggctggacgaggagacggcattgctcgcatcgcctgccctgccctgccccccatgcgtgttgtgcgcatgaacagaggctaggctaccaacaacgcatagcatagcc

SEQ ID NO: 3107 - DNA, 1500 bp, Zea mays
cgaactttttatataagtaaataggtgccttagaaaatgatctaaatgaatcaaaacaacagtaacaattaaaatcaaagaatcaatctagaattaaaatatacatgtaattaatcaagagagagaaacaatgttaatacactaatctagcatattcaactcttgccaccagcccctcctctgagctgctgcctgctgggctcccgctgctacaggccgcgccctcaggctaccacgggcctgcgtcagcagcgtgggcccctcttcacacacgtctgggccggtgccacctttgggctgtgcctattcactacgtagggccgcacgccccttatgaatccgctctacccaaccgtctggtgctgccagcctgctgctcctcgcgggccgtatgcgacgcccacgcacgcctccacatgggcggctgcccaggccgtcgccgttgcctgctgtgtgccgcacagctcgcctcgaaaggcaaagcgtgggctgcagcagcgcaactttggagcccgtctgcacccgtatccacacccccccccccccacccccaacaacaaggggacatatctagtgcacataaaagactaatgcacatggtacacatattaagttattatcactcattttagatctaacatctctagttgattattcaatttacaaataacaccttccaccgctacacatcaccacgttgacggatgtccttagtaaaatgtaccaaacaactagagacgttagattaaaatgagtggtgctgatttaatatgtgcaccatgtacaccaatgttccatgtgcacttaaatatgttgtccacaacaaaagtcacggaggccaaactgtactgattagtttggaaagcttcatagtcaagccaggattggctatccgcctagaacactcccttgagatgactgtcacctctccatctaccacaggtcattgatcaagcgtcgcgggacccgcatcactgtcatactagagattttccacgccggccggagagtcacagacacagacatacggatacggacaagcttggacagccacggtccaagattgaggcgtggtgcagcgtggcttacacggcgctgcgacacctgcgtgcgaattgcgatgcctcgcggtagaatcacttggccacaggcgtggccaagtccacgaagaaaagtgttgcctatggttcaggatttcatcggacatagcagattgtttcggagaaacatgcgtcgcatctgctgaagaaaagtacggttccaagtcccgtgctcgcccatcctgtcatcctgggcgactgatcgggccccgtgggtggtggtggtgggtgatcaccttccacagcctaatcagtgccagtcaccttcaccgtcgatatatttttaaatttttgatacaaccggctattcatctgtattcgtttcacttggctgcttgctttggttacccaaggaaaaaagcactgaagtaacggttacggccaaacaccgactgttcca

SEQ ID NO: 3108 - DNA, 1131 bp, Zea mays
tgcatacattgtcgtatatactctatagtaaatgtttttgtgactttatttgtttatttatagggaggtattatctagtggatgctgattatgcaatccgcgaaagttacttgcccctatattggaatcagagatatcatctagaagatttttatcgaagatgagcagaaactttagaggaaaggttcaattttcaccactctgagtctgcgcaatgtagttgaacaagcttttggacttttgaaatcatggtgacatgtgttgtgagaactcccaatgtatgaaagaagcaagcaattgaagattgtaattgcttgttttgttttgtacaactatttgttggactgaggccacatagggggatcaaggagtaactcacatgaccaagctgatgttgattacgatgtgtcggatcgagcgagtgctaatacaagtcaagaaatgacagtagtgagagattggatcgctcctagagtgtcgttgatgtagtcatcaatgggtagtagtgttagtgaagttaagtttgttttcttttcatatttggtgggtttgcacaaattactaacaatttttaactatacacagattattgattgacaaaggaatccrgaatggagccattttaaaacgagccattgacaattttgccattatcatttgtgggcttcgccagtatgccatcggacccacaaatcatagacacagacggtcccaccagtcatagacacgggatggcataataacaggcagccaaatttgagagtggcaaaacagcaaatttctcttttaaaacttgtgattgaacaaccgtgggtaagtgtgatgtttctcagtgaatgttatgaagtagttagctggatgtgtttgtgttctaatgtatcatggtactgagtaatctttgtggtaccgactagctttgcagtacttagatagttagatgaatgtgtatatgtaatgtactctgttcatatgtatttttgcactgttcgtggctgcgttrgtaatgcaactcaatttacattgcttgcgctgtgcagcagtagctgcagctgcagcctcagtcgaatggtaactacatcggcaacctctcacaacccttgccgccgccggctgctccaccctgctgtcgcc

SEQ ID NO: 3109 - DNA, 114 bp, Zea mays
agaggcgcttggcatgaagcgacctaccaagaatgagacgctgggctacccctggcacaagtagagcaagagccccagcaaccgagccacagtgaggaggactcgagggaagag

SEQ ID NO: 3110 - DNA, 815 bp, Zea mays
ggtcttccttgtctactaatgattgcttaatttctgtgtactactgtaagatattgtgatattcggatctgcttgtcatgtctttctggcataacagtttcgtaaccacaagatcagttttgacatttaccacggtgcattagaaaacttatagattagtgaatagaaccctagaaaaatattaaagattgtatatcagggaccttaagtgggcatttggatctgaggcaagggggatcctagctttacagcgaaaggattgaagttttataggacatcaaaattcaaaagacttattttggggcaatataatctgcaatcacgagcaaaagcttgctctgtgaagagagccaaatcagtttggcaccaaaagaaaagtagcgctgcagtgaaaaaaaagtctggcaactgctattcagaattatggccaaacattaatccttttctattgctggttgtagaacagatgggggagctaggtataatctcagcagtcccatcttcctggtgaaagtaactatttgaaagtttgaatcatctggctataaatgcatgtgataggctcacacaagaaagtatgtttttttgtgtaagtatgacatatggaacacaatacaatgatacagataataaaccataaacactgctctaatattgacaggggaaatccagagggaatgaaaagaattacacagcgtctcatcacataaaagtacagcagcttcagttattgatcagtggttgctactttggctggttaggttgacctaaacagggctggcgtacctttgctcgaaattgtctcagagccagac

SEQ ID NO: 3111 - DNA, 180 bp, Zea mays
tgggcgtggctaccaaccgcagagtttccatgagcagatgcaaaccagtcggcggcgagagcccagcagcagacggacctgacccgcggcggccgatgtcggagacgccgtgttccgtgcagcccggggtcgtccctctcctcgggaagccatacttcacatgcatcctctgcaagtctc

SEQ ID NO: 3112 - DNA, 815 bp, Zea mays
tgggaattacttaggagctgtgggagtagcttgcattgttgcaaaaaaggactataatattgtgtgcgtgtctttggttatgaataaaacaaaatagataatttgccatgtctcttcctatctcgtttgcattattttggggaaaaaaaggaccgtaataatgcgtgtgtctttggctgtatgcatgaatacaaaatagacaaaataatctctccagagtggaacgctaagaaataatggaagagacaggagggacaactaacgactgttaggttaggtagtatttgaatctgaagtatagtgggatggagcatatctcggattggatagagtgactttaaaaaggaaaattcagttccaatcatccagctctctaaaatctctcggatgaaaccgctggcatggagctacttcatcccgatcaccaaaccctacgttactcaagtgacaagtggtgggaggccaaacgctagctgggccccaccctagtgcatccgccaagagcacatgcatgcccgtgccgtgcgcggtgagccccgccgccgagttggctgcagagctgcggagtcttggcgaagaccccgcgctgggcgtcgccgctgctgagtcggtcaacgaggcgtaaccagcgagccagcgacgcgcctttgggttgggattggacccggtcgtcccatcccagccccgcctatgtaaagagcacccgccgctgcccagctctctcattcctgtcggcaaggtgaacgcgagagccgaccgtctcagtgtgcgcgcgaagaagagaaggaggaggaggaggaggaagaagaagaaga

SEQ ID NO: 3113 - DNA, 1026 bp, Zea mays
gttcttattcatttaacatctaatatgtggattgtggactatgtattcacttttgatattaaatttattttttagaggtataaaatatgattactacatgtatatacaggagtgtatataggagtagagatacacacaaccagaagtgagaactcaaattagccgcggtccaaccgtcatccccaaggaccggatatatagtcttggagcgtattctagacgtcatggaaaccacgtgttacattttgttgttttctttcagaagagtggatttgtggagtactagctagacaccgcatacgtacgaagacctatatccgccacaattagtatcttgctattggctgagaaaaatgtcaaagacctatatccgcgtggtaacttaggggtgtttggaaacaaaatttttctgcagtattgaagcaatactgtagtattgagtaatactgtggtattatatactttgaggtgtttggaaactcatctgaaatctctgtatactaaactgtagtattgtaaatactgcatttgttttgcagttttagaaactttggtctcagccaaagtttttctctgtaaagagagcgccagcttgttcctgctctagccgattggtctcaaccaaagttttttccaaacaccttgatgtattggatactgttgtattcaaaaactaaagcattaatgtcattactaaagtatactttattatttaaaaactacagtttggaaaaaactgtgttcctagacacggccttactttttcgtcctgtctccgccctcgtgcgcgcgtgcctataaatctagcgctgcaaacccagcagcttaagccgtcgagacagcccacctagcccttccagcaacacgcgatcggagggttgagacttgagagctattggaagcaagtacgtgcatggcgaggggtttgcgctcgtggcgtgcgctgccgcggcggcggcgctgctgctgctcggcgtggcggcggcggacgtggcgtcgatcatcacgcaggacgtgtacaaccag

SEQ ID NO: 3114 - DNA, 79 bp, Zea mays
ggtaaggcgagacaaggcgttgaaccaccgcctggacgcctaggcgggcaaggcgcctaggcgttggacctccgcctgg

SEQ ID NO: 3115 - DNA, 1500 bp, Zea mays
tacccgttgggtttccatttgaacccattaacaaacccatgggtagagaaattgacccaaactcatatcctaatagagcaaaaacccaccgggtttcgggtagcgggtacccattgccatctctagttgtagagctgtggtgacatttgtatgctcttcgtacacaatccaaagcaaataatgcaatgaactccaaaagttgtatattttgtttagatatcgaattcgaatacaatatgtctgatatctgtcggatattgaatatctggatatcttctcgataaatcttctcggatatccggatatcttattcggatagttgtgtgcattttgttgttattttatatgcattttgttgttattttatagaaagaaattaataatacacaaatagcctcataaattcataaaattttatggagacrtaacatatgtttctcagatatccggatatcttattcggatagctgtgtgcattttattattaaaattttatggaggcataacatatgttcatataatcctccaaaatatttggaccataaaatccacaatatactagtgtttctttcatttcactttttgcgtgaattacacgtgaaatcactctaagtatctaaggttcaacataatcaatacttcactttatcatttttcatgtggagacttgaggttatatttttatataatgtttattagtctttgtaatttatttgcatttcgatgattttatgcaaaaataaattaataatacacacagcctaaaaatttatgaaattttacggagacgtggcatatgtacacatataatgctaagaaaatgtttgaactcaatgagttaataaatgacgtggaatgatgtcttacggtatccgacaaaaaaattcgttaccaacgatatccgtctccaactagtttcgtatttgacacgccgcagctatccatatttgtatttgagaacattcgtattcgtatacaaagggatgtattcaaatttgaaaccgaataaaaatatgaaaaaatatagttttaatgatatatgttattcgatccgattaatccctatgtacacctacactacataaggccacaacgtgtcgtgtacctgttgcgcccacggaccacctcgtcgattgcatgccccacgccgcacagcccctctctacgctccatgtgtcatggcgccccgtcgccaccacgaaccggcacgtgggcccacgtacaggggcctcacgtgtcagggacgctctccgctgtagcagtactgcctaccctaagataaggccaacaaagcgagacggcgtcagtttgccgctccctcaagacacctcgctcccgtcagttaaccgtggttaagttgactaaggttagaggataacactagttagatggcctgtttataaacctgcctcccttcatcccctcttctcacaggccaacaaaggagcaaagctaccgtcgccgaagccgagcgacgttccaagaaacgaaacagccatg

SEQ ID NO: 3116 - DNA, 684 bp, Zea mays
ttgagcttctcgacaaatgatatggttgggtagaaaaagtttatggagaaggagataacattaaagttatttgacttcttgagcctaattagctactctggatagtatataaaaaatcataggtgctttgaaatgttacaccctctatagagccagtgtctagactatttcagcttgattacagcagagaatattgtggcaacttgtttcggtgtttccaaattatatatcttattctagtagctgtaattattactactattttgttgcatgttctgcggacggttcacccaaatcgtatatctgagactatgtactctctgcatgactacaatatcatcagctgattatctctctcctcctcggtatctcatcctctgtctcgtgactagtctcgaataggataggctgagtaagatccctaagccttatcaacatccagggtcgacccgtttcagtatcacaagaatctagctttggcaattatccaaaaccttcctgtcggttcgctgcaaaagcccctcttgccatcacatttccatgcctatataaagtcgcctccctgcacccagtcgtactcgtacctctaagcaagcaagcagcaggcaattgctagcactcgtacaagaagcaaaccccgcagagatcttaattactagctagtcgcttaattcgatccttcac

SEQ ID NO: 3117 - DNA, 848 bp, Zea mays
aggcagtgaggctcacataaatggtagatggatttccagatttggtccatgttctcacatattctttttcctttttgaaaaaaaatcgaattcatatttctgccaattatgtatcaggaacttgtagatggcaatgcacctagcatatgagcgtccagtaataaagatgacatgggcggtggtggtgatttgaccgtggcatgaggggcgtacaacataccacctagcagtcagctacctccctgcagaattggctacattcaaacattcagttaacaaacaaggtcagccttctctggtgctgggtctcaggtccctcatcatcctcagaatctggaaaatttggaaagaaatgaagaacagagtgttcagtagacagtgccgctctaaatctgggatcctctctggtagcagttactcttagattaatgttgtgttatgtgtcatgcattttcctggaaatcgtttttagtctcccaggggcggcaagaacgccaagtaccttgtatttggagaacttgcaaaaaattctgctgtgcttttagccttttagtgcacaactgtaatttacaaaggcgatataccacttgcacacaaaaggtgctgtactgtcaatatttggtagcacttacaagctacaggctatcatttgctgaataaaaaagaagatgagtgaggctcactaatgtcttttgaaggcaaagttcagaagcatggagtcaaagagaagctagcaaacaaagctcccattgacttcctcgagatccctgcaaatgcaatgcaataccctcgcctatattaactcgtgttctaccctcagcaaggcacttttagctgcagcttaagca

SEQ ID NO: 3118 - DNA, 1271 bp, Zea mays
atgagtggcctcatggtatgtctagcagcttatgcgaatggaactgggaactaacagtacaaatgatcttgtgatggtgaatgagtgacactgactgactacttagctacttgtagaatccagagtggattgcgataccatgaatcgataaggtcatttcgctgcttagatggcaaatgctctatcaccaggcactacagaatggacagagaactgtgtggttctatttgttgtattcttgctcttgtttgtctgttgtagtttctccaaggttgtactgcttgaccttacttgttggatcttaatcttacatatccagtcaccagggtattttcaatctgggagtacatacttaggccgtacttagccctgtttagccctgtttgtttcggattataatctctctagattatataatctaacgcaaataatccaacagctaaataaacacctagattatgagtttagattatataatctaaagcctagattatgataatctcataatctcctaagagtagcttatttgagattattttggtaaaagacccactacccatggttatgtaaatagaaattacaatatatgtcatcatttttttctcaccttaaataaacaaacaagggtactactgtctttatgaataatctacatttgtagaatctaaactatcaaaaaactatatgtagattataatatgtctagattataatttagattatataatttagattataatccagattatataatctataagctgaaacaaacagacccatatgttactagcgtttaagcgtgaggttgttgagccgctcaagcagcgaagcatgccaaaatgtgatgacgacgaggcgcccatggcatttctctacttttttgttgtgacgccaaattcttcggttatgggcttatgacaaatacaggaaacacgtactaactctcggctctagcccgtgcccgtggacgcatggcagtggcaccaccactttgcatgtgccagcgtcaaacaatctcggctagtcaaccttctagagaatttccatggaaacttttcaaacttctccagccaccattaatgtccacccacgatgcaggtacggacgcgatgacagctcccagtgcaccatgtttgatcttttacgcatctgatccatatccgattctacaggtcatgcagtcggtcatgcagtctccagacccactataaaacccaaagcaaagcagaagcactccacacgcttcagcattcttcaaatacttgcataag

SEQ ID NO: 3119 - DNA, 1370 bp, Zea mays
accgtaggagtgtctttcgatttagtatttcaatttagctagcggtgttttatatagacaacacactagcttttggacgaatcttatttggttattagtttcacgatcgaacatcaataatggttacatcaacaagcttcagattcagattcgtgcctactccagtccgacccctccgcccgtggctccgttacgtcaagggctatcatacgacagtgtcgccgacggcaacgacgacgacgacgaagccaggagtggagttcaacggtgatgtatactgaaaagagtatgggcaaaaccgtctcagatttttgagtgtgaaccctaaatgagtgactggtgcttaaacagaggtagttgtcgaaggaacacacgaatcaaagaattgaggagaagtgttaaattctgaaagcttatgttgacagacaaataaattgagtcccatattctgaaatttctcgataatagtgagtagtttttcgtaaagttggtagcgggtttttttacaaataagattagataaatattggttgagcattttattagattatgatttttgactcgttatatcttaaaatattagtcgttttagctcttaatttttatgtctaaatttaaatggacttaaatggatgatgataaatttaaacatacatataaaagaaatatattaattattgtatgatcaactaaaaaggtaaaataaattttattttgggatggatggaacaatttatataatcttgtataacaatatgttttttcttatatagattaagattatataatctagatagatcaaaccttaatcacatagcagtatttttctatcccggcggctctggtttgcaaaattccaaaatgtgtatagacaaaatcacaaatgaccggtaaacacttggaagcacgaaaatgagctctctctggactgaactagtgagaatacttgagaaagagcgtataccagtctagcaccgaactaccaaaaccgaccgagccgcgaacttcacccctgccttctctcccttctccgtccaggccctggtgcccgagcgttctcgtgcggcaagtgggcgccgccgccggactacgccaggtgcccagttcctcgtcgggtccttcgtcgacgacgagcacccaccagttatgccctttctcttcccttcttgctgtgcgaaacccagcaccatccgaaccctaacttgagctatctggctatttgcrtccggatctgatctaattaccaagcgtgtacatacatactactaacttcgattttttttttgggaaaaatattggaacatccgtgtcctttaccgggttcccccctatagaaaattcgagtattagactctacatgtcaagaaagt

SEQ ID NO: 3120 - DNA, 400 bp, Zea mays
tgtaaacaaatgtcagttgaaattcaagcgaatcttaatcacagctggttcagttcataaagatttcttctcatctgggtacaaatacaaacaaatgcaaaaccgcttggcaaaacgaaacgcttgttgttgttgttggttgcacagggaggcacaaagagtggcaaagcaaagggcaatgggcaggcagacccgcgcggccatcctcctctagaaccttccacggccccacctcctccttcgttcctccgctcaccccaaccctcctcggctcctccctccacgcctctcctcgtcgacgagcggacccggtctacgcccccgacccccacccccgtccctgcccccgtccccgccccctcccgatcccagatcccgccctcccatcggggcatcagcc

SEQ ID NO: 3121 - DNA, 213 bp, Zea mays
ttcatccatcgccatgaacgaagctgccatcgggcctttggaagaaaggcctccattgtgtaatacagtctatactcgtctattccagcccaaacaaacagggcccaatattagttctcaaccgtcccctttcccgaagtcaagtgccaccacgacgctactcgtcctcatccagtcacgaaaaatcggaatctctgaaaaatcctccgtacc

SEQ ID NO: 3122 - DNA, 797 bp, Zea mays
atcgaataatttatacgccgtcgcaacgggcacatacctagtaaattaaataaggaggaatttgatgtcctccggtccttctcaatcctccactcataagacccactactttgtttggttagaagtggattgaataagattatagaagattaagtctcttaattgaaattgaatagaagggactttaattcctttagtctcttttaatctagattcaaccaaataaggtctaacytaataagcctttaatactccatcttttgagcgatctttagacattaaatgatttaaatttctcaaggaaaatttatcacatggaatgtcatcccctgttgtttgcagaagrgagacaaaagggcaatggatttgatttgtagttaagttgttcttgggtgttttctgcacaagggagacaaaagggcacatgttatgactcgcatagcatgaattatacattaaggtgcaggctagtaggatactgcaacacagctattggcacagcctatttcattacggttgtaagcacagttttaaggtctgcaaaaaaaactgctgcaccaatcacctgctgaaacaaaacatcttcactagcataacttcatcgcaaaaggcgagcctgcagtcagacagtaaaaagagactcatgatgctgatcactgtccatggggggatcacggcatactgagccgagaccgcagcctgcttgcaatgcagtcggggcttcgttcaacgcactttctcttccttgagactggcttggacgacggagtggcacacccagcctccgtgttggcttg

SEQ ID NO: 3123 - DNA, 450 bp, Zea mays
tggtggtcgcacgcgctaacctagaagccccagaggccagacagacgcggaaggggatttgcggcggcggcggcggcggggacaggggagtcgtcgagagaaggcagggcaaagttcaggtggaagtgagtggcaagtgggttcgatgggccaagccactgcccactgcggcccgtcgaaacacggtttcctctttctcattcggttcaaccaacaccctccactcctccagagccttccagaaccccaatctaacggccaaggtcgccccgtgcccgaatcttctggacgcgccatctcctcaataaaacctcctcggctcctccagtgtccctcgtctctcgcctgagaaaaaaaaaatccacgaaccaatttctcagcaaccagcagcacgacctgtgagggttcgaaggaagtagcagtgttttttgttcctagagggaggaagag

SEQ ID NO: 3124 - DNA, 1120 bp, Zea mays
gaaaaaacttcttccttatattcacggggagcttatgtaggagcaccctatttaattaaaaacgtagttcctcctaattttatggaagagtgaatgaaagagagccaaaaaagtctgtttttagagctcctggccttgttcgtttttatggatgctttttctttttttcatggagaagttagtggagaagctcgccatttggtagattgtgtgaagtagtagttgagacagcccttgaaagagctcaatgagggctattgaacatgggtagagtagtattatccacaattcctccttttctctcgtctttctcaccaatcaaacaacatgttcatttagctttaattcgtatcatgtctaagagcattttcaaaagattctttatttttgactctctatttaacttttatttatcttttaataaagattatactttatataaagcatttcactccaacaggctatctatctatttcagctagtcaggtggctaaccaagtttagttagtcagggagctaatttggagagtcggatagcttggcgagtcggatcgctagtctgttggagagttattttgctgttgattagccaaaatttttcttgataagctatttacctagtctcatggagatgttctgatgcttatataatattttttatttataagttatagctacaacagtctaaatagctgactttaatctgaaatgaataactaaaaaacacaagaacaaacaaaaagcaaaaaatcggagaagtgaaaaagaattcgtccattgtttctatcgcgttttttcatggcaggtcactaaggtcagatggcaggcgtgtttgttccttccctcaccctcccccctgcttttgtgctgttgcgtcctgccggagagagagagaacgctggactgcgctgcgctgcgctgcagactacacctgctctgcgtttgcatgtctttcttggcctcatgcttgttccatgtttgaggacacattgcacgcaggcaggacgcaggcgcacaccatctcctcccttgcccttggaaccgccacccttccacctcgttctcttctcttctcttcccttggctccgcccacctctgcggctctgcctcccttcggca

SEQ ID NO: 3125 - DNA, 885 bp, Zea mays
ggtatacaaatcagacaccgtataatccactgcattggcaattcccagtatagtgacagttaagtacaccatgtagcatttcatctagcaactgatacccaatactcctatggctgtatatgtgataccatctaatgaagatttaattctaaggaatgtaaatttctgaagtgtgttagatatatacaagaacataaaaagtaaacagattgctagaaaaggtctcaactcattaattatcctggggctttggacaatttggaaccacagaaatagatgcgtatttgatggtctttctcctaacttggaaacagccatcagaagagcaaaggaagaaagagaaatgtgggagctggctggtgccaagagtttggccctccttactgccccaatcccggggattggctcgtagtgttttttttaggttgtttagatggatcttctcaggtttctgagttttagacctccgtaagggagtctttgtacctggtctgtttttagaccttctttaatttccttcttcttaatataatgggacatagttctcttgcgcttttcgagaaaaggttcactcttggacatggtcttaaaattgtgaagtatccctccattattgtgagtgccttctctgatgcaaattggccaagtgacatagatgatggccctgtttgtttcggcttctagcagcttctgaccaccaaaagctactgcggactgccaaacgctcagctttccagccagcttatataaaattcgttgggggcaaaaatcatacaaaatcaacataaacacataatcggttgagtcgttgtaatagtaggaatccgtcactttctagatcctgagccctatgaacaactttatattccttcacacgtaatcgta

SEQ ID NO: 3126 - DNA, 1500 bp, Zea mays
ataatcggttgagtcgttgtaatagtaggaatccgtcactttctagatcctgagccctatgaacaactttatattccttcacacgtaatcgtaatgatactcagattctccccacagccagattttcagaaaagctggtcagaaaaagctaaaccaaacaggccatagtaggtgccccgtccgtccacttattcgtttgcaccaatccagctctggattagtatggattggaattaaatcaatgccacaatctatacccccaaaataatctaagcatactcaaaaaaaattattcggttaaactcatcatagattataaaccaagggtttaggaattttttaaactatagaaagcatggattctatccatagctctttaggtatgtaacaaatctatggagatattgcacaagtttatattagaatccatgaatcaaaaaaaataactacctttgagatatacatggattaaatgatggatttaatcccaccatgggattgtgtgtgaggtatggattcacccaatccagactcggattaaatccacaacgagatttcatcccttgtaaccgaacaagctaacatggattgactgacactttgggtttctgaaagacttctgtaacaaatccagtaacagatacatcctgttttgaataatataatgcaatgctagacgtcagtataactgtctataacatcttcaggagtaacatgtactgaagacttaattcatataccatgtagttgtttttagatccagtggaagatgtagcatctatttatttggtttgaatcctagtggtttctgcaaaataagctcaattatcaatgaagaatcaaactgtatgtaaagtgcatacaagtgtaaacaagcctcttaaacagttggccatcactgggtttgagagtgctaaactagatttgttcatttgttgttcactgtaactttcatatcctttcctagaccccagtcatgtgggagcctctggcattgggtctgccatgataactttcatattaccaaagttaaatgactcctatatgaaaaatctcagctcagattgcactacttctcttccattcaaattcaggaaaagctcttaaaaaaggaaccacaatttgcttaatcagctgtaggcccaattacacatttgttaccgacttctatctgattgggacaaaaacatgagcgatgtagcaaacagatgggattctgatacacattcgcacctgcttagctgtcttaaatatagggttgtgaattgggactggtacgagcataaatatactgactaaatgatcttgttctattttgtctgtagagtgtagattgataaacaacattgaatatcttttcacagcgaagcatttcatagtttgttaatttacatatgcaaagcatgctgctttaatttctgtatttctcgagttagcttcttttcctaactactactactgaatcacctttggtgtggtattttacaagttttttatgca

SEQ ID NO: 3127 - DNA, 126 bp, Zea mays
cccccctaagtgatgattgttgcaaatactgaatatgatgacttggtttatttcgtgcaaaaaaaatttagttaagaattaatctttctgggtgattttgttttgcaggttactgtgtggttaatt

SEQ ID NO: 3128 - DNA, 1247 bp, Zea mays
caacaacatgcacacaaccaaaagagagagcgcacaaatcgaaacgatagagtcacagctcaagaacgcgttcaaatatctttctaacaaatcaacagcgtggtcgcagaggttcgaagttgtagtgtgctcaaaatatgcttgagtactgctccatggcgcctagggggtccttttatggccccaagggacatatgagctgttggatcttcatttggaagctcccaaccttttctgtctgtgggtgcaccggactgtcctgtggcgtaccggacactacacagtgcaacagtcaacagatccctgattggtcactttccgtttcaggcggacactagactgtccggtgcaacatctaaccgttggctgtcttcacaccggactgtccgacgcttcgcgcggaccgtccggtgaattatagccgagagtgctcggatgaaaccgagagcggaccagtacgatcggacggacaccggactgtccggtggatggcaccgaaccgttcagtgtcgcctagtccagcacaacttgttcctttttatgccaactttcttttgctccttttgactcgacttcttatggtccctatcatttagtcaaacatgattagtacctcaataattgactaagtgctagaaacatacctgtttcactttgatccatagatgttttagtatgcctattttcaaacctaaagggtgccttttcttgtaatccttaatttactttacaaacacctatgctcatgcccaaacaagacctatatttgatagacttccactattgcattcttttagtttattatgaaaaacagctaaattaattatgttatggtacagacgttctgtttgataccactttcgtttttaaatatacgaagaagctacgaaataggctgtgacaaataaagtttttgtgcgattgccaacgagagaagtttagggagagtgggagacaaagcggattggtgggctacggtctacagttgggtcgtacggctgtgaatcttgggccggcccatccatttttgttttatattctctggcctttgttagcctagactccacccaacttttcttgccaaataaaacgatgaaaaagttcattttacctcagtcaactaccaattttctcgctcagacatacagaattacagagtcgaagtgcgctgtggcctgtggactctcccctccccaactccggcgaagggagcagaaacgttggcgtgttggttgggtggcgtcggc

SEQ ID NO: 3129 - DNA, 1410 bp, Zea mays
ctgcaggtctattcaagatgatcctgatgttggatcggggagacggatataaataatggtgtttggatggtttcttttcgtgttaaccgactacaatgacaggaacgggattagatggcttgacgagcacacatatatgcagacatgaagtgaagtgagtcggtgagcaacatgcttgagcacgaaacgctgcgctaaccaactcattggattggtaatctgatgatcttttgtttcgactcttcagttagacgccggcccgaagattaattcgcttgctcgctgtatatgttttaaatcatgagctattcgtctgtcctttttatataagctgtattcactatatacacatctaaacacaatgtgtatatctaaacgtacgtaaattttttaaatatataaaaactaaaatgatttcttgatccatagatggcaaataatgtgcatctaataaatcacaaatcaatgcatccataacaaatagtgctgggaatatgggctgggcttttcgggccagtacgagcacggcccgaaaatagaagcccaaagcatggcccagcacgaaataatatggggccggactagcacggcatgaaggcgggcccaggtcggacctcaaattccgacccgtcgggcccccagcacggcccgcatagatgggccaggcttgggaccggcacggtccaattaagaccaacttatttaattcctttaatttagtaagatatcaactttatattgttgttatatttagagttcatgtggtcaaatgattctaaaattgtttagtatctttaatttagtaaactatgaactttatatggttgtaatattttgattttatatggtcaaatatacgggccaggcttgggccgccacggcccaacgaagacacgacatggtttagggccggaccgggctgggccactgtttttacacttcggactggcatggcacggcccaaaaaaatttgggctttactggcccggacccgtttagcacgaagcacgatgggcttggaccgggctggcccggctcggcttaattcccagctctaataactaatatatgtgttattagattaaactctatcttgcaggttgcagacagacgtaaacggatgcatggtccatggatggattgctgagacgagcaagaaactgctcgtggtcgacaattgcaagtccctcgcacacgccgagtagactatacaagcaccggttggtcgccagctggctcatgcatacacacaatggatgcatgcatgctagctgatcacacttggcgttgctatataagcactcgcacctcctccatcgtcccggcaacatcatcaccacacgccaaatttacagctagttagctgaattcgatcgatatccaggaactaataatccaccgacccccctc

SEQ ID NO: 3130 - DNA, 122 bp, Zea mays
ttgattctattcttgcagttgctggttgtgcatgtcataggggggtttgccttcattatccatacgatacgaaatgcaccaacatttaactcgcgaagtcacaacaacaataggataggaca

SEQ ID NO: 3131 - DNA, 363 bp, Zea mays
gtcttatgaacatctacaagaaattgagctggtagattttatgatcgatattaaaatcgatgtgcatgtcgtctatcattaaaaatgatagtattaatttccaaaataattctaaaaaatatgaacacttatcttatgtcaacaaacttgcttggaaggtcaagcaacgggctgcaacgctagctcaaaaattatgaacatgcattttgtcatcccacccccagcagccagcacctaccttgcacgacttcttctttccggtaccttctccccttcctctccctccctagtccctagtcggcagtcccccgaccccgacctcgctaagcaaactcccagagcgatcgccgcagaagatcccgc

SEQ ID NO: 3132 - DNA, 109 bp, Zea mays
atgacggctctgccgagtgtggggaggcaggtggtttgcccgccgcggttggtgctgaggatgtgctgcaccccgtgccggaggaggaggaggccgagtatcatgattc

SEQ ID NO: 3133 - DNA, 394 bp, Zea mays
cgctcgattccccgctgcctctctctctagtctctctacacacgccttcctcccagcgccgcaccacaccatcagggcgggcagcacattcctctctctctcccactcccacttcttcatcctccgccgattccagcactacgcaggtgggcagggaagggatattttctgctctggccctatttctggacggctggggaggcggcgaggtgacgtggactggcgccgaagacttgcgtgagaggtaactggaatatttctcctcagctgctcgcttcaccccggcgccgctcgtgtaccctgctgccgcgccgctgatcgggttgacctcatctgcagatccctgatcggttgccgcggctgagtggggcgagcccggaggacttgagaagcg

SEQ ID NO: 3134 - DNA, 504 bp, Zea mays
tttgaacctctgattagtagggggactcggggcccgcttccttcgcggagaaggatccctttcagggtatcccctttcccggtccctgtggcaagagagagaaagaggaagtggaaagggatacgaaatcaaatgacgtggcgtaccttttttgacacggtcattatggcggaggtgaagcgtcgcctgcttcgcccgccaaaggtgctgcccgtcctaccacagagttaatgcgacgggacgagtggttcacggggcggccgttgtgcgtgcgcgagccgttcgaggaacaggtgttttgctttgagttttgaatctcgcggcgggtttgggcgaagtgttgaacgggtctcgcctgggcctttatatattcgagagagggaccggtgacggttctttactctgcttctcgcctcccacttaggttttcgcaacccgagggaatagccagagaaaggaaaccgcacacccagtcctctccgccgccacctcttctgcttggtg

SEQ ID NO: 3135 - DNA, 795 bp, Zea mays
cctcgtatcatgtcgatcagagaccgagagttttacaaaaaaaaagagtcaactacatggtgcaggcccacgacaaaaaaggcagcagcaagcaagagtcatcgtagtcccacagctggaacaatattggcaggagatttgtctgtcgcgcgcccaactgactgctgcctacgctgaaccgtccaagaatctgaacgagctgggggcatatatatatataattgcccacgccagcacatagaaataatcggtcgtccggacttcttcgtatatacatgcatggagaagatgccaattggtctattggaggctcttccgatccgctggtgggcctggtcgatctcaattaattatataatacttgcattgttattattgaattggagaccgctgctggtgcgatgatctttccttcgacggctacacgatgcagcgacgttgtgcatagcactactaaccatgacataaactaacagagactagctagctaggaattttgcgtaccaaaaaccatattgtattcacacaatatgcatgcacactagctatattgtattcacatacatgcgtaccaaaaacctcctacttgcaggccattagcatatatgcatgcatgtttaatttgcgtgatagtatataagcagaggcaatccctctgcgtttgtcatcaagcctaggagaagcaaaagtagtcattcgtacagtttgtgaaccatccccattctccaagatcgaggaagatcgagctagctagctaggttgtgttggaaggggaagaagacctgcaggggccag

SEQ ID NO: 3136 - DNA, 1500 bp, Zea mays
tggcgtcccaacggacgagggttgcaatcaacccctctcaagcggtccaaagaccaacttgaataccacggtgttttgctttgcctttcaatatcccgtttgcgaggaatctccacaacttggagtctctcgcccttacacttgagattcacaaagaaatacggagtaagggagggaatgagcaacgcacacaagacttcaaaagatcagagcaacaacacgcacacaagcagcaacaagagctcgcaacacaactcaaagagttcacaactccacaagagctctatatgctatcacaatgaaacgaatgcgcgagatcgatgtcttggtgcttagagatgttgtaggaatgcttggtgttctcctccatgcgcctaggggtcccttttatagccccaaggcagctaggagccgttgagaacaaatctggaaggccatccttgccttctgtcgtcgggtgcaccggacagtccggtgcacaccggacactgtccggtgcccgatttctttccataaacggcacagccgacctgttggggacttgttctcaagtgctaagagttaagaacaaggcaacataaaaagtgttaagtgttaaaatccttcgtccttcgaagcattatgttccttcgggaaataatgagtctcggacgaaggtcatgagagacataccttcgtaaacataacaagtaatgacgaaggactcacataaagcatgaaatatgatataagcatcaccatagaatcatttctattttattaacatggaaaaacagaaatgattccaaattacaaatgtaccttcggtcctgagagaaggtgtaaagtacaagcgtgatgccaaaagcaaatgccaagtcagcgtgtccagtacgggagtactgttcatctatttatagacgcgggacgcagcccacgtaaaattacatccatgtccattacatttgttaacggcttatggaaatctgtcgaggcccccgaagtcttttcatctttaagtcggttcccccttctgccatcgcgccgaagcttccctgcgcacagcttcggctacactcgaccttcgtctggttcaggcttcgtcctggccgtgctccatattcataattctggatccgaaaatacctgttcacataatccactcggaaaacattgtcaaatcatgtttttgaggaccttcggaggacgaaggcccccaacagtagcccctcgcaatattaatttgtaaataataaattcagattgcgatatggacgaaggccttgagccgaaggtccgaaaaaacaccttccctttgctagaatagcaacattcaatgacaagtggggtctttcaactttcaacgcatcaagcgtataaatacggccatgccgcaaacttatttcgcacgctttccggccaaccactcctgctcattcattttttagctcttgtgcactgctaagttttttagctttgaagcttcggctttttaaaaacagttttttagcgcttccgaag

SEQ ID NO: 3137 - DNA, 145 bp, Zea mays
aagctaccatcagctcaatgccggtgaaacagtgtacagcttaaccatatatcataggctggtcccttccaacgttgtttgcctgtcaaaaaagtttttgccccagtattcaaactgatgtaacaggaagggttagctgtttctg

SEQ ID NO: 3138 - DNA, 206 bp, Zea mays
attgaagagagttctcggaaggttctcctcccttttccgcgtagctaaggtgtcccggggagacctgctgcacacgcggcggcgaggcctccatatctctctatcatcacggcgcgggggaggaagccagcgagtaagctgaaaggggagagggagccaggggttcacgcgctcgccggagacgacgacgacgacgacgacggaag

SEQ ID NO: 3139 - DNA, 1500 bp, Zea mays
gcacatctttacccacaagtatgttacccatctgccaagggatcgcgacttcccatacacctctaccaaggaagcaaggcagggaacactgaaagggaaatgtgcccttgggccatttctatgtattttggtgattgagtgccaacacaaatgcttttgtgctaatctatgcaaaggtgtggacaaagtgcaaagcatgtcaaaaggtatgtttctagacttagtacattattttatggactaatgtattgtgtctaagtgctgaaaacagaaaaatcgagttggagaagagatggtcaagttcagccaaagtctgctcagtctggtttcaccggactgtccggtggtgcaccggacagtgtccggtggtgcaccggacgactggctcgggcgaacaggctgctctcgggactttgacgatggtgtacggctataattcaccggactgtccggtggtgcaccggactgtccggtgagccgttcacaggcgaactcgtcgctctcgggaaaccatcaacggcgtacggctaaaattcaccggtctgtccggtggtgcaccggactgtccggtgagccaacggttggccgggccaacggtcggccgcgcaatctgcgcgggacacgtggccgagccaacggctagaagatggcaccggactgtccggtgtgcaccggacatgtcaagtgcaccaacggctcccaggctgccaacggtcgactgcgctgtttatggaaagaaatcgggcaccggacatgtccggtgtgcaccgaactgtccggtgcgccagacgacagaaggcaagaattgccttcccagattgctcccaacggctcctagctgccttggggctataaaagggacccctaggcgcatggaggagaataccaagcatctcctaatcatttctaagcaccaagacatcgatttcgcgcattcgtttcattgtgatagcatatagagctctagtggagttgtgaactcattgagttgtgttgcgagctcttgttgcgacttgtgtgcgtgttgacactttgattcttgtgtcttgtgtgcgttgctaatccctcccttgctccgtgttctttgtgaatttcaagtgtaagggcgagaggctccaagttgtggagattcctcgcaaacgggattgagataaagcaagcaaaacaccgtggtattcaagtgggtctttggaccgcttgagaggggttgattgcaaccctcgtccgttgggacgccacaacgtggagtaggcaagcgttggtcttggccgaaccacgggataaccatcgtgccatctctgtgattgatctttgttggttattgtgttttgttgaggattcctctatagccacttggcaattattgtgctaacaattaaccaagttttgtgacgtaagattttgaagtgttacaggatcacctattcaccccccactctaggtgctctcaattggtatcagagctgttctcttcaagaaagggactaaccgcccgaagag

SEQ ID NO: 3140 - DNA, 1500 bp, Zea mays
catacttcccgccgaacgagcgcaactatgcaattctccctatagatatctagtagagcaatcaactcgtttcaaaattactgatacagttaagatgagaagtaaacagcatctggctttccctttgactgcaccacacaagaggccaagacccgcatttcatcatccacacaagaaaaaaaggaaggtactgccaaactatgttcaccaacatttacttaggcaacatatacgacgggatcagtggcagtcaagaaataatagaaaattgcaaccacgcactgaaagagcgggagagaaaagacggacaattactatatagaaatctttcagtctgctttaattcgtaccggcttctactattcttatagtgttttgtctctatagattgtagatacaacaactgactttaagttgaagcgaacagttcatttcatcggccaatgcaaacatcagcctgccggccacactttgtctccgtgcagaacgaaccttctgtgtggaagccgtcctttatctgcattttctggaacatcatgcataaaaaatttatctgcacggcaagcttcccgacaaaggaaccagttgagcaggtgcatccaaaacctggccttccggacccattcgtgttggtgaacgaatagcatctgcgaaaagggggaaaaaaaaagaacggccaggcctttccgaaccatctgcgaacttccaaggatcaaggagagcagtataatcgtctgcacatgctttctgacttgcgatttgaagctttgtgtctgtgcaggtgagagaaaccctgcctcatcatcaaatcaaatttactgaacatgaaccatcaggtctcctaagaacaaaccgattcatggtaacacgatgggtggtgcgttcaaggggaccgaagtatatttacgtaatatccttgtcatgatgccaaatccacatcataactgctagcagcagtagcgcagcataacacgtttctgaactgtgggcctatggcacaaaagtccgacctgtggccgtactaatctaattaattaatagccatgaccgggtcaaagcttagaagggatactccgatgaggccccagccacaagatgacaagaagcaactgccccactatcaacgaggaatacagaaacattttttcttcaaccatttccgtgttttgatcagttcaactgagctctctgtagccttgtttaaggcctcccatacccttgcatacgtgcgttcctatgagcatatccattgcttggacccggtaagcagaccaggcaataattgacgagagattcttctgaatctggtgatgcaaggttgttttgcttgaaacgctatttgctttgcctggttccaacctcaggaagaagagcggcgccatttggtagcagctgactcgtccattagctacctcattgcatagacttctccaaggataaccatcgtcccatcgaagttagcagtggtctgctgcaacttgtttggaggcctagctcggc

SEQ ID NO: 3141 - DNA, 1500 bp, Zea mays
gctagtcgtgtcaacaagcactgtttgtgctgtgtgtgttgtaatcccgtccgctcacgggccggtgagtgcatcaaaaccggtggtcgctgtcgcccggccggacccagaagcgactactactactagtctactacggccggttaatttcttctacggcgacgatgcgacgtataaccgctgccggactttaacccatgcatacggatcaggttaggcgcagctgcagaacaacggggaaacggaatttggcaaggcccgaccaatggagccccgtcgctcacgctcgcagtcacagtacgacaggacaaggccgggccgtgactgagtcacgcacggccaagaaaacgagctcagccactaccggaaagagggccctgctggcctgcttccagaagcgcgcgtggcacctcgtcgaacaaaaaggcgcggtagtttatttatggtatagccgtatagtgtgtggaaccgtggatgcacggctgaggacgcatctaggctaatgggtgccaaaagtggcacacattaccgcggtaatggcgtgttagtggcgcctttttttttcttctgagcttttctgctgcccccttttccgcctttttctgagaagaaaacgttggggggtgccgtgcctcgctgttctttttacttttttttttttgccccttttgcagttgcggtagaatctcctggaggagaaatggtgcggcaccgcatgtgatggagatgttcacgtacccttaccttctttgttcaacacagttacgcagagcactcggaatgtctgaaacagatagattgcgaggcggatagacaacgcagtgcagaatataatgtgagtatataagaagtacgtacactacgcggatattttgtttgtctaggggaaaaaagagggagagagaagacatttcgtttcgtggggatttcggagatggactacatactgctgctcatcacgcgtgcatgcatgatacatcccagtcgcgattgaaatcaaccgatgatggcgtgtagacttcactacatgacaaagacaagggcagcacgacaggaaaacagtttgaactgtgatgtagtagattttgtaactccatcgtgtccaattattcaggtgttattacgcatgcacagtagattttgaaatgtgatgttattacggcttatcgggttcaggccttcagcgacagcccggattcgcaacgaggcgataagaacggaccagagctctctctctctctctctcgctatcaagcaccagcatcaagcacccccgtccgtgtctccctgactccctccctctagaattttacagtattctactcgctgcctgcgttccaaaacctttcgtcttttcccccgccgtctacaaagacttcacactcgcagccgcaggctgctccggcagactcctacaccgggaagacttctcctctcctctctcctctctcctctctcccttccactcgcgctctcctggataccgcgcgcggcgacgag

SEQ ID NO: 3142 - DNA, 1480 bp, Zea mays
catgccaaaccgatgacatggccaagaaatcgcttgaactttctacccgtagatgatttcatttcaataccactcattgatgagcacttgagcaataccagggagataagaaagagaattcaggactccgtgctgacatagcagggcgtccatatgcttctgtatctttggcgttggaccgttgtagtaaaagatatgaatgtctcgtgatatttgtacttgtctatgcctagtctgatgtctgacgactcttccataacccataccagtccgtgcagattttcatttttgtgcaaccgtcttatgtctgagcagtttttttataatatcacaggagtcagaagtgtactcccctttcgagggtaggaagatgtgtcgtcctttctaatacttaaatttctgtatcacaggagtcagaagtgtactcctttctatatagaattctggaaaacaagatgctgatgacacttctactaggatggatccatatacttattaggatgttaaatatctgatcttttttcaattgcgaataaatatgatagctatataaatttatattcttgtttttagcattgagtttattcataaaaaataagctttaaattcgttttatatcttttttaaataatcggcataaaatttggatacagatttaaattttcaacttttttttgttgttgagagaaaataatgcataaaaattatacaaaattttattctggtctttataatatgtttaacaacatgattaaagatcaacatctaattttacgcacaactatgttaaaaattaatagggtgtttggtttgaggaatgagctagtctatcatcttctcactcctcactatttttgtttggtttgtggaatggaatgagttgatccatcaccacctcattcctcatagttaattagttagtactaatatgaggaattaggtcatcccaccaaatttgatgaatgaacctatgatgcattatcttaatttggatgtattggatgtagtgattctttaaatcaaacaccagataaatctatgatataatttggatatttaggatccatccgtatctacaactgccgaaattagtaattggtaatgggtaaaaaaaggaatgcgacagccgaaattagaaagtgaggagcaacacctgcagactgcaagcatggccatcaatgcgagcaagtgccgggcgatggcaggaatgcatggaggccaccttcctcgtttttccaggccatttttctgcagctcctcgttgttgacgatgacataaattctcccgtcttatcacatcatttttttaaaatccgcatgctgacatctagcagtaatgctaatggaggcgcatcacgcagggacgtctccctatcttaagaagaggagctgcaggaagccaaaggaaacgaagcatagccgtagaagcatttcacaagtcttgaagggattgtgcttgctgcttgcatagtggtaggag

SEQ ID NO: 3143 - DNA, 1003 bp, Zea mays
actaaaatcatttagtcaaatggatcggggtccattttttccttacacttattcctcacgacccatagataatggtccaatggtaggcgtgaagggcgagaagtgaggagagaacatacatgtttagactgtgggttggattataaagaagtatatttttagcaagatggtattacgtaggagcgctgctttgtgtgcgtccttttatgtcatgttggccttggtagtttatcactcatgtttggactgtgggttagattaaaaataagtataagtatttttggttttttttaaataacgatggtggaaaccaataaaaccgattatttatagaaatagagacatagaaaaaagtaaataataaagacttccctttcttttttcttgtggatactctgttaggctattcacaatattagttttatgtatatttaatagcgtgctacattagattttttttgataacatgacataatatttaagaggattgagttttatggggtgaaattagggttaatggagataaaaccatgttaactcatttataacatattgaaaaccgtgtgaaatatgcattgatgatgatttgttttatctttacctattttactagcgtcattattttgtagcgaagtgaaatattatattaagagacattgttttatttatagctttatggttttatagcacttcgaaatcgtttttgtaagcaacttgatttctaactggattaatgtttttatatcagcgttttttataccactttagaaaagattaaaaaaaatctgggttggaaactagctgtcgccccctaaattcgatttgatacgtggcgcaccccaagctgcaacacgttctgtcgttctcgcttgaggcggcccgcggccttctcgaagccctccgctcgctccgtgctcgtggctcccgcacgatccccacattccttggccggctccgcgctcgtgctctcgttgggatcgttgtcagttcaggtacggtggcg

SEQ ID NO: 3144 - DNA, 126 bp, Zea mays
ggtccgccgcgggggaacatggaggtggacctggagatgtgcggcgtcacgggcgcgcactggtgagagtgagacaccttcgagctcgaccgcgccgatgtgctctacctcaaactctgtgaattc

SEQ ID NO: 3145 - DNA, 781 bp, Zea mays
gattttgctaattctgttgttttaaatatcaaaatgtataaaggggatgagagaggaactctatatatagaggatccattaacgtcctctatatttatatttattggacattttagaggacactaagacataaaagagagaaatcttctctaaaatttagattacagggcgctttagatatactgctcgagagagtcctactgcagcgcactgcgcactggggcttgtctcgtgccgcgccgcgcatggcggcaccccgtggcaccggagggaggggggaaaaaggcttgactttccctgtcaggtgctaatgcccgtgtttgtcgcctcgcctgccttcgcctttgcctcctgctcctccagtcctcctctcgcggcggtctcgccgagtcgccatcgctccatccacgggggaagggcctactcgcccaacccgaccgcccaaactgcgacagcgaaacaaaggagctcgaatgccacgaatttcggctggtcccgcccgtcgtttttttttatccgcgatactggggcacacacgcagtcacgcaagtacgcacggcattcgcaactcgcaacccacaaaaggccacggtgaccgctgccggactagcctgccgcacaacgatccgggcgcgcccgtccctggcccagaagaccccaacgccgggcgcgcgtccccatccgtccgtcgcgccggggtatctatcgcggcgtcgtggggtcggagctccgggtccggggccgggaaggcgggaagcagggcgcaagccgcgcaagcgca

SEQ ID NO: 3146 - DNA, 1287 bp, Zea mays
aaattttggccccttcgtcgtgtatgaggtgatggctaggctcagcgggggttgcaaaattgacccaccaaggttttgtgctcagtttgcttgtttaatgaaaagattatactatgagaaggcttgcgttttacctgttccagtacctacttttacctgcttttgcataagttgcattcattgatcttgatgcgctatcggtcgcattcatttaccatgatgacgcgttatccagagttgctaccaaaacgtcagcgtaccaaaatttctctacttaaaatctagctgtggtatcatttaaatcaatatatcagatgtcatgtatgaatgatgattgatgaatacctgatatgttcaaggccaaatctttggtagtcgtcgtcgttgggacaaaaatcaaaagaaaaacaaacacgacagaaattttatacccatgcccttcgcatgtagttgcagtgaaaaggctcttttgtatttttgtatataggcgctgccgtccttcaacttcaagtcacgcgaactgaaatgcagccaagccctccagcgccgcaaccaacgcccgactcactcccgccgcgagcacttcccacccaagcggcgatggcgacgcaggacgagctccaggcggccgtcgccgcggtcacggagaagaagcgccgcctccgggaggcattcgaccgcctcgtctcctgcgccccggtccctgtccccttccgctgggaggacgtcgacgcgcacctcgccgccatcttccgccacctcggctccacccacgccgacgtcatagccatcgctgggggtccagccaccgctgctcaccacttccagttccagcacacggtcaaggaggagcaggaccaggaacgccgcgtcgggcgcggcgcgtcggaggagggacaaggtagcaatgcggaggaaggcaggagcgcgtcgtcgcaccaggaacgcggggaggaggaaggggaggtccgggaggcgtcagttgcgcgtcccgaccgagaagccgacgaagcgggcaacattctcggggcggaggcggttccagagcagctagacgacgagaaggaggatgacatggggacaatcgtggcgtctccccaccaacgcaatgatggcatcgagatggtagtggaggaggaggaggaggccgtcaaggggaacgcagacagagaaggccgcgaggacgaggcggaggaaggggagtggcggcagcagcatccgcacgccgcaggcgggggagagacgtcgtcggctctggcgaaagccgtcgccgcggcgtgcgcgaac

SEQ ID NO: 3147 - DNA, 1500 bp, Zea mays
gaaatttaagtatttttatttcctattttaaattttatttgaaggataacatgatttactttgagtagcttattcattttgttttctttaatgactagacgagatcgatgtgaaagtaagaaaatatagtgggtgttagggtttaaagtttggaagcaccacaatttctaaaaaaaactaatctctatcacgagtttctaaaaactagtttataaaaaaaatagatatgcatgtttggagccagtttcttagaacccagtttctatctttttgatacacaaagacaagtctatccttactttgtttaaaaaaaatatttgattcaattattccctttatttttgcattgctaccaatattaaacatagattgaactaatattttttaattcaaaagatttaaataataattaaatattgaacttgggcacatcggcatcaagggaatcacatgcataggcatagaggtggtggcaatactgtaattttctccaaaccaatcaaggacagtacgtaaattactggacaaaaactaattctagttaggaaggtcaatttcttggtttcttaaaaaatagagcatctccaataatatcttaaaatggtacctcaaattgaaacctaaggctttacacaaaaaaaactacttcaatagcgcatcatttaatcaattaaaatttggtaaaaaaataaggcgctatctcaagtgcttcaaatatactatactgcagtggctgccatatgatctagatttgaggttctacaattagagcagaatattttgttgataacctaaattttataaaacatacttgtttttaaaattatagaacaattttacaggacacattgttgtagatgctcttagcctatttgcaagcaccacagtttgtataagccaggttctcaaaaattgtgcgtgcttccaaacattgcctttagtcgaggtagcaacattatttgttgagtccattgtttacatatatcgagttactattaatgattgccaaatctcccgtgttgaatattataaacttgcgatatctatatttctacgaggacccaaccctgccttctcttcttccttattcccagtttcccacagcttgcgcggtctcactctctctcggcgacgactacgccaaggcccaagtgtgccgaggtattttttaggctcaggtcgctaccgccctacggccccggtcttcttccggcccttcgccggcgacgagaaccagcaggtaggtcttcctcacctcgctgctgtgcgaaagcgagcacacaacaaaccctaacttactatttgtattcggatctgatctactggatccgcccctgatttgaggcagtattcctcatatttggcaaaggaggccgaattccagccagattctctattctccccctgatttccagcagcttccggaactttgtaaagaaacgaaagaaaagtttaacacagcgcgcgcgcgcgatcctttccgacaggacagtatagcgg

SEQ ID NO: 3148 - DNA, 1133 bp, Zea mays
ttagttgtgttgtgccttagctattgctaccagagaaaacgaatgtgtgccactcctccgtgtcgcgagcgagaacatatagtgccctacctgccgcaagcaagcccaacacacgccgctcctacaatcctatacatctactagtatatatccagtcttaaatgctatgatctcgagaaaggaaagagaggggtcgacggcgatgacataagaggaggggttgacggtggcggcgcgagtgagggagaggcggcagtgggaacacagagggaggggaggaggagtctagggtcacgggagaggaatgagggatgatctaaataatattattcattgaatttgagtaagggaaaagggttatccagtgatctgaaccgttggttttgattgtgtgttaagtctggtgcaatttgttgatctgaacagttggttttgattgtgtgttaagtatggtgcaatttgtttggtggatttagtggaggttgtcggtggggtggtttggttgggtgagttttgcaaagtttaaacttgtggtttatatagtggtatagatacgtagataaaaatggatgaaatcggtcaagataaaccatttctcatttttacttttatattttaatttgaaagcgaatccgaaatccgaaatcatcaaaatagatcagacactgaatatgcgggatgacagaaacaaactaatccgaacataaacatatggtggtcgatcgaaaataggaaagataaaaccaaaacattatccataccatacataatctcatcaatgaacaacaactatatctctactacctattaatccaataatgtagaccacgccacccttcccctagaccctcaccccacaccccaaaccccccccctcgcgcgcgcaacagccgcccagtgacgctcgtcgtgacctcggtcgtgcgtcttcatccaaccaagctccccccgacacttagccccacacccctcaccctcacctccccgcacttcgccatcactacgagaggatgaggatggacggggctgagtgtcgtcgtcgcgggcgcctgtggcggtgacgcgcacatacgctggagtagctagctaggcaagcgagcggtggtggtggtcgagcacgtagcacaccagtc

SEQ ID NO: 3149 - DNA, 1175 bp, Zea mays
tgaatcaatcgaaattgtttgagcatttcacaagtggatagatcgctccaccgtcgacatagttaatgtgacagtcgataatatggtcggcaatacgatcaatagctaatgtgacggtcaataaaaagatggctaggttggatccaacgttacctcgctaataataagtggctgtcatccctgtgaaactaaaactagctggtagcccctagctaatacatattacatagtagttatttagttacttggttggtctacttccatgcactagtactgtagcaacgatttttaacctctaagtaactattaccgcaggtgggtcctgctctgccgccagcagtgtatgaacttgtgcacaatccgctactacttgatgatccagcaggcagcagcattcgcgctgctgtgcattttaccgagatggactggctgcctgaccagggggattgacttcgtctgggcccacgagccagtcaccccatgaacctagggcccagtccgaacgcgcctcccacggcggcgcgtgcgactcccccagcatgggaaataaatagatgtcccaattacccatcgagccgtcgtcgtggagcggcaggatttgaaaatctcgcgagaggccttgtccttgtccacttcctccgcttcgccgtcctcaaagcagcggaaggggagaggccagggtgcagcagcaggacccccaacggcaacctccgccacgcgccacggagcaaccaagcagcaggtgccgtgcgcgcggttcccacttccctcctctccctctctctctctctctctcgctagtcgctaacttctcgatttgatcgctgcggttgccgtgtgggcgcgtcgtctgttttctctctctctctctctctctctctctctctgttctcgattacttctcgttcgtgcagtgcagatgaactattaatgttcgttttttttcttgaagttctgctttgttctgtgacataagtgaggtactacatcgaaaaacgatctgattttatttttcaggtcacaaacctgaaaataccaatctacgatacagatctagaaaccacgaatacatattttgtcggggctaatagggaaaaaagaagatattttgtggcatcggaactctgtaacactgttggtttctgtgaacgcttcaggtaagtgacgagacaaag

SEQ ID NO: 3150 - DNA, 1380 bp, Zea mays
atttttcactatagactatattattcgtagtgtggactttgaatataagtatgaataaactgatagagatagcctaaacattctttatatgcatagggagaattaatctccgcgcgcatgtgtatcacacacacggagagcatgttatacattaattataccatttatatcctaattaagccttatgacataataataatatgcattatgatactacaaatgcaaatattgtatattttttaaaaaaatataaaaatgataaatatgtactaattaactgatttatctgtaccattatataatctgtcagcttgaactttgtaaaactcatccaaccaaatcatctctacccctataaccttcattaaatccactaaacaaattgcaccaaaacttaacacaccataaaaaacaacaattcatatcgttgaataactttctctctcacacgctcactcaattcaatggacaaaattatctggaccatttctcatccctcccctgggatcccatgtataagagaagtgtatatagaaaatggttgaggactaacattatgtaggaagagaatctcataacgatgaggtagtcaaatatagggacaatctcagaattttgcaaaattagatggctacttttacaaaatttgagtgacatgtttgaaaatcctaaaattatattagaaagtatagatgcatagaaataatggttagaatagaggctaatatagttgctttcaaagaaggcacaagtcaccaaagacatgaagccaaaagatcacggcctcggccctcgggccttgttccacctatggatctaaatttcaggctctaaaatttaaatgtcggatcgtatttgaattatactctatttttttatttttctcaaacaaattttaaagaaacatttgaactgcactagttccaccgttccaacttccacgttcctcccctgctcctcaaccttcccgagatcctggtgggcccggagcaccctccggcttccagttcctttgttcctcgcgaagtctcaccgcgctgcagagcgcatcgccgagcccccgcctcacctcgaattcttctcgcgtagttcgttgccctcctccttccccttctctcctcgacaagtacacggcggcttggatctatacgaattcggcatctgtattttacctcattggtaaagagttcgtttcggttctcccttttcccattttcgtttctgcaagcaatggattccataactctcttctcttctgacatggatgcatccacttatttttgtttttcgtctttttcgtgcttggtggagtttattccctttttttcgcgttgagctcgcctccgatcctcatgtaattttgcccactttttgcagggg

SEQ ID NO: 3151 - DNA, 1500 bp, Zea mays
cagacgattgctctatgttatagtggaacatgtaaggatttttgtcatttccatgaaatatgagcggtcctgctgtctgattttgtacatttttttagaaaaaaagaaaaattccggggaatgaattgttctcctactcctgtcctgttctttcccgggaccgaaccccccgacttttgtttcttctactaggtccaccccttattatctcataaaagcagaagggtcgacctgtactgtttctcttctcctacttgtatttttctattttttttgcacgagccacgagtactcgacctggttgctatttttgactcatggtgttctagcagtcgtttcatgccatctaactcgatagaaagactcagataagtgtaaactagtagggaatcgtgttataaaatagatctgttttatctagtttttcctttggctggcatagcacttgcaggatgtaagcatggttcgtagggctcaaaggttgtgagtagtatgggagttgaaagacggactggtacagttggtgcagtgcgaaggccgaatcaaaatgttcattagattagttacattggaaattttgtcaaagtggttttagaagacggtttctgggcaaaggggggaaaatgcttattgctattttgagaaaatgcacgaatattgacagtacatatcgtgatatgtcaaggagagcaagtattgcagtcaatatgcatttaactgaagagacatttgttttatcaaaataagaaataaaaaagcatcatttccacaaattaattgccttttacctatggtgggagttcaactgaaatgaaccacatttagctcttttttgaacgcctcaatgttagaaagaacaaaaaggcagttttgaccaattaattgacttctgcgaatgtttgataactaggagttggagtaggacaagcaccctacatttagcaacggatcacagaatcggaaagtattgactattaggtccaaggatgccagtattggccattgttcaaaacattatttaggtagagttagccctgcatgatgttttattcgattgctgactttttgacatagcaccttttctgtgtgaatcaacggtagtaggtaattactggaaacattgatggcatgaaccttttccaaaatatccacatgtcatttgtcctttgttttagctaaggctaaagcctaaaggtaaatattagtcaaacttttcacacaacgcaaatgatgaatagataaagaaagcttgactttccctttgctgcaatgatccatcatatcctttgagattatacagttctggttgacctaactattctatctttgataatcgttaagtagttgagcattcacttatgaagtgcacatggacttcatgtggtttcaacaacatcattcagtgtcatcttaagactggattgccycccagattctttctgacattataatatttgtgctgaacagtgtcatcatcaagattgacagccttcttcgtgg

SEQ ID NO: 3152 - DNA, 51 bp, Zea mays
cccaagtagagaagagcaagggctgcagctggcaagaagctttgctcagaa

SEQ ID NO: 3153 - DNA, 173 bp, Zea mays
tggccaggccaataaagttgatgaaacagcgtcacacagagcaaatggaacacttctaaaagcattcttcttcccctaattgaactttaccttgtggctgaatagaaagcaatttagtgcaggcgtccatgttgatactgttgtcatgaatcctccctttggtacacgaagga

SEQ ID NO: 3154 - DNA, 1164 bp, Zea mays
tatatagaggctgtgataaaaatttgagaatattttcagaaagttgtgagacactacgtgtagaaacctaagagaattacgttgaaactctatgatttcatgtgtcacctaatacactcggcaaagccgccgtctccgtcacccagcgccgtgacggccgcttttctttgtcgagtgctcaataaaaagtactcagcaaagaagcctttgccgatgtactgttcaccgaaccctctttgtcgagtatcacactcggcaaagactttgccgagtgtttttcaaggtttgccgagtgcttcaggcactcggcaaagcgcccgatttcggtagtggtgttttacaggttttgccgagtgcttcggacactcggcaaagaagctaattccggtagtgagggcagaccgtccggccacacccaatgctacaaaaggtactcaacaccaacaattggctaactagctcttagagcaaggttaataatatagccaactactagatgcaagaattgttgcagctaatctcttagcccatttgtataataattggttttttgttgttaatgtatggaccacttaactctctcataaagtttttttagttctcgtatctgagccgatcgtaagataacaacccacttcttatctcttctgcaactcaacgtttaattttgtatagactattactatacttagctcctagatggcatgcggtcccttcgttaatttaaggaagcgtytaaggccttgttcgtttctaccggattggtgggtcagaacgattcctaaccggattccttctctaatttatataaactttgattaggccttgttcgtttgtgctggattgatgggtcggaacgattcctaaccggattgcttctctaatttatataaactttgattagctggaacgattccggctgcaatccgacacaaacgaataaggccttagctggaacgattgtgggtgcaatctgacataaacgaacaaggcctaaggaatctgattggcaccagaaagttgattaacacacctttaggccttacctcaagctagcagaacactagctagcgctatataaactgcctagcggctagctagcgcaagcaatcgagaaaagagaattagctatagccagccgtgtgtcgaacacgacacgcgata

SEQ ID NO: 3155 - DNA, 931 bp, Zea mays
ctagtgtctagggcacatgatttagtcgttttaggtttgtcctaagtcaaactattttagctttgatcaacaatatatataagattaagttattttwaactaaaagaattacatagtatggtagtttaagtcatgataaatttaataactttatttttatgttgtaaaatcttatgaaacatccagtataaccaatcaaaattaacaaggtatgcgtcggttactaatttcattggaattatatgtatctaagatcgtgtccaacagttcagttatatggtcatttaaaacttcactatttacatagtgaagtttgaatataggtatagagatgggtaagctgttgaagataacctaactaaccaatcacgctatccacatcactagaaatacactgtccgttggatcgtttaaccgtggaaaatctagccgtccgatagatgcgcagcttcccagtgcttctggaatctggactcagtcgcgcgcacaagatgaggaccagcaacggaaactcttctagcccggcgccaccgttagttattataaataaacgctgctcagcctgagttcacttcccacgcggttttcgtgtttgctgccgccgcggtttccattgcttctcccgtcgctagggcgttcgtgaatacgtgatccatcgtctccatctccgtctggtgtggtgtgttggtttgagagactcgaggtgtgggcgtcgcttcgtctggaatcggctctcccatttgttagatagatccttcatatctccccacgtctgggcgtcgcttcgtcggctgcgacctgcgagacgccggcgccgccggcgacggtggacgaaggcgatcaaggattaggcgatccgatccgatccgaaccaattctccattcttcgattccttccttgggtgggcggctcccctcagattccttccac

SEQ ID NO: 3156 - DNA, 1500 bp, Zea mays
aagtggggtgagtgattagttagttagttagttagttagttaataaccatctatcgacgacaccttcctccgtcgagtcctagtgtccggagagaatctctcgactcgacgaagcttgagctctgagtggatcggagttcatcggtgtctcggtgatgaccctgctgcaccaccgctaggtaattcgaggccttttgatcctgccctggcaaaggcgaagggccgcgggccggaccagcaaggcagcgggtccacgtgcgagcggaagcctcctcgaaccgctgtccggcagcggcgcatgggccagccagccaccgctccaccgctgggctggccagcagcacgtcggcgcgcgcccacgggttatccctcggcacgcgccatgtgggtccgacgacgcgtccggcccacatggcagacacaccaccatggtgcggtgcgagtgcagtgcgagtgcaggatagttttcgtatctgaggactgcgggtgacggggtgagtgcgtcgcggtggctggcagccgtggcgtgcacatggctgccgccgcatccggacgacagggagatgtgtttgttcgtgcagatgagagcacccagcacagcagacgcagtctccattctcatctcatctgaagacgcctagtagtgtactacccgcatctccatcctggactcgcttcttaatcacttggcaaaagagtaacagggtgacgtgtttgaatagtagtattactgctgccgctggtttggtttctgcggtggtcgtcaatggattggcaacgttgggtagggatagggcaggcaggcggttgaggtgatcacatcacacgcttcgacagaccacctctgccttttcaggtaacggtccttgtcaggataggatatgataggacaggaccgacgctgtaaaacctggggcccaacgtgctcttcgttcgagataacgtcccagtcccatgcacgttcgagataacgtcccagtcccatgcaccgtattgttgccagtgcagtgaagccgaaactccccttttcgttccaacaaggcaacaagcatgttccagacacagagaccgcaggattttaccttccacatgcacacgaaaggctcccattcaacccgattgtatccgtccgaaacagaggttatcagttctgaggttcatgctaccgtgaccccaggacggacagcgcaaccattttctcaggttgtgcgctggttcaatgaccctatcgttaaatcatcaatgaggacgcacgacgcagtgagcatcaaaccagcacgtacagcgacagcctgtgtgccagattgacagatactcttacactagcctccaaactgagatttcggtgtaccactacccccccctgaccctgagtgactgtgtcgtcctggttcaacctctcacttcttcgccttcgagaaccggaggcacctgtacttctcgccgctgacggtgatctccagcgctccgtcttggctatcctggctcgaagccgtcccc

SEQ ID NO: 3157 - DNA, 148 bp, Zea mays
tcccaacgccgcgccgctcccgacgccagtgtcatcgctccgccgccatccgggcgacaaaaaccgcaggtcccccgcctcgcgccgatcccctgtgatccttcccagcgctaaaggtgtcggcagacgacggggcggcggcggggag

SEQ ID NO: 3158 - DNA, 1027 bp, Zea mays
gtcgatcctaagacaactctaagatctcctccccgacggggtcctttccgagagacgagattcaagtttctgcgaagaagaagactgcgtcatcacgggctattcgaaagcacgtagagaagaagcagctacagattatctgtccctacatcacgaactgtcgactcccgcaaagagcaccgctacggttccatccaattatttaaccctaactcggagccaacaattaccaaacatgcacaaaatatatggattggctatgtaggttggtagccgacaaaaaaagtcatgaaagaatgcagattgattcagagccacaaccccaaaatcccgctccctttccattctgtggctgacatctctcgagggcccacctacgcctaaatccaaaaccgaacctaactcccaccagctcatcaactccaggtgaccaggtacgagtcacagattcctgggcccaggcatccctaccccgcatgtcggtgatgataatgttggtatccgctgtagccgaagaagacgtagagcatcaaatagtgttgggccagtctcgagtagagagttgcgtgagtacggtccatagtcgtaccaaaacagttcacttggcggcttgtcgcttgctgtggttcagccgttcaggagtcgttctgggtgcatagactgcgcctaggaaatgttggcaagtacgatgcctctagagcacgggtccaccacatactaggcaccaccgcaccgcaccagtgcaccaccacatccaaatcatatacctcttccgccgtgtcgtcgcccttcgctagtcgcttcgctgccacatctctcctcgtccaaagactccaagctcctgtgcggcctgtgttctgctgccgcctctggtccacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttggg

SEQ ID NO: 3159 - DNA, 768 bp, Zea mays
atatttaattttgctatagagcgtaagtaggaacctggtagagttcgctagctaaggatacgatgagacgacgatggttttttggttcaatcaaaaccagtggcaaagttgggtacgacagcatgtgaaccaaaaaaaaaaattgctgatctgtgttcgtcttgacgacgttaacgtcacatctgagaaggttccattcgattgactagtcctagataacgtaataaatataccacccaaagaacttcgtcactactctccctctcatctcaatgtttcattcattaaacttcgcgagaacatgggaggagcagtagagcagcacaggacgtagatgtacggtagccggccggcgcccatggattcaagctcacagcccgccgcaatgtacgcatctctctctttctctctcatatgcatgcatggttcatcatcttttggggtcaaattttcatgtagcaactagcaacatggaggtaccatgcataacggatgttcaagtttatgatatctgtatggcctagcactacgatcagccagctggtatatatatagagcaagactgaatttttgcatcattgtacacctaatagataggtcgacgacgacgatttatgcgtgtcctagatataacgttaattccttggcacacactaaaaaaactgtagtgatggatcgagagggagcggaggaggagagagaaacaaaagggaggaggaggacgacgacgaggcggcggcggaggccggcaacggcagacagctggtg

SEQ ID NO: 3160 - DNA, 148 bp, Zea mays
gctgacgtcctctgctttccgtaagggggtgagagccaccgtcgtcacagagtatgcggggcgccatcattgcctatctggcggagcgagccagatgggacaccggtcttctttcctgcggcccgagtcagctcggggtagggcgatg

SEQ ID NO: 3161 - DNA, 53 bp, Zea mays
attttctgtgcaagcagggagagcttgtggaagcgagggcattgttcgtgagg

SEQ ID NO: 3162 - DNA, 399 bp, Zea mays
cgtgagttctctgtgggggattttgtgtatgttaagttgcaaccctatgttcagggatcagtggttgtccgtgcctgccataagctcagcttcaagtactttggaccctttcaaatcattgctcgcattggcaaggtcgcctataagctgtccctgccagcatccgccacagtgcatccggtgttccatgtttcacagctcaaaccatgcacaccggcgcccaaactggtcagtcatgctttaccaattattaatcttgatgtccagtaccctgcacagaccatcgctccgtctctcgtggtggtacatccgtcgaccaagtccttgtccgctggtctggcctcgacgccaccttggcgacctgggaggatgtcgaagccctgaagtcgacgtttccag

SEQ ID NO: 3163 - DNA, 1466 bp, Zea mays
tggtgtagcttcttgtggtcgtgaaatcactggaggtgggcaccaatgttggtcacttgcttttgattactatatggtatcaaaaacaaggcaacccaagttagaaaattgtgaccctctccctttgactaccttttcttcgaagggtaatccaagggagaagatatgaaagagaaacatatacgaagaagtaacatatggtaatgtagtggggagtcaagcatgtttactcatcttatgtgccttagcacttttcattccatctttccttcatatgtaataaatgtacatgcataccttcggatttacacatggaatagctcaaagatacttcgaaggctaagagatgaagcttaacgccctccaaaaggtaaatttatgcatgacactgttcacctatttataggagagggtacaacttcgtatgaaattacatacataccccacaagctttacaaatatggtttataaatatcataggggcgccattgtctttttctttttctttcttgccgctcaagtcttcaacgctttccctttccyttgcttcgtgcgcgaagcttttcctgacgccaagggtggtggggtggcggctttagtgcacacttcatcggatgcgtgttcaaagcgaagccctttgcaggctgtttcggccgaaggtcgacttcgtctgtccttcatatagcacttgaaacatactttatcaagtcgaaggtaaggtgatttgaggttcttcgacaaagtaggcgaccccaaaatcacggacctgcactcgacactctctccgaccctagaacaaatctgacacacatgttagtcatggtgccatctttcctagacattaaaaccattttgtttttatattttttctcggcaacaaaatggaaaaagataactccgaaaatggaaacaacattggtaattcgaaaaataataaaaattacttttttctgtataccaatagatatatcttgattttaggaaaataataaaattacttttatatttttctaatctaagttaagatgaatttgttatgaatatataaataccatctcagatttaatatttttctgaaaaattatcgaattcattacygattgtaaaataacgaataaatacagtaattttcgaaaacggtctgaaaagacaaaaaccatttccgttaccgaatttttctaccgattttatatttatattttcactaactatttttatttycgtttagtaatttaggtacgatttactacaacctaaaattactgttttcgtttttcaccgtgctcctagtcacytcagcttccctccgtcctcacccagtyctcacccactggacttgcccgattggaaagcaagcgcccggtaggaaagaaggcgcggtcgttttctggacgtgacgggcgcgcgcgtggccgcgtgggcgtggcatacatcctttctccttccatccatacgctgaacagagt

SEQ ID NO: 3164 - DNA, 341 bp, Zea mays
ataagttttaataaattgggaatgaatcctggttcatcccggataaatgaacgtgcccttatgctgaaacaaatcgtgtccgtatcgagcttgttctgttgagcttgctgcagatttgcagcagagctgcggccgctagtgcagcaaccagcaaaccatctcagtaggtaaagctaaagcgaaaaggcccatcaaattcggtccaatttaaggatttaaacaggccggccttttattaccttagggtttgctcttaccactacggggaagccagacgcccagactgcagtgcaagtcatcactcggctcgtttcccgaaccttcctcctcgacttatcccc

SEQ ID NO: 3165 - DNA, 1119 bp, Zea mays
tccgtcgtatctagctttcgtatagtcaaataaattcggatgttgtcttaaaaaatccatttattttcatagaaaaaacgggggtaaaccaatgataggtgacgtaagatacagacgccactccagcaaatcttatgtgtattgtgtagagatgaccagagactagtgaccgagtagcctttagttgaacggattctccgtagcgacctaaaaaacaaacaaattacccgcgtaagaatgatcaaacgtctctagattttttattatagcccacaaatcaaacagtccgaactacaagtaacgctgtacagattgcgcgtgcgtactacataccgacggcgacggtcctgcaccgtgacaacaaatccaatcgctgttccgggaaaaaaaagcgtacaatttaattttttattaataaaaccatctaaatttaactagactatagggaaaaaatatcattttgacaagaacaggtatactgataaaaatatatttaattaaaaaacctaacagtactacatattaatgttttttctatataaatacacacttcaactcggtagaattgtacctacttattattttttatttttgctggaaagttgtgtatgaaccgacgacgtcggagtatacaccgcgcaagaggcgccgtatgttttcgccgcgggtctatatgtacaacgaagcatccggtggttggggccgtggcttccacgaagaagacaacacgacgcacggcgagttgctcgcgcagaagaggccaagttggcagaacaaacggagggcgcgccgcgcaagcgcaacgcatctttgcatggacgagaaagggtcgatgaggtggactgggattaaaggcgtgcgttcgctctgctttcgcgatggcgggtcttgcgagaccgtttcagagctttgacttggacagcgccaggccgccagccaactagccaaggcagcgggagtgaggcgaggcggcgataaatacgcgcgcccgcgcgcgctcccggtcagccatcttcgttagttacatagagccgcgccgccgcaagagaggagagagcgcctccaacgccacctggaggagaggacagcgcgccagggagggggaggaggaagaagaac

SEQ ID NO: 3166 - DNA, 1500 bp, Zea mays
gcgcgtatagtaccaatgcgcacggtccaggcacccttttttagagcacatttgagggttggtattataaacgtagtcaaattttaaatagtttgatcgaaaagcacattcttttttagagctaagtccccctcttttttttgattgggtcggtgtgtgtgtggactgcgcagggtggggagaaactgagatccaaatccaaccacctccaaacgccagcagtgcaagagcacgaggtggacgaccaagatcaagaccagaccagatcgggcgaagactcaagacttatacaatctgattggatgaccacacgttcatacgcaggttggcgccgtcctgaccagccagatacgataattttaagcatcatatagatggatgcatgttaataccatcaaaatagcctattttgcttccacccatgcaggttgtgactctcacatacaatcaaccaaacataatctcaaataaagtcaacgcatacgatgatctaagatgagatgatgcgggtaaccaatcaggcgaatagagaacacttataagacttagatatagagaatgaaacatgcagagacttttgaaatggatctacaataaaaaacctaagctcaaaaagaaccaaaattttcatttcagttattttctaaaaaaatatttatttttgtatttacgaagaattttattttaacatcaacctaagagattaatataacaagctataatgttgatataacccatctcgatctcatagaatatgcatgaggcacagtccctagcccctatgatacctaatctagtcgactttcagtgtttgctagaccgacttttttggagtttgaatcgatttgttttcactgcttgaaatttttttattttaattgttgactaagctttttgccccttagtaacatttttcctgtgtaaacatctagtagtaggcttctttggtttctgctcacccgccgccaacgacagcgggagagggatttttcaggtgcggtcatcatcacagttcaggtgctgatcgacatatgttcaaattcgggaatgtgtggtgcggagaaattgcgactgcgtcctgatgtcaggttcatctgggttacagagcttgggcgtggtgattgttgttgacacccacctgaagtcatccaggctgaccaggcatggcttttttggcctcgacggccaccaaataccgcacctaatccgctaatccctttgaaaatgagcgcccgtacgtggaaaaccgaaccgtagacgccaccgtgttgcaaactggttcggctgtttccaggcaattcaatcaccaaacagtacctgcacaaagatgtcgtgctgcgaccaggtcaacgttctcgtcgcgttagagatagccgccacggcacgagctcgacgcggaccatcttctcactgctaagcttagcttatataaacgcaaacgttccaacgccattctcgtattacgtactcctgcatagcatagcttagcttgcttcccca

SEQ ID NO: 3167 - DNA, 1500 bp, Zea mays
gactgaactccatcgcaggctctgtactggtcaatggtaaatgtcacaggtctcaggtcaaatgaatgaccaactgccataaaacaaagatcaaccaccaaccactttgaaaataggccttgcttactctctttaacagatactccctccgtttaattttagttgtcgctggatagttcaattttgcattatccagcgacaactaaaacgaaacggaggaagtatttctcagtcttttggctaagataaaatacaatatctacactttaatatgtagtatgtgtgtatatatccactttaattttaaattttttaggaacggttcactttaattttaaatttatttttatgaagaaactccatcacaatggccgtcactcgacctttgcatgtaccgcacggacattgtactaatacaaatacagatgtataagaagaatgtaaaataattagaatgatttaaatgtttgtgatttctaatgtaaaattataactacttcgttaattctaaattataaggtatttctagatttatagaaaaaaaactataaacataaaaataccaaaacatcttaaaactataaaagaagaaagtatttcagagcaaaattttgaaaatgatacatatattatatacataaataaatcattaaattaaagccgttgcgcagaaagaaaaaggaaaaggagaccagcagcaaagaagaaaatccgcccgcgtatataaccgctctaccgctcaaggctcgactcccgtrcgcttgcggtgcggacgcttcccctccacctccgcacacatctccaagtccaactaaccatgccagtctaccgcagtactgccgacttctagcagttgttttataggttagtttcgttgccttgtggctttgttagtgtatcaaaaccaattcgcgacatcactcaggaaggggaaagcagggtccggaaaaagaagaagagacgggtgagaatctgcttgttttcttgattcttgatatgtcgctgatccaaattcctgcctttttttttgttccccatctaggttccaattctatacctgtcattacagtgattctcaccgattagattacgtggttcctgtttctagtggattggggaatttttttattttgttcctcctccatgttctaccttttcttacccatcgattttcgctttcacaagttcacactttacactgtcaattctgttattattcgtagtttacattccagtatagttctttccagtactaaataactgggaagttgggagcctcagctctctctctgtctgtgcttgcttccaatgttacttcaactgaaataagcatggaaaattggggtcttctctgtttggtagatgcattcaaattgtgaagagaagaatctcagcgattagatacaacaccaaaaatatgcttagaacgttgtgaaattttgacactgctctacggaataatgtgttgggatttgtcatggtgaaattggctctgcagga

SEQ ID NO: 3168 - DNA, 1500 bp, Zea mays
aaaaaactcatacccatgacgggtacaaaattttgcccgaacccatgcccatgcgggttttgggtacccaacgggtttcttatacccactaacatcaatcaacataaaaaataattcatcatgtaaatgacagtcaatatagtaataagtcaggataaaagaaagaagtgataattaattttagcttaaactttgttacatggagttcatttcaattctaacatatttcattaataatactaagtatatgcccgtgcgttgcaacaaaaccaatatgttaaaatgcattgatatgcaaaaatactaaatgttatcctatacttttttagcatcataaaaagtggatgtttatatattcttaaaagatgtaggactactctaaagttctagagacaaatttaattttgattgacagcacaacatatggtcatacatatattattgttgtattattttttctcgttgcaacatacaggtatttacctagcatgaatataaaatgacattgctctataactataagtgctgatgtaaattttatcccaaaaatgaaaaaagcaaataagcagcaagctagcaacaatgttgtataagaaaagagttacctcattagaaagtttatatgcaagttgtgctctccttacatcaatgggtgtgtctatatcaagacctaaaccgagagcattttgtgactctagaatgttcttgagatgcaataataaatatatgaaacaataaatataacaaaaaataatattgatggtatgacttcagaattgaagtaacacctaaacaaaactgagaaggtttgcagaaaattaatgagtatttttatactcaataacctaggaatcagttgcctgtaaagaatttgacatggttataacatgggccaactgaatttgcctggaaagcttgagaatttgacatggttatttccctttagaaaataattctgtagagaatcaacataaatctttactctaaattatcatagctgcaaaggcgttgtgggcgactgcggggaggggcacgacctgtcttgggtgacaatacaactttcatcatcagctaaagcaaggtccccggcgcaaaaaatatttacaaaaatgcccgtcgtcggagactgtatggatgggagaggcagaaccatggtgcacgcggtctacactaaggtcttatagagtagtagagattacgagatatatttgtaagttatgttgattttaagacgagcatgagtttacgggtatggttagtgaaagaagtagaacaaatccatgtccacataccggttgggtttacatttgaacccgttaccaaatctataggaagataaattagtccaaacccatagagcaaaatcccaccaccggctgccatctctaaatatatagccacgatatgacaaggttctattgccatccgccccgctttgcgtctgctcgccatcctccttccacccctcgcctcatcgtcgctcacagcttcttctagaag

SEQ ID NO: 3169 - DNA, 450 bp, Zea mays
cgcctttgtcgagggcagtacatagacattgtgtgcataaaaaatatttaatataagtgggacgaatgtgattattagcatgaactggtaaaatttggagaaacaccataattagttggtcttgttttttttttttttgcatgactataacaacccaacaggaaatatgtgcatggatggaagtgttttatgcaaatgttgcactgaagtaaacacaggaacgtgatcttaggttgccacttggtgataggctgagggtgtttaacagctttactttcatttcctgcaaaatattcctcagcagaattcgtttgactcgtgagagacttttgattcaggttaattgaaggagtggcacgttctgtgaacaatctgcttgagaagttccatcagtcctttttcctgtacttccttacaggtccaagcaagttcatttcggttgatgtgtat

SEQ ID NO: 3170 - DNA, 955 bp, Zea mays
tctccgttcccgtggctgtgagcttgcctgcatatacgatgaacacggattgaccgcaggggcgacgccagaaaataaagttattggggtctgttttactaatcatcatctaaatacactagctaacaatatatttgtatagtatttcttaaattttataggggtcaagtgacaccaataaaaccccctagcttcgcctctaattgaccggtacaacagttcaaaaaggcaaagaacaaaataggtcacgacgccacacactttgctgggtctatctcacggtacctcttttcaagttgcttgaagttcttcttggcaatcgcagtctacaacaacaacgccaaaccgacaagtgattgataatgttgtgatgatagatatgcagtatacartatgtgtgtagtaccttatctcgtactttgacggtcggatcggtacctcgagtggcggtctgttgtcaaatgatttccacaagaattataaagagtttgttttaccttaatgtttaagaagttgtctatttttttaagttctcatgaaactctaaatttagctagaattatacatagactcttggagttgctcaacacatgatatttcttcttctagttttaaatgcagtggttttgaccggatctataacgtttataccacgcgctgtagcacgatctacggccaggacacggtcgccacacgacgactcccacccgcagccaccgcacggccgtgttggcaccaaaccgcgtggtggtgttaggctcttcgcccagatcaaaatcgaatcgatcccccaacccgatcgcctcgtcgtcaaaaaatccccattcgttccccttctcgcctccacgagccttcacaaattgccctctcagctcttctcctaatctcactctagccctagccaaatcccagacccatcccagccctagcgacaccaaccagctcgccagcgacc

SEQ ID NO: 3171 - DNA, 213 bp, Zea mays
cagacctatatcccttatttgcgagcaaatttatgaatttacacaagtcggtgcttttgctggtgcaatctaaattgtattgtagtaagcattatcattgctctgctagccttgtgcaacctgtatatcatagtctgtttctatttgtgtgagaactctcagttttaaaagtacgcgtgtaactcactatacctggggattttttccctgtag

SEQ ID NO: 3172 - DNA, 1500 bp, Zea mays
ttagatgatcatttttctatctaggcattcatatttagctagagagtttgatagggacactaatagagagttgctctaaaacaccctgcacttcggctgtccaagcggaccctctgctagatagatgggctacctttggtttcagcttgtcaaaattaaggagaaaaaatatccagactattaggataaatttaatattttaaagcagacatgtataaaatttgatgatgatgattttttctatgttatcaagcacattattattaataacaataaatttttgtataaatcgttttatgtattatttgctccctaaaaaattttaaaaaatatgtatccaaattgtatatctatcatttgacaaaatatatgataattttgaggttatcttttatgaacattttaagcatctccaaaaaaggtctcaaacgaagtcctatcttaaattataaggctcaggggagaaaaacagccttcaacagatgtcctattttgtcaaattttatcaaaccggtttagggcttgaagtatatatagggtcataaatatagtacctaaccatcctgagtcctatatttttttcccacgttgcgcgagtcccacacccaccggccagcttggtccacaccctgcttaaatatgccaaagggactgggcgcgcgaagggaaaaagcacaggatatacaacgtgcgtgtggcctgggaagttgaaattatttgagaaacagatgtttaagacccaattattggagatgatgacatattcagggtcctaaaccaaatcaaatcaagtccaaaacgatacttagggcttaaataagagacttcttcttggagttgctcttacaagtttaatgctaaaaactatgaatacaaatttgcataacagaatccatatcctatttaatttattcgcaatttaagaaaaaaaaaaactagtgaactgatactatcccaaaaggctagtgtatatccattatttccatcccgagtcaaaatcggacaagctatgccggtattcggaggagcgttacaacgtatatatgagcgttgttgcacgtaaacatgcttgtgtgatggagacgtgaactttcgtctgcgatggggacgacacacgtaattatctttttttttcattttttgagcgagtggagagcacccgagatctgctgcgcggaaaatggccttggagttggaggagtgtagtggcgtagtgtgctactgctacgctgcaacctgcaactgcaactgcatcggtgacgtcgcgcgctcgggccatgcatgcatgagacaacgttgacctgacgtgcgccgcgcgctgctcgcgcatgctataaagccggcagaacagcgagctgccttcctcgccgtggagtagaggagcacaagtgagctagctagctctagctaggccacgcactgctgcctccttcatcatcaggtcgtgctagctagctagctatagctgggccgggggacgtacgacatcagcgcgcggcc

SEQ ID NO: 3173 - DNA, 1500 bp, Zea mays
gagcaatagtgggatcttactgcaaagttccctgtgatgctctttcatcctaaggaacagacacaatcctaaggatggaaatacttaaattgagacttgggttaggaacaggtgatgttctacccaggttgattaaggattaatgcgaatgtaggcgtgctgaccgaggaccctttaactggtcacatgcctcgtcatgggtaagccttgcctcgggcagactaaggccagaataagataacacgaaatgggcgtggagcggtggcgagagtagcgtgtaccctccgtggcaagaggctggacggtggtgtatctgtgctctcggtttgcgtgaacctgatctggtcttaagaaccccggtggcgggttgacatatgcaagggttaagtgctacatatgtcgtgtgattggagatcctcagctgagtataatcgattcggatcgccgtaccttcgcggttatgaagacttggtcacttccctgcaacctaagtcaggatgtgaacactatggataaaaatgatgttgtattgatgagatgttgaaattagactagatgcaaatagagtctattaatacttaatatggcgttaaaagattgaaagtaaggactcactttagtaagctacttctgcaaaagtataagttgatttttgctaaagcctctccttgactcctatttatccagcatacccttgagagtcttttccttagtcgggtaagacttgctgagtattccatactcagggtttatccctttgttgtttttaggtgaggaagcgacaaagttttgttgcttttgctccaaggtggtatctaatgaagaaaaacaagaatgaagatacgggaggacttggtcctccacataggatctttttgtttgataattacttgggaggagtttttgcctcccttgatatgtaataatactactcagcactcgtttatagctctggtctgtaataagtaacttgatcttactttctaaataaatgtaagtttatgtaattgcttccgcacttctatatctccgatgttctgtaatgtctgcaagacgggtgaaacgttcctggtgaggtaaggaaagataccgaacttgtcaagtgacttaggaacatctacagggtgtctgatgtctgttggacaaggacaactgtaggtgggcctaattacttgggaggttccgtcacagctggtatcggagcgtagcccttctttgcagatattatgaggcatcttcaaaaggatttttaaaagtcttacctaaaaactcttttctcttcttacctgagtattctgaagagtctatcttaaagaccagataggaagagtgcaatgtatagaaggtatgaatcaactaaggttgattctgtaattacacatgcatcatgtcatacaaactttaagttaaaccccctgcgtagctagtttagtacatgattcatctaccttgttcatacatccttagtgaatagagtgtatccgttgcccttctctatag

SEQ ID NO: 3174 - DNA, 346 bp, Zea mays
gctcggtacccctgctcctcctcgactcgcgtccgaccggtgggacccacccacattccagcattccaccacagtgctggtccaggtccgagtccaccgcaccgcgtccctcccggtcccgccccccatcgccactccggcccgctcgcgcgccgcggtataaaaagtatacttggattagcctgtcctggcaagcccggccaccaccgtacacccaaaccccatcccatccccccgaacgcagaagatcccgtgccaaccaacggcggcggcggcgacggtgtgtggactctagactaggagccaatccaggccatccacccgtagccccgccccgctgccggca

SEQ ID NO: 3175 - DNA, 1048 bp, Zea mays
gataaaaagcttggacattgcagtgtctccgcagcaagacagtacaatcctgctagcatccttcccgagttacgttggtgggtatttggtctcatggtgacatcgtcaatcaaaaagagttacgattcttccggagaattttccttgtgctgatctagctgctgtaactgcatcgaaacatgctttagaagctattgaaccccatccccccccccccccccttttgctttttattcccctcgtttcatgcctaaaagtttaaaggacgatgcgtccaaaggattcgatgttatgttggtaatcataaaggttaatgaaatgtgaaagatacacttcgtttatgggagagattagattcaaagtgtcctgtgcagtaactgagcagaagtgtggtcacatcacatcacaaatactagtacatactccaactccattcaagaaagaatgcaattctagcagtgttatgttttggtattttaaattttaactaattatagataaaaaaagaatcaatatttataatgtgaaataaatattattagattgattatgaaatgtatttttatactagattaatttagagtaaatgctatttactaaaaaaacttggttaaacgtaaatcacttcaactcgcacgcgttttcgtctatgacacagagtacaaacatgacgattagatagaaagtggtgagggatcaaaagcagcttggtcatttcctaatcgaaactgctcagtcgctgaatcatggtctagtaatacctgtcccactcagattaatatgcttcgcttcaggcgcgggccaacgtctcccgcaaattcacatgcattgataaaatccattctctggaaataggcaaggaaaacttcatcgattgcttttgagttgcccgggctggaagaagatattgctttgcgctgcgctgcacttggcagtgtctgtatatatacatccaccacgaacatccaattgccatcaacacaccaccaccagcagcagcagcacatcaatttagctagttccaggaacacgcgaggaaaccgcaggc

SEQ ID NO: 3176 - DNA, 146 bp, Zea mays
aaccttgaatcgctattctgctacgacaaatctgtcccagaggagaatattggaaaaccgtccggtctagatctggaaaagaaggatgtcggggacaaccctccctgctcaagctgtgaagctaaaggcgctgtgctgtgcgcaac

SEQ ID NO: 3177 - DNA, 237 bp, Zea mays
cttttttctctctttttcgagagagaagcggtcgactagtgactagcctggctgtaggctccccccgctgaaggctcaagtctcagtcccggctcaccgcagagttatctcactcggaggcgccagcgcgcgcgtgtataaataactgcgcctcactgctgcggtgcacggtgtccccctccctacccgctgtctgcggctggccaccctcatagcccccgagctctgtgtgcgacg

SEQ ID NO: 3178 - DNA, 1034 bp, Zea mays
actgttcgaaggagaagagagcaccctccgagaccaagttcggacggtccggtcattgaaaaaccagaaaaaaccgaaggtaatgggttcgataaaatgcattttagcgtcctcgcggaccgtctagggtgcacggccggaccatccgcgactgttttatctgatatctaacgacacatttaacacacttgtagccgttgatatagccgttactgctgaccgttgagatttcaatcgttgatgtgcaggggcagaccatccggaccaaggacgcggatcgtccacggttgacagaaaggaggcaacggctagaaagtggttggtggctataaatacaaccacagccacctcaattaaatttatccaagcatcccattcactcacattcaatacaagagcaagtactcattcaaagcttcgaagtctctccaagtgccataattatgactagtgatcattagtgtttagtgccttggaaagtctagagatagtgtgatccggtgtttcatttgttgcttttgttgcttgtttttcttaattgtgctttcttcatctacttctaaactcacacgtgacttgtaacgctagcaagagacacctaagtgtgtgatgatccttgcagggtctaagtgacccttgagattaagaagaagcactcaaccgatctaagtgatcatttgagagagggaaagggttgaaagagacctggcctacgtggccttctgaagagcagtaggttctttgaaaccgaacctcgagaaacaaatcgccccgtgtctttgtgctaatcttgtattgcgatttgattctctctcctttatctttaaagttgtctgtattgattgagcaactcatagaaagaagaactctcttccgcactctgatttcattattacttattttaactctaaccccgaggcaaagttcgtgttcaaagtttataatttttaggttttgtctatccacctccctctaggcgactttcaatttgtatcaaatcacgacacttcattagagtctaacgactcgaagtg

SEQ ID NO: 3179 - DNA, 343 bp, Zea mays
ggtggcctggtccgtggccggatggttgttgccgtggtggtgcgcggcggcggcggcggcctgggcgcacgtgtgggtgccgtggtacacaacgtcgaagagcagcgggtcgccgtccgtgcgctgcacctgcttgctcgcctggcagctctgcgtgtgcctgtgcgtgcaccggaagtaggctctgcgagaatttgatgggggggggggggggggggagatccgcgaggtcgacatcacgccagagaacggcttctacacgggggaacccagagcagagaacggacacgagacagagcagctggccaaggaggaggaagacaggcaggggggagagagcgtg

SEQ ID NO: 3180 - DNA, 1500 bp, Zea mays
aaaagctcttccagttccaacagcgggcaagtgttgcagttgaactcgtataccttttggcctgcaattcaggcagcggactataagctcttcgggcgctgtgtaaactgggtacggcgagggcgagtagtgtgttaggcacttggtcgacacctaacctatatcttagccgacacaaccttttccaatcagctttcacctgaaaaaaataattcaggcctacgtgacgtcaacgtgttaggttagatgataatatgttgggttagggctaggctggtgccacccgaagacctattccatatcgtctatgttttaaacttgacatgtttgtttgagattttaatctatccagattatattaatcataatatagacatatatatatattataatcccaaacaaatagaccctatatctacagtactaaaaacaatattttgtacactctgatttggatcaaactgacgagatcaacgagcagacccatagaaacaaacaacacccagccgcgcacacgctcagtttggacaggtaacttaaacaaggggcctaatctcttcgcccctgatgtcaccgtcacacttccacaggttgacataaagatcgagtaaacaaatcgtacctcgctccatgttttgagggcatgcgtcctccctttaagacctttttctttaaaaaaaatagagcactcatacttaacaaggtcaattgccaaaatattttacctttacaagaaatttatcatacttaacaaggtcagatcgtctcatgtgcagtcccacgaggtctgtcttgtttyttttagtaacaaggcctttaaaatttcaaggttcaacccaagcttccaaaaatttgaaaacaactctcaacgcttgcttcaaagaaaatatgaagcttccaagtgcacctgtccagttaacatgcttgaaaactggtgtgcaggccccgtagcggtaggcatttcgtaaatcatttatcactaaaagtttatgaccttgtaagactagctctgattagggtatgtttacgatagccccatttctaaaaatagatcttgtgaggttttttttgtgaaatagtgttattttcgttgaatctaaagttggccttataaatgtaaccctacacatccaaacaaaattagtagcttcggtcatgaaaagaggagaagcatgtcgaaggaaggaataggtataaaaatagactagtcacataaaagcaccgcagccatatagaccaataatagagaaaaacagtcacttcacaattcacaacattggtgcggcattacttatagccactagggggcacagataggtccctagtaagaaggagtataagccgattgataaacccctctctagctacagggatccttctgctttaaagcatgccgaaacttcttccactcccttcctaaaacacaacaaccacctctaccaagaccaaccaaaccacaaaactcgagtcaccaaacacacgaagcataaggcaagagcg

SEQ ID NO: 3181 - DNA, 1500 bp, Zea mays
aatcctgttctgtcattcccgttctgccaccattcccattccttgttctgcgtttctcattttcatgttctgccatcattctatgttctctcattcacattctttgttttgtctttctcatttcttcctccccgcaaagctcattcccatttccctgtacataggggcggtaatggatcatggccctaatacttgcttcacaaaccaacaaagccaccacatgtatgtttatgtctatatctatgacaggaaacacatctactaaatctctcaccaacctcacttgctacccttacacaatgcgtagtagtagataagtaacaccgagattcttgaattatatttttggatggaaggagtagtatttaaagaagaactttgcacaaccgcgacctctcacgcaaatgcgagcagtagctaccgctacaccacatgtggtggttgttcgcggagtagggtgctcgtggtagaggtgttgattgctggcggttgtgggcgcattggtggcgtgattgtttgatagatgattgatgaatagcgttgagagatgatccattaaagaatgttcgtcggatgtgtctgagtaagagagagtagacaaataaaattatctggagcattgatttttcataatgtaattaatctagggttaaatcgtttggtggctttagtcgatacatgagtgtgtgggatggtttatggggtgtacgtagtttagttgtttttatagtgtaatttatccggggttaaattgtttggtggctttattagatacatgagggcgtgagatgatttatgggatgtacgtagtttagttagtttagtttaaatcggtgggttaagggtagaatatttagagggtgtttggtttgaggaatcacttcatctaaaatgtggtggtgcatcatgggtccattcctcaaatttggtgggatgatctcattcctcatattagtactaactaaataactataaggaataaggtgatgatggatcaactcaatctattccacaaaccaaacaaaaaagtgaggagtgagaagacgatgaactagatcattcctcaaaccaaacagcttattatagagtgagttgaggtatatttaaagtagcgggctagcggcagatgtctccgccgaggccctttacacccacgtacggcccggccaccagtcaccagcccaaaacagagctctcaaatcgaaacccagrataccctttgcacccacgtacggcccatccaccagcccaaaacctctcaaattgaaacccaggaggttgggagacccgagactcgggaagaatccattgcgtgttccaaatccgctggcgtagcgtagaacacagcatctccggtagcgtcaccgtaggcctcgcaagtaaactgacctgccttctccgctttcccctccgtctccgtcgggagtcgagacaaagggagccagagttagtcccggcgccgtgtcgcgagcggaaggagaaggactgaaggaggcgacg

SEQ ID NO: 3182 - DNA, 194 bp, Zea mays
aatgaacaaattcataaaaatgtccaagccactactattttgctagcatctctatgcagggatgaatataacaaggtcagcggcttggacaacgccaaacagatttgggacaccctcaaaatatctcacgagggtaatgacgccaccatgattaccaagatggaattgtggagggcgagctggagaggttcgtg

SEQ ID NO: 3183 - DNA, 489 bp, Zea mays
aaggtctggtcaaaataagaatgttttttgttccattttagttggagtttgggttttcaaatctaggccagattagttggatttaataatttggtttctaaggtgcagcagccatatgatctcccaacaaggaggatcttgcaacaacgacattgatcaagaattggatgttggaaattatggtttggcattgttacttctcttactcctgtttcatgtcccaatctgaggtgactcgtgttggtaatcatgtaatttttccttcgtgcttctattcttcctatacgctttaggcatggcatgttgtgcactaacattttgattaacaatacaacacatggccatacatatggtattgttgcactattttttccgttgcaacgccacgagtattcaaccaggacacctcagattgggactgggaggaggacctggaggaggacgaggagatgatttcgtgctaccagggtcagaccccatctcctagaa

SEQ ID NO: 3184 - DNA, 913 bp, Zea mays
aagattatgatgcggacgaagtcgcccaaatccaacactttaattcccaagcaactacaatactcctcacctctctaagtcgagaggagtataataaggtgcaagggttgaaaagtgcaaaagagatttgggacgtattaaagaccgcgcacgaaggagacgaagtgaccaaaatcaccaagatggaaacgacagagggggagatcggtcgatttatgcttaaccaaggggaggagccacaagccatgtacaaccggctcaaaaccttggtgaaccaagtgtgcaacctcgggagcaccaaatgggatgaccatgaaatggtcaaggttattcttagatcactcgcatttcttaaccctactcaagttcaattaattcgtggtgatccaagatataaactaatgtctcccgaggaagtgataggaaagtttgtgagctttgaactcatgatcaaaggctccaaacaaatcattgagcgaggcgccacctccacacccgaggtgcaacccgtcgccttcaaagcgacggaggagaagaatgaagagtctacaccaagtaggcttcccatcgacgcctccaagctcgacaacgaggagatggctttaatcatcaaaagctttcgccaaatcctcaagcaaagraaggggagagattgttagaaatatgtcgtagagataatcatagagatgagcatatttctttgtatccatgatatgtatattgctgaattgaatatccatggaaggcaccttgtattgattagcaattatgtgaattgtttgtgagattctttacttatatggttattctaaatgatgtccctagtcagagtcgatgactagcacatgtattagttgatgactacatttcacaagtcatgaacatggagatgttaaactaataatgtgggcgc

SEQ ID NO: 3185 - DNA, 1284 bp, Zea mays
gtacattcaaacaccccctaaattagttcagttcaactcgtttataaactcgatctatttcgtttagcttgtgatttagatgtagaggcataaaaacaatatttttatatttatctaaagctcagcgtaataatacaaagtaacatatccatagactttgaatcaaataaataaaatattgacatatataaaatatatcctaacactatactgtatatccatagtctattagtctatactatactatctattctatatactctacaccgtatatatgttgtatctatctatattctattatcgattgtctatacgtccattacaaataaagcgacagagtcatagtattattttataggatctagctccatctatcaactaattataaagtataatacattatataaaataacataaatttagaatcaataacttcttattaactacatgagtgtgaaataccggctcctcattaaaactataaacaaatcaatcttcgaacgaaccgataactcgcgacatgagttagtttgattcagtagccggccacatttttttttgggttttttaatgatcgggagcgattgagtgagtgtttatgatgcgttctatatgtggatgtggagacgactagacgagacacgagacagtacgaaccgcctccctcgtcggatctggtgtcccagtctgctgtctgctctgctgttgggatctgatctgacgccaccgtgagcgccaacatttggggctccggttggctggctgtcacggtgtactcacggggacgccgccggccccttggcaggcgcagataatccccacttctcccagcgaagcagcgcaaagaggacggcgtccaggtatgctgcgggtccctgcgccagccaccgacaataatggcggcaatccacatcggagtccactccccacctccccgaccacccaccgcatcgccagtcgccacgcgacagcgacgccccgcatccccgcggacgccgacggctgggcctaccgcctgcgcctctgggggcggcgggtccagacgccacgcgcactctagaagagttgttgtgcggcgccgggcgcggcggccgttggatcccgtgccgtgccgccgccttcgccccgcccgtcctcggcgcgtcagcgaccccctcattgtggctgcgtgcctgcgtcggccagcccgcttgctttgcccctcgcttcgcttcaaatggtagagccgctgcaggctgagcgaccgcgagcttgacccgggcgcaagtcggctcgcacccagcc

SEQ ID NO: 3186 - DNA, 142 bp, Zea mays
tctcgtgactctgcgcgcacagagaagcgagagggcaggtgcctccggagcccttgccgttcgagaccttgcacgagggatcggcaattagatttttggggagcgtctacgcgactgcccaaaacgtcttcttcctggtgac

SEQ ID NO: 3187 - DNA, 1118 bp, Zea mays
tactatcgctgccgctatgtggcatgagtaaatattatacaaattactaattgttgaactgtaatcatgttacatttatgactaaatcttattgtaacaaaaaattgtcaatattataaagtattaaagaataaggttaagaaagcattgaaaatgagctattatcagcctcaggagcatccatattattttatagatcttattttatagaccagacaaagaatttatgaataaaaataattaggattgtcaaacatcttaggtgtcgtttggtttctgaaatgtaacgtaaatgataatgataacgatttacatttgaataccgacggtaacaaatttaaataaggcggtattaatttgtagtgtgatatcggttacggttggacttaaacaaacataatttaacgttatcgattactcattacattatcaatatgtaaatcaaaccgtaccttagattttctagacaacattcagaaaatttcgcttctcagctaagcgagtttcagaacagtggaaacaagcagcactttgcttgtacagctcgtcacgggtggggtggtggggtgactcctgggccctggcattcggcgcggtgcggtttctggcgctttccacgctctgttggctcctggtcggtagcgatggtgctacaatataaaaagtggtaggctgtgttcactgttcactgcttcccgtagtcctttgtcgcgagctgctgtgctgtgtcctgtgtgcccgcaccatcgcctgaggcctgagggtgcgtgctgcaggtatttattggacgcttcccggatcaaagcaatgtcgagtggcgacagtcggcggtgggcgcgcatgcagtgggtggcgacgcgaccgagtgcggtggtggtacggcgagcgagcgagcgacacgagctgagtgagtgccctgcaagcccaagctcgtgacagagataggacttcagctcgactcgcgcggtcgccttgcctgctgcacacgagccgtcgccaactcgatcctcaccggtgacccctaccgcagctcatatcatcctgttcttgctcttcatcttactgttaatttcctgccaatttaatcccaccggccatcgttctcctgaaccaaagcc

SEQ ID NO: 3188 - DNA, 213 bp, Zea mays
ggttaatgggcactagcagacattgaggcagcgaggtcggtgtttcaggagatgaggaatgctggtgtggtgctagatgctgtgagctacactacactgcgctgttcggctgcctctgcaggcatggaagtgtggatgggggcatcaatcttgttttggagatgaagaaggggtgtagagctgatgccgtcacatggacggatagtgtaagcg

SEQ ID NO: 3189 - DNA, 1500 bp, Zea mays
gtagtgtaagcagctgaccctgacctctcgcatgtgaaacgatggaagaacactcgaatacaacagctcactcgacgatcatggtgccgtacgctttccgggtaccacaccacgcgctgcggagtacagacgcggagagagagaggggctagacacaggaggggtgacgccggcgtgacgctgagagtgagtgagcgcgcgcgcgctgttcttccggcagttcttggcggcaacgctgctggaagcaaagcaagcaagccccccaccccgtgtgatcccgctcaataacgtactacgctgtgattgttggaacgtgcacgcattatattacagagaccggcaaatcaaaacccgtggccgtgtgtctgcatcccaaaggccaaagctaagctaaaaacatttctatagagagagagcacactgaagttagtttcaaaggtaagcgattttcgggtacagtacagtacagcgcactccaactccaacaagctagcgcgggcgcgaacaaaatggtcggtcggatcccgtgccgaggacgtcgtcgtcgtcgacgaatagttattgaccgccgtattgccacaagctgacctgagcgtctgacggacggtggtcggtcggtcgtgatccacaatccacacaaaagctaattactgaaattaagaaggtagctagcactctcagcatgacgtgatcatgaagcatgcatgcatcgggacgatcgacgacgattatacaggtaacctatgttgcttccagttaattacatgcgactgatcggctagcggccggcctaatcatgtcgcaccccgcacccaagggaaaataacacaaaacacgcgcacccttccgcgcggcggcataacgtcgaaaaggcgacggcaaattaagcgtagggcgcaacagcgtagagtatatctggagtaggagagtagctagcttattagctagtagatgatgtgcggaattccacctcccaccaacccccggccgcgcggcccagcgaacaccgccactaagcacgctgatcgcgctaatggcgcaccaatgcaagcaatggccagccttgtgttttcacgccaatgcaagtgggtgtcgctttaaccgaaaactacgtcgtcgtcgtcgccggccgatcgatcgtgtgatccggagccaacgacttggcccggcacgtcaccccttttttcttcttccagcgagctctctcctgccatggaggagcggtcaactttgcgacatcattacgcgcgcgtcctcctgactggtgatcaagcaagtccagcagcccggccacctgagcctgatgcaggctatatatatatatacaccgtcccatgccattgcccgccacaaacacaaccgaacgacgaagcgtccgacgatccaatagggccggctagcaagtgcatgcacacgcgtagcagctaataactgcctgtgtgacatatagagaggcagctaccgactaccgtacggtcgagagagagatagcttagatcg

SEQ ID NO: 3190 - DNA, 286 bp, Zea mays
ggtgattgaactaaggaacgaaggcctttaaaaggataaaatattaatttcattggtaaacaaaataaaataagacaaagctagttccaaagctcaagctgaggctcaaaagagtcaaattgaagaccttcggagacaattagttgaggccaaagaaaaatgcgttgttgctgaagctaatcgagatgccagcgaatattggaaaaattatttagaaaagacagttgcagagcttcatgcgtccaaggaaagatgttttgaaaaatctgtggggtgcgtgaaaaag

SEQ ID NO: 3191 - DNA, 136 bp, Zea mays
gatgtatcgggttcacacacaagtcactggcaagcaggagagtgaagaggatcaggaacgagaccagcaacccgcttgagacgaaggatgagcttgggctgcttcatccagcattcaaggctgtgaagacttccac

SEQ ID NO: 3192 - DNA, 82 bp, Zea mays
tttgtctcgagaccttgccccatccagcccaacgctccgtccatcaactgaatagcttggcggtgtaaccctgtcgtgtgcg

SEQ ID NO: 3193 - DNA, 1116 bp, Zea mays
gctagaaaaatcacttgacttctatcgagatccggattagcaaagcggctactcgacctagcatactaatatccatctcaaaaaggaatcatgagttcatgcatctagggtttcaaccaactcctacacttaagtgcacattacaaacctacaaacattaagtgtagtaaaatagcatatataaactgttatgcataaaaccgaggcttgcctggaattcaacactaggtagtgtttgctagatgacactcgctgggcgagcatccactggttaagtccatcattcttcaagtcgtccaccaattgcatcttgtggttggcaccacatcacttgcacgatcttcattctctgtcctaaatgagatgcaggatgcatatgtatgaatatgatgaaagtagcacaagataatcccaaactagatggtagtaactaaacactaaataataagacactgcaacaactatatgcaagcgctagttatctatacgtctgcttcgtccagggtgcttcggaagatcagcacagaagtaatgccgaagctatcatccagggagcttcggcataacgacatgccctgagacgaagggttgcaccgacttaaagatgaaaagaccgatcagcccatgataatttgtgtcatgattgtaactagttgtaaaggacataaatgtaattttgaccgggatgcgtcctgtgcctataaataggtgaacagtatccccgtactattcacgctgactggtactcgcttgtgcaacacgcttgtactttctgtcttctgtcaagtcaaaggtacaaatgtaattcaatattgcttttattcatttatgattatataaaaaaggacatattatgatgtcatataattatccatgttatttcccatgtttcatatgcttcgtctttcattgatatttactgtgatgatgaaggtacatccttcataaccttcgtccaaagatcgttatatccttggggaaataatgcttcgaaggacgaaggacattaaccattaacctatttttgtgttgccttgatcttaattcatagcattggagaacaagtccccaacattggcgcccacctccagtgaactcacttccactttcgagctg

SEQ ID NO: 3194 - DNA, 1110 bp, Zea mays
tcgtataggagtatcagaccagtaataagctctaactcatcaaatttccgccactgcattcttgcatcagaaagagaataatccaggaaatccatcagcgacctagtaaaggacatgagtgtacacatgtacatccaatacttttttgcaaaggaaaaaacgagaaatggtttacaggcataatacacttcaaattggatcattcagaccagatccgaatactgggtttgggtgctcggttccaaacagcggggatggaagagaaggggtgggcgtacatggccgggtgctcgacgccggcgaagatcccgaatacgaaagacctggtcacctggcgtagggcggtggcagcgtcggccgcccagtcgtcgccaccagagacaggaaacaccgaaacaggaaacaccgaaacagagcgcaagcgaggagggagacgagtgcctcagcctggatgaagaggaaggcccattaaaggcccaattaccacgaagcggatatgtatatatgtgcacactgcgaagcaatcctaaccgccaccagcatccgcctctcttctcagtgccagccgccgtgcgctcgctctctctgtccctcaaggccttcgccggcgaagagcgcctagtcacccaccaggtattcccactccgtcctttttcgtgtctgctgtgcgaaaccgaggtcccaaactctaatctcgagctttttagctatttgattgatgcctattaactacgattatttttttttttggcaaaaatcacccatgtcacccctgctactgacctagtatggtgtctgtttggatgagatgctatttctctgcgctgagttctgatattgggatcgaatgaatctcgtgaacctacatgtcttgagcttcttgttgacatatagatctctagagactctagttgaggaggaccttgttaagatttcctctggcccttgacttgagcatgtatattgatttgtagtgttctgtagttagcattcaccctaggtattggcctgatttgctttaggctcttgggtcggtaacttccattttacctcacctcgctgtcatgtagctaaaaattgggaactaactggaatggtggtttgtgcagg

SEQ ID NO: 3195 - DNA, 1500 bp, Zea mays
aatcaatatcttattttattaataaagttagacaattaaatatacaatgcatatgtaggatgttaccttatgatttgatggctttattttagaggaatacacggcgacctagaagctagaaacgcgctggccgctggcagtctgccacgtgcagcagggccagcagcggaagccagcaagtcgcctgtaccgaattttttgcattttgacccttcctcggaaaaaaattcacgtttggaccttagaaaattttaatgtcatttttggaccctttgctcggcgccgtagcctatggcgccgagatacgtgctgcgctggcacaaacggacggcgtggcgccgacgtggcaccgagctcggcgccatagatcttggcgccgagctctattttatacatagaacctctgtagctcagttggtaaaactcaagtctcttaactttgtggttgtgggttcaagccccactgtgagcatttttttaatacctttttgtctttgtcacttatttgtttttttttgttgttctgatttttcgtttatgacgctgatttatccgtccagatttatttctcatctagattttttttgtttttgtgactgttttgtttatttgtccagattttttttatctggcgagcaaaaacaaatcagtcagcgaaccaaaaaatattcgtcaagatttttttatccggcgagcaaaaacaaatcagtcagcgaacaaaaaaactggacgaataaacaaatcagtcacaaaaacaaaaaaatctagatgagaaataaatttggacagacaaattagtgacataaacgaaaaatctgtaaaaaaaacaaataagtgacaaacaaaaggtattcgtcaagatttttttatccggcgagcaaaaacaaatcagtcagcgaacaaaaaaactggacgaataaacaaatcagtcacaaaacaaaaaaatctagatgagaaataattttggacagacaaattagtgacataaacgaaaaatctgtacaaaaaaacaaataagtgacaaacaaaaggtattaaaaaacatccaccatggggttcaaacccacaaccacaaggttaagagccttatttttaccaactaagctagactagctttgtgtacagaactgagctaatcctagtatgcaatctatatcatgcagatgtttggtcacactcccaacgtaccatatatatatatatatatatatatatatatatatatggggccaggaacaatcaatcattgatggcgtagagatctaatcccttaagcatttattagcgagattctgtgttggcctatgttcagctaggtagttaagattggtactattgtttgtacgagatgttccatgttcaagttcagcaccaaggtagctattggagcgtacacacagttttgagtacattattagcatagaaaaaaaagccaagaggtttgagctggttggactgttacttacaaacacaacagcatctcttgcggcgaggacgaca

SEQ ID NO: 3196 - DNA, 792 bp, Zea mays
cacggtgcaccgattatcgccgtcggcccgtcgcactgccattctggtaccaccgctgtccgctaggcgctagccccacatcatcgtctcacaatcacgagagtccaagcggcaagcctccgtgctttaggtcagataacctgccgccgatgccgtgcaactttctccctctctactgtctactctacccctctcgctggtgtgtagtaactgctctcacgcggcaccggctgggccccgatgcttttaccacgacggctcggatttcctccagcttgggctagctgcctagctccagctccagacgcgggcgagcatgtggaggtagtgttcatttattgatggcgatccgagcgagcggccggcgcctggctgcgctccagcgcgcggaggggctctaggtgcgcaattaatggcggcatttagtttctacgtcgctgttagttggcggaggggagaaaaggtcggcggggcggtggccgtggacggggcgaccagcagcgcgccggtaggggcctgccagggaccagggggcgttccgtcttgagaacactggctggcactctggaagagtggaagtgttaccacagcagcttgtgccgcttgcgctcgcactgcccctcgtgctcgtgggtcctgctagagctagaccagctgagagacgatagatttcctcccgacaccgcgtcgcagcccccatcgctctctctcgctggcgcagtgacgtgcccgtgagcttctcgtcgatccaggaaagacgtgctcctcgctctccttgtcctcggcggcaag

SEQ ID NO: 3197 - DNA, 52 bp, Zea mays
ggtcgctgggcggttataggagagaaatatggggcgccatgtgttttgcgtc

SEQ ID NO: 3198 - DNA, 912 bp, Zea mays
tggtggcgttgcggcgcgagctcgcggcaggcgaggagctcgagcgctgggcacggcggcggcggcgcgagggctagggttttggacgagggggaagagggaaaacacgagtagcgcttatatagggcgggcgagggtaggaggagcgggcgccgcacggcactgttgcgaggatcgaccttgaccgttcatcgctgcctcgcgatttggcaggccgaaaactgaaaccaatgcgagcgagttgtacactcttggcccattctttctattctatttctttctataaacgccattggattgtcatcgaacggcagccgccgagttaggcgtctggacggctcccagtaacgcaacgcttctcggcttctcgcctcttctctcacccgtgactccgccgccgcatctctcctccaacgcgccgccgcatctcttcaacgctccatggtccccttcacctcccgccgctaccctacccatggccaccgcagccgctcgtgctaccctcccgcggcccctcctctctctcccacccttcctcctcccaccacatcctccgtgtgtcagcccgtcgttggctccgccttctattgccgtagggaacacgcggcgtcgcccttgcgctcctcgccacatgctgttacaggctgtcgtacccgtgtccgcggttgagggccttgtgccggtcatgttgaagaagaagcccatcgactagatctatctcgtcgtcgtgcgcctctctgccgaagagaggcaacgcctcctccgcggtgccatcacgtgctcctctcactactgcttccactcctcccagagtcccagtacacccccgccttgtggcatcgctgctcgccgcggccctgcacctcagccctgcctccatcccgagtcacacacgtatcctttgaagaatta

SEQ ID NO: 3199 - DNA, 637 bp, Zea mays
gtatgtatgcatctattagacagctcaataagcactgttgtacgcttgtatggttgggacatatgggcgttatggcatgtatagttgtatgcctagatgtacaacacgtgtactcgtatatatatatataaatgctgaaacaagcattggtcctgtactgtagtttctacatttcattgtcaccaataattaagtgtactcctatggctgggagtctatgaaaatggacgtgttgacttattgggtaataaataatttatatatatacttgtgcaagaattttctcaatatgttgcaaagtgtaaccagcttctcaggagttatatcggttggagcagtgtgctcgggtacagcttcttatttcaatgtctccagtgggcgtcttacctctatgtttgtgtttttttttaagtgcagaaatagagaaagttcttgcaaatatctactctatgaaaaggacagctatttggaaatatgtgaacagaactatccccagttgctgggaaaaaccaagaagaaagttcctgcaaatatctactctatgaaaaggacagctatttggaaatatctgaacagaactctcccaagttgctgaacaaaaccaaagacagaaggaaccaccacaatccatacagaa

SEQ ID NO: 3200 - DNA, 625 bp, Zea mays
ccaaaacttacgtatctataattccatattcaatataaaaatccggatatttactaaatagtcctcacttcgaatttgaagctgcactatctagatactattcataccggttcgcatctgaaatatttgtattatccccaaaaattattaggatttgcacctgttttgattaatcttcgtaataggaaaagtaactcattggctagctatgatagagaaaagctcattactctgggtagataattctcctcttctgtcttccatttaattgtacacgatgtaactgcctttgtgaatcaataaagctagccacaaggcttttcctaaaaaaacagtatggatacttccatatgcttaagaacatttaacaaaactagaaaatcataaacgccgtacacagacagttgacatacatgagcagtgtacaaataatcaaatatgaccgaagtataaacccatcccttgtctccttttgatgatcgggtacaacccgactgagcgacgctagagtcgtgcgtcgtgtccccttggcgcggcgcccacctctgacctcgccactggagatgctgctgcgccagagctgaactaaaaccccgggaaatcaggcagcaggccgccggaggaa

SEQ ID NO: 3201 - DNA, 1500 bp, Zea mays
ccggaatgcgaatccacgatggcggcggcggctcggacgagttcgcaatggcaacagcggcggtggaaactagctacgcggcggagtcgtacaacgtggacgcgggattagattagggcgcacggcgtagacgactcagggctaaatactctgaggcagagtcgcagcggcccgaccgaaatgggcggcgcgacgaggtcagccatgcgaaggatctcggcttcttttacacgaagtccgcggggaggaggcttccgccagggcggccccaccagtcattgataagcgccgcgcgaccaggagactaggacagcgcgagtgagacgaccatgtgggccccgcacgatcgggtggctgcgcgtgaggaatgaaggagattgggctgcgcaggagtaaaaggggagatgggccgaattgtagttcagggcccacgcgcggttttccccatttattctttttcttttatattttgttttgtttttccttttgagtttggaattcaaaattcaaaattcaaacttacactatggtaaagctccctcagattaagggtacaattttgcatatactattattttatttataatatttatttttgtctatatattttcttcttttttccaaatttcttgaattttcctttaggtcttaaattctattttgaactttgatatatctcttttcacatgattttttatcttatgtcacaaaatgcacaccacataaaatttcagcatgatgcacaatttattggagtgtctcttgttaattatttatttgtgtaaggtgttcacatgaaatgatagattgagatgacacacatatatataaaagaaaacacttttccccttttatatgatctcttacaaattaggtgttacaagtctctttgcatcagtgttgacatcttctagtgcattgcgagacaactgtaggagtcgatctcgrtactcgctgacggacatggtgttcatgatttgttttttctattttttttttactaattgctaattcatgactggtacatattgaagccaaaccttcgtttaattagtatttgttgtttagtaaaataatatattctgttaattaagttggtatattagaaaggatgagatatcgatgatggagacgatgaaatataggagacgaaatcttttaaagcgtgtcgcattcggtaaaattttcgtcgagtattttttagactttgccgagtgcttgcaaaacaactattttcggtagtgcataaacgataatgaatattatttaggagagtggagaacctgttagaaacagcctaaagtgcgtttcgcgctttcctggatgcctccatggctttacgcggtggatggcatcgattcgtctatgctttggtaatataataatattatatatacaattattagagcaccaggtaccttagcacggcaatcatctacactcacactggcccctctcatgtcctgagcagcggctagctagctccacggcttcgtcgcc

SEQ ID NO: 3202 - DNA, 1500 bp, Zea mays
agttgtggacgagaaaaaaaagtctagaaaggactttatttttgaaagaggaagtattatagtttaagaatatttttaacttgattttcaaatttaatacctatcattgttttaaacttaatctttaaatgtaagatttattgtgtaatttagtggatgcataccgaataatatttaaatattaaaactatcattgaattattaaattgtttgatcaaaataatttgatcaaatctacatgtaaattttggatctagctgtgagccgagacaatacgagccgccgctgcccgctggtgcaagaagctgcgtgtgcatagtgcacttgcgactgagcttcgtgtcgacaccacaagctgctcggcccatgtgtgggcattttggtcatttgaccaaaaccgcacattctataaatcagcccccttcctccacggtcgcgtttcacgggcgtagagagagagagagagagagagagcgcgagcgagcgaagagggcgtgagagaggagggaggccaagccgtacgcgtcgtctcctgctgtttctccccatccctttcctgcctcggcttgcaccttcaaccttacttgtaagttccatcgttttaactctagagaggctttttgctcgcgaatattttggaacgaagatgctccgccttgattttggtttagctgttgttaatctgaatcgtttggttgcgtttatcgtggatttggacgtcgagacgccgctatatgaggaattaatttgattttattgcttatgataggggttgttgtcggttggcgggttaccgttcagatctagtgtagtaaaattgcagtggtgatgggaggagaggagtgggcaagttaggttattaggtttctaggtccatgtttgtttatttttttggtgaggatggtttctggttcacctaacggttgaaagggatgcgtgctgacttggcaaaggtcgttgtgtttttgtttgtacgtacgagattttttttatatctacttggctaattttaaaacggttcaaggttcaatgccactatgccggcggtactatctgcatctcagattcgggtttggtaccatgatttttttacagatttggccaaactgcatgaagttcagtggattatgtcaattatagagtcaggcgcctgagtgaacctttacagattttatgacgtcgagagttgggtaaagttggcgcgaaatcgttgcgctatgatttatttatttatctgtagttacgctagattacacactgtcggttaatctgttcctaatttcctatcacaatacaatcgccaatgcacagttgactaccttttgttccgcgtattgctcagatgagttggctcagcagtagcatcaagaaaaaacacattgtggtcatttccaacagcccccaaacagaactctgaagcaatttttttgttttgggttgcagaaagctctgacctcaaactgaaagggacctgcgaagagttttttttgcggcagtaca

SEQ ID NO: 3203 - DNA, 166 bp, Zea mays
ggtgcgcttcgcggccgacgtggcggagccgtcgtccagccgagaggagtaccggcggcggcgggcgtcgacggcggcggcggtcacccgagcaagatagcacgccgccgccgcgcgtcagcctgacttgtggtgcatggctgtgtagcttgcgtgacgtggcggc

SEQ ID NO: 3204 - DNA, 1500 bp, Zea mays
ttttcttaatttcattggggttcctatagtagaacacatcaagcatttcacctataacaatagcaaaagtcgggccaataaatcctaagaggacagaaccaatggcctccaacactacctatgggcatttagatggccttgattgctcgcagataagaatacccttctatgtgcttttctccgtttgttaagcgaacgtcagggatatatgggttgagaaacaaatctgcacacgacggagtaaagaaagaagaataaggactttttagcaaaagtaacggcggtgaaaatcagaaaagctagtactttatagtactttatagtagtaaagatatatgtcggatgaaatctagtttaacaagaaaacaaatttgctaaactagaatcacaggctcttcatacgttctcgcaagacttatgttagaatccggatcgtatcccaacatcgccatcaattaattatttttttgtggtggaacacatttatctaggccgaaggtcttaacttgaaaaatatagctcgttttttctatattttttatttgaagatttaatatgttatcggttatcctttcaaccgctttgtctaggtcaaaggtctttggttgagaagggaacccacttttttctagttttgttcgaagatttaacttgttattcttttttcgtgcagaaataacatgttattccttgagtgacagaggacaattagacgctcggtaactttacttagggcatatataaccatatttaatatagaattttttcagaggtttttagaggataattgaaacaaacacaagagacgtacggtctctttatgaaaaatccgactctatatgaatttctatacatattgtctcttaactatatatataaactagagcgttagggttatattatacaatcttttaattatttcttgtatttagaaaatcgaaccaccgtatcagagttgtacatgcacttatctaaaaatatgtcatatttatttctcgaagatgtttataggacccttaataacaaactgcaccccacctgtatacatatactaatgcaatgttcatacgtttcaatagcacacaatcatatttaatcttactgtttatatatgatggggtattggttaatccttggttagaccctaccaacagtacatacgactacgcgaggggggcccagtattaatagcataggcgtaaaagttgactcgcaccgcaactgtatatgtaattgaccacgtcacgtctcttagccgtcgtcgcatggcaaatgaatgcacacgggtcctggctgtcccctgcactgcatctttacacttcccgtagctcagcagccctgtatggcaacaccaaatttggcttcttgcttgcggtatatagacgatgcaccacgttcgtgtctttcatcaacagctctgctagctgcctagcttcttgtagcactagcaagttgtactcctctcctaccaagtactagcagagtagctttgtagcaacc

SEQ ID NO: 3205 - DNA, 79 bp, Zea mays
tgcagcggcggcggcggcgccaccgccggccgccaaggagaaggagaaggacgcggaggaggcaccggccacgggggac

SEQ ID NO: 3206 - DNA, 264 bp, Zea mays
agctaggctcagcttccttgtctctttcgtgggctctatgatattacttattccataatattgtgctcagtggttagcgttgagtcatggcacttggcacttaatttgaattggtgtggccacttcagtctcatgctgggtaatatattagcataacaaatcttaccatgaacttcagatgggcgtcagcgccatgctttcataggtttaggcttccgggaaagacctgaagcatatgacttccaagctgccctacatgatcat

SEQ ID NO: 3207 - DNA, 1267 bp, Zea mays
tcacaaattagtaggtctcctatgtcctggttcctaaagtagtagctcttaactggtggtgtacacatacttgttttgacttttagtaaattagtaaatctcttatctgctggttcatgtcacatacaactgcaaacattgatgtccagaaattagaagtacctggtatgccatcaagagctagagtctgcactagagatgcagtctgattcaagagatgttgtttcattcgcaatcaagatatataaaaggtctagagttcccataacacagtcaagaactgcacttcgtagaaatgatgcaatcaagatgagagcaatatgagaggcgattacatggaagcaagaactagagtttgaagtctacggaagttgcagtcaatatgccttgtccacgcctccacggccttcgcgactcagccgctcacaatgcaagaactagattcacggacctctacatcttctactgcagattgatgtcgcatcgtcgtcgacctcaatccctccgttggagatgcgtcgcttctgggattcatggttgtcgcagtggatgatggtgtagtggcacccgatggaagcacaggtcgtcggctcgccggcacaactcgcacgccaaattgatttgatggaggcaccaaggcaggaagatggcgcgggaaaataaaaattgtggaggattgggagcgatgatgttggcgcatctattcacaggtggaagctcgcttctcgcatgcgacccgattgggaaccgacataggagctctatttttcttttccctcctataatatggtttaagaaatgaatattgagaattgttggagttattttaatcctctccattacttttctcccaaaccaataaaattaggagtgtttggtttttatagactaattttttggccttttattttattttagtttctaaattattaaatacaaaaactaaaactagtagtatataattctattttagtttccacatttaataatttagagactaataaaataaaataaaataaaatatgagaactaaaaattaaggttagtttggaaaccctattttctcaactatttctatttttttattgaaaagtagttcgtaaaaatgaaaatcctttctgaaaatggggttgacaaacgcctttgtgtcgtgatttcgctccccgcctccgcagcgcggtcactcaatttccaagtaaatccagttctccctcgtctccgtcgctggctcgtcccggccccgcctgtgcgccgcggcccaggaatc

SEQ ID NO: 3208 - DNA, 546 bp, Zea mays
ggttgtctaggctcgggccggccgacctagactcctccaatcggcgtagagtcaaaaagaggcgaaggatttggagattgagaggtttaacctaaactagactagaactactcctaggataaaatgcgaataaaagttgtattgattcgattgttgatgattacaaatcggccgtagacctctctatttatagaggaggggggctggaccctttacacaactgattccgagctaatcccgcgaatatagctaacaaccgtagcacaaaactcggaaccctaatctgttctgcgcacgcgcggaccgtccggcccatagacgcggaccgtccggaccgcggaccgtccggcctcagggccggacagtccgccggctcaaaaccggttcgaacacttaccttcaggttaacttttcaagccaggcccaagggtaaagctggtgggccgacgattggaacccacacccaactcccaagttgcttgcttgatttcgccgagcagacaaagatcgggtcgagtcctacgccgacgccggcgacgaacaagg

SEQ ID NO: 3209 - DNA, 328 bp, Zea mays
atatatgtctaaattactattaagagattttagtttattttcttttagaaaaatattttttttggaaaatagagtcccaaactagcactaaggtgtcattttacaggcagagatgccawwtgggtttaagaaaatatgccagtttcagcggtagagttgctctttgaactgaacgaaaaacggcctcaatatccaagctgcacaaacagggcctcgaacagttggcattggtggtacatgggataaccgccgcagcgacgatcccctgcctccattgctctctcgctgcactccgcgactgcccctcggcccctcccaccaccgcgcc

SEQ ID NO: 3210 - DNA, 1500 bp, Zea mays
aaatatttgtagagactttaaaaatgattctaaaggtatttcttaggaggaaaatatttggagaattatcagtggaatatttggcagtatttcttgaaagaacttgaaggggatcactagggaaatatttgtaggatattttgaggaggatatagaccactatattttatttgttgagatcaactcgcaaacaaacattttgaaacgaaatttaaaatttattttgaatttaaagcaagtttgagaaaatttcacacatttgaatttttggggtgctacacaaaccagcaacctcatcacttcttttccccattttgcctattttcaatggcaaactctatgtccaattccggagaaaataaacacatacattggctttgaacctacaacagtataactatagttttgcagaatatataatacatcacacaaacataagttcagttatccaccatgtgacacaaacactcctgtacatactatgaagtgttctttcccaccttcaatctcgcaacatatatacgtgattgctcaacaaaatgtgaaaaaaactaatatatggcaggctgcatcaaactgttgtgttaaatggttaaaaaaactaaagctatacacagatgagatgcaaactatgattgttgactctaaacacacattcacacatgtagccgaacatatatatctttatgttttatattttatatttaaatataaataaaaactgtagcaacgtatttacagctcgctagttttatagaatgcgacactttttcctatagaaatgaaaaagtaatttctctagaatactttttgtacaattcttatatttttttcaaagagatcctcacgcttgttggcttcaaacaatacacctaaatgaccactcagtcatgtcataaaggctaagatctgcctattttgtatcaacagaaatgccacgacagtgtagagtgtgaatcacctaaagatttgttgatctcgtattaatttggtgtatatgtgattagaaaacacaaataacatgtcagcctaaagcgcaaaacattgaaacttacgtgatgacgtccaccgtaccataaaaaacgtaacaattttttttaaaaaaggttaaaccaggatgacacatcccacaaatcggccaaaaaatagggcacgcatactctccttgtatcgcacaagtaactgaaccctagaaaaaaaagccctaaagtccaaacaaacctcccctaaaaatgcaagtggatgaggccaaaaccatacgaatcccatccaaatctacatccacatccgctgatttttaaatgctgccaaatctaatcgcattcacatactcagcacacacatcagatcgccacatctccgacaccaaccctcctccccctctcgccgtcggccccgcccgtcagcctcggccgagtgcgtctgcctcgcactcccgcggcccctatagacagagcagccgctctagagcgggaggaaaggcgagcagaggagacagag

SEQ ID NO: 3211 - DNA, 631 bp, Zea mays
tgcaaagcccaggtcgcgatccctactggcgttttcggttttcccatgcaatgcgattgcccaccggcgaccgaagggttgagcgagttttactcctcccaaagccgaagccactccgtaataatcagccgagcgaccccgatcgcacggctcacggctgcgtgtatacgcaagcggtctctctgagatgtgggtcgtgagccagccctggccccgcacgtcggcgacacgcccggcctggacatcaagtggtactggaccgaccgatgtcactggctcgtacgttgcccaaacttgagtgttatacaaaagatagggcggctgatacggggttaggtagctaggccgactggcctggccgtggaggctcatttctaccgcctcgtgccggattccggcacgcgactccagctttttggttgtgtcgtcgcggcgaacgcgatcgccggacgaactctcatgccccggctcacatccttataaattgcctccccccctgcatgcctcttggtatatccatctcactagctaagccagcagccacagcgccacaggcagagcaaccacacgctcttcgatccgtcattagccagcgcctcgatctccttcgattcaatcgtttgacattgat

SEQ ID NO: 3212 - DNA, 842 bp, Zea mays
atccctgtccctatttaaattataataactagaacatatttcatatattactagttagatgttcatgtcttgctacggttttatatcatataaatatgtattgagatatttcttaagctatctccaacaatcttactcattgcacctccaatttcaaattccactattcgtattttaaattcaactatataaatagcgtagtctgcggtataaaacagtattttgcccaatcatatttatgactgttgtccacaaccttagcaaagcgaaaggcacaacagctcacaaaattggtcaccaagcaataaaataatattacagttttacagaaaataaatgccaatcttattgtttcattcaggctttattcgtaaggaaagaaacaatacagttccccgggtgtcatcaacacccactgaacaataatttagaaaaatatgggctcattctttcttattaaaacccgctggagtttccagcctcctccgcgtttccggtcatccggtgtactgagacactcgcgggtgcgaacacgtggccagtctctatagccactccggatctcaaaccttcatctaaatttcctatgagttgacgttcgattccgctttgtctcagcctctctcttccgtactgcttctcctctacctccgtcgccagccagccactacctcgattcgctcccctccggccctcctgtcgcgcgcgctctgcctcactggcgccacggtcgcccgcgccggcaggctcgagtccctcgacgccatcgcctagattgtctactagctggcccccgctcgccgcgaggtggtgcttgcggaggtggcggcgatcgtgcctgc

SEQ ID NO: 3213 - DNA, 1500 bp, Zea mays
ctttgtttgattaatgatttttttggatgagagtgtggctacaggatgaagcaatgcattttttgatggaacacacatgtgcagtatacaaatggaccatcaggttgcgggtatgtttttcggacaaattattccatttttttctattttgttgttccatcgagtctaattggattgggaatgcacatgctaactataccactagaacattagatcatgttgtttttggacaaattattttatttttccgttccaaatttctcccattaagtctaactgggattcaagtgtgatattagaaatcaccaagggacaaatcatggtggcgcatttgaggttgttctttctaactgtcatgttatttttgttgggacttaattataaagattgatgtttcataatgattttcaatattggtccactctgtttaagtactatagatgaattaacaattttaattgtcttagcctgctgctgatgtcatctttctatagcctaatactatttccctcttttgtatcgaactagagcaaaataccacccctacttgttacagaatagactcctgtcagcatagcttcgccatattttgcatctatgcaaaaatgattgtttgtatgttttagggaagaaatttctagctttatttacttttatcaaacaattagtataagtatcacagcatactgaatgaaacctgctggatttgccaagaacctgcaactttgaaagtgctaaggatatacccatgttcatttctgctaaaaattagcttcatatgcatcattgaaacttcataaatcagttcatcatctacaaccattcagcacacccttgccaacattcatgacacagaaagttagtgtagaaatatatggcagggctagaccatttcagttatactttacattaacaaatttcatcattaaaaattatgcatcgacttagctactttgtcaagatactcatttagaatatgtttggtttgaggtcaaaataggatagagcgggaacgatatcatcctcccaatttttggatcacaccatcaccaaaaaaattaattcgacgtttaacatatgactcttagggagtgtttggttactacaaactaatttttagtccctccattttattccactttagtctataaattgtaaaatatggaaactataactctattttagtttccatatttgacaatttagtgactaaaatagaataaattagagggactaaaaattagtctctaaaaccaaacacccccttataaaaaaaactatgactgtccacttccatccttatacatccttcatcgattcggcgagttcaaccgtgtcctccgcgctccgtgcctgccagcctgccactgctcggttctagaatccactccctgacctgtgcggcgctccgtgcctggctgccagcctgccactgctcggttctagaatccactccctgacctgtgcggcgttcccgtgcccggccggagtatcgatcgc

SEQ ID NO: 3214 - DNA, 614 bp, Zea mays
ccgagcctgagtccgagccctgggatcgggcgatgcagagttcgtcgtcttccggggctgagcccgagtccaagccttggggtcgggtgatgcggagtttcctatggcgcctgaggccgtacttggctgctgtcagcctcactctgtcgagtggtagtacagcagtcggagcggcgcaggcggcgctgtccccttgtcaggccggtcagtggagcggcgaagtgactgcggtcacttcggctctatcgactgaagggcgcgcgtcaggataaggtgtcaggccatctttgcattaaatgctcttgcgatacggtcggtcggcgtggcgacttggccaaggttgcttcttggtgaagactaggcctcgggcgagctgaaggtgtgtccgttgctggagggggtcctcgggcgagacgtaaatcctccggggtcggctgcccttgcccgaggctgggctcgggcgaggcgagatcgtgtcccttgagtggaccgagccttgacttaatcgcacccatcaggcctttgtagctttgtgctgatgggggttaccagctgagattaggagtcttgggggtaccccctaattatggtccccgacaaccggggaggaagac

SEQ ID NO: 3215 - DNA, 148 bp, Zea mays
ggggggcccaaatcaattccttctacaatgccacgtgccaccaaagcatcaatgatagaggttattgatcaagcaggtagcagcctataaagtttcctcgctcccagtctcacactctcactccacggtgtgatctgagtagtccacc

SEQ ID NO: 3216 - DNA, 1500 bp, Zea mays
ttccatactcagagttttattccctgttgtttttcaggttctaaccttgtgctgctgttgatggtgttaagtgccggtgggctcggcgttcttataagtctaagtacctcttctatacttcttattgaggatggtcacttgagctagcatatatttcaaacttatacttttgtaatcactccgataaaataatgtaaaatttttgtaacctgtaaaatttggtaataagatttccgctgcaaaattattgtatgtgtgatttgtgttacttaatcccgcggttctggttgtaagtggtttatccgatgtccttgggtcaatcggacggatcctgttgagttatctggtgcacctgcatgccgtctgaggtctttgagacaaggacaggtgcatgtgggcctgataacttgggaggttctgccacaatggttagcttcatgctagcgctttattttaatcaatgaacatgatgagatacaatgatgatactatgattttattctggatatgatgatatacttgtggcatttaaggggactcgagctgtttctcgagtgcctctccgtaaggactggttcgttggatgatcgcccgggaaaacagtgcaaccatgagggtggaatgggacgctgttagctgaataattagaggaactgaggtgtacttcgcttcgccatcgtgccgttaatggggctcgctctgccaaggttggttcgccccttgggaaggagtgcggtgcatttaggaaacctaacgggtggctacagcctcagggaatctttgtaaaggcttcgtagtgaatccctggccattcaccttgggagtgaataagggtcttgcaagcccgggctagagagggaatcacgacttgtgggtaaagtgcgcaacctctacagagtgttatgaaactgatatatcagccgtgcttgcggttatgagcgcccaagggagctccattgattagagacacattgaatcatggctactttgtttacagatgatgatgaggataatgttggtttctattatgattatgattgtgatttctggtattctttccatttggaaagagtacttttgggttaacaacttgggttaatgttaaaacctggctctctactagtaataattacctgatcaactaaaagcaactgctttgccttaactctacataaagctagtccactacagccaaacgggacatttgctgagtacgttgatgtgtactcacccttgcttttcacaaaacatcaggttgcctttggtgcaatatatgctcaggtaaagaagaaggagaacggtgtcgaggcggatctccaggagtttcaggacttcgacgagttcgaggattaggctagcgacctcccccagtcagctgcctgtggtgggttgtttacgttggctacgtttcgattctgtgtactttgatttatattatgtaaatggctctagtctgtaatattattacttaccctttattgtaattcgaagcattgtgct

SEQ ID NO: 3217 - DNA, 1437 bp, Zea mays
atttgtgatgacatgcaattttttattactgccatggcctcccagccctccctgttgtgggaggagaccaagatgatgtgattggaccatgacatcttgaagaccacatacccatagtaggtggccgcyatgaacctatagagcacggtggtggtctgagagggtactttggctactcattggctccctcgttgcggtgttagatgcatgtgtgattggagacatgtggcaagtcgatgatgcagtgctcaagtcttaagttgaggaggcgtagccctgcaccatcactctggaagtagtggtacaagcctacaggcttaagcaaagagaccagagttgggacacaatagcaagtaattggacatcatgctccacattatgtagatgtatgatctaatgctgttaatgtatgactccttttcagagcttgcttagttgaatatgtctttatggacaatgaataacttcttagagctgaataccttatgaagaggtcgttaaataaaattctgttttagttcgatttttttggaagagttagagctttgcaaatagaccgttaatttaccatagttgtttgtaaggttgagttgtgtttttatagagaccggtgtatatgcattgttttcttcaagaattttaagagtacaatgttcattggaaagtggaatacgcatggaaatatggaatgcgagggaagccacaccaacggacaagcagcgtcgtcggcgggtggaaagaaagatgcgtccggcctaccactcggcgatccgttgccttcgtttttgctttagcccgcaagagaatcgatgacgccacggctgagattcgctgcgaaccacgccaacgccacgcggtgttggtcaatacgcagaaacctcactaccagggcctacacacacagcacctagaccgtgcactgagcgagaaatggtccattgcttccgcgcgtcatctacgggtgcgctagtacagaagattcggactttcggaggcaactgccatccaacaattcccccagcaacgctacgcccactgacgtgtgaacccagccatagcctgggaccacgcgtcatacatgccatacgagccgtctcgtccccgccgcgtgtgagcaaaccgacctgcgtcacgcgcgcgttctggaaggacctgcaacgcgccaagcgactcactgacaaacggccccacttgtacctgggcctaccagtcatgcaacaggtcgagtccgcgtccaagaaatgtccgcatcctcctcctccgttccccttctggtatatataacgacgagcaagagccttgagccatcaaacaaaaaaatctcaaattctcaaagtcgtcgatccagcggtagcagcgcacataccgatcgatctaggagagggagagaaccaaccaatttcatcgccgatcaaacaaggaaaaaagatcccggcc

SEQ ID NO: 3218 - DNA, 55 bp, Zea mays
ggtgtttgttctgctggttttttgtttgtttgtttgtcttgctctcatcacaagt

SEQ ID NO: 3219 - DNA, 289 bp, Zea mays
tgttcgcttagcttgttggttgcctgccctccctctttgtccaagtcaaaccaaaccaaaccagatccagatcagatcccgtagtctcctcctcctcctcctcgtatggcaattttcagactggtcgattctaactaagccaggctctaaatcgggggggatatctcatgctcatgctgtggtgcaggccaaggggaaattctcctcctcctcctccccagctgcggcagctaccacgcgtggaaccaccaccaccagcagcagaggtagaggtagagggaatgccgac

SEQ ID NO: 3220 - DNA, 1125 bp, Zea mays
gttggcaattggctagttgtttgtcgttgagtaacatatgttaccatggagtttaatcatagggtgtttggttcctagtgactaatttttagtccctccactttattacactttattttctaaattaccaaatacggaaactaaaatggagttttggttttctgtattcggtatcttagagactaaaatagaatagaatagagggactaaaaattagtccctagaaaccaaacaccctatgattaaactcatggtaacatatgttactcaacgacaaacaactagccaattgccaacatagctaaccaaatatggttaagactatctctattccaaattagtatttgttttagctcttagtttttatgtctatattcaaatgaatgatgatgatgaacatagacacatatattgaattaattagaaggctaaaacaaattgtaatttggtacatagaaatcccgtttggcagagctccgttcctagatttcgcaaagtggatctgaagagctgtgcaaaacttaagttttctaagaatcaattatagagtgaattctgtgaagtgattcttcaaaatgaaccggaggccgtgagctaaaaaaagctacttcttattcattgccaccgtatagttagggttcacgtggagtttatcatatgttttttttttcaaaagtcactctgagccatagaatcacttctcttaggaaatcacttcaaacatagaattagaatcagtggagcaaactagagtgaaaactattagcacacggaaccaaactagggtaaaaaggaaatggatggagtagcggtgctttttgggtaacctttttggtggtatatgtagagtttagatattatttttccgtgtaaaaggaactacgtatctctatcagttatcacggctgctttcccgcattccgaggcctttaaatcgtcaggcacgcgacttgctcagcaccattccgattcggcgatttgattccctatccctgcgctgcccacctcccctttcccgcctggccctcccattcacttgcccccttttttccctctcccgacctcccaattcccgaaatcacccccgacactccccacccaagaacccctcgtccccacctcgcc

SEQ ID NO: 3221 - DNA, 534 bp, Zea mays
gagaatcaaaataggaagaaagtagagcctatactactattctatggataaagctgaaattgataragaaaacaccgtaaagatcaattagtgagcgactgggtcgatacaactaaaaaaaactgcttcattataccacgatatgggacaaaatttaggaatccacttatgtaataaaaccgatccactaaaggattaagcagcggtgcagtatcagatcccaaagatagtgaaccaggcaaccagactagctaaacaaaccgggccgtgtactcctccagtccagttcacacgcaacggagactaaactaaaccgctacagtataatatatataatttttagagaagattttagtaaagctccatatagtcatatagacacgcatagacacggtagcagtagcgggcgctcgaatctcaccggccccatctctaggctctagctccatcactcggagaagataagacccagagtgtcgcctggtccatctccaatccagcaaggcgggcagacgagccgagagtgagacaacc

SEQ ID NO: 3222 - DNA, 349 bp, Zea mays
ttattagatttttaattatgttgtcattcaatccacaaaagatcacctaagggccaaatgtaatttcaaggacgttttggctttttctagatggatttcttttgctatgtatctggatatattgtatatctaagtgcatgtgaaaagttacttacgtagataattcaaaatatcttataattaatttggaacgaaggatgtacatttttaaaaaaaaacacgttgccaattcaaatcacaaatgaaaaaaaagacaaaaactggatcgtttattatgacatactgatcgctccgattcttttcttttcttttctaatgggcgatcagctgatcactctcagcagagaaa

SEQ ID NO: 3223 - DNA, 1050 bp, Zea mays
cagtattttagctatattatttattggtatcagtttttaaagcttcttgttttgtctcatatccgattaaagtctacctttgcggtgacaaaacaacgaatgttataaggagagatcatgacaccacaatttttacaccgtctttactggaaaacaaactatacatgttggaatcaactacactagtatcaattaaaccaagggtaactaactatggtgcctgtgtgtgtaccatatatacgcgttgctccgaaatgcaatgacttctctacgtaatacgaagatatattttctttgaaaaaaaactaattatcgtataaacgaatatttcatgtgtcagcgggctataatgataggagtgcctggatttatttttctcgccataatatgtagtactcaccatcacaaagcacagatcttgagttaataaatctatggcattaaagctcatttattaagccttaaaaattctggtgaagtttagtttttttcttttcaataggacagcgtgggttcggatggcgcccgtggattaatcagtctggtccatgggttctagtacggctcctggaggcaacagttagtaaagagtcacgttttagttggactgcctccatcccaacctacccttcaggttcaggtccaaccaacgcacgctggatcaggtcaccccagctcaacaatgtcaatgtacagtcacctgcacacacatactactcccgccaagataaaataaaacgagggaaaggaagaaaaataaaaaggagaatgtcaccccgctctgggatgagaatgagatccaccacaccactcaactcaccaacccggtcgccaactaacccaccaacacccggcctcagtgcctcacctaagcccccgctgctattgctagtgctagtgctagtgctgctaccctatataaccgcctcgcccccgctccatttcccttcaagaagagctccaaagtccatccaccaccacagctgcctcccgagctcttcttctgccacaccgcatcagcatcatcacacacatcccctcccggcccaa

SEQ ID NO: 3224 - DNA, 1500 bp, Zea mays
tttagaaaaaagtttgttgcttttctgtgcagggtatctttggagtcgttcactggttcgttcgtgggcacctatgaaacgactagattcgtaggaggttgcggtgaagccatcgcgtcttttgttgctcgtggctatgaagtgtttttcttaggttcatgggtggtgatctagtctaagaattgatagtcactaaagtgtactcggccgattagtaatgttgggcggtgtgttccattggaaaacagaccgaaagatgtaactcaagctttgaagttaatatatcttccttttccaaaaaagtgtagataaaaaggatgatggggtgcaagcaacgcagcagccgctggagctcacataagagaacactgaagcgaactagccttcaccatctcaagatgatgcaactggtaacaatcaagccacaacaaatggcaccgttagcaataatcctcccttgatcccttgaagtttgtatggagtaagaaaaaaaattaggctctgttcggttgtttgggattggaggcccggattaattcctacccggattacttctctaatttatatatattttgataagctgtaatgaatcctgacttattccggtacaaccgaacgaacccttagagagagagtgctttgaagatctaggaccaggtgatctttatggctaacgatcatgatttcatgatcgatgaaattgtactatatgcctacactgagttagtatatgacatcgtgattaattatattcctatgtacgtgttgatagaacactgttttttattaaataaaacggatgatgtttgattttatctgagtcaactgttggctcgccattgaaatatgtgcattgatgcgtcggttacagtttttctataaaaaaatatttgttacaatcattattatttaatcaagcataatatactcgtatgattcttaagaaaaagtatgatagaaaatgtagtgctactcggtatgagtctagagaaaaaaatcctgacaaaatcgtttttagttcttgtgaataatcttggcaaagcgtttttttagttcgcgattggatctttcacatgatatcattcttcacgagttcgcgttcccttcattacttaggaataatattgtgtgtcttgggaaaaaaagatcgatttggattttgaaaactggatccaaacaggtccgaaatgactaggaagttgcgattctggaatttaaaattataatcagaaatgaagactagaaaaccaaaaaataaaatatgcccccatgcaggatcgaactacagaccttcagtttacaagactgacgctctaccactgagctataggggcaattgtgatttacgtctttgtgtaggatatatatgtatttttcagattttttactatagtgtacaacccaccgcccgcgtctctctcgttactcctccgtcctccctccgcgtttacacccgccgccactcctgccttggcgccgtagctagcaaaggcgatatcc

SEQ ID NO: 3225 - DNA, 1147 bp, Zea mays
tcgctaactcgcgcggcgagggttcgcttcgctttccttgttatgctgcggtttctgttgcctatcgcggggaagaggaaatactgaggcagggccacggcccgcgactccgtccggactccggagcctgaagacgagcatggcgcggctcggcgaaccggcccatatagaaacgatcctgtaatgggcccccttcggacccacagaggtgcttaattatggtcagtggaccagaagcgcctggaaccttgacagtcgactgcctctgtaaatccctcggtccaaaagacgaagaaaaaaaaggacggtatctgtttcgcttgcccgtaactttgactctttgaggaggccaaatctgaggtggcgatttctgtggtccagttattatattggaaggtgtatatgtggtgtggtgaggattgcttggcttgactagacacggaaggtccaccacgaatcagacagaacgatatttatttaccagcaataccaataggaaccacggacgtccacaacatgtgtgtgtggatcgcttcacttcgtacatttttaactgtgtaggggcatccaaatccaacggtgatcaggacgctccactccaatcaggcaattaccggcccgggtagccaagtcaaggaagcaaatcagcatgcaggtcttccgctactccagtccgagcaacgacacgggttttgctccccctcgcagaaaaggaggagggcagcagacgacgaggaccgtagctcggacggattacccatatagtacctctgatgcagctctgctctcctatataatgatctgatctgcttgtgtatgtgcaagtcctcctggatcacactccaccacgattgccaagtgtcaaatcagcaggcgtgggcgtacgatctggacacggcagcaggagcctttgggccgtcgttacacgcacctatccatctcatctccgcggcacacggcacgacacgatcgtggttggtgttggttacacgcgcctatatcgccggttcggccgcacgtccgcctcctcctctcctcccctcttctcactcagctcaccagtgctcgctcacctttcccctccctttcctttcctttgctttcctatccttgtgccctcgaactcgaatcggaaacccagccagcc

SEQ ID NO: 3226 - DNA, 675 bp, Zea mays
aaaaaacccattccctcgaatcccttccctgcttctgctcgcctgaaaaaagctctcgttttgcaggcccgtgcccgccattacgcgcccccgattcaatgccgtcttgagctcgtctcgtcgcacataacagtatcacgtcctccccgccccgctgcttgctccctctcgtgctcctcccacgcacggcacgcagcacgctctcatcctcctcctcacgcctcccgccccaccctcacaggccggaaagctccaaccgagaggcctctgtttgtatgtaggacacccagagcgcgtcaagaaaatatacgagagggaaggttgggagcagttcccctgtgtcccgtcccctcatgtgcctatacctgcctgccgattctatcttggccgaccactcccttgtcgtcccaattcaattctgattgccggcgcgcgagtggtgtggtgtgtcgtcttcgtgcgcgtgggaatgcaggttttggaggcaccagcccactaatcgcgacgctccacgggacttgcagctcgaggtaccctcacttcgcttcgctgcagtggtctcagtctcagtttctgttttgtttattatttaattacccttctcctgcatccgacgcgacttcagtttctttcgaagaggagcgtgaaactgacgggagctgggcgtgggcgaga

SEQ ID NO: 3227 - DNA, 1091 bp, Zea mays
tcgttctaaaaaaactaggtgagaatgttcaaaatccattttctaaaaaaccagtttcttattttttttagatacacatgactaacctactttctttatttaaaaaaatagtggcaatagacgtaaattccacgaaatcaacaaagccatgatgtaattaaacagacaaaaactggttttagctagggaagaccagcttcttgatttttaagaaactgggaatccaatttttataaactaaagcataaactggtatatttgtaatcgtctcggttttcgtaaaccaatttcttaaatgccggttgcttccaaaaggccctcggtggcttttataatcgtagatgtggatactatagttaatgatgattagagtatatcaattcgatatgcatatatttatgtctttttcttaaagaaaattaagattattacttttctagtgcgttttatgagttaacatagagtgatagtgattaaaaggcacgctaatattttcaaacgagtcgtcataaaacactaatcaatcatgcatggacaaactatctactagtatgttgctacgtgaaatgaagcttgagtgccgtcatcgtaggagtgcagtcacgaactgtactgtacatgacatggggtggtgaaaaatcgtgactgcaactgcacatcattaagtacgtcataaattaagctccggctaaggactggagttacaatcactgaggtgacaggcagacaggcagtagtctttgatcgaggccgtggaccctcgtccgttacagccgtcctttcaatctcaccccacgcccaaccaccgttgattggccgccgtcgcacccgttgccgcggcgcgctcagagctcctccacccggtccatccgtcgcgcgccaggagcccagaaggccaggggttcaccgtgctgtacctgtacccctatataatccctcgcatgcaacgcgcctcggcttagccagctcgaccgacgagacgacaacgccgccgtgccgcgcgcacgcccgacgccgacgacacgccctccgctcggccccggtgaggcagcgaacgcccgccacacgtacagataccgtgcgcgcccggc

SEQ ID NO: 3228 - DNA, 152 bp, Zea mays
ccatcctcctcgcggctcgcgccccgaaaaatggcgccaacccctccccagtctcccgcgcggcgctgccccagctatttccccctcccctgaattgaccccagccgcgcctcccaaaccctaacctaacccccgccccctgggccccggcc

SEQ ID NO: 3229 - DNA, 1122 bp, Zea mays
tgcaggtcaaggtgctatacgccgctcacgggagtggcccgcaggctggtggtctcgtcgtcgtacccgtcgtcgcatgcagcatggagtctcagaaagcgccaccacccatcgtgggtgatcagtgagtgaggtggtgagatcgaaagctgatcgatcgattgattccgatcgatctcgcgtccatgtcccgccgacgcgcgcggccccgcccttcgcaggctcctcagctcgcaccagctagctagccgccggcgagtcccttggttcatctcgggggtcggtgtggtcactcatttccaaaagctcgctcgctcgctcgctcttcctctcctcatcacgagtcttttgaaaactatactactacttgcatggatcggcgcgtactgtgcatcaggatcatgctcgcgtagacgccttggcccattccatggccgtatgtccctaccctctcgtacgtacgtcccatgtgcattacctccctccccccaacttggttctgccgggggcaccacgtactccgactgtgcaactttgagatcgcactctgttgatctgtttcggcggtcaggcatgctggtcttcttggatccaaaaatgcgggggtctagacggttactacttctgttgtttccaaactggtcgtcctcctcttcgttctcacacccctttctcgtttgcgtctttttgggctgacgctgtcccttttcgaacctcgagtcccccaaacaaatctctctccgtctctcgctcttcacgctactcccaaactctagtaatataatatttttgatgatgccatccgtttccgtttttttaattttattaatggcgaggagagagagaccacagatcacagagagctccatgcttcgctttgtccgctaatgctaatggggatggccgctcaccttgccgccgtggtgtggcgtcgtctcggtctcggtcccctactcctttttatttccagcccgcggcctctcgcacgcttctccagttctcctcccgttttccctctcttattcaaaagaaaccccaccacctctaaccgtaaaccgctgtgtatcccgtcccgtcccgtctctcgctcggccagcaggccaccaactgccaggtccggcg

SEQ ID NO: 3230 - DNA, 471 bp, Zea mays
accatcctaaggtgtttaattccacccaactaaaatttagtatctctcatgtttttatttaaataataattacgtgtattaaatataatctaattataaaactaattacatatatgaagacgtcaagacaagatgattttattaaatctaactaagattatatttaatatttgtaattattaattataattaatagttatatatttgatgtgacagtaaccaaacacccctacgataatcattgaggttgtatcggattagcaaattaggctacgatatagtctggttctagagtcataatcaaagtatttatagaacaggtttcataatggcagcacaagaaagattatttttaaaaagaattgaaaataattaaaaaaacagagctcagagtctgcttatccccttcgccgcgacgctccctatccatagcgcccgctcgcccatcagcccacgcggccacgccgaagt

SEQ ID NO: 3231 - DNA, 1015 bp, Zea mays
tccgtcttcattttccgttttaccccaaaatacacccccacacacaccaaagtaaatatggattttccacctctcgtttttactgattgggatatatgggtcaaatggaagcaaatggaagcagtcaatcaatataaaatatggtgcggtctatagatgtacagaaagtccgaagcacgttttttggcccggtataagcccggtccggcccacttttatacaggcctgggctggcccggcacgaataaacgggccaggtccggacaggaaactaagtccggcgggctcgccggcacggcccgtttacttttaagctcgtcaatcccttttttgcactaaaccgtgcttactggcgcacttagcccgtttttcaggctacgtttttctgtgcttatcagaccgagctcgcgggtttagatagtccggcctggttttctaaccgtgtctggtgaaccgggtctaaaatgggctaggcttcactggacccgggcctggccgggcggcccgtttgaccatctccagtgctgtctgtaggcgcttcatcgatcgaaaatatcctccggttttaatgactgcataattccttgtctctagctcgacgatgcttacatcagaatggaggtggagtggccggggacggggagtgccagccaaggcgaggcccgtgctagctgccatgacatgagcgcacacagcacaattgtcttgcctgaaacgatacggggagtggttcggagcagttgggtgtgctggtgtgtgttggaacggttgtccctccggcctgggggggtcctcttgcttgctgctatatgatccccacgcctcccgcgccactctaaccaccgcatccactctcgtcccgtcccgtatctacctacctgctctctcgtcttctgctcacacgctgacgcgcacgctccgagtccgagctaagctagctagctagctacttccggcgcggcacagccacagctgtttaggtagtagctagacgtacgtacgtacgcacaccacg

SEQ ID NO: 3232 - DNA, 422 bp, Zea mays
tcggtaccctgtctcacagttgcaacaattattatttggtcgtctgcgaagagaggcatgttagttataacatttatcaggagctgtcagtccatctatagctatgtggttactccatgcatgctacgtactgggtggatgacaaagggctggctgctagcggcggtagacggcctgtggaatgtgaatcacctccggccggccgggtgacagccacgccacgcctaccgcagccagcggccaaattttcaccgcctggaccacgaacctacgtgcgcacgtacgatggaaatgaacgagagccatgtgatgtgatcctcctcttcttcaaatacccaccacacgcacggcacactataggtagctcactgtactgtaccctagctagctagtcgcttccagtccagagcgtcccgagacca

SEQ ID NO: 3233 - DNA, 709 bp, Zea mays
tactctaagactactcttagggacatatatactctaaaatattctcatccacgtatttagagaactagagaagattctctcctctgtacgcttcaacggtatctctaagagcatcaccaacaatgcctcaaattgtaatatggggctctatacaggaaaaactacttccacagtgccctatttcataaaattttgtcaaaaaactatatgacaccctctcaagtgactcaaatatactacaccgtagtggactgccctataatctagatttgaggctttattgttggagcgggatgttttgttggtgccctaaattttataaaatatatttattttcaaattatagggcatttttataggtcacttgttgaagatgctctaatgcatcctctaaatatagagaatgtttttctatcctctccttgtatagtctcctttccatcccctatttattttcatacatctgagggtatacaaatatctagagtaaaatatattttaaatttatatatttaaggtatagagaacgagatatatatagaagacactttttggagaataatgagataacagagaataatgagatactctaaccgctcggtctccgctttcctcgcttcctttggaggatacggttggacttcggaaaatactctaaccgctccggctccgatttcctcgcgtccaaggaagctgcagcgagccagcc

SEQ ID NO: 3234 - DNA, 618 bp, Zea mays
gtactagtactgccgcggtaccacgtgtctccttgtctacttgttgttccagtaagggcatgtacaacccagatactgctgcacggtactccaagtacaagatacaactaaaacacaacataatacagtggtcatgtctaaaacatgtgtcttacgatattcattgtaccaatcagagtattcaataaattaaagtgaccaatcagctagtctcctgtctcgaacatagagctaagacactgtgtcttcgtcaagatacgtgtcttgagtttttttacattcacccccctagacacactctaagacacaacttaagatacccattgtacatgccctaatgcaactaacaaataacgcgaggaaagttttgctgtgacgacagcgccttttgtttatttctgagccaaccaaagagagagagagagagagagctgagcacggggccttcgatccgtttgccttataaaaagtcctaccaactgcgcgtcctgttgagaccgcagagcgctcgccgaagcccctcatgtcctgtagctagctgatctccctccgaaactctctgctcgcccgcggcctgctggaagcttggcgcggtcccggcggcggcattctccggca

SEQ ID NO: 3235 - DNA, 1398 bp, Zea mays
ctgcagcggcttcacaaacggagctcgctgctacgggctccagaatccagatgggccagtacaagaatgcgtgtgggctcagctcctaacctatattcgtccttgatcggccggacaagtacagcccaacggtccaacatacttggggtccaaggccatcagcggtccagagagcagaactggtgaccggcatgtgcgagtatagatgtacatttgtgctgtgcctaataggctggcccaaagcacacgatttttggcatggcctagatctggcacggcccaacctaattgtaggtctgggccggcatgacccaatatgtgggccgtgcttgggcctcaagtcaagcccatgggctggcctggcacggcccgtttaactaaggcacatcgaggcccactaaatataaactcggtatttgactaaggttcgtcaaagttcacatgactagcacaacttagagaatctagagcttcaataggccttcgagaaccaatacctagatggggatagtgaatagtgatgatgattattgtatatgaattttgtatgactgtatagtactcaattaaacactgaacagagaactgaatattatttctgagctagttgtaatattttttctttatgaccaaaggtttttaatgtacatccacaaaacatcttagttttattttggtcatatatatattctatactttttgtttatctattgctgttctatgtatatgggccggtctggcacattaaggcattttgggctatttgggccggcctggcacacataactaattgtgggccgtgccgtgggccgatgactgggcacacgtgctggcacggcacgacccataattagatatgtgcttttgtgcgccgtgcctttgtgggccgtgcttttgtgggcctgtgccgtgccgggccaggccggcccacatgtacaggtatacttcagggcgacccccggtgtcgttgcaaaatcaaacaagggatacaatatcacatgtgcaacgtacggtagtgatatagaatagcacgatgacaaggagcctccggcgagcgaggatgccatgcctagcgacacttcctggccctccgccccccgtacgtagcgacacctttctgtttctgccccgcgccgaggttgcctttcttgtcgtgtgccggacgaggagggctaccaagagtccgttcccagacggccagacccagcacgtacgacttccaactaccagccacgtcgtcagactcagctgtttgcttcagcaatcagtcgtcgtcagccacggacacacgacacgagcagaggaagctgaactcttgcttgttcctgcagtcgtctgcagccgctgccgacgagcggcgcgcccgcccgctacgtgacatcgggtcccgtcggggcc

SEQ ID NO: 3236 - DNA, 1307 bp, Zea mays
ggcttagctggtatgctctcttccttcccctcttctctcattctatgccagggcatgtcgaaatcaaagtaattgagcatatctgtctcattctttatgccatggcatgttgaatcaaagtaattgaacatatctgcctcatgacttaatttattatttcccatactacttcttgctgggagtccagggttaggctagaagtcgatcctgtctgtatatgctgacgatgacattatacaaccttacatttattatctgaaagaggagttcactacgagggaattgtttctaaaacgattctgtttgactcggttatgatcttgatttccttgtgcagaaattacaacaagaactgcagagaaatccagaatcgcttccttttgatgagatttgtattttggatcccatgagctagctactagctgcatctcttttcacttattgtttccgatggtcaatggagtttatgttacacttacacatatttattttaatggcagatactctactgtaacattggaaatccccattccattggccaacagccagttacctatttcagaactagatcattggataactgcattttgttcatgctttaaactgctttaaactgaaatacgttacagctagaactagatcagctgtacatgcttctgttgttcatgcttctgcattgaactacattttgttgaacgtggactgcattttgcaaaaaacatgaactttactatactagagtgaagcgaacatggactacattttgcaaaaaaaatatggacttcactgtactagtgtctaagcgaacatggactgcattttttaaaaaaaacatggacttcactatactagtgtggaagcgaacaattcacagctaatacatttgtatccatgtggtataagcgaatagtgaaaaataagccacgtattaaatcccagccgtaacgaaaacacacatggtttatgtgacatgacatggattcactcaatcccgctgtgtattagatcctaatgtgtattaaatactagcaagccgaacaaggtcttagtagtgttggttcccttgtgcgtttaatttttttttttttgatgtgattagtccttggtgagctggtccggatggaccttttggtaagtgagggaccatgcatcccatcacaatgggttatgatgattagcctttagatgtgtgtatatatatgaggggtgagaggggggaggggcctggggagcaacacaagcactccacactgctgtgcagaacgagagcgtaaccatcagtactcaatagttagagcgaccaatag

SEQ ID NO: 3237 - DNA, 847 bp, Zea mays
taagttaagttcattaattaattatagttaaaaataaatagaaatagagctcattctaatccgtttcaatcctcaagggcctatttgaaagcacccaatttttaagaatatggttataaaatatgaggtgattctaaacatgtcagtttatgttctaatttatagaaattggattcacggtttttaaaaaccaagaatctagcctccactaactaaaaccagtttatgaaacctgaaatgtttccaaatactatttgctaattttttttataaaacagttgctagaaaccggagatataaactagattaaaaactatgttgcaaccaaacatggtctaaattttatagccatcaccatccttatttacagtaggaatataaaatttgaatttttgtgtgcgcagcagcagctacagatagataccatgaccagtgtcctgtccagctatcagttgcaatcccgttggcgacgggagcggacaccggaacggaacggaacggaactcgtggttggacgacctatcagcagcggccacgccagcgcgtatgattggcggaccggacgccaataataccctcgcctcgaggcctcgactcgacgcatcgccggtcgccgctgctcgctcgcgttcgcggcgccctcgcctccctgtcactccctcgtcccccgccccatccacgccgcgtcgccctccgcctccaaataaagtaaatgcgggtgacaggacgccaccaccaaatccacctgcgcccttaacccatcgccgccccgctcgatcccctccgccttcttcgccgccggcccccggactgcgaagctcccaggagcctagaaggacccggcgcc

SEQ ID NO: 3238 - DNA, 661 bp, Zea mays
acgcgcgctctgttggttactagttacgactgccatccatcagtcggctgtccagaccggccggcgtaaagactaggacatgcattacgtactctcttcgttttggcatccgattcgatgatgatctgtcgacctttccgatgccagatgattgtccatgcagacagtacgtagttgtgtttacattttgtccattgtaccttaatgattttgtaaagtggattctgatgatggtttattgtgttcgttctgcctttggcttcgacgttgctcagtgtgcctgtgaggaagctgttgcaacttacaatcttcttcttttccttgtttgtctcacacctgcggtgaattgacacctatttttggcaagcagctcgatttagcattttctggccgattagcacattgacatgtgggcccttctcctaacaaatgagcaccagaaggggaaccccctagctcccctccgaaacgaagcaaactcacgagctcccgccaaattaatctcctccatccataaatacgaatttcgacgcagaagacgacggagcgtcgatccatctcgatcgatcgagttgttcgtccgtcgcatgcaacttgcagcaggcgccttcttcttcggcgcgacgaactagctagctaggaccccatccggcggtgcacc

SEQ ID NO: 3239 - DNA, 702 bp, Zea mays
aaaacgggcagctgccagattcgcctatgtacttagatgttgtggggggtgagaaagcagagcctgtacagcttattcacccattttgttgccattacactagtagtgacttgtactatgacaacagtagacattgttgtacagccttaccagtcagcagcgggtctttctcattttatttattagttattaatcctgtgggtaatcatgtcgataaggcgccgccctgtatgcagggacagttgttgatttgtttgatccaatccaatcatccagcgttttgcttgctcatcattcacaggtaatctttcgacgtatttccttaaataatactttccgtggccttaccttttcacccaaaggctggtgcacatgaaggattcacaagctgcagatttgttgggattaatcctgtggcgtaagaggaaccggcaattccttagtgcccatttcaagagcatctacctttacagccagcatttctcatctcactcagcagcccacatattccgttggagcttgcgcctcaagtttggcacatttctttgccgcgctgggcctccaggtccagggcccaggctctctatattacgtaaacaaacccagagttccgcgggaatctcacctgtgaaagcgagcacacgcaacgcagctacgcaagcaagcctgttctctgtcgattgaggccgctacacggcggca

SEQ ID NO: 3240 - DNA, 1194 bp, Zea mays
tgggaggggacgacaccgtccgtattcctcctacactcacctatgctacaacctacgtcgtagcctttacccacactccaacaagactagatagaagacaagactggacagagaagatctcaatccaccagccctgtttttactccacgatttctttgttttcctaggcccacttgtcaggacttaggctccatgtaagctcctcttttgggctataaaagggagggcacactcggtagagagaagaccgacttgaagcggcttaggccgggacgattcatggggcattcacgaaaagactcccacagacgtaagctttctcaagctatgagtggtatggtattatgctctggcaatccaaaccactctaaatttttgtgtgttcttgtgttcatccttctttataggctaacctcatgccccttctcatcttaggattagagcatgtgctatccgccaccccgtctggagtctacgtctccgataatattgttcacaagtcttgcatcacaacacacaacttagttttacacttaaaaggttcaagtagtcaaggtaaataggtaaagtagatggaagttatcaagacacagatctagtcgtagcttcaccttcagattcaggttcagatccaactctaggttcaacattaaggtacatgttcttaagtatatcttcaagccctcttgtctccctatccacaaggtgttgtgaatgagcatcggtgttgtgaatgagcatcgacaagctttcgatccttgatggaatataagatctccaattctccatcatatcaggtgtaaggatgtctccattattcgatcaccttggcaaaagctaaatatagattctgatgatattatgttgatgccaccaactaaaaatgttgaaattttcatagatgaaatgcaatcatagggcgatgaaatgcaaagtgccaccaaccgtaatgcgggacccgtgagatcgcgggacccacactcagcctcagcgaacccctctgcgttccgccgcagcttccgaagacatcgatgtcctagcaagttggaaacccccctccctcccctcatattcgcctccgcctccctctccctccgtccctcgtcaaatccacgcgaccgcgagagctctcagaaggccctagcacgcaaaaaccccacgagagagacgaatcttccgaatctctcggtggcg

SEQ ID NO: 3241 - DNA, 266 bp, Zea mays
caaccaaagggtgcatccccaagggatgtgtcctttagggagaaacagtcgcgccctttggagtggattgatcacaaaatattgtaacaccctcctcctccctccgcgcgagtccacgtctcgtctcctcctcgccccactcgccaaccacgccggccgcaccgaatccgctgctcgaatactagactagtccgaagagccaaatggtggtcgcgtgaggggcgggcggcaggagatcggcccgcccggggaggggggagactacg

SEQ ID NO: 3242 - DNA, 855 bp, Zea mays
ggttagttttaaaggatgatgtaggatgaccgtcgaaattgttgctttaatatagtagaaatattctatactaaacataaatagaaagtatagcaacatacgagcactttacttgtctataaaaattataactttagaaccatcacagtgtgttaaatatttgctaatgtaggagcatctccaaaagcctctctatattcttcctaatctatataaatagattttttttataaaaaatatcctctaacaacttatctaaatatagctattttctattttgggttagctagctaaatacagagtgcaaataagatatagaaagactgttgcagactaagaaaaaatatagaaagttattttgatataaatggttctttaaataataatttagagagtggaatttagaaaaacttttggagtgctctaaaagtcaactattctagagtttgtagggacactttagagttggatttgaaaggtcagatttgatgagatggaaggtcgctccggccccggccccggccccacccccagttaggtaataaaagccgtgcccaggcaaaaaaaaaaaaaaatatcgggaaaaagctacagaacggacggaaaattgacgacctctcccgttccggcggccgaccgtgcacgatcgtctgcctgccctgctcacccacttgccgtcgcaccggctccgttccttctgccccactaccgccatcccaaccggcaagcgcgccaccgccttctccaccctcgcccaccttgctgccgcagtcgcccataccgctaccgcgcccacgcccgcctcgagggcccgacgccagaggggctgccctcgatctgaccccacggggtagg

SEQ ID NO: 3243 - DNA, 1500 bp, Zea mays
tacgttaggattacaaatttagtgtgtgtttgatttgacttttgtctcctaaaagtcaaaaaccaaaccaaagaaatggatttaggaatcagcttttttataaagacgattttttcgcagtgcaaaaaaataaagcacatctaaacttgtttttccttgcttttggatagaactgtaaaatatatatggaataacttttagcgtgttttagtggtttctatcaattggtttttagtttttaacagctcacaactcacaatagtttttttttcagttgacagctcacaacagttttttcacaggcacggtccaaccaaacagataattgcaatgttaaagtgagaccttgtaaacacaaataattgcttaaagcatctctagcgggccctcaaacaaagctctacaccaaaaattaaggagtttggatcccgtgctgatgtaagaccaagctcattacacacctcactgttatagggtccattagacactgttgcacgatactccaaatataagacacaactaaaacacaacataatacagtggtcgtgtctaaaacatgtgtcttacgatattcattgtaccaatcagaacattcaataaattaaagtgaccaatcagctagtctctatgagggtgaatgtaaaaaaactcaaaacacgtatcttgacgaagacacagtgtcttagctctatgttcgagacagaagactagctgattggtcattttaatttattgaatgctctgattggtacaatgaatatcgtaagacacatgttttagatatgaccactgtattatgttgtgttttagttgtatcttgtacttggagtaccgtgcagcagtatctgggttgtacatgcccttatgtaggggaagggagtagaaatacgatcaatgcgaacgcacgttgatgacggtgaaaacggtagaaaccggtggaagtagagattacagcaaacatggagggacggctttcgtccacccaccggtccttggcgcgcgcgcggcgagcctacgatccaaaagccgcgaccgcttggtgttttggctgacgcttgggaacctgccgcagctgcatttcttgctttgggagccatgtacggcgaactcatacttttgacgtcggttctttttcgaaaaaacttttgacggtcagttttccccactcccgctatatttaaaaccccccaccactcccccaatatttatgacttgacaacaattcccacatcgattcattgtcacttgccagaagtcgggcggccatcgatcccactcccaccgcttacagccggcccagtcctcgtcggcgccggacggggcgaaggtaacccccaagcttccagattctctgtcaacttcagttatgcgtttttcttttaagatgaacctgaaacattttagctttagatcaccggagtcatttttttttttcattaggcgattggagttaaaacaggccgagtgggagaatttcctggatcttatctgttctccatc

SEQ ID NO: 3244 - DNA, 1148 bp, Zea mays
atagaggggcaatgtgtagaagaaattaggaggtgtgggtgtcacaacgagaagctaccagtgcatctaacctcatagttgtggagcagactggcaatcaacatcgatattgcaagaataaaaaacttctgcccaacacatgctcgacttccagaaccaaatggaagaaatgattcggccttggtacactcactgaaaatatttatcgtagttgatcctttaggtgctcctaatatttctgcggtacagaaacaaagcaatagattaatcaccaagaatcttgcaaaaaggcaagagaatggtaaaggcctaacaattgtgtgactaatccaacaataatgaaaacatggaagatagacagtcttcaaaatggtgttacaaatggcatgctgcttatatggtgtcaaggctctgtcattttattggaagcatcagggtaaacaattttaacagtcacaaataaatatgatgctatttagttcacataattatatcgtgatggttaatagataatgttaaatcatgtttaacgaggacctattcaaacttattagcgttgtcaatcaagtgtgaatcattactgttgtcatttacattacacttcttgaactaaacagctccatatatttcatggatcgatcaacaaccatacaaaaagaataggtcagactacgtactgtcatgcaaagtggcttttaagttcacccatgcatccatagaaaacattttaagtttgtgcgaccatttcggtagcgatagaactctattctctattcagagaagagtagtaggtgcaaaacagaagatcatggttctggctagctagcatctattgaacgatggaccgcttgttggacacggcgtatgcagtttttttttgaatcacacggcgtatgcagttagttgcagccttgcaggtccataccgggttcatatgcgtgcgcagcattgcttcctctgtataaaaagctaggcgcatggtcttcgccccaggagcaacagggagtttgcctcacctccattccaagcacatattcccggcccggcagctcaccaactaccttgcacttcaattcatcttatcgcggcacgcacagatatatatagattagtacctagctagatgctcatttagctgcagaggcgcc

SEQ ID NO: 3245 - DNA, 1500 bp, Zea mays
tatttaaacaaaagaaattgcatgcaaggttcttctttaaatactactccctctatccaaaaatataattcaagaatctcggtgatacttatctactactacgtattgtgcaagggtagcaggtgggcttggggagagatgtagtaaatatttttactgtaacagatattgatataaacacatatatggtgtagtggtagctacgagcacatttacttgaggggtcgcaggtttgaatctcattggggccacatttgtgttttttatttaattttaactatgtgtggatgtacgtgggaatgagaatgggctttgcggggagggggaatgagaaagacagtgcggggaggcgggaatgagaatggcagaacatggaatagcaacctaccccttagagcatctccaacaaacgacataaaagctccccaaaaccttgtttataggcgaaatctggattttattaatccaacagaaccccattcgtcacccgcatttattggcgtccctgaaacgagaccaggtgtccctcagatttgcgggagtagatttctccccgcatccgagtcctgctgtaaacgaaagacatgcaatccaaaaaaaatgctagcgacatgcattaaatgggccagcgatttagacaaaatgggcctaggatttttaaaagctagcccagttttgttttcagtttttattttgagggaactgctggagtaacaccttgtttcacccctacaaaattttctgtatgtcccctataatcagtttttggggaaaaaatttacattaccttttggagttgctctaaccgccttaataagtagtaaagataatgtttttttgttttttagaaattttaaactaggtggttaacctttaattagactagaacgagagcgcctatcgggcgtcgaactgttcacgcacacataggggaataaattaaatcatgtgttatagtatgtgtggtagcaaacttagacaaagaaagtcatcacgatcgtagaccaataggctatagcacataaaaaagatatatccaaatcatgtgttatactcatctagaccagagtacactaataaatcttgtttctagagcgtgactatagtctatagtcatataactttctttttagtactacaccatataaccaaaactatggactgagagctttaattctaacttggaattcggtaatttagctgattcccgacctatactaaaaatgatttgtgtagcgcttgacggttttctcgatcttttcatacctcgcatttagtcacgccggccccacaaggagcccacgacaagcacaagccgtgctccccattcttctgcccccactggtactataatatagcacgcgcaggccgggcgagtttcccacgcaaactagctagctagctactcctactcgtactagctagcagagagggagacgacggcggcggttagatcccattcccccacggcacggcgagaggtacgaggaggaggtacag

SEQ ID NO: 3246 - DNA, 435 bp, Zea mays
ctttcttcccatttgttcttgtgatcaacattcattcacttgtaatcaaagcaagagacaccaattgtgtggtggtccttgcggggactttgtgtcccaagtgattgagaagaagaaagctcactcgatcggtggatcgtttgagagagggtaaagggttgaaagagacccggcctttgtggcctcctcaacggggagtaggtttgcaagaaccgaacctcggtaaaacaaatcattgtgtctcacttgttcattcgcttgcgatttgtcttgcgccctctctcgcggactcattattgtttctaacgctaacccggcttgtagttgtgattatatttgtaaatttcagtttcgccctatttcaccccccctcttaggcgactatcaattggtatcagagcccggtgcttcattagagcctaatcgctcgaagtg

SEQ ID NO: 3247 - DNA, 135 bp, Zea mays
ggccttatcctccgttctattctataagagaggttctgataaactctcccccacctgttctccaccagccccggaggtcgacacgtgcgccacaccatagggcagggcccagggagcccggcgacctccatctcc

SEQ ID NO: 3248 - DNA, 543 bp, Zea mays
cctgcagtcaattccaggtgaacccactctttggacaaaatagataagtagatttggatatagtgatatggtcatgcttggtgtagaattcctgtcagagggggactggagaagaggtttgatgcctgattcaactttgggtacgagaaacaaagttgatgtggatgtgttttttattcaatggccccctcaagtaccaattattagggactactctcgatgatttgatgatgatgcgatctgcataccttgttcctccttatttttactttgtttgcataatgtctttcatgatgatttggtgaaccatgccttttggatcgaccagtttttgggtgtccagtggcatttgctttgaaccactacttgattgccagcaaacattttttgatttgcatttacgcttcttgtgtagtttcccagtaaacttcagttagctgcatgtattggaagccatgagaagtcctcagatttttttcctttgcttcattgcaacctgttcactgacaatgttcttttttctgtagctgcacgggtatagga

SEQ ID NO: 3249 - DNA, 79 bp, Zea mays
aagcaaagcagcaaaatttcatgaaaccggtgaatcgagtgcgcatacgctcctagattgaactactgcaccagcactg

SEQ ID NO: 3250 - DNA, 1250 bp, Zea mays
ccttttaaccaaacggggtctaaagtgggcatcagatagcacttgagctgaaggagattgctccactggcagctcgcatcatcttccttttggaggatgcagactagagctacagatatggtcaagagaaatttacgacgtgtttggtttgctctttagtttgtagaatgatgttttattcctcgtagactaataattagtaataattcttttttgagaatgccaccacgtagaaccagagcactgctttagagcagcgtcccatgggaccatctacaaatgcagctcgatggagtagtgttcgatccatcggaccatctacaagtccagctcgctctactgttgtaatagtgagagtgttgacattcagcttcgtagctttggcaaattaggccgagggtctgaagcggcggcccaaccggtcatctgggctgcagcctatggtacccagcatagtcctgagcattctccttgagggccttttggcaacaatattgtaattttataactgtcataacaataattaatcttttctaacaacatattaatatataattattgtatactaaatgattttaattttgggtgcgtggtcgatatggaaacataggaataggtgtgtgtttgatggttgtagcccaagtgttgagatcaccctctcgacagcaagggaggagatgatgtgctggcatttgctggcgctaaagctctcttttttcttatctagaggagttgtcttaggagtggtgtgaaagtctgtatacggtggtgtgtgtcggttaagtgtgttgctcgtgttttggagtttcacctcattttcttcttaataataaaaacaggcagatctactgcgtattaaaaaataattttaatttatttgaaagtggaatatatataaaattataatacgaaacaaacggagccgtattatataatgtgctgtttgcacggtacccaagaaaatgcagcacctacctgatgctgggattttatttcacagcgcacataatccgatgctaaaaatgatctatatttggatgcataacgtattttcaaaatctgatactcattatctgccatgaactaaacaaggcaaacaaaataactcatacaggcaaccagcacctaaatgccgtgccgcgtcctacccgggccgctgcctccaccaaaaagcgtaaccgcacaaattccaccgatccccctcgccccggtcaaatcctctagcctccctgtgcccggcggcgagcccc

SEQ ID NO: 3251 - DNA, 307 bp, Zea mays
tccacgtttagcgaacgggcatgtggcaaaaaacttcagaaacgtttcctttaaatccagggtggaccccacaaacaaccgcccgatctttataaaaagcctgccccctcccagctctcctgtgcgttgtccgttgtatccccaccaaacccaaaccgaaccgttctttgcactttcgcattcgcagatcgaaccctcttcgaccaaatatttgacacaagttacctttgcctgtattgctttcttgcgcgtagccccctgaagctatctccgacgcgcgcccgtgtccttcgccggagcttgccat

SEQ ID NO: 3252 - DNA, 1200 bp, Zea mays
ttgcatgcctgcagcagcttgtatgtaggcctactacagtttggtttacagcttgtgtcttgtgctaggtgcatgtgcgttgctagttactaaaggtgtgttggtcgtgcgcgctggctcgtggttgcgtctcgtgtggcaacatcggtgtgcagtgcgatgcacaatgcacactaggccctacggagcaacgctaatatggttgtagtgttgaagcatagatatggtccgatgcggatacgtgcaccgccacattggtgttgacgtgaatatatgatggtgacatactggcatggatgaaggccagacacagatgctgaatgtcacggtcaagaaggttgtagcctattttaattaagttttatgagctatatttataatataatatgcacaacataatctacagcccccttctgtacgcctctccatgcatactaggacgacgatcgattggtggcgtgtggaagcgagctggagagatctcccgaaaactttgacttttaattaacgagctgtagagagagagaggagagcacacaaaacattgacttttaggtactactcctatgtttcttttatttgaacacggatgtgaggacttctagcgcttctaggcaggcacccgccatttcccgacggttgactttttggtccaaattaaagctgactttcaaagtctcgttgtactaccagctaccaaacctggaggaagggaagggaggcccttgaagaaagcgctgcatcgttattatttccaaagtggagctactgatggactttgtttatagaaaaagtgccatacgttattcggtgacaaataatggattttgtttatagaaaagtgtgcctttgcaagattactcagatatactccaagccaaaaaaaaaagaaggcgaggttgatatctgagtcagaacctcgaataaaagagccatcagccatgggagggagaaggaaggcattgactttgtacaggcccagcgccagcgggcgggcagctcgtcgtctagtatttggtcctctccgctgggtcctcccccatttccacctataaaaccccaccccaccaccgttacaatcccacacagcccaatactactagccacaagacagcagcagcagcagcagcgcgcggacccgacctgacctgactgacctcctcccacgcccggacggcggaaggccgcagcagccaagcc

SEQ ID NO: 3253 - DNA, 1064 bp, Zea mays
gatccatttccatgtctaatgatttcttagacttggttgatattcaaatttagcatcctagtggtgtttgggaaacaactctatggatttagagtcaatggagatttgttggaatatgcctctaattccttttatatatttgaaatataccttagaatatgttttcatgtatgcctataaatataggtcctccttgtaacttgtactctacggttgatagtgaatctatttccttgtgattgtttgttcctccatattggaaggattttccacataaatctttgtgtctattttattccctaacaaaattaaaccaccaccaagtcaaaattctcctcaatcttccttaccctccaaaatttagggatgaaacgaacaaagtcttaattaagcaattaatagaagggattgagaaggattaaaccttataaggttttgtttgagtactttattattgacctcaatccacttgtattgaggtggattatggtgtaacttaaactaatttacacctcaatccaactcaacacatgtggattgaggttaatactagagtatagtgctaatttcataatcctattttttaaagaatttttatttttgcaaagaaaaataaactaattttttatgagaaaatgaaaatcgtttagaaaaatagggttgttaaactagtcaaaatcctcaatttttctcaaaacgagccagctctttaacaagctactacaatggtgggtgcgcgctgacggagtgttcaattcgcacttcgccggcggcgcgcctatcccagcccaccaccatcccacgccatccggaagtgcgtacgccgcagtagccggctagccgccacgcagtcacgagttgtttagccccgtcgccttcgtagctcgtctaatttgagcggcccagaaaaaaaggattgcgcgtcgtgactcctgatttcactctaaagtagacgggtcccgttcgatttcgcccaaaaccatccaccggcatcggccggagagacagcatataggcaggcaggcaggcgcggtgagaggaatcggcatcagaggtacggtacg

SEQ ID NO: 3254 - DNA, 1500 bp, Zea mays
agatacaactaaaacacaacataatacagtggtcatatctaaaacatgtgtcttacgatattcattgtaccaatcagagcattcaataaattaaaatgaccaatcagctagtcttctgtctcgaacatagagctaagacactgtgtcttcgtcaagatacgtgttttgagtttttttacattcaccctcatagagactagctgattggtcactttaatttattgaatgttctgattggtacaatgaatatcgtaagacacatgttttagacacgaccactgtattatgttgtgttttagttgtgtcttatatttggagtatcgtgcaacagtgtctaatggaccctataacagtgaggtgtgtaatgagcttggtcttacatcagcacgggatccaaactccttaatttttggtgtagagctttgtttgagggcccgctagagatgctttaagcaattatttgtgtttacaaggtctcactttaacattgcaattatctgtttggttggaccgtgcctgtgaaaaaactgttgtgagctgtcaactgaaaaaaaaactattgtgagttgtgagctgttaaaaactaaaaaccaattgatagaaaccactaaaacacgctaaaagttattccatatatattttacagttctatccaaaagcaaggaaaaacaagtttagatgtgctttatttttttgcactgcgaaaaaatcgtctttataaaaaagctgattcctaaatccatttctttggtttggtttttgacttttaggagacaaaagtcaaatcaaacacacactaaatttgtaatcctaacgtacagtctgagagttgaaactttgttgggctactaacgggccatttatcgttcatcagaacccagttttaacaagtggaatgaagcccaacaaccccaccacccaattccatgggacgtgggccgaacctacctaccagcccgatttgtttaagccagtctcgaccgtaaaaccctcatccaccgcaggtgaaacggtaacatcagcggtccccaacgggtgggggcccacgcggcagcgtcccgcccggcaccgtgcctctacggccgcgcgcaccaacttcccaggcttttcccctggacctggaggaagccagcgggagccgcggcgccttgccccggtaacagtacacacgcctcccttgcccgccattaactgcctcacgctcttctcttgctcgctcggctcactcactccctccacaaagcggcagcctcacgcgctccaccacgccaccaccctccatccctctctatatactcactcctcccgttttccgtccattttcatccatccgcccacagcttcgcagcccgcgcccctaaaaccctagccccggcggatcgcggggcgcctctggtgccagcgacgcggctcgtttgatccgattggttggtcgggccccgccctcgctgccgcgcttcgctccggcggtgtggcggggagagcaccgagcacgcggga

SEQ ID NO: 3255 - DNA, 160 bp, Zea mays
tgaagtagcagagaagaactgatatggagaatttagtgaacagtgattcccccctgctctgttctccctcctcccctgttcgagcccaagggaaacaggagtacaggactagcttgcacgcatctcgcctcgccatcgccagtcgccacaacagcgcaag

SEQ ID NO: 3256 - DNA, 376 bp, Zea mays
atcatccaaaccgttgcttctgtgatggatggatcagccgagtgtgccttcgaatttgaccagccttcgctgccgcgtcgcccgcgcatgcatgcaccacccgcgactttgaccgactattccactctcgctttgcattgatcgaatactagtacgtactactactggattgcatagttattggtagttgcctccgcgcgcctctccattttacaaaatgacgaaataatattgcgactagagtctagctagtagacgcgatacatacaccaactcccgttggctccatataaagcagctgcctcgttgtcgttgctcggccagtctccttagctttgctgctggccatccagacctatccaatccatcagcatcc

SEQ ID NO: 3257 - DNA, 1451 bp, Zea mays
aggcgagcgtgattgattgattagaggagatgtgtagtactataataaatgatgacgatgatgatgctctgctgctgctggtggcagcgcgggagaggttcgcctgcgggggcggcgacgtgctacctgcctcgcgcccctgaggctgcactggatctgctttggatggattcgtattccttcagcttgctatcgccgcccgctctgcggacgtacaagtggcactcaatatcgatttccttttaggcctcatttggatcattggaattgcattccattctaatgatccaaaccgggcgtaaagtgaaatggcacacaaaatatctgccagtgtatacgattcatgcttgattaaatgatttattgtttggagttgcagcagaaacctgtatcagatggttattaggagatacatatgtcagcgtttcatcaacattctctagttatgcatttgaccttcttattcttttaggagtragaaatgtagaataaatcatattaattacatgagataattgataatatcagctatggagtgtgcgattcaatttcatttccaccttttttctgcactcgctacgagtagcaataaggaccagttctgcagcatgttccacgcgcactttcagaatcgcagcagacacaacatgcgtactgcaataaaatcaaaatgggggaaaagtaagaataccaatactaaaaaagtcatactaactcaatttgagaatgctaacaatctacggttcatatgtgtgctctcttttgtaaagtctgcacgccgtacaatacaagtgcaaggatttgaattcatagacgccattatgcagaccagaagaacacaaaatggcataataatgaagagcaggcctggcaaggaaaagaatcaccttgcagttaacactacacaatacattcctcgaaaatccttctctccttctctattttttctgcgacaatgaagtttagattgtttccatattccaatctatgaaaaaaggactaaaggcaaacgcagaccgatcaatagacccactcataacccactcaagaattagcaaaataagaaagaacatacccataaaccatatctgagatgtcactgtgcgcatcagtagattccaaaaatgcatcctatgaagtacagagatcgaggtgagactgtagcagccaagtgttaagatagaaaatatctccttgttaggtaaggcttgtacgcctgattatacgcttgattctgttggagctgcgcctcctttctaggcatggttgttgcctattattgtgtctccttctatacgccatgcatgtacctcttcctatattaatacactaacagccagggaggctgattgccttgcgccattaacatagtaccagagctatcgatccaatagatgtcaaacacgtccaccacatcttcccttacgtcttccttctctcctcagatcacc

SEQ ID NO: 3258 - DNA, 195 bp, Zea mays
ttcatgcgcagcgacgaactggctgccgcatggaatgtgctcactccgataatccatgagatagatcagaacagagtagttcctgagctctacgaggctggggacagagggcctatcaatgcttaccatctcgctgctaaacatggggtgcgatgggatgacgactggtgagtcgatacatggcaaagattctcg

SEQ ID NO: 3259 - DNA, 924 bp, Zea mays
gttttccataatgtgtccaagtttgcaccagtaaattcttattaatactactgcatgaaagttcacacaaccgtaataaggcatttctatttttatattttagtataacttcttacttccagttaagttgaccgattgcctctgacatgccaatgtcgccaccagtgctattagaattctgatgtcgctcaactataccgggtaagatctgcttgacttcgggtaccataccattgatctaaaataaaaatgataactgtttactctgagaaaacttcagaaccgaaattttgagtaagaacccatttttctaaaagtagactccaatacctaaattggcctgttagcgcatggtccattatgaacttgtagccatattgacattagaaatacacatgatgcaataggaaaaagaacttgataaacctctaggagaagtagatcaacaaacatgttcacttccatgagttccttgtgttgttttagttgaaaatataaaaaaggaaatgtagatttaagaaacaaaaccagaaaaaggtgaaatcactgaatattatgttgaatagaaaggctaaccataatccaaactggtgttgtaaaccatagtggcatgtagggatgtattttattctttattggaacgtggtgggttttctgcagtggtgatgttttcctttggtttgatagctacaaattttaatacataatccttggtgctctgcatgagtttcattcaagctgagcagggcgtagctgctgccaaggttccccgttcaacgcttgcagccacatccctctgccagccaggcggtggtggggagggagattgggatggagcatgtgtcgatgtggctgcgtgcgttcccggatctgcacacctatgtcagcatgtaggtgtgagttgagccgtcggtgactaatgac

SEQ ID NO: 3260 - DNA, 159 bp, Zea mays
ctgtaaaagcgctgttcgcctgttcctctctgctccttcccagagagcgaaaggaaaagagggagaaagaagggaggggggagggagaaggagaaaccacccagccatcgtcccaatttttgccgcccaacggccacgccaagcttcggatcatcagat

SEQ ID NO: 3261 - DNA, 210 bp, Zea mays
cctgcagtttgacaccgtcaacatcattgttgttattatatattagtgcttgaattttttgtataacagataatagattcgtggtaatctgttaatttgattgtaggttgatttgctttagattattgtgtcagttgcttgccatttttatctcgtctcactgtaatgtagataaaaatgggaactaactgatatattggtttgagcagg

SEQ ID NO: 3262 - DNA, 929 bp, Zea mays
tgatggtagactaattgacaagtataataaggcaacaaacaagagatccggaaaggattttgtgacactagatcgattggacctttattataaaaaaaacagtacaactgcaaccaagtgcaagaaactttttaatgaatcaagatttaatctccaaaattgtcaaacaagggcagcaagctttgaggcaggtttgattgtgtggatgagtgtactatatagaataacaagttttataattgaggtatatatagttagatattctagttgcttgaggatcattcgaacattattagatattcaataacaagttttataattgaggtatatataattattccttaatatttcattgattacgaacactttaaaatataccatgtcagctaaactactagaatcaacctaggaggctatcaaggtgttttcaatagtttaaggaaaagaataatttgttttatatgtaatagtaactctaatagtcatgtaaattttagctctgtagattacagatttacagagttgctaaataactttggagtaaaaattataagttctccaaataactttctaaatataggttgtagttttrttttaaatctatccacgttaaaaataattcacaaatgttaaccatcatcttcgttaaccacaaatgcaaccattttttcgtttaaggagttggtaaatgattgtcaagtgcagagagaaaataacgttaaagtagaagtagctaaatttaaaaagtttatttagagtgttgttggagaaattattaatttgggaaatctttaagaaaagctgtgtagtgagtcaattaggggagttaaatcgactttttcctaaacccgcccggtgttttgtagggcgggccccagccgcctcccctctcgttttctctgaccctttccttcccttcccttgttttg

SEQ ID NO: 3263 - DNA, 112 bp, Zea mays
ggacggtgttctttcggggctacatgtacagaaccaatctcccctgtttaatttattttgttttggcttccataaccattgtttttgtgtggcagattagcttattaccacc

SEQ ID NO: 3264 - DNA, 743 bp, Zea mays
gagagttgtattgtattcttcatctgtgttgggctttggttagctaagtcattagcagtaatctcgtgtatttgggcctaggtttagcctgcccaacgttttgggtataagagtctgtaatagagaggatttgaacagaaaaagacagaaacaaaaaacagttgaaacctctatacctgagtattgtcgggtcggtggatgtggctcacgcctaggcgataccagtcggcggccaggggcgtcacacagggcgtgcgggaagcgccgcggccctgctctggcagcagtgaggccaaggcggcggcggcggctaggatttgctgcccgagccgcccaaacagggcgacgtgagcgggtctggggcttttttctgtcaaacttgtaacattattgtttgaattcttgttgggtcaaataagtaagaaaaaaaaaagaaaaacaaaaggttgcagcctcgatttgtaggctattgctagagttatcctaactaaactgtgagtgagtttcatgtcttaacaaacatcatcgaacggttgtgcttgtgccatgtggaacaactacatccattagttcagaaagaaaaattaagacatccatttcagaagtgaagggaagtcaagtcaaataagaaggctgacagcaaagagcaaagaaatcaaagcacgctctgcttgaccaagataacaccctagtagtgcataaaattcttgaacaccagacgtccaacacttccgtgcagagtg

SEQ ID NO: 3265 - DNA, 84 bp, Zea mays
tgtaaggagtattccttccttcacgccactccaaaatctttccatgacgaatagttagtttgtttttgatactgcagcttggtt

SEQ ID NO: 3266 - DNA, 1500 bp, Zea mays
acctatattctatgcacaatatccctacaggatgccataacacccatcatgagggtatcccaaacttcagtgcttgatcgattaagagatcctcgatctggtcccagacataggttcagcaagcataccagaatcctcgctggcaaaggccgaccaatacgacatggggcataaagaggaaactcccgcatttcaagtgcctgagttatcggtctccgattgtaaaaaaaaactagagaggactacagtcattgatgttattaaggtgggcaccacagatgtcattatcaatgctaacgatgaagggtcgatgaccttttgagaaacggtcaaggggaaggaacagtggtggatccacctcctcaacggggtgggcatgcgtccggcctatttgcaacagagtagaaaaaatggccaaaacgacttgtgtgcctcgacagtcagcatgtatactatgtacttcacgtcagggaactggataggttttcacgtgttgatctaaataggttcctaggaatctaggcgtagctaacttgtcaatttctctcgctgtttgtgcttaattatgtttgcaattgcaagtttccacttgaatacatgttccttttgcactgttccggtgaatgtgcaatagatgaaatgcaaaccatatacgcaagtcttctactctgaccattattttatatatttatattgtatggtctctttttatgaattataatatactatgtatcggtaaagtttgaaatgcaaaccattcaattttttctacttttgtgaatatctttagaagtattatcgttatcttttccatcattttaagtgtttgcatatgtattaactaatgtatcaaaaaaatggcatccacgaataaatttatgcatctatttatatattcgttgtttataaactagcacatgctctctataaatcaaggaagttgtcatatatagctagtgataataaagccggtagcaaagtgcctgactcaagtattcatgttcatgctaaaaacaaaaataagaatttacagagtaaatattatattttatttatttacaattataaaaatattgaaaattttatcatccaataagtgtccggatctatttctgaccggcgggtaccccgcatatcagcgacccagcagccgacgcaaaatatctgcgctctggaaccttcaggaaccagctggtacctccaaaggccgacacgcgctcttcaaccgagcccaacagatacaggtcaggtctcataaaacttccccaagttggatttcacagccgtgtcagaccacccgactgcccccgcctagtttagggcccacagatcagagacaggaggagacagctccggactcttctagaacgttcaccgcactagcctcccctaatcatatatacccgccaccattcaatccgccagaaaaacacacccagattctttcgattctttcacggttccacccctcccctccctcatcgccgctgcctactcccc

SEQ ID NO: 3267 - DNA, 1318 bp, Zea mays
aagcttggtgatgagcttagcaaaagaatgaaccaagctgatgggccggaaatccttaacgagcgaggcgtcttcctttttgggcagaagaataatataggctgaattgagcaagtcaaaattcagcagcctccttcactttgtgcgtgagcgtgtagccatggtgacgtccgtgctctccacgtcccgacgacttyccagtttgctgatatyttcacaaagggccttccctcgtcggtatttttggagtttaagtccagcctcaacatctgctgtcgctagatgtttggtctggggggtgttagaatgaatactccctttctattttaggctgattgtatatatctctcctttcacccgcgtctgcgtgtgattgatcctttccatagtagagatattccttagtagagttgactaccttgtcaggtagggtgcgccggccctagatgccttggcccccaagggtttccatcctatatttatgtaatgctacatctgtctatcaatcaattcagattccaccctttccagtcttctaacaaaatggagttagtctatgtgatttgcatccctaaattcctaacagctttgtttgggaagttgggtcatcaacctaagtgctaaatctaattccatgtttcaatagaactgtatcaatgatgtgcacataggttctttctracatgagtgtctagacgattgatgattcccgtgtatcatttctccggtactattgaaggttccttaggccctggctttcgcaaaytagtcagcatgaatacttttatgtaaggtatttatgtaaattatccatatgaattaaaatggcacattaatggtatgttttcatgttgtgacaactatcattattgcatacatgaacctcattttccccgttcaatagttgatcaatatagaactgaaacccatggctaatttgcttgtctaaaaaaatgtgatacctattttttggccaccaatatatctgattgcacatgatatgtcgtcttcatagtatttgtacttcaatgtttttagaacgaaggcttgggaaagcgccttgctcatggatacccatttttggaagctgaagtagcatactgtgctcgttatgagtactgtgaatctgccgtggattttgttgcaaggagatgccggcttgctttccttgacacagatgctgctggtagagcattgccccgaatcattgaaattttagcttcagagcacaagtgggacaaggcaaggaagaaggcggagctgcagaagggtagagagttcttggaaacattcaagtcatctaagaacgcccaattcc

SEQ ID NO: 3268 - DNA, 1500 bp, Zea mays
tatgcaataaataaagctgtgccgcaggtttcctctacatcctttttcttttcaaaaaaacgtcacagactatccaagtaatttcttcacaaaactaccaaaggtagcatgcagtggcataggcaaataaatttcttctaaattgtataaaacacaatagtggcttgctctaaatttcatcaatcatcaatactgtgattcgttttagatcttgtgccatcaacgcggccatatcggccagtgttgaggggtcaaaccggggatcgatatcctaggctgcagttgattgtgggctaactaggcaatgagctgtaagtatatgctacgtaacgtacatatttttgtcgttcttgccaaaatcaagcctcagcttaaattcgtttctagcagtacttttgattgatataataagttctaacgattttgcgtatgtgtatgttgaagatttgtttgattttgttgccacatgcttgtccgaaactagtttttttttaaacgcagcacctgaaatctgatgcaaattcaagtgccatataaatgacggataaaattaaggacaccaggaaatatatgattggctcaaaaactgaatgtaacgctgtcagttatcgcttctcagagcaaagcaagtacaataatatgctgtaaaataactaattgttgaggtaaaagagagataaaaagaaagagaagagagagataaagctgtaaaaactaatactacatattagaaaaaatattatatacacccaggatgtaaaaccactactttgcagcttttcatatccacaccaatagaaaaaaaattaggcttgctagtaaaatctcacatgttcatgttgctacgtctttccactgatggtggcatggtgctacttttttttttcagtgcgctgaaaatgatagaagcaggaagggagaggatgcgaaattggcattgtaattcggtctcttgctacctccaagcgagaagataattacaggtcgcgtctcgtagcgtccacccacgccgacgccggactgtgcgcattcttcgggaacgggacagaggagagaggcgagcgagcaacgagacgctgcgctgaccgcccgccccgcccgcgcccattcctcctcccactccatcctcctcctccgcagcccgcgcttcgccgctcgcgcctccttcccatccctcttcttttcaccgccacccctcttcgctctttcggagccaccgtgagtgcgccgcggcttcatcttgctgatcgtgtccgtggcttcttgatactccgtgactgtctccgtccgtgcgtgcgctggcttgatcctggcggttcttgttcttgcctgcattccactcgttcgcttcctcgcgataatatctgcttcgtcttttttttttccttctggtttcttctggtatgtgtaggaagcgagtgagcaagccgagcaacagtggctgagattcgctgcaacgtcggtatcaaaaggtgtccgagcggttgagattcgcgtgcc

SEQ ID NO: 3269 - DNA, 142 bp, Zea mays
gggttttttttttctgtcaccttttgttatctaggtcagtgcctgtcttaattaccatgtagcatcttaatggcctcagaagcttgtttgaaggcctatgtgagcctttgccttgcctacacctttttgtttggtcgatgat

SEQ ID NO: 3270 - DNA, 343 bp, Zea mays
actcagtgggtcccagtatccgagatcgcaatttcgtgcgttcacagcatccaacaaaacgcaaattgaactataggcatcgcaagttttcgtgttcttttttacctaccgaaagcaaaaggtaggaaatttacagacagggagatcatcgaaagaaaaaaaaccaacacgatgggcatttttgttacacgccgaggcggaggccgagccgcgagccggagacgaccagagtagtgaagagctaggggaagaaaagcagggggtgggagcttagaggtggcagccgcagcagaggaagaagcaggagagcgcgaggcccagcacgacggcctcgacgacgtac

SEQ ID NO: 3271 - DNA, 208 bp, Zea mays
ttttggagtgtgggtagtcccctagttttttataacagagaatccctcgcctacgcctccaaatcgtcgaagccgcacctgaggacttctataatggcaaatttctctccaacgagaggccgccaactcaaaatccgaccgagtcgtccgcatcagttttccttcccattccccgttcccaacccaccgtaaaccctagctgcgagct

SEQ ID NO: 3272 - DNA, 345 bp, Zea mays
catcttcccattggtttaaaaaattattttctattgttttatacttgcttgtttaggatcctgcagggtcctgattattggagcatctaagtgcatctctgtatcttggaaactaaacccctatacatattctggtttattttttccattttcttgctggatgatagtgtttccataacagttttctttctagtcattccatcgcagcgtagctggcatagcttctttctgtaaacagacatttccttccagctctttccgttccaagtctaagattggaataacttaacacaacaaagtaataaaaccactgaacaaaattcgtgtttctcaaagcaggatgcc

SEQ ID NO: 3273 - DNA, 672 bp, Zea mays
ttttggtcgaaaagtgggttacaaataactatattttaggatggagtgagtattaggttgagtctgtctttggtagtagcgaagctagcaaatattttattgggatcatcaatattatctattatatcttcgctattgaactattgtaacaccgtttttcattagatattcagaaaattactgggacttaaaaaaaaaggcctrcctccgcccctgccctgggagtgtggcggaatgtctcagctacacttgttgatcggtgattgtagtcatgatgtttcacgatgaatcagagtcctgagtcgcggttgcacgaagaaacggtgccaacgagcaacgaaacgcagccaacgagcaacgaaacgcagccaactccgccactgcccagacgtccgtcaacggtcgaaacttctcgtaaaccaaaatcagacagagagagccggaaccaataaagtgaacgtaaaccaaaatcaatccatccccggtgcagaacgcccaacgggcaacggctgtgctgccaaaagtccggaccacagctcgcgctgcccgccgcgccttgcccagacgtgcgctcccttctcccgcgccgtcgcctctgccctggccgacccgctgggcccagtgtgcgcagccctcccgggttaaggcggaggtgcttggggacccgctccc

SEQ ID NO: 3274 - DNA, 1034 bp, Zea mays
gcatagggcccttgcatcatggcgtattgctcatcggtgatgatgccctatcaaatcagctcattcaagaggttagagcgaccttccttctatgaggttgtcatattgttatatttttaccgaatttatagttgatagttgtttcaaccaaatttttttagatttttctataactatcagcttacaacagttttatcatagtttgtagttaacatcagattttttttaaagaacatgatgctactatagagtatagacctatagtcttgtacgattagtgtgggacacacgtcaatttctttcaactgttcttgaaccgcccaacgacccaacccagaatcaatttcctcgcgccgctgtcccttcgtttccccagacagtgcagaccgaaccgaacaggcgaacagacattggttttccccgccgcgcagcgcgcacacgcctgcctgccatttctaaatccggggccggtcatcctctcttgtttccgtggcaaccgcgcctctcctccttccttgcagcgtgcccctgcggggggctgcgcgtggatctgatctcgtcaattgtcggtaaggctgccgtagctttgcttccacgggttgttcctcccgctgcacagtcgtctcgtccccgctctctccaaatctctattcctgggacggggcatattcctgtgcatagttttgttgcgtatttttgttcgaatctgtaccggtcgactgatttcaacgggttatctccgcaaattgaatcctccacctccgccccagctaacgaatcattctttcaaccgaaaatgctcagacaaccctgctaatgaatcaccctttctgctcagcccaagaaatgcctgatacagacttcatttgagatgcatttatttagtctctactcctatctttttaccttaggtccgccattatagtatggttaccgcaagtatcatcttacatatgacagagattttccgtgcctattgcagtgctatgtttttctccagcggcacgaagtgaagaacacgtttttgtgacgcc

SEQ ID NO: 3275 - DNA, 595 bp, Zea mays
tctagggatcggcttcacaacatattttccgcaacacaattaggttttttggtaaaaagaaaagaaacaggacacgtttgcggagcccaaatataaactggcctcaaaatagtgactccagctcaggttcagcagccttcctgttcatgcacatgcatggatatatctgatccacatatatcgtgagtacaggataaatatagtggtttccatctttaaatgcgcttttgcatcgataaatcactctctttagcacccccttcgccattttcgttactactacagcagcattaacccatagagacaatttagtagatctagtagtttgattaatttattaactccatacactgttggtttcagggtaagtgaatcttgttatatcatatgattctcttcttgtttcttttatttccttctgtttcgattcaagcatgtagcgtgttggttgcattttggaaccggttcttgctaatttggccgatctctaatttttacgtggcggaattgggttggtcagtggacccgaccgaggccgacggccaatcaatcaagaacgccaccgcaccgctggtcagggcgcgttgggcctgca

SEQ ID NO: 3276 - DNA, 794 bp, Zea mays
gtcatagtagtgtttgtgactagtaaaattataaatcttaccgttcaagttttcaaaacaaaattgttaactttatatcaagcaatagtatcttatatgaccaaagggtaaagaccatgggaaaattttgtactctatccttttaacttttggccagcgatcaaagtgctcttcgcataaaaatagttctctgaccaaacacgaaatttgcatgcttccttccyaccaaaaacatgtgtccgaactatataaactaaaatcagaggaggacggacgggcagccgggcaggaagggctgatccgaaaacggcggattctctccgcgcaagaggccaagtgtcctactacagtagcgacgacagcacagacgcacccacccccggtgacctgacyaccagccacccaccccgttcctggtaggcttcctcttccagggacacgcccgtcatttccgccccacgacgcttttacttttctgcgcaccctttcacactcactgactcaccgccgcgctcgcccgccctctcgcctcgtcgtcacgtcagactcagacatcacccccacccccaccctctctctccctccgtcccgccaataaattttcccagcgcgacggcgccccgctctcccgctccgttcctcctcccttccccgaagcttcggcgccccctcgctccctccgccccgttttaagcgcgcccgcctccgaccgaccggccgccacgcgagcgaccgcttcggcaaacggggaggaggaggagtgtttgcttctctgtcttgatcggggaggcgcc

SEQ ID NO: 3277 - DNA, 420 bp, Zea mays
gagccttttttcgcttgctttatttttggtggtgtaagatcttcaatctcaactgtttccgcttgctatgtttgctgctatatatttcccccttatgttgcaggttctggcaagtgacatccgtaacacatgtcgagaaataaaaataattggtttctcctccatttctccatttagatccactaattttatgtctttctgattccaggttttctccagtatcagttgcttgccttctacagatgaaaaaaggggggagaacaactttgttacaacatacccatattcatctttttttccttgtttcacatccatcctacatcttcaacttgtccatttcactccagtcaaattttcatccaatatctcacggctttctccactcgcaaagcaagaggaggcacaaaccactgcaatttc

SEQ ID NO: 3278 - DNA, 1500 bp, Zea mays
tatttatttgtttgtgtgtttgataaaaacatatagtctattaagttaaaatttaaattgaaatcagacatgtaatctattaaatagtgtttacctctctctataaaaaacctagctatgctcatgtttggcgcatctatatcactatacaatccaaccgtttaaattgtatgaaacacactcaatcaaatcacccacacaccataacctctactaaatccactaaataaattatattcaaatttaatacatcattaaaactaactattctcctcttactcaaatttaattaataaaattatttagatcatcgaccctcgtcctttcccatcttcctcccgcgtgaccctaccgcccccagccttgtcgcggtgaacgatgatcctcaggtttgactcctcgtggaggtactgcaagccccgtgcgacgccgataatgatttggtgcctagttctccagttcagatggttaggaggagcacggagcaagcatgtcagcagcaagtgagctatggacaacggacattcaggtgaatcttcaaagtcatgcatgattaccgaatagtaccttgtccaagctcttgttaggcttacaccagcagccgctgcgaccccctgggagcagcacctgaccccaccaaacgcacgaggttctttgtgctggatgcttgtgaccatccgacccaccctgcccagacttgccgacgctgagctgctgaaagcaaaatggtcttaaacttttttctatattaattttgccatcataatcatatagactaatagtaggatcaaaagggctcgagaaaccccgccacgagcaggatctgctggacagcgaacgtgtgtgtatttccgcttgtgagtgtctattttttttaaatgctaaactattgagaagtgtggttaattggaaggtgttgaagatgtgtttttgttttaatttttatcataaattctgaactggaagaacgttttggtaactctcacagatactctaacctaatcagatggaaacgagaaattgcctttcccaaaatcaaccaaatacgtagctgtttgatcatgttaatgatgtggaagcacgtccttttcatacttttatttatacctccctctaaaatagggccaaatacaaaaattgagtatagttagtgttagtcatagtcttataattttgtttctttaagttagtatcactattcatacaactgttttcgattgtaataattaatttgtattggctgtacgtattatcattgctaaatccggaattcatattttcattataaaagatgcattctagcaatgcggggtcggcagaattcaaattttcaattttcgaacccttctgccgttcgtgtgcacctggatggggtccataaatatagaaggcctcttcatcttcctattctcctttctctaaaccgccgcttctgttctgatctgctccccgaaactactaaaacaaatcgaagtggggaacagacaagagagaagggag

SEQ ID NO: 3279 - DNA, 73 bp, Zea mays
gacagcataggttgtaactgcagaagaagactcgttcgacctaggaaactcttgaaaccacaatacaccaata

SEQ ID NO: 3280 - DNA, 681 bp, Zea mays
aatgatttgaactgctgaaaacatataagaaaggcctaagatagtcaaccttctcttttttttggagttgcgtggatgcagatggagctgacaacgttacttcggagcgcgacggaatgttattgctagttactctaaaataattgtcgttattgtttttccaaaataaactattttaaattttaactacatatataaaaatattaatatttagaatgtatgattagtatttattaaatctaactttgtaatactttattaacaaatataaatagtttttaaatatataaatcaactaaaaaactaaaacgaatttgatttaggacagatggagcattataatattcattaacaatttaacatttttttcaaattcagtaacgagtactctttctaaagtttctatagtgtcatactgtcatgtaagaactttttctattgatttgttcgcgtcatattaacgccagggagggccttttctctctcctgtgaacgccaaacagtgtctcttttccaattccagacctgaagaaactccgaccggccggtgggcggtggcggcagccggcaggtgcgccaccccgaggccccgacccatccctctctctgccggaaccttcagatccgcataaaacctcgctccccttttggtttgtgccacgtgacaggatctgtgccgcg

SEQ ID NO: 3281 - DNA, 850 bp, Zea mays
gattttgatactgtcactcctactttattccttggttgggcaacttccaataggctcatgttaatcaatgattagtaattattcagcaaatattcttgtttgtttgacatttataagaagtggggtgagacggattaaatatcatccatgagagctttatcttcatgctctcttgattttggtttcagatcattctttcagtgttcacaataattttctcagtttggtccatgtaatttttgaagtgaggttccttaaatttcattatgcttcctttcttttctagactagcaattgcatgacttttcactttggcttcacaaattgactcacaagaaaacaaattcacttttgggttcacaaattcctcttcaggatgtacttttcacttgaacttcatgtataggaacaaggaatggctcagtttttaaggaacaatgtacagatttcatttcagaactctttctggttggttgagtttcagactttttgtaccaagctgatggatcacaatacttgtttccaaagtctaataacagaaactggcaactcctaattgataatataaaagaataaaatacagtatcagatgtctcattttcttggttggcagatcacaaaaaggaacacaaaggctaagcctcctacttgttcgggagttaggtcagggacaccatatgaatgaaagaaatcttaatttggggtcacaccaagattgtctctctcgaggttgggggatccctaaggttggtagtagcaatacccaatatatcacctaacaaacccaatccatgctacatacatacatagcatccatcacttgtagactggacccttcatcaagagcacc

SEQ ID NO: 3282 - DNA, 1500 bp, Zea mays
ataagacctcaatgttattagcacgtccacaaccaccgttaaaaatctgaacagacaacacaaacacacaaacagagatgcacggttactactgggtattgggctactgcctacttggagataccagatgactgctatcttccgggcgctgcagaggtaatagagggaaagggaagggagactgggagataatcagagaagggagagcaactgctaccttcagatgacgagctcatcttcaattcttgactagttgagtagctgacagacgccggagcactggagtactggacgccgctggacggctggagcacttggaggctggagcagagacgtcggcaaggacaaaggagaggagtatggttttttgcggctgggaggggttttgaaggggcgggctactgtagatgggccaaaaaccagagtgaagcccagtaccaaaactgcaacgacaaaaaacgaccagaaagtgttcgactagatgactaattgcccaggtcgacgactagtcagacgactaggacgactagaaaccttaatcgcgtcgtcttcctaatcgccctctttcaggcgaccagtcccactaatcgcgattaagttggacgacttgtaaacactgatctgaacagattgtaacccyaaacaaacacacccttgattaagcttattctatcaaattttgtctttgagtacccaataggtggcacctcctatctgaaagtcttaaataaactgataagaaattaaattgataagttaacaggatatttgatcactcttggcacagcgcaggcaatgcggcgaccataagccataatcatacaccccattcgtagcacctgttagctgacactagagcatggagacagaagtgaaagaccaaaacttaacaaataattttcggagaaagatgttctgccaaataataaaaaaaggaaataaaaaaaagaaaggtggagtaaacaacaggaaaagatatcgattgattgtgaatcaaagcagacgagaaaaaaatggatgggaaaaaagtagctgtagtggtaatcatttgatcttgaattcttgatccactatttcgaggagaaagagggagagagatgactagctgtagttgaagccttgcaggtccaccgtcacctcgcgccgcccggcgagtcgcaggcatttgtttaagggaagggattctcttccgccgcggctgcctctgcctggctggctgcgtcgccacaccccgcgcacatcgcgctgcccagctctgctgctgctgccgctgcgtgcgcatcactggaaagatgggcctgtggggacgggctccttctttccttcaccgcgccatgaatgatgcgccttttctctgctgctttgcttccatctggctcagctctgtgcctctgtcgcccttctccttcctctcggtgtcccctctgtcggtccatgctcgtctgctggctcctgcttgttgcttaggcgttcttggtcaggtgagcagcactggcggcg

SEQ ID NO: 3283 - DNA, 1500 bp, Zea mays
aaagaaacaatccatgcacactttataggtatttatattggcgcaattctaagtaacctttgcacttacaattatgcaaactagttcaattatgcacttttatatttgctttggtttgtgttggcatcaatcaccaaaaagggggagattgaaagggaattaggcttacacctattttcctaattgattttggtggttgaattgcccaacacaaataattggactaactagttcgctctagtgtacaagttatacaggtgtcaaaggttcacacttagccaataaaaagaccaagaatcgggttcaacaaagagagcaaagggataaccgaagtgtgccctggtctggcgcaccggactgtccggtgtgccaccggacagtgtccggtgcaccaggggacttcacgctgaactcctcaccttcgggaaaatccagaggcgctccgctataattcaccggactgtccggtgtacaccggacagtgtccggtgctccaaggaagagcatctctggaactcgccagcttcgggaattcgctccgctataattcaccggacatgtccggtgtgcaccggactgtccggtgagccagcggagcaacggctacttcgcgccaacggtcacctgcagaggcattaaatgcgcgccagagcgcgcagaagtcaggcacgcgcgaagtggcgcaccggacactctacagtacatgtccggtgtgccaccggacatccaggcgggcccagaagtcagagctccaacggtcggaacccaacggcctggtgacgtggctggcgcaccggacactgtccggtgtgcaccggactgtccggtgcaccatgcgacagacagcctccaccaaacggctagtttggtggttggggttataaataccccccaaaaccaccccacattcaagtcatccaagttttcctacttcaactacttacaagagctctagcattcaattctagacacacccaagtgatcaaatcctctccaaactccacacaacgccttagtgattagtgagagagatttgcttgtgttctttcgagctcttgcgcttggattgctttcttctttgattctttcttgcgatcaactcaattgtaaccaaggcaagaggcaccaattgtgtggtggtccttgcggggaagttttgttcccgtttgattgagaagaagaagctcactcggtccgagggaccgtttgagagagggaaagggttgaaagagacccggtctttgtgaccacctcaacggggagtaggtttgcaagaaccgaacctcggtaaaacaaatctgcgtgtcacactccttattcgcttgcgatttgttttgcaccctctctcgcggactcgattatatttctaacgctaacccggcttgtagttgtgattaactttgtaaatttcagtttcgccctattcacccccccacttctaggcgactttcaattggtatcaaagcccggtgcttcattagagcctaaccgctcgaagtg

SEQ ID NO: 3284 - DNA, 1500 bp, Zea mays
tccaatctagcccgctagcgtttcatcccactaacctttgcgcgaattcaaaactgattgggtaaattgcctcggcttaccctaagttcctaattctaaaatctattgcatctttggatgttgatgggtatgcgctctctgatactccgtaaaatggaagatccatcttagcacggtgatccatcttagtttcagctaccctaagtttctacggtttaacttctcttctattttacggtgatccattttagcacggtttctatgataaacatataaaactaagttgagatcaagcttacatgtataaaatactatgtggattagacgctaaacgtgagctaagatcgagtataaatgaattgagtttagggtttagtcacaagatcgagtttaggatctatagtcacgatccgtcttgttttttttatgttacataaataggtgaagtcacacaaactcatgtgtgccatctcaatgcatacatgtttaaggtattggtttttacatgaccctttaatatcgttttagtaccaaattttcagaagaaccggtattaaagatgtatttcatagctttagcatcgatggagcttcaaaacttcatgtgcgaaaccctttcaattgggtgtggtaggccgacgtcatagtatatgttagtgtgagatgtttatggcataagctgagttgtttagactctttccgacattttgtgaaccaaacaacacctaaattctgcggagcttcggcctgcaaccacgatgaagttcagaaaactgcctttttccattcccaattgataatttttgtggcagccgcaaacggttatggtcaaaaccctaacatttacacggaagcttattttcgctcttgagagcatgtttggcgatagccaaaggatttgtcattcccctggcttctaagttctaaacaagtttaagatgccaagaccttcaaggcgcgtgcaagctttgcagaagattacaaactcatagaaatcatgagattgtgttaccaggaaatacctgtcatggcggcaaggttaatggatagcaaaatatgacagcacataaattggcacaacatgctaatataaatgcgatctaatttcagctcgtatccttcttgtatccaacatgttggtgcttatggactacaataaacactatctaattatgcttcattaaacaccaattttctcgcacaaaacgttacattcctcacacagaacattacaatttaacagctcagtgtttaaactcatccctcatttagcattagcatctggaatatgtgtgcatacagcttgaactacacctagttaatcctctttgtttggatcctcagaagcgacaacccatgccttctaatttctcataatctgcctcagtggtttaccttgcagcgttagctatactataaatgatgaactactgcagccacaatacagagtgttcctccggttagtagctgaccggccggcgacgtacgcactgcgctagca

SEQ ID NO: 3285 - DNA, 130 bp, Zea mays
aggtggtggaatggaatgcatgtgcgcgcagttcgcttgagttgttgcattcgcatggaggacgcgtcgtgcctatgttaggtttggtgataacatcgcaaatttgcaaacagtgtttaaattaaatttg

SEQ ID NO: 3286 - DNA, 398 bp, Zea mays
ttccaaaaggcaagagaacacacgattcctagctatagttcccacatcaaagcccagctcattaagacccaacccgaccaagcagaccgcgtctcgcgcccacaccaaccccctccgaccgcaccaatctccgcccccgcattctgtcgaacacctcgtcttcgctcgcaccgaccccaccgcaccgcacctccaccaacaacaccaccagtccaccaccacccacctcccacatgtgcacacgcgcccacctcccgtccaccaccgctatatatcccggcgccccttcctccctcccccgtccttccctccgcctccgcctccgcccccgcccccgcccacgcccactcctcgctgccaccactcctgtcacctcttcccgcgccgacgcagccgcc

SEQ ID NO: 3287 - DNA, 201 bp, Zea mays
ggtacgtactccactacactactctaatataacccctggcggtgtagcagtgatcacagcattctaacgtatgaacgatgacgccgcagcgtgagggtgagcaacgagctcggcgccgggcaccccaaggctgcatccttctccgtcaaggtcgtcacgattgtgtcgttcacggtggcgtcgactatagccgtcgtcctc

SEQ ID NO: 3288 - DNA, 540 bp, Zea mays
ttccaaaaggcaagagaacacacgattcctagctatagttcccacatcaaagcccagctcattaagacccaacccgaccaagcagaccgcgtctcgcgcccacaccaaccccctccgaccgcaccaatctccgcccccgcattctgtcgaacacctcgtcttcgctcgcaccgaccccaccgcaccgcacctccaccaacaacaccaccagtccaccaccacccacctcccacatgtgcacacgcgcccacctcccgtccaccaccgctatatatcccggcgccccttcctccctcccccgtccttccctccgcctccgcctccgcccccgcccccgcccacgcccactcctcgctgccaccactcctgtcacctcttcccgcgccgacgcagccgccatggaccccgtcgccacatgggggctaaccccgctcgcgggcgccgacccggagatctacgacctcctggagcgcgagaagcggcgccagcgtcgcgggtatcgagctcatcgcctccgagaacttcacctccttcgccgtc

SEQ ID NO: 3289 - DNA, 348 bp, Zea mays
tctcttttgctccctatcaaaacaccggaataaaatttccccgtttctctcctgtcgttgatgtttcggatgcccctcctgtttctttaatttcattccactaatgctcgagacctcataatggatgctggattgagataaatggattttaactttccaaataaaaaaaacccactcgattccccctgctctaagcctctaaccattcttctggcacagggacggtatccagtgtgaaagttgcgccccctacgttacctttcatgaaccaaacgaacggcacctctgaaatgctttcgtttcctgtgctctccctgaccaccaacagagtaacggagagacggagcc

SEQ ID NO: 3290 - DNA, 871 bp, Zea mays
tggtatcttgcttaccaaaacctacccaacttggcaacttgggtcttgggttgagtctcatacatatatggatggactagcactagcctaaagatacactgctgccacgtccacgtttcatctagagcgacacatattttttttctttttggtcataggccggccttttccaaaccccggacgttgatctcccgcccgaaagctgcggctgcgagcgtgcccacggagccgaaatgtactggctcggctcgaagctctgagctgcggataggcacgggggtgaagcgaatctggaggtgagctgtcacgctgacttggattcgggggttggctgccggctggtgacgtcccctccctgccctgccacacaaaaacctggtggtctgtgctgcgcggcgcgggggcgtgggatgtggctggcgacgtcccggtgatccctttcgccgggccggcgttgcggggcggggcgggccacagtgccgcatgctgccaccgcccaccgggagcaggcgaatccatgcacgaaatttgggttctgacccgatctttgtgctctcaacaattacaacttggccaccagaccagcccaccatggcttacgacttgttaactttgtggtgggtactgggtagtccagtcagcgaagttggccgacggtgtacgatggatggccaacatgggctacgccgattgaggcccatcaacacgggagtgggctacggcctgtttgacgtcgcaccacggtccacgacaacctcgtcgtattccgattcggtcggcgcgactcctcaactgaaactgtgtcattgtctgtcagtgctcgccgcgcggatctagggggaggggggccgtgcccggcgcggacgccggg

SEQ ID NO: 3291 - DNA, 644 bp, Zea mays
gtgcatactcttgttgtggggagagagaggtaggagtgagtatatataggtgggggccaaaactagtcattaggctgaactttcctgcgcagggccgattgaaccgcctccagggccgattcaaccgtctggtggtcagactgacagtcaaactgacagactgtaggtcagactgatcaggtgactctaacaccggttgaacctccccaaggccagttcaactggttttgaccagagaggttcaggaaaaaccctcggttgaacctgctctgaacaccggttgaagttaagtttaatcgagctgaagttaaagctcaaccgagctgaaaaagcttaactcaaattaaaaaaaatttaactcagctgaaaaaaacccaacctacattaaaaaaaactctaactcagttgaaatcaactcagcagcgcgttgtcgccaagcggagcggactgcggacccgtagttgtcaacccagcagcgcgtccgtcgcatttaccgacccaccacgccaccccccttcggcccttccccacgcgccgctcgcccgccctctccaaatcccaaatccaacccaccggccaccgcaccaccgccgcctatcgtccccacccgcagccccccgcccccgatcgcggcggcacccata

SEQ ID NO: 3292 - DNA, 984 bp, Zea mays
ggtatggagatgcctcagagacaactataatatggctaaccaagttgttcgaccatatattttgatcgaataagattctttacgagtggagaagtacatatattggtaccgatccacaagaataagggagtcattccaagttatactaattaccaaggaattaagttgatgattcatgctatgaagttatgagggaaagttactgagcatcatctgagaggaataatgaggatctctttgaaccaatttggtttcatgttcagaaggtcaactatggaagccattttcttaataagacaagtgatggagcaatatagggagcaaaagaaggatctacacatggttttcattgacttggagaaggcttatgaaaaaatacaaggaatgttatatggtgggcagtacattggactcattaaggacatatacaacaatattgtaagaggcatttatgattatacccctctgtcttacaattatggttttgcccctcatttttcaactttgtgattttacccctctttttttgaaaacaaagctttgtcatacccctcgctgtgacatgtatttgacagtgttaaatctgatgcgaaaaggcaaaagtacccatacaattttttgtgattttacccctcgttatattatgtaattgcgactttacccctactgggattgcgcccatatagaataggagggtagtttggaccattcacccatttcttcttatatttttatttttaataactaattcttgctttccctaacgtcgttaagaggcaagggcaaacggtagtttgtttttaaaatggaggggtaaaaacacaaagttaaaaaatgtggagggtaaaatcacaactaaaaggccaacgaagggtataatcacaattgtcccatattaacaatatctcccccaaattcacttttccttgtctcttttcttttgccaggaaaaaagattgtttggttcaagaatttttagccaac

SEQ ID NO: 3293 - DNA, 1500 bp, Zea mays
tcctttgccaaaaataaggtgtgtcgctataaattaatctgatagtagtgaaggtttaaagaaaaaatgtatcaaagttcaagagacatatgttatagttccgagaattttgctctaaatttaataggggataagagagatagagtgatgaataatattaagaataaatttgacatcaggaggaaataaaaaaaaacaaaatggctatataagcaaaaaaaaaggacaataatgccatactggtgtaggaggcaataaaaaactattggaaattaaaagagaaaatgctacacggttacggattttttttaaaagaataaagatgtacagtagaaagagaacaagtaaataaaaactgaatattaataaacaggaaacagagaaagagaagacctaaagaagaacccacagcctatacggagccatatatacactgaggctctatttgatacaatgtaatgatagagttttagaaaaatattagcatgattttgtaaaatgctttggttttagaggctctatatggtttcctaacacgacgacgtacaaacaaggctaaacgcacacgcacgttgactggatcgaatacggctgtctcgacccgttctacgttacacacggtcggttttgcccggtcgtcgcagcagcaacagattaaaggacggcgcgccggcctgtgtggtctccagtctacgtatactgtgcgacctgggaataatattgtaggcgatgtcaacgtgtgctttatatcaagggggactgtgggcatatatatagctaggatgccaacattatattaatttgaataagaagtcattaactataaactaattcaaatcaagtatttttattaggggctaattaaactaaataaaaatgaatagggcaatccatgcaactggacggagagtacgtatgattaaaatttaaacgtgccgatcacatgaaaacaagtaaatatgttctaggaaaaagagagagaatatgtatcctttgtgtcaatatttttagttgactttttttttcgttctaaatatatacctaatatataagaatatagaggtagaaagtttgagatcgtcctaagctagctagctatatatgtatcctttgtgtcaaaataaggtgaagtggtggatagatattcaaatttcaaagagagagaatatgcatatgcatgtgtcactggccctctcaattaattaaataaataattaaagcagaataatatccagctcttccaacaagagcttcattcaaaaaagagtccacgggcgcgcgtactttgtgatttctatcatcctctcgtcaacatatttcgatacacaagtgggttcccatgatttgcaccattatattatgcatgccgcacacaatgtactatattataaataccacacctgcgcactgtgcagctcgatcgtacatgcaagcagatcagtagcacgcacatatatacagaaaacgtcacagtgcaaccgacgtactactgaaaataaa

SEQ ID NO: 3294 - DNA, 1500 bp, Zea mays
tttcaaggctcaagggaaattatgaaaaaatctacaaaaagaagtttctacaaacctgggataagtttgacagaaggtgagtgactttcgctagatctccaaaacacgcgggaactcatcttcgagttccccggaagtcacgcgtgcatccaagttgccgacatacacacgggccattgtgaacgaatcctgaacttagtcagaagaggcacaaatagagttaagtcaaattagcacccccaaacaattaaccaaaaaaaacacattgtaaacaattttcatgtccaaaaggtgctaagagtaagggatgagtatcataaatcaaaacaggtgggtatccgaaatcaagacatgtctcacagaacatcacagacaccacctgccacaaatcctggtaatgagtagccgaccagattcggaatccaacaatgttctaaacaaaaattagtaccagccgatgttttgctgctacagcagcaaatttacaacagagtggtcagaatcatatttggaagtctaaacaattaccgacccttgccagcaaagttagatcagatcctcattccctaaaccaaggaggtacctctattgacccmaacgaacaggagamcaggtcattgcatgataaatcggatgatataagaatactaaagaacgtcaagcggattcgatacggattcgcaacaactccaatccaatcacgagatgggcacagtatgacgactcaaacagaaggggcacgcggattgcgcgcgaccagctcatgaggagatggcgtcgacaacaaccagttacgcttctagggttccaaaagcttggagagactaacacagatgcggaatcagacatgagactggatcagagagctttgttgttacctacgcgggaacagatgagagcagtcgcgagtagcacgtccaagttcccgcctgcggcaactgcggctgcagcgttggcggcggcgcagggcagagtgaagcgaagaaccttctggttgtgtggagccgatgggaaggagaaggacgggttgtctgttctggagaccgggtgggaccgtaggagtaggaggccgggccatatatggggctgattgtgtgagttgagtcgtacactcgcgtgggccttttggctcctcgggccatatgcccattagcaaccctgctttctccaagtccgggcccaacacccactatgggctttcctagtcacctctctctcatcaaactcaacaccaatcatcgtagttcgcccccttcacgaaggaacctgctcggcctcgccgtccccggcgcgtggagcgcgtcgcgtccgcgcacacgcaccgaccatcccctgccctcatcagcaatccccggcccgcagcgtacaaatacacgctccccgccgctccgacctcactttccccgcctccatcaccaattcacgatctcctttcccgcaccgcgccccggatcgccggctcgcaattccggagttaaattcccctccaccgcaaccgtc

SEQ ID NO: 3295 - DNA, 1500 bp, Zea mays
aataagagaaaatgatgataagctctagtatatgacctattatatttatgacgtgagagactgagctgtataatcatttgacgaaattttataaaatatgaccgctattggaaggattttttattgttttgagccttttatttaaaatatgaccacatttagggcctctcttggagatgcttaagtgaagattgggcctgtttggaaagggctttcaaatcagctccgactctagcttttggaggagccctcccaaatggtataaaaaagagctatcaataaaaagtagtgaggagacagaaccatttttatatagagaagtcagagaaaaaaaactcttaggtgcttcttctcttactctccattttgcccttctcttgcgctaagaagagtcgttttaccaaatgatttgttaaaaaaatactagctcctatagagaagctgcgcttaaagagaagccagagttagagtaatttccagaggaggcgaagccgtgccaaacagacacataattattatagattatcaaaacatctctaacaatgtgctccgtaaaagtaccctaaaaatttaaaatatatttattttatataatttaggacacgaacaaaaaataagctctaacatcaatgttccaaatcaagtgattaaccaaaaagtagttttgtgaatagtccactcgtttaatctaaatatggggcatgctaataagttgcagtatatttatgacatttgaggaggtgacctatattttttaacaatttttttgtaaaatataataccattggagcaattttgtatgagttaaccactataatttaatttggggcactgagataagccacgtgaagatactcttacatataaactcaagaaaaaattaaaaagaattcgaacttttttgcactacgcatgtaaaaacaaaatagataaagacaaaggcagccaaaatcaatgtttaacgaagctaagagcatctccaaaagactttttatttttgactatctatttgactttttatttgtcactctataaagattaaactctaaatataacatctcattccaacagactctccaacatacaaattagcttggctagtgagatttgcttgccaaaattagctagtgagggagtcaatttagagagccgaatagcttgtcaagttaattggctagcctgttggagagctattttgctattaagtagctaaaatttagtttgacaagctatttagctagtctcttggagatgctctaattccatgtaataaatcgcctatccatgttatgtcttgataactaatgtattatcagtccatttgaaattcaactaataaaaccagctacggtgtcgataaaacacgtttagctacagtgtctacggagaacgccaacaaagccctaacctgcacaacctttcccccctcgcaagcaaagccaaacagatctcctcgtcgtcgcctcgctgtctcctccgccgttgcctgcgatcccgatc

SEQ ID NO: 3296 - DNA, 1500 bp, Zea mays
tctagagagttaaaggtggttagtctcaccttcaaaattaagagaattctaactaacttacaaaatggactgtacttttttccctggacacatgggtgacggactagtcttcggattgattaccattagcgtgtgggttatcaactttgtttgtttcaaagctgtgtgctccttaagcagaggctagaagaaattttaagggcttgtatctcctcgatgtaatgtgcttgaagtcattaataaaatcttcctgtatcaaaggaaaaaatgtacaccatctataaagttgaaaaggaagacatgtgtccacctacgcgcgcttgtattaactagccttgtaatttgtaaatctggtcgtcagttgacttggctrcccgctttggcccgtgaccggtgccaactagtagctggtatatatagtgatattattacccggtcggggtttaccaaccaactttattagccgaatttgtcaagggaaaacggtaacttttgacaagatcgagagggagatttgcgagaagattgcagttgttttgatacgttagctaggccccgcgaggtgcaatggcctccaggaaatgcctgaatggttagcaataatgctgagaacttgggagaaaccttctagaagagagtctacgtgaggggttgcgaagacgacgtcattattgcctcgtcctcaaatctattgaggtgaaaaagacatggctcttgctgctgcctagcgcggcgcacacggaaacggacgtgtgctgcctgtgtgaagtgcgcgaaggccctccctcactccccactgcaatgcacccaacacggatggcaccacccaccgcgcaccctgaactgaaatgctctctatctattaataaagctggagacagtgctaaaggggaaactaatcagactggctaaccgtggagtaagcactgcgactgcgagacagtcccacggccatgttcgttgaagcgaagaaagagaggcgcgcagcgcagccatatagctagggagggccgaaaaaggctacgccacaggctcttctggtcagagagagagagagaccgtattgactgacattgcagcaagcaacgagaagggcggctttggcaggccgaggaggccagagaagagcagcagcagagagagagagagagagagagagagacgagttgggtgcagtgcagagaccagggcggctttgggttcaataatatcccatcactcacacgccacggcatcattggccgcgctccctccttcctcctcctgctctgctcgtctcctccgagtgagtcccaagtgagcgcgccccgctccgctctccgttaactgccgcgttcattcagtcccattatattcaccgaccgcctcttcgttggagcagcagcagcagcaccacaccagcgcggagctgcaaagctcctcacggctgctttctcgtggcgcggtgcatgggagcgcggctctgagaggaaaagaagaggagaaaggcgcgcagggagg

SEQ ID NO: 3297 - DNA, 707 bp, Zea mays
caaacccgagcaaattaaccgacacctctacgccgtgggtaccacgccccccgggcccaccctacatggacccctccccagaccagagggtaaacagcgatcagttcgttaattaaccgatcaattccttaattaaccaaccgtgtggagggaggcgacagcggtggatgaaagaggtgtcctggaagcatcgcatctcgtgtccgcgtcgcctcattccatgacctctctctctctctctctcgcctcttcttcttcttcctcccctccccttctccccccatctgcggcggggttgattcgatttcgattcccttccccatccatcgcccacctcccctacagacagccaacgcaattcgctccccgaggcgcctccctgaccctgactccctccaccccacaacgtgcgcgctcactcgcgggcggggccgggcccgggccggcaggcacgctcaccgtcaccacccttattaattcctcttccgcgtccgcgcttcaaaacctcctccagtcctccgcctcgtcccccctcccccctctaccactctccgcagcaccccggcggccgcattgcttgccgccgcaccgtgtccggctagggcctctctgggctcctgcatttcgattccctcccctgcctgtgctttggtctgggccggttgcaaggagggggaagggagggaggatttgatcggagggcgaaa

SEQ ID NO: 3298 - DNA, 72 bp, Zea mays
ctctctyccctcagagcactgaacaatcattatgatttatgactaactctgagtggtgaaagaattaagaaa

SEQ ID NO: 3299 - DNA, 285 bp, Zea mays
ctgagtgcgataaggttttcttcgtttcaccgaacatatcctatgtacaaggaggtctttgcgttactgcgtactgcacatagttaatctacatatttcgtcctctatattgttccgtttatgtttttaatgaaaaaacaactcccacgctctttttttttcttcttctcacgcgtagctatatatttaagagaaagtaaaaccgcaaagcgaaggtaattcaccctcaccccttcggctattcctcgcccccttcccttctcgaggattcgcgtaatcgtcacc

SEQ ID NO: 3300 - DNA, 98 bp, Zea mays
agtaatataatataacccacacgctagctctctgttcatttcattgtttagttcagaattcagatactagcgttgcgttgggttgcgtcgcgtcgatt

SEQ ID NO: 3301 - DNA, 812 bp, Zea mays
tgtacatgagttgtgctgccttattgaggaattagtccgttaatccacttatatggtatgtatacatatatatccaacttcaacaaatgtccagttctctgcagaactgttagggtgctgaatctttagtgctaatgcatataagaatatattttggttaaaagatgatttgtgtgctgtgtcatagttttgtatcactttaattgttctatcaattttccacttgttttacatatgctcttgttattgtttttacccagtattacaccatgagtgttagtgaattacatcatctgagtttgtaactttatatcctcacccagtccattgtttgttatcagcattatatcttacctagtctgtgggtgttctagatatgcatgggcaaggcacatatgtaatgttgaactctgatgccattttgttactttgtgccaacagtgcgcaattgcattggaactatattctgcattgattttttttgctataacgtgtaacatgccatactatcatttagatatctgtgaacaatttatccatgaatacaggcagcgccagttaggtgtttgctctggtgtaaattgtcttccgttgtgatgttagactatgaacttggtagaaactgctgttacagtacgtattatatgatcgtctacttctctgattgatatccaactgtttctggtgcacctgtatagatcctgtactgtacaagcttgagctggagtgcggacggaagcaccctctacactggctacaccgatgggtctatcagggtttggaagatctccgggtacggctacgcaggctag

SEQ ID NO: 3302 - DNA, 169 bp, Zea mays
ttgatcaattatactactgtgcttttaggacatgttatttttgcttaaaagtgccagactttcagttagtgcttttggcttgttggaaatggatgaggccgagatgctaactccccatgcttctctctcctattatggtcaattcagaacatagtcttcaataaaagga

SEQ ID NO: 3303 - DNA, 1500 bp, Zea mays
tcattgtcaacctagcatacatatatagctccataatatataataagctagccagtagcagcaaagaatacttcatcgtctatgcatgcatggatctatgtgtagttagcaaaaacacacacatgtctgtaatctttgattctatgcttattgagtgcttcactattaattggatgcaacttgcaaagactgacttccagctccacacttggcaaagttaatttctttgccgagtgtcatctaaaacacttggcaaaggcgccgcctccgttaccgggcgccgtgacggccgctttcactaccggaatcaacatcttcgccgagtgccggaagcactcggcgaagccttaaaaacactcggcaaaggctttgccgagtgtaacactmggcaaagaaggctcggcaaacagtgcatcggcaaagacttctttgccgagtactttttctcgggcactcggcaaagatctttgccgagtgcccgacaaaaagtactcggcaaagatgttgttgccgatgtacagttcgccgagcgttgtttgccgagtgttacactcggcaaagcctttgccgagtgtaaaatagcctttgccgtgtgtttagaacacacgacaaaggagctgattccggtagtgtaggcaccaatgaatctaacaaggacaagttaatcttgtgttcgcaatggtgcatgcatttgcatccgtctctattttactctctctcactcgcttattttcatgcttgtccggacatactattgaactcaaagacaaataaacataagarcgctgatattttatcgaatattttgtatacgtgtgcacctaactagtgaatatttatatttgacggcaccgacggcctccacaggtcgtccgcgcaaagcaagcctgcctgctccagaacaggtttggcaatgcacaccggccggctagctggtcgattatcggtctcagcatggtgttacattccaaaaaggtgcttttttattgtgagcaccgacaaaaatgagtacccaagttcacagtgcacacacaaggagtggaggacccagatctacttgtaggagcgccgcgcgccgacgacacatgggtgttgcaacatctggcatcgggtcccgacgacaaacgtcagagacaacgcaacaggttcattgatcgcgaacatgggggtctcgaggctttgccctcgctcccatgcgcggccgatcgatggatggatcatgtggatccaggccaataatgcaacgagtgatcgtcgctaggtcgatcgtagctcgtgtcagcgtcagctcccacatgcacgcacggcctctgccggcctcgggccgggccagtccagaaacgatcgacgattaattggcacagcgtcctggtgatcagctccggttcctatttaaaccgacgcagcacgctgagaggtttggccattagtgctggtgtgtgtggtggttcgtcgatctcctgctaggtgctaagcttagctcgctcgctggcaacaaca

SEQ ID NO: 3304 - DNA, 599 bp, Zea mays
acaaacttgtcggaaacaacgttatataaaaacgtattttgtgaagctatatactctgtatatcctawattaaaattcgttttaggcttttaatagatttatataataattaatgtgtgttttatatatatgtctagatttattatcatatatttaaatagacacaatatttaagagctaaaataaatacccttacccataaaataaggcgtatatttttcttacaaaatttttaaagtgaaactttgaccattaatttttttaaatatgacatcaacaaataccgattaaacatcatattaaaatattttgaatataaatttaaatatataacatgcatatatacactaaaaatacatgtgttttgctaatggtcaaagttttagaactttgacttttttaaaaacatggatgccttattttataaaatggagagaatactaatttgatacgaaagggagtattaaacaaacccttaacaatattattatattgttattcgtcaaatttaggattgtctcaaccacccacgcctcatctagagttgacacgcgccatgtactggacgattggccgctggagacgacgcacgctcggcc

SEQ ID NO: 3305 - DNA, 1500 bp, Zea mays
gggggacagaggcaccaactggccgggcagcgatcgaaagcatgtctggtccggtaccggtaccccttcctccgcccggtgccagccgcgctgcgctacggcaccactagcttgctgcattgctttcctttctcatgcgtcggcgtcgtcgtcgccgccgcttcggccggctgggctttgcattgttttgatgtgcatgcatgtgccccatgtatcctatatccctaggcgactaggccctagctagctacgtagcagcagcccgcgacatgcatgcatgcgcgtgcgttgcgtgatttctctttgcgtgcggttgcttgctcggctgttgcatgctctcgccgttgggccatgccggcaatgccgcgctgtgcatgcacccccccatcggcatccgcatccgggcagcgagcgatcgactcgcgtggcgtacgtggccgtatcattgatccgtcttgtttctgctctcaggccgcgcagatgggcgagcgagatacggggatcgatagatgctgcagcattgcttgcttgttgatcgatgatgcgtgtacgtgttagcctgttctaatcacaaacgtatactatctcagttctacaatatttcttaaatatttatgttccgctactttattttttactaaaacatgataaataaataaaaaagagggacccgtttcggaacgtctacgtcaccagcagctctgcaactcttctgcatgaggtgccgggaatctacacttctacagtaccgtcgcgtcgctacgctacgtacctctctaccctacgcggtgccggagggagcacgcgccgccggcgtggcccatgagctggctggcggcctggcgtttgcgcgcccacggcccacgggcggccccgtcgtccatccgtgatccatccatccaagcgagaccaggccacaccagactggccgggccgcgacacgtgtgagccccgcacggtggcagcagcagcaacaaggaatctatagcactggcccaccgaccgccgggccccgctccgcacacccacatgcgcctgccgcgaccgaggccacgggcatcgcaaggaatctactatattctactagcatccgacctggtccacctccccggacccacctgtcggctgggccccggctgcgcaccaccgacccgggacccggccggcctccaatctccatgtccatcagtccatgtgacccctcactcggaaggggcgttgtgtgaagacgtgtcgtggatggcacgagctgcgctttgcattgcattgagtttgcaactgggccggctagactggtgcggtgcacgcaacgcaactgctaccagctgcaaccgcttctatatatatgccgagcctccaaggcacgcaaccgagcagtgcaagccaagcattctcctcacacacgtacttccgccagcgcagctagctatagctgttcgcctgttctcttctcgcgcgccatcatctctcgtctgtgatcaacgtcggcgcgcggccagc

SEQ ID NO: 3306 - DNA, 1500 bp, Zea mays
tcactatatatatgtacttagtgtaacaataatacattacaaacttcagattttgaaccaacaaaaggaaaaaaaattaaatatagctagattagctggcatggtataaacgaatatctgtcctctcgcaaaggcagacgtacaattaggaactttggcacatatatatcgcttttcagccgatgatatgacacacaaaacataattaataaaggagtagccctcggttagaccgacctttcaagtttcaaattaaaatagctttattgacatatatatatggcttgtagcgcgtacgtacgtacactttttatttccgctctggtaaaaaaaaattagtgagcaagataataaccacttcgtttcggtttccactttgtacattataaagaaaccaacgacgatgggatcggatatccattccacttggggcgtgcgtgcatgcgtttgccttccgatccgatcccactttacgctgccgttcctgtgtatgtgcgtgtggcggaggtcatgtcttttgcgcgtgttgctgctggtagtctacgcttcattcatcattgcaactgcatgcaattatcaggtggcgtccacacacttactatgtgtttggttcgaggtcaaaataggatgaggaggaggcgacaccgtcccctcaatttttttatcacaccgccacaaaaattactttggtattcatatagccccacgtgactctctctcatccaaacactatataaactatattcggtctcttctatcccttcttatacatccaaytaaacacatatagaagaaatcgatgcatgcatgacatggattaacgggcatcgccctcgtcgtcgtccttaacgcgcgcgctcgtatacctttcctgcgtcactttgtcgtggtaaagcaaaagcgacagagtagggaaataaataaataaagaagaagaagaaaaaatgcagttgtgtgtgcgtgtgtatgagtacatacaaaggacgaagagtgagagagtgtgtagcgagagaaagggagcgggaggagaggaaagcaagggaaagttcgttcagagagataaaggagtgaagcgaaaggaagcgcgaaaacaaaaacaaggcccagattcctcctctccggccggatcctctcacctctctctttctctctccttctgttgctgggtgttgttgttgttgctgttcccttctccctctctctccctccccatctccctctccatctccatctctgtagctatagggaggagatgtattccgacttccgagccccccatctccaaggaaattgcgacgagcccatcgttccatatctccctttaagattgacctgagactgcttcgtccacaccacgagtgcaagagaggtgggagacagacacacagagagagagagagagagagagagactggcgaggaagagataacgaaccagcatttgctgcgtcaccagctctctacctagcaagctagctagcggccggtgcgcgcggcggcg

SEQ ID NO: 3307 - DNA, 308 bp, Zea mays
atagcatcaggcggcatgagaccataaacaactttacaaatttaatttcgtacccttagttttgcgaccttcctcatttctaccctaagccgtatttttttcttagttttactcttctatttcatagactggaagaacaaaactaataaaaaaatataaataaggataaaaataaagacatcagcaaaactaaggacaccaactcaaaaaaaacccgatctatataaagccagcagatggaccgagctctatagagcccatcctctgcttcggcaccagcagctaaccgtccagagaacagaacagag

SEQ ID NO: 3308 - DNA, 615 bp, Zea mays
agcgcatggcggcgggggcggggacaggagcgggagcgcatggctgttgggcgagggcggctgcggatgcgggagcgggagcgagagcgaggcaatcggacggttgggatkkaggcggggttgatccggcaatcggacggtcgagatggaggcgggggcatggttgtgcctagtctacactattgccttaaggattagtagagatagagatagagatatctagattatatagtccatctaataatttatattgtttgtttgtctttaacttatctaacctagattatataacaggatctaagtatgaccggattaaaatttagacagctgggaacctatcaccaattttcctttacgacgtccagtatccgggaacctatcaggctcattcactgattttcctgcacccgtggcccagccagcactgatacaaacggcccaaagcccaatactgcagctctagcggtagcggccagccgggtggaatcttctctccgtccctggtctagcaatcaagcgccctgccgctctaggcaccaaaacctcgcgaggcaaccgcccgccggcgccgccgacgtagcaagagggtgagctgaggactagaggagagggaag

SEQ ID NO: 3309 - DNA, 529 bp, Zea mays
agtagaaaatatacacggaagattcaggatttgttgtttctgcaataagttgggtacaagacagcttctttctaggtgtccttttattaatgttgatgatgattccctggatgactttactctgcatctgattaaggccataagcattgatataccaactgataagcattgataatacgacatgcctctggtttttaattgctactggcgatatcttttatccagttcacgtaattacatgattttggaatactgcataaaaataagatcctcctgtctcaaaaaaaaaaaaaaactcagaagtccgaaccggcaaagcttcggcggacccaccaggcaccagctggcaggatatattcccatgcttatcttggcgttggcggagagtggattggccgattggcacacgctttcctttcctgcagacaagctgtaaatctcgccgagctcgtcgtcggagaccaaggagaagagcaagggggggcgcagaggcagaggcttgccagcctacctagctcgtcggggccct

SEQ ID NO: 3310 - DNA, 509 bp, Zea mays
ggtctgttggatgtctttaaaacgggattttgtgatactgtaggaatttttcggtggaaccatagcttttgttgcgatataccgctattgaccacggatcatcatgttttaaaatctttttttttcctcagaggtatgggatgatcgagtgctaaacgctccgttaaggtctgatctgcgtcgatcttgatttcaggatgcgatctattgttaaatgacggatgcattttcctgccatcctttgtgttgctaagccgtagtttattctgatgctaatttgttagggagactatatgatcagtctgtcttctrcagacagcaacttagatgaaacgcagctatgaatgtgatcatctaactctttgttgctgctgctgttctccttccagtttgtgtaaaacctgcacttgctgcacaatctatttgtcgaaagtgtgacggactgtcatttgtttctcttatcagaccgagtcctctgcttctgctctcatccatctgtagagtgcaac

SEQ ID NO: 3311 - DNA, 86 bp, Zea mays
tctgatccgtttgcaaatgcagtttggttttcatcactgggtaaggcaaacaggcaggcagcatagcaaatgggacgtgcatatca

SEQ ID NO: 3312 - DNA, 287 bp, Zea mays
ggtaagttaaaacctatttatgaagcagaagccttttagattgatttgcactccttcctataaagtagtaaatctactatcatatagtattggtggtgttgaaaattcttgcttcaaacatcttttgaacctcgccatcttatatctagttattcttgaactgatgaaagtttacaacaaagatgtcatttaactagcttgcaagttgttgcaatgggtgctaaattacatttcagggattgcaactggcaatagaatcagggaattgtggcaaggacaccattgat

SEQ ID NO: 3313 - DNA, 358 bp, Zea mays
tgtccctcaaattatccattagctactttagatggatcattgagcttttcttcattgcagatgttacaatatttctactttctagcatgaaacctaaacaaataagaataccaataaagtttcaattctaaaaataataaggacaggcctggtgcagtggtgagagctgtctcaccgagtcaccaggtcgtgggtttgaagcagcctctctgcatttgtggggggaaggattgcctcggtttatcccttctccagacttcactcatgtgggagccttcggcactgggtctgccatttttttatcgatttcctgtctccagtaggagacatctatttgtgtacattatgtacaaacgcg

SEQ ID NO: 3314 - DNA, 60 bp, Zea mays
ggtgagtgggaaggggcacgagggaagcagcatgggaatgagtttgttgacttgcacacc

SEQ ID NO: 3315 - DNA, 109 bp, Zea mays
gcggcggctcgagacgaaactacggtgctcgtctcccgccgcccgccgcccttcactccccagcatacctagtccctactctaatccgtacagagcaacgcatcaagtg

SEQ ID NO: 3316 - DNA, 990 bp, Zea mays
ccttcgagtttctgaggccgcgctccgctataattcaccgcactgtccggtgtgccactggactgtccggtgcaccaagcggagtaacgactctccagcgcaacggtcgactgcacagtgccctaacaacgctacagtacgcggcagaagtcagaggcgcaccggacagtgaacagtgcctgcccggtgcagcaccaaactgtccggtgccactagaagacaaagtatccaacgatcgtctgcgcccgaaccctaacggttgggtgacgtggctggcgcaccagacattgtccggtggcgcaccggactgtccggtgcgcccatcgacagcagccacccccaacgattgttttggtggttaagggctataaataccccccaaccacctccactccaaccatccaagcattcaacactctccattcaatacaggagcaaagtgcaacactctaagacacaaatcaaagccaccgatccgatcaaagtccccaattcaattctagtgcattaggacttgtgagaggatcacttgtatttcttgttgctcttgtttgcttggcttggctttcttttctttctcacttcttactctcaagtgctttgtaagcgaggcaagagacaccaattgtgtggtggtccttgcggggtctaagtgacccgtgagattaaggaagaagcctcactcggtctaggtgaccgtttgagagagggaaaaggttgaaagagacccggtctttgtggccacctcaacggagactaggttctttagaaccgaacctcggtaaaacaaatcaccgtgtcatccgctttatttttcttggttgatttgttttcccctctctcccggactcagattttattctaacgctaaccccagcttgtagtgtgtttaaagttgtaaatttcagtttccgcctatccacccccctctaggcgactttcaattggtatcagaaccgatactttattagagtctaaccactcgaagtg

SEQ ID NO: 3317 - DNA, 271 bp, Zea mays
ggtacggatcagactaacaaaatcgctctacttccttaaattggatgcacatcttacttccatgattctgaatgattaaccagaacgtcaccatactctctcacacttgaggacctgggatacttaaacaagttttcttacaagctggttatgtggttgcagtaacagaatactctattttctcttctaacaagaaatggataggaagctatagcatactcagaccaagcaatttcttaagagcataccttgcaatcgcgcattctaacag

SEQ ID NO: 3318 - DNA, 579 bp, Zea mays
atttaatccttttaatcctcctcaaaccaaacagacccttaacgagagtcatctcattcaacgaatagtttcgatgtcaaatggcaatgcatgggtgcatgcatctgaccccaaggatacgacgatcatatcgtgtccgtgcatgtggggggcgagcatacatgcaaatgcaatacaagatcatgataggagcttccgattttaacaccagttccgttgcggaggcggaggagatcattcagagcaaagaatctggatccagatttctcactgcaggtggggccttgcttgccacgtaacacaagttttcttgccagggaagtaaagcaacggaaaccgccgccaacgccgctccacgttaactatcgcgctccagccatcaccgcgacgcgaggaaagaaatcaagaagaactcgcgacgtcctcgcggcgacgttcggtccctcggccggctcgacctgctagtccagcctcgcccaccgccccgtcgtccgtccgcgcgcgggccgttctcgggaggaacccaagttcccgccgcgcgcgcgcttcttctttgccccgcccgggaactcaactcac

SEQ ID NO: 3319 - DNA, 445 bp, Zea mays
gaccaggttttttagttaggaacatatcaggtgttgaccacttttttcaattgctacatagtaacaaaaataagcaatacaagttagaagattacgactttcttccctctgttacttcttccccgaaggataattaaagaggagaaggtaaaaaacgaggacgaagatgttatgcatcgtataaagagaaagtaacctaagggtgaaacatgcaaccagggtgttcctgacttttgaggggcccggaacaagattataatcagagaccccaacaccataaaaactgttttttactattatatatatatatatatatcaattaattatacttgatgtaccacagaaagacttgagcagtaaaaaatagaagtaagattattacctcaaatatattgtagagatcaacttaaaatgtcttctagcatttctagatgcaaaatcatca

SEQ ID NO: 3320 - DNA, 1500 bp, Zea mays
ttttattataacaagctagaaaacatctcatgtaaaccgaccaagattcagtctacgacctacctcccaagctatatgagatagggagcctccaatccatatgttgatgatcatagcaactctaggcaattggtcatcaacatccctataaacaccaactcaccaagcttgtaagataatatatatatatatatatatatatatatatatatatatatatatatatatatatatatatatatatatatatatatatatatcctccactgatgtaggaaacctagtacacgaactagtataatatgtgttcctttatgctacccacatgatttcttgtgtgtgtttcactcatttgctaatctatattatcaaatccaaatctgatagctactaagtcagatatgattgtaaagcaatagtataggcttgcaaaattatgatgcagttcaaaagtgaatctccttattgctttcacaactattaaaacatatacttgggcatatgcaactagggatggtcagccattgtacctgataggcatggatgtgaatatgaaacttcacccatggttgtaggtatacttatacatgtgtgagtatgttatttcaaaaaaattgaaatttcaaattctaaaaaagaataagtagattcataaaagatatatgatatgaatagataaaatcctagacttacaaaagaaattgcattagtgaggaattcatataaaattatgaaagaattagatttctcatgggaaaaagtttattgatgagttagtcgctttgataatatggttagctccaatattctattatctcttactgcattatcaaaatggatttcatacatgtgtaagtgtgtcatttcattcagtcatgcttaaaatgcaaaggattatgtctattatagtgtcaacgtaaccatgggtgaggacacatgtgggcatgggtgcaaaatgttacctccgagtatagatgtgggtataaagttttgtcaattataaaattgtcacaaaaaatattcatttcatctgtgttytactcgacacgctatcattcctaaatgcaacacaatggtagcaaataaccacaatcctactaaacataccttgcatgtccaaaacaaccaaatactaacttgttgcatagtttatgctagtatgtactatatattgtatgaggcaccatgcatgctaggactagcacaataaactagtcacaacttagcctacttctatgcaatcccctcttagttaaggataaacatggtattttaaaaaaatgaaaagaaaaataagcaaggagcatgcaaccacaagatacayaacacccaccacaagtctaaatttagcattacatccatggttcctagccacaacaattctctaccacctccaaacacaacggccatcccccatccttcaccactcccgcccatcccttcgctccaccacctctgagactcctccttcacaggccggcgtcgtcggtggtcggagag

SEQ ID NO: 3321 - DNA, 151 bp, Zea mays
ttgatcacttctttttacccagtcatgttcttattaatcataatgatctgcataggttaattttgctgggacccaataggataccctagattttgactatctttataccttgtttcaccactggttttactacaaaatttttgggtagtac

SEQ ID NO: 3322 - DNA, 67 bp, Zea mays
gttttaaaatctggttactcggcagcatttatggatcaaccgactgttgatccaagggcgcctgtgt

SEQ ID NO: 3323 - DNA, 443 bp, Zea mays
cataaaaaactgtgcgctaccacatgtaaatcctgggggaaaaaaaaggaaaagcgcgaagccgcgaacaatagaagactcggacctcccccgatccccccgccgccgccgtcccgccctcccaagaggcgcttctccaccttccgcttccggcttccacgtttttacctctccgtccgtcggtccgcccgcgcgcgtaaccccatcattgcgccatcacccagccacccgcattggccatcgccgcgccggacgaccagaccaaatgccaccgatcgccataatggcgggcaggtacgagtaggaaggagaggggggtatgggtatacactgcccgcctgctccatcactccactccagtctccagagacctctgaagagcccgcgtcgtacttgtacccgttcgttcgcgcgcccgcagcgtagcgcaggcacgccacgcg

SEQ ID NO: 3324 - DNA, 1500 bp, Zea mays
tgaactgcttctcaaattaaattaagtatttttatgtgcttataaaaaaggtggaactgacgtggaataaacgatgatattttttaatcgcaacatgaaccctgctgatacatagtggtagtgttttatagtggaacaagcgatgagattttttaagcgcaacctaaacctctgtccatacagtgacaccataacccacgtgagaattgctttgtcttaggacaaagtatttttttaaccataacctaaatttgctcccacgaaaagtcaaactcgggatctaagtagtgctatttagaccatctaatcaactcagggggtgtttggttagagggactaaagattagtctctagtttttagtctcatttagtcccttttttgccaaacactaggactaaaatatggactaaaatgatttagtctttagtccttcacataggtgctaaaacagactaaaagcccacatgagtgtattccaaaggcatttgggtcttgtggacaatgtatttaatgactttagaatctatttagtccctataaccaaataagtagggactaaagtttagtcttaagactaaagtttagtcctaagactaattgaaaccaaacatggcctaaagctaaatgaacatgtatatgtagatattgctgctagtggtacaataatggccactgagagtacgtacgtacgttgctcctggcacaatggccactgaaggcttcgagctctgtggccacggcatacctaaattctggaataataattaacagttgtcatgctaaaaagtttcagcagagttcaggtatgaatttcggtgtttccttaaatgaacataaatacgagagccatcgattatattaataaagagagagacttagggcatgtacaatggagagacaccaaaacggttctccaagcacaggagacaactaagagactctattgtacaatggagtgtctataaacgtagtctattaataaatacataattaaatgtatttgtatagtatcagatcgatagaacagacgacaaattcgtacagtgagaagtagggcgtctgttgctacttggtttacgagccagaggcgtctcttcacggagagacgactctaagatttttttgcaaataacccccttaaataccttaagagactccacattaaacaccactgtacatgcccttaaggccggaccgtccgcgagtccttttttggctggccgaaccgtccgcgaagcctatttttggcttccaacaaggtgaaaatgaactaattttttctccaatttctttcaatccttagagagatttaaatttccaaactagccctcatgaggctatgtgtggattccagtggatttttttttcgtccggacggaaatgacgagctattgctaacgaggaattcttcgttgccatgcgtacaaagaacccttaaaccctaatcctcccccgctacacgttcgcttgatctttacggccgccgctactcgttcgcc

SEQ ID NO: 3325 - DNA, 181 bp, Zea mays
tccttccttcgtcgacccaaaaaatgttatgggctgagaagaaatagaaagtgagtccacgaactctagcactccgggcggaatcgtgtgatgcatgcatgcacggcacggcacgagagaaggacacacgcatcccacggcaggcgtgtgtctctgtggggatccccaagccagaccagag

SEQ ID NO: 3326 - DNA, 1500 bp, Zea mays
ctatgctaacgctatgttcctagcaacaggaggagaggggtggacgatgatggtggtagtgcgagaggatggattgatggtggtggggacacgaggaggggagggctaaatgatgataaaatgatattgttcattagatttgagtgagcaagagagatgatgttatttaaggatctaaactgttgattttgaagttgtgttaagtatgtgtgtaatttgtttgattgatttagtaaatattatgggtgtgtgggagatatttggttggatgagttttgtaaagtttaaaccggtatattatatatagtgttatagatactaaatcttggaccactaatagttttaggcccccgtccatcgcctctgtcgcataggctcagggctggcctagctagtgtgtatatctaccagccggcggcttctttcttacagctcttggcgacaatctggtgaaaccaagagatggccagaatatatcctccctagctagtaaaaaacggaatttaaatgtcactccaatctcacatatttactatgttagtaattagctacgtacggaatgtggtagtaaactagatcgccgtttagcatatgtaataacgtttagcttgattgtatgtagaccgtttacaaacggttaaagcctttaattcactatatgataccctaattagggcgtgtaaaacccatttaataggggtctcttgaggagtctctaggatgttaattaaaaaaatacaagaagagtttgtctctatacagttatctatacgaattgtctcttaactatatttatggtttcagggctcaggattataccatgtaaattttttgttgtctcttctacttaaaaatcgttccaccgtctcagggttgtacatgcccttaaaccaacacacatgactaagatttgatcagttcccatggcgacatgcatgggtgcatatatagtagtactggtcccaaattaaagatgagagtgaggtatcgatctcacacacaggctacctagcattgcctgatgaagttgggaactggaggaggccggacgcaaggaggcatttatttggttcctccaccccagctcgatcggatctcctggtgactgcattatgcatgcatatgctaggtccccatcaatcctggagattccccggccggccctgttatgactgacacggtagcagctaggtagcatgggacgcgcctcatcgatcagctctgtagcacgcagcgctgcactaccaaaccctatataaaaagcccgcgtgcgcctcctccctcctcaaaccaacgaagaagaacaagccttccactcagctagcatccagagcaagcgatcgagcgagctctctcggcttgctagctagctccattatatataacatcgatcgcttgatagtttttggcagctagaggaagaagagagagcagctagtacactagtacagctagcagagcaaaaccagcaaaggcgcgcgatcaggccagaagagaata

SEQ ID NO: 3327 - DNA, 525 bp, Zea mays
aacctccctgcacttgttgtagttcgacacgggaagaacagctcatcactttttcttgtagctgcagacaagtggcaagcattgctgacgtggagctagctcacttgttgccggtctcaatgtttctgtcaacataccagtaagctaagcatccggtttggcaacacgaacatgagggccgggcaccagattaaaagctggacggtcgtcgcatatgttcatcaggcaactaaataatgcggcacgagtcgccatcagcttaccggtaaagcaaatcctcctcctcctctcgcagagactactactctaacaatgcaaagcatctccgtgccatgcccatcacacaatgagaaatcttaatttgttttgcttctctctctgtctgtccctttttatatgaaaaggaacaagagataaaagatacaggaaccaaaaggcgacgagctcaaatctgttctggtgtatccaaggaagagcccatatatacacctgaccttacacggccataccaaccaggacagatag

SEQ ID NO: 3328 - DNA, 531 bp, Zea mays
tggtctttgaaaggcgtcgtggcatcatccgaagatatggccagacactaacaatttcaaaatttgaatttcaaattgtgggcacttaaaacaaaattttgagaccgtgattatttcaaataaaggagttatcaattgcaatgtttacttttaaaaacctatagccatggttatggccattggtcatttgagaaattcgacgattttggatttctagaggcggctctagatctagttgcatctaaagatatgagcgtttttagaggcggttataaatccaagttatctctaaaaaaacgttttctagaagcagtccaacaagagtacgattttcagagacaagttttgattgggccgcctctataaaaaaagtatctattgctaaaaattatttgcgtcgaagtaatagcatcattctcgatttttaaaattatccaacagtgataacccaccatttggccacctatatatgtacgtagctagctagccgaacgcggtcgatgataaataaagcattcctattaatttgta

SEQ ID NO: 3329 - DNA, 174 bp, Zea mays
cgccacatcatcgccatcctcatttcgtcctgttatctcgtagctccacagtccacacccaccatctcgttctccctctcttctcctctccaaggtccctgccacccacacaaggcttggactcttgggccggccgggggggaagaagacaagacaaacgcagccgccggcatg

SEQ ID NO: 3330 - DNA, 1500 bp, Zea mays
aattaatcagtaaatcacataagcatatattatacttttagagggtctccaacagcatgcatgtgctagtactaaactctaattaatctagaaatagtagatattattgagaagaaagagagcgtggcaaacaatcttgaacagtactgtgttatgtaatagaaatgcatcgcgaaatgtagaagaatatctctctcaagtcaatactaatctctagcttggtctgtgcattattcaatgattgaaaaaaaataattcagctagctctaagctaatccctgtccctagcgggtacaaccccacatgagatcttgatctggacaggaggtcctcgtgaattatttggatggcaggtggactctcacggccggctgtgtgtgagtgggtctttaataaactatatgatagtgtatgattctatttcagacccctgtttttttcctccttaaaaactgggtcaattttttttccttaacggggcgtttggatcccttcattttagaggaattggaattcactcaataaagtaacttatttagtttggaatttgacattccaccactttctagagttcagatataagtctatctcaaattcatgaggtggagggtgcgaaatgattttatgcattactagaattggtttctaatctataacttacatgacattcttcgtttcactcacctatagtaaaaatgtagcacataaatatctccgacatcttgctaataatagtatacaaatatattttgcataaaaccgaattagcttaattaatatatgcctaaattactattattagaatggaattcaattccagtgatccaaacggggcgtaatagaattacaaatctctcgcgccattatgttggctcatgaatcacattggaggtgtcaattaaataaacattattctctcactggataaaaaaaagccacaaaaccaggatctcggaaattaaacgacagcaagttagcttttgcgtgtattaaaaaaagagccgactggtgatcgagtggtgaaaggccacaagcagcgagaaacattattatatataaagagattactagagcgaggagcactgtggctgtgagtgtggcgactctagctacaaaagggtgcggtattgtttagcacaggcaattagtaccattttgcggatcatttgcaaggatttgaggtaaccaagtttcttactagctagctagcattgcaggttcggatcataatacatttgtaggaagatggtcatcacatgcatacagcatatatatatgtactatgtagctttcatttaaacggattaaaatggttttgagctatgatttctgcaaatctacaatagatacactcgtacgctatccaaatctcaagctgcattctgttccagaaaatataattgtttctcgccgtgcgcggaagtagaaaagaagaagaaaaaatgtttctcgacgtggaagtagtaaaacaaaaacgtttcttgtggctgcagcatggac

SEQ ID NO: 3331 - DNA, 1500 bp, Zea mays
gcaggagacctcgtcgctggtttgcctccaaatgtgctcgccacgatcgcagccgtagaggaagacgcgggccttttttttgtctctttctctttctctacctgccgcgcgccggcgccggcggtgagcagaggacgcggcgccaggtgcgagcctcccacgcctctcggcttctctcctctagagggctctgagcctctgacctccaactacaaatggttaggttagtgcagcgcatgaaactcccaagaccaccttattagttgttagctggagtgctagctactactatattagcgtgtcaagaatccatctctttgttcaggcatgtatatagtctgccaaagctaaaataatgccgcgcgaactgctcctcccaaagttctccagatcaagtaacactgttcgcctaaacggtcgtgtagtctgtttgtttactttttaaacgaagaagatttgtcccgcatatcttgtttccatttcacacacacatatataataataataatatgaatgtgatgggcgtcattgacgcgcaggcgcagaggtaggctaaccctatagcttgcgagcatgatccgcgtaacctgtccgagaacgtgcgattagcttagcagaagtggtgtaccaatagatcagccagattatattatatatctatactacctattaaggctgtaaggggtaggctgcctcccctggttctgccttcggtgaatctgcaccgtccgttcggttcggcaaatctacaccgtccgccccccacgcccacgttcgttcccccacctccccacccccaccccgcgtgagccgccgccgccctgcctcccacctccagtccgccgctctcccacggatcgtgctccctccccatgccctccttcttactccttaccgcggagtccgaggccactcgtggccttcggtgcctcctccgcatcggcgacctcgcctgacacggctgccgtctctcagtcggcctctcttcacccttcggcctggtctctgctcccctctcttttctggttgttccctatggatggttggcgcctgaagggcggatggatccgatggaaagctagcttctccggatccggtcagatcatatctcccggtaacccgttccgatcaacctcttccggtattttttcagaggaaaggttggccaacggcgttccggtggttggatttgtatttggtggcggtggactccggttatgtccactgattgcttgctgttcggttcgcttaagtggtaaagctgatgtctttaggttagaagaataactaagattgggtaggaaggaaggatggtggattgggtagctagctgctggctgcttggttcaggagttggggttaaattagcgtctgaaatacttgtttggtttaggtattcctatgtagacgacctgattatgattcagggtgatttatcgtagcagtaatctgaagtttggtgtggtgtttgatctgtgtgagtcttgtgttaggtgagtc

SEQ ID NO: 3332 - DNA, 1036 bp, Zea mays
acaaatcacaggccatgaaccctactcatgcttcgatttgtccaacacacacttaccaaaactcaaatcatgtccttgacagtcactcgggactcataacatgggtacgtatcgcctatgtcagctatatgtgttctcatcagattatagattggcctagtacgtagtgatatttccactagcgctgtggttatggctgtacctgatagtgatatcagcaccgggtcatggctctactaccaggtagtgagagtgacctttatactgtcagactgtaactaaggatttccaatcactgttcggatcctaggcttagaattaagtaaaactctatcgctataggctgcagcacactcggtatatattgatgggccaacagaaattgtgcgtactatgcgcgatgtaaaatggacataaaccctacccatatacaatgcaataacttttgtccggtctgggccaccggttagcagaggtcctgatttcggtggtagtggtagcttgatctggtcgtcgtatcgtagagggatatataaaatcatgtcacttttaaagggagcgctcacagaaataataggtattcgcgggagccgcccccgcagaacacaaaataaggcgagcacgcacacgcatcagtttcgataaaataataatagcgccagctgatcggaacaattccagctagcactaatgtatttctgcattgatctgtttatacaacatgctacctcgttgagtgattttgacatgatttgtcaacttgctccgatcctatatctcgatcgatctccacatgacgatggttgttgtcctgtatcccatgacaaccaggcaacgctcaaagcacacatgcgttgccgattacccgtgcatgccgccaagcacgaaagcacctccctccacaccgtccatcagctataaaaaccatgccaagcaccctgtgaaaagcatcccaaagcacaagagcacgcactgcagcaccacttcctgcgctgctgctcatcacacaccgtagtactaacactccagcgccaca

SEQ ID NO: 3333 - DNA, 723 bp, Zea mays
gtttgtaattttatacaaagttgtaccccactactataaatagaaaaatactgccatgcatatgacaacttttggagctcaagagtgccaccttgcttcacctccgaaggtaccttctagtttttaactgtaaagtcgaaggtatatttgtaaatatatgttatgttgcaaagatgaaatgaactacactctcatttgttttgttgtgtaacatgttaatgattgaataacttttatcctgagctttccttttgatcgactttcaaaggaaagttaaacaaacgagagaagcttaaattgtatttacttgtattgccttgttttatggtattcgtttagaaaccaaaaacgagtgaccaacatatgtatattatatagagcagttaggtggaccaagttaattacaaagggatagtcaggtaaatacaagacccaaatctaaccctaaatatgagtgtaacccaaagaatcactttctaccttaaattttatagatttttgcaggtatgttttaatcaaacaaattttagttttttcataattactggctcagagaaagcaattggattttcagcaatctacactctacagtgaaccaaacaaaagcctcgagccagtgtggtgtggggtcgcgtgctctcttctatcctgctctgctagtgccaggattccgccctatccatcccatcaacctcagctaaggtccccagcggcggcgaggcg

SEQ ID NO: 3334 - DNA, 825 bp, Zea mays
aaaaataaatattttaattcactgctcactgctcagtatgaggaaattttgtccatatgataaataaagctgggaataaaacaaggatagacctagtgttggtggctcccacatgagttgggggtctagggaaggaatatctgaggtaactgcatttttgcatagaggttgtgtcgaacctaggaccttcagctcagtagaaaggcttctcatcaccgcgacagacctatccttaataaataaagctgggaataagggaaatcatagaaagcataacaacaagtccttacatggcaccccctccgtcccaaaatagtagtcgttttagctctagatttttatgtccacgttcatatggatgattatgaacctagacatatatatagaacacatacattaattatgaatttaaatttagaatggaaggaatatttattaattaacatatgaatatagatgaaaaaagagagttaaaagaactatatttttgggaaggatgtagtatacgctacgatcgacatgctaaacgcgatacggcatacaactgcatgagcattgtagcatgcaatacatgcaagaggttagaagaaccagtgaccaaaatctcttcttgtacagacgacgacgttcctaaatagactgcatgagcctgccctgaagcgaagcgtccgcaagggcaaggccgcgcgagaatggtgggcacgccacgagaaatcatgtcagtagcgttgtggcttgcccatcgttctcgcccggccttctcctctacacacctatatatatatggtaataggggatgccaacgcctgaataactagacagaca

SEQ ID NO: 3335 - DNA, 484 bp, Zea mays
gctcgacgccacgacctgtgacgccgagaaaaggataaaaaacgggaatacttctcccgagggtttaaatgtgatttttaaaaaaaactaaaatacaaaaagttcagctttgttgagccacgccatcaaaggaccaatgcgaaagcttttttgtttggtgaaccatgggatcgtccacttcattccagcaggcagcagcacgaattttccagcaccacggtacagaaaatatgccggccggggcggcgcgccgcgccggcgccttcggcaaatccacgctcgtttgtctccatcccggccggttctttctgcgtgttctccttgtcaatttgcgccttgtattttggcgctgggcagtgttgctggcgctgggataaggaagtggcaactggcaagcggaagccgtggcggagatattatataaggacgaagaggaggaggaccgaccggaggaggacgtagtgaggccctgtagtggagcggg

SEQ ID NO: 3336 - DNA, 1500 bp, Zea mays
tggttgtggccgcgttggcccaatttgtttccaggcccaagaaccaaagcatctttttggtctgagatagggatggcaatggcctccgatcctcgattcccgacagtgaattcattcattagaagatagtgatagggtttcttcccccacgaggatgtaaacagggaaaaatcttttcctgacgggtaaacgrggatgtgaacgagaaagcattttctatgcccattccctgcgggactcgttaaaattgtatgtgatgatatttttgtgtactagctaatgataaaataaataattactttgtcaagagatcaatttttgtacaaatatgttcattttgatgtacacataatgattttcttacatctaacaatatgtataagtgcaaatgttttgtattaataaaacatgatgtatgtcttaattataatttaaatggggacgaggattctcgtcgtggatttatccccacgaggacagggatggggaagaaacgtccctcgcaagtgttcgtgggatctctgtgagatttttttgtcatgggcacractacgaggagatattcttcgatggggaatttctcattgtcatccctagtgtragagaaatgtgtggcgtgctaatactagctagtttgtcgattctctccttccatgtaatttagctggctagatagctggctcattggagacgttatagggctatttggtttatttccctagctagcctggctcgcatatggaaaccaggctgcacagagccaagtcgaggaagtgtatatacgcttgtttagttcacttttctagctagcttggttatgttgtttggttgctttgtatgagtggttgcttcagattaaagccatctgtttgcactaccgtagctgcaaaacatagcgacaaaacactgtaaaaacaatataagactatacggattaaaaccaaacaaacatactagtgtgagaggtcaatagcatgaacgaatataacttaatttggctatgcattcccctctttctcgcagatagagggggatttcactatttgcatccatttaataatgagatcggtgaaagactgaaaacaaaaccacaaattgcatttatgattgtttggaagagcatcaaaactgatttttgtatagcatctttgrtgcaaataggtgataattccatatcaacacaggagcagatgcgtcctgaaaatcggaaagcagttcaagccgtcaaagcagcaaaaatatctctgcttcgatttgcatgagccaagcgataacaacgctatcaccgcgattcaaggtgtaacgaggaaagaaagataaattttgaagaaaggaaaaatcctgagaagaaaataaataggagagagagagaagctctctgttccactcttttctaacttccccgtagctctctctctcgctccctcacgctctctctcctcaccatttttgctcctgccgagagctcgccaagctccgaaaggcgcaagttttcttgcc

SEQ ID NO: 3337 - DNA, 264 bp, Zea mays
gacctgcaggagagaagagaagcaccgcaaccctaggtcgccgcctcttttcctctccactcgtccgcgcgacgcgacgcgacgcgacgacaaccggaggtattcctctctcctgctccttctatacaggatctcttatttcctcgtcgtggatcattcgttgctcggcgaaaccccagcccagggatcggtccgctcaccgtttggtttgttcgtagggttttctgcggggatttgtttgtcgccgactcgccggcagccaag

SEQ ID NO: 3338 - DNA, 239 bp, Zea mays
ggcagaatggtcaaagactagagctatcacttattttttatgtggcaccttgcacatctatcatcaagaaaaatacaaagtcgacgcagtcatgcgtgaagcctcgtcagcaccgaacctcgaaagatcagtcttcatagagtattggaagattaggcttcataaaaaccagatccttccaacatctgtacaggccagaaagtttcaacgaccaaagactcaaaagaaaataaggagcg

SEQ ID NO: 3339 - DNA, 821 bp, Zea mays
attttttcccaggtgtccatcctgcaagaggagttagaagctaaggatctagagctgactagattgaaggaggtgcttgcccagaaaggagctactcaggacgcaccggtggagaccagtgacgacgctggaaacggtcaggaggcagattcagatacactgcaagtgaaggcggaaagctaagggagtttaggctttgaagtgtgtttgttgggacttgtgggaaaagtaatatcatgttatgcggtctcatagcatgtctaggttattatatagtaggggaatcactgcacaaaaacatcggcaaacttttatctatgatcgtacatatggctttacaaaagattattttgcattgtagacaacactattatagtgtggattttgaaattagatatataataataatatagatgagtaagctgtgagtaagaaagcctcaaactgattcgctacagatttgcgctggctgaaccagtaatgatctccaacaattcatatgaatattctcacatgcaaggcattattcgtcatttccgttaagcctcagctggtgctttaaatgtttcggatcccacatgtcagtgagccatccatcagcaaaagcgaaaaagacgagccacccaagagtaaccagaagcagtcgtcaaagggccaaagtcccctgctccccgcccggcgcccgcggcccgccggctcaaacccctaaaccctagccgcaccagcgccctattccctccttcggcggctccggcagcgggcggtcactagcaaccagcatcgtacggggaagaagcgccgtttacacccatctggcggag

SEQ ID NO: 3340 - DNA, 1197 bp, Zea mays
aatagagtactcatacctttagatacccattaggatgttcttattttcggaagtctatctcgaaagaacatctgtgttaatgtgttggtctagagcaatctggagaagggtgatgacccgagaaatctttttgggtgcacatgactatggacaaagtgcgcacataagttagagggctactagaagtaagtaccactggttcaggagtgtacggaatgttacaaaattagttttttatttgtgaatcaatacatacaaaaaaggattttatgtatgtatatcattttgaaacattcctagtattatcacttagccttagtattatactaaaactaattttatctagtgatctagcataacgttttgttttttatattgtagccctatatagaattttgtcctacgtccgctggctccacggcaacggccaagcaccggtgcttctccacgcgccacgcacgccatgtatgatgagtgctttttaatttgacatgaagacacgtgccccaagccaagaggccaagaagcaagagtgcgaatgaagaggcgagtcgagcagccaccagccggcacgctctccatgtattatggttgcattgaacttgtctttacaccgttgggcgccgcctgtcgtgtccgatttcggctccggcgacagcgagtccgagtcggagctacaacatgaccccgctccactggtacgacacttcatgccaccttccttctcggccccatctgtgctactcacgatctcgtccgtaattaaactacgaacagtacttataacctaaattacaatcttaagccatccggatccgtggcgcaatggtagcgcgtctgactccagatcagaaggttgcgtgttcgattcacgtcgggttcaaaaccccgaacaaaccggatcatttttaatttctttcctttttgttttgtttcgctttattttttctttttggtcatttttgctccacaaaattgaaacattccacggcccagtctaccggcccattaagcctgcccgtgtcgccctcgcccgccccccaaaccaaagggaaaccctcaccacgcttcccgaaacttctcctttctccatcctcaaccctactccccccttcatccgcacgaacgaagcagcgcgagcgaggagcagacgatccttcccgacctcgaagcgtacccccccttccagccgcagcc

SEQ ID NO: 3341 - DNA, 853 bp, Zea mays
ggcgagtcgaaataagctggagagcatcaggccaccggcggcgaatagatccaccaccgctatcgcttgaggggtctcgatacgacgttttgtagctaggttggtggacagattaggatgagtaaaacggctacaccccacagctgctgaaatcgtttcccccacgtttctatgtatggaagatgcggtttgtgtgggtttgctaaaaccgctttcctcatcctctacggagcggcgtgcatgggttgtcgggctcttgtcacggtgcatttggcgtgggcacacttgccatgtcggtcgttgctatgaacaaaagacatggcgtgcgtgggtttgtgttattgtgtgggtgactgtgacgctcacacgacgtgcagagtgttgataaacgaattggattagatgtgatcgatgtgaagagaatttgtcttgggggccatttcaagcaatatgagttatttgtaaaaatattccgcgggacgaacgtggaaaaatggtgcttgaagagaaacgacgatacacaacagtttcactaggtacatgtgtacatgtcatgcctcgtctcgggtcgatacagtagggtaacaagcatttggtgcacaacacatgcatgatgtcctctcctattcccatgcagaattattaagtggagcacgtagttctaagagttatcaatcaatgagtcgtttcaaattctcatatcaggccagatagtccgtgaaagctgctatatatatttaagtatcctgtgtttctccatcaagctctcaccctctgcccttcaatctacccagaacatataccaagaaaactagcgtgctttaggcttaggattaggacttacgattacgag

SEQ ID NO: 3342 - DNA, 459 bp, Zea mays
gcgaatcgcctttgtttggtccttttatatatcttataaaccctcatttatactccaaaatatatgcattttactattgtaaaaagaagtaaaaatggaaaaatgattctctaaatatcctaccgtcatatctcttgagccttatccttgtcgtagtctcttaagcaggtaagtcaagctccctggaattctctacacgcactctctttctcctatccttatctgccattttgtcgtcgtatttatcttcctatggaactcgctctgcttcctgggaaaaatcccgccgcttggagctggccttctccctcacgtttctctctccctcatcttccttatctactacgcgcgctggatttccaccgtatcccaactcggctggtcgcggctctttctctggccgcgcgcgagctcctctgctgaacgctgctgttcggctccctgctgcgtctccctgcc

SEQ ID NO: 3343 - DNA, 1034 bp, Zea mays
tagaatgaagataaaggacaagtcaaagactacagagacagagagaggaagtatagcactggcccacatgtgtaattaagtagcttgataaagaatctcgtagggatttttacaaacactgttatggactcgtcccttacgtgtttcctacaatcatccgaacacaattcaacaaatgttcctatatttttatttgtctgttttgcacatacatctatgttatatccctgtgttttccctgttcctgcaatttttttctttcaaaggaggactaagcaaagacctccttccgtgcttggcctttcccgggagcgtgacgctgccggggccgttttcgcgaaagcaggacgcacacaaacacacaaacaaccaagcaacaatggcaaacgagcgagcgcggaggaaaagccaccttttcttcgagttctacctctagctggtcccgacgcccgagggccgacggcgagagcagaccgggcctcctccctgtgcggaaacagttcagtcctgctcggctcggcacaccaccaacggttacgcgcctacagacgccgtgccgcggcgcccgaggacaaggaaccccaccaaaaccacccgccgaaaccgagccaaaagctctgtggtcccctcgtccacggccaccgaccccaccatccataaactcgccacggccactgccgcagcggtccggtcaggaggggcgggaacaggaaccgcggcccgcacgcatcgaagccgctgcggtctgcgctctgcggtggtgggctctggctctgcctctggctctggcgcaggggcgtgggggacgggactggcattgccactgcccagccgcgggagcggcccctccggggggacaagcgcattaatgccactgccgcctccgccgatttaactccccgcctctatcgccctcaccttcacctgtacgccgtcccgcttcgcttcggagaggtcgctgcctgtgcctgccatcaacgttccctcgctggttgaggtagacccaccgacccccagtactagtcgggacagag

SEQ ID NO: 3344 - DNA, 769 bp, Zea mays
gagtatatttttggtattcaaacgcaatgtggaggacctgccattgccaacttcgagttgttcgaaatgattggcttgggagtacagtgtcacatcgatttagggggtgtttggttttagagactaatttttagtccctccaatttattccactttagtcactaaattgttaaatatggaaagtaaaatagagttatagtttccatattttacaatttatagactaaagtggaataaaataaagggactaaaaattagtccctagtaaccaaacactacctaagatttcgtggtgacgtttaggcacagcataagatatggcgcatttggcaaagcgcgttgctttaatatataaccttttgtgccttgtgcgtgcatccaatttcaggcaacctctcattgtttccagaacctaccaaaccctcttagcttgggttaccaccattagtttagcatttcgaataaattagcccatctggcgaccctagcccaagcaatggggaggcaaatctgtatccgtgatttccttgctaaataaaggaaaggaaagcagctaaacgaatgccgacttgcaaagccaccagcaagagactcctctcttatcccgtcgtcctcttctctcgcctccaataattcgtaacccttctccttccaggccgggctcctgctggccggagttcccatctccctctttccttctcggttactatccgtgaagtctgcttgcgccgtgtgtgcgcgtgcaagatcgaccgggcgcagcttcacg

SEQ ID NO: 3345 - DNA, 518 bp, Zea mays
ttatcaaattgaattactgtttatggaaactgacagtcctagatttttttatgttcctggacttgaaaacctgacggagtcccaactattcttacagcaaatgactgacagtctattacctaatttggattattgcttgctgaagttggaacgcgactaaaagtttaaaattgctagttgtggctaattagaatgttttggattaccagtgtgtcccgactcccaaggctgtgaaatccttatgatacgaaatgaaattctgtggccttactgttgagttcatcgtatgcaattgaatgtttattgaaacaatgaggaattccccgttttattgtaatccgaagttgggcacagaacgtggcatttgcatcacacagctgcttttggctttgcaggttgttgatcataccacacaccatttcaagaaacatgatgggataacatttgtggtggaggactaaaaaaagaacatctctcaatccgaataccactgacaagaccgctggctgatcttgtcc

SEQ ID NO: 3346 - DNA, 176 bp, Zea mays
ctgcagttcgtgtagtaagcaagaatattttcttgagaccaagggataatgtcatctttttgatgtaatctgaagaatgacaaccaccaagagtaaccaaaaaaaggatgattgaaccatctctttcaacaacatagaatgattctaacgcttcaagaaactgaattattgcagtc

SEQ ID NO: 3347 - DNA, 89 bp, Zea mays
tctgctaaggcatggggggctatctaatcatatcaggcccccctgtgagatggaagaatcaggagaaggaatgggatgaacttcaagca

SEQ ID NO: 3348 - DNA, 1283 bp, Zea mays
atctgccaggcgaggccccgacggtcgtcgttgttgcgcgggatggaggagggagcagaggcggcggccacgacgccaaggctgcgggatgcgcgggggcgggggctgcgggatgcgcgggggcaggcgggggcgcggaggattcgggatggagatttctggaagggctgcggcggcggaggcgctgattccgggcagcatgcggggcggggtacgrccgcggcagtggcagaacaatagggtgtgcacgcctacaatagctacataattagtagtagagattagaaaagagctcaaaacggtttaatttttatagacgatttcagttatcaaacgtcagtgctatttataaaaccgtcaatagaaatcatatttgtagcgattgtttcctgagaaaatcgcaatcgatttctagtggcgattttcttaagaaaccgccactagaaattatttttatcctgatttttttgagtttttcaaatgaccttggataataaaactaccaaaataaaagtcgtagatctcaaaaagttatgaaactttgcagttgacaacttttttgtttaaattaatttacgacctcaagtagtaaatttacacttagttattagttataatatgcggacaacaaaactatagtatagacacaaataagttagtagtatagtggtagattaagtgatgcattaggtggaggtcgtgggttccaaattcaagatgatttataaaaacgtgtcactaaactggttcaaatatttataaaaaacacataactaaaagtagttttattagtgacatctttttacacgtcacttatccaattcaattagggacaaaaatctgagatgcattttacacgcatcactaattaacgtaaaagcatgtcaataaagacctgtttttgacgtagtgtaggttcaaatcatatgctcatgtttcatgtcatatgatctacaacttaatctctatacttcccatcccagagagaccttgyctcctcgagaatgaactcaactaggcaatacagcccatacggcagtccctcctggccagccttcatgaagaacctctgcccaagtaccaagtacaggcaaggtacgctatggtttttcccttcctcgtacacaccaagtcatatcaacatcagtactacagtcgtgcaccatgcacaatgcattatcgctctaccttggcacccgtatataaaccaaccaacactactagctagctcacaagacagcaaggccactaacactagttatcacatccaccataacatgacc

SEQ ID NO: 3349 - DNA, 273 bp, Zea mays
agtgagccttgtaaatgttggcaggccgattggtcgtgtggaccgagtggtcgtgtggttataagtaacacccaaaccctggctgtaaggggtcatgaacaatttagctatcagatatcaaatcaaatcgtcttcctcgctgctatctccttcttcaacccttcttctacctgaacatctctcttctttccgatattcccttctagttgctaacacaagacgacttgcttatttcttatttgctcatcgatcaatttcagttcagttgtgcgt

SEQ ID NO: 3350 - DNA, 499 bp, Zea mays
agtgagccttgtaaatgttggcaggccgattggtcgtgtggaccgagtggtcgtgtggttataagtaacacccaaaccctggctgtaaggggtcatgaacaatttagctatcagatatcaaatcaaatcgtcttcctcgctgctatctccttcttcaacccttcttctacctgaacatctctcttctttccgatattcccttctagttgctaacacaagacgacttgcttatttcttatttgctcatcgatcaatttcagttcagttgtgcgtatgtatgtacttcatgctgtcatgtcacgcttgcagctctcgccgccgatctggaggtggttcaccacgcagggcgaggagcaggaggcagcgtacgaagcggccgtagagcagctgctggtcctggagaaggagctcgccgtctcctggaagccattcttcggcggggacaaggtcgggttcgtggacctatcgctcggcccgctggcgtacgtgcttccgatcg

SEQ ID NO: 3351 - DNA, 1413 bp, Zea mays
tgacgagctgaacatggatcaaaatgtttagtaaggaaataatgttttctgtccgtcagaaaggttgatgctttgtttggaacctcttgctaacttactgacacaattaggggtgagacaaactttagactcactaacctgtatcctatatgcttgcattactactgtctgtcaacctcaaacttttttcagtgcagtgtaaataaaaaggaagcagcttgatttgatggaactatctgttagggctcctttggaacacaggtagcaaaaacacaggaataaaaaaaaacataggaattgaggtgtaagattttttcaatcctatggaaactcaaactacaggaatctggatggaaagccatttggtagcaccgtaggaaagaaaccagcacagtttgtccattagtctttttatacaaaaagaaaaagaaaattccttttctcttccgttgccgtcaaacatgcaaaagcatcacagtgcgccgcgacgtgtccattcatgcaaaggaaattttccatgaggtctgagctcttttttactttcctatggaattgaactacgagactgaaatcctatggaaccattctttctcttttccggtgaaccaaagacctagataggaaaaaatccatagraacacaaatcctccaaaaatcctacgcctaccctccgatccaaaggagcccttaatgtttgagcgtcagawtggtgccgagggaaatggtttggtgcatagtctctgtgtgtccagcctcgtcacactgcccattttcacattaggttgggaaagcagctattaatctgtttatttcctctctaagtttcagaactgatcgattaaaacaacacagatgcattattgcttaccccactaacatcatgtaatgcacttgcaaggaaacgctcgccgtatccaaggagggatcaaattttgatactttttactaacagtttgaccgtgtttgccatacaagaatttgtttgttgaattggaccccatattgtcgttttaggttttttttcgccatgtgcttgtgttgggtccgtgaatgtagcatggtgcttccatctttatattttctaattcatggtatatatatttttggttggtccttgagctcacttggacagagtgcggcttgccgacccagcagtatgtgcaggtgcggcccggccgaagatttggcgcacgcacactcaggtagcccagtggctggctccactgccagacgcgctcggctcggctcggcgcaccaccaccccgaggacacggagtgagcccgactgcccgagcccgtataaatcgacgctgcgaggggtagcgagccgcaccgcaccgcaccgcaacgcgccaccgatccaccccgcgtcctcggcctccctccctccggcgagcggcggcgcgggcggcc

SEQ ID NO: 3352 - DNA, 255 bp, Zea mays
tttttatgccctcacgattgcacgcaaggcctcaaccacagaggccgtgtcgccatcttagaaacagcccgcaagcggccgaatgctgctttggtggccgcgccttactcccttggtagtagggcttgtggcgaagggccaaatgaggtgccctgcgggaattattcccggcaagggcgggacattttccgtatccggcgacgcccgtgccgtcccaccctgtgcaggccaaaacctccactgggaactgcaacc

SEQ ID NO: 3353 - DNA, 544 bp, Zea mays
gggcccgagttaactagttataggcccacacgcgttgcacgcgactggcgagagagaagaagactggctagctgtcagtatggggtaacaagcacagcagcagcagcaggcggccgcaccgcacgcggtctggccgccgtccgcgcagcgtgaaagaaagaattggatgctgctgcttagcagcgaaggaagcgggcaggaaggccgtgtggggtccacacctccccggacacccgcgcagccgccgcccacgcttggtccgtcgaccgccggccgatcgattgatggatgcatgcatccaccgtccacgtacgcggcgacgagacgtgttgcgtttgcgtgccaccggactagctagtagatcgctcgactggtatgtagctgtcgccatcccatcgccctccctctcgtccaaggtctgcctgcctataaagtgaaagtgaagccagggaagaggcaaagcgaaaggagagaaggaatccgatccatccaagccaagccaaggcagagaagaagaagaggaggaagaagaagcatcggcagc

SEQ ID NO: 3354 - DNA, 1041 bp, Zea mays
atataatcttacaatctagatgttcgtttacatattaaattatttacgctggattattaaatctgaacagattatagacaaattataatccgaaacaaacataatctaaatcataagcctagcttgctcgcaagtcgcaataatcaaccagtgcagtggcggatccacagggtatgctgggtatacaccggcataccctgcaaaaccagtgtcacatgcacatggtatatatacatatagtttatatatggtatatatatgcacatgtataatattttatttaaacaatttgtattaaaatttgccgtcgtactgtatatgattttaccgaattcgaatatggttttaataaattgtataagacatttttttgtatcacataaccataaccatggtcaaattctagattcgccactggttaccagtgcgtaccggagcagcagacgcgtgcgtaacggctctctccactctcacccgttatcgacatcgtcctctactcctcggcgactgcgagccttgtcggagtcagaggtgggtgtgagtggaagcgcccactgcacccgcagaccccggtccacccgccgtcgcctccaaggtccagcgatccgactccgatcgccgtctacgtacgcgccacggcccacgcacgtggccacagctcagcgcgcgtcctcgcacagccgcccgcactctcaagtgaagcctccaggtacaacacgtacaccaaacaccggatgccttcccccttcactaataaaccttacccacgagctagccacggcgggccagtgacagtgtggccttcgcgctagcgccattgcataggctgctgggtgctgggtgggtggatagcggcgcccaggcatacgattccctgcgtcatctggctggccgacgggctgcgtgttttaacggctccactcctaacactggctgagctcagcccacacttggcctggcctcgttctgctgaagctcgacccgttccccctaatcttctccaatccctttcttctgggctctgacagggtgacgaatccc

SEQ ID NO: 3355 - DNA, 1500 bp, Zea mays
cccccgaagttatggggcccctaaatatgtattaagtataagtatatgttgtgtgctataaatatttagtaattggttttaatcaaacactatttgatagtctgttcgctagatgtagcttgtttgctagatgtagcttgttggaaacctaagaaacgaatcgatgagactattgctgtcacagagaaaacaaatcgtcgcagactcctaacacgacatggcgacaccctgagtacgtgttcgatagatgactatagccgtagtgtatagtgtactagttcttatattatatgttatatgtgtgtatctttgcgatctcacgaactaatgattgttcattgatatattctatacaggattttaaagtcaaaacttttatcctaaactcttattttactttgacaccaagtgagtaaaaggccaaggtaagagatttttgaatggtgtattgtctgctacatgaattttcgagaatttcgtagaggtggattgttatcttaatgtctctattgcctatcgtatcttagtgactgctctatctaccataatttttttaaactaaaattattaaaaaaaatatttatgatcaacaatcatgttttcaaaaactttatatgtaaatatatattagatatataatatatatagagtgagagataatagggacctctaaattagttttcgtctgggacccctagaatgctaggacctctattacaatccctgcttgatcgcctcgtgctgcttcggtcgatggatttcgcttgctcctgcatcgtatgtgatggagcataactcttcttttgcgaagttcctcgacgtcgtttcaaagctggtccacccgacatggaaggtggacgaacagggtggtgaggacgtgtcctctagatcgaagtgcggcgacggggctagagtttgaagagaaggcggatgggtgatggtgctagcaaggggaggacgacaattgaaaacaatatgtcatgggatggtttcttgcttattttgcacatttgtgtgttgcgttttcttgcttattttgcacatccgtttcagtttgatgtaaaaaaggtaaccctagctaacgtggcagacctcaaagcatcactcacacaccatcgtcctctccttttgccagcaccgccgaacccgccaccagccttctcccacccacgaagtacggaaggctgccggaaggagctctcacctcacatccatctctggcacgtccgtccttcttctccctcggtccctccccttctccacagctatcggatttgcgctgcagtggagatcgacccgggctgggaatttctttcgttggtaaggaaccctaatttggtcggatgggattttcatcttcgacgaagcccgcgagattgatcgaccttagctgacgcgagggattggaaagcgaacgctcgggcgtagttaattttctaggaagattggggtttcagctcaaacccccatgctcgatgctgaggacgaccctggcgggag

SEQ ID NO: 3356 - DNA, 1313 bp, Zea mays
ggtgtagtgctaaacgggctaaatgggctaaacgggctaaacgagcctaccgtgccggcacggcacggctaagcaggcttagtgtcgtgcttgggcctggtcttaggcactagtgccgtgccggcacggcacggctattaaacgggccaaacgggtcgtgccctaaccgtgtcgtgcctggccgtgctgggtcgggccgcccatttggccatgtatagtggtgggcaagcgctagctacgctactccgtggaccgtggtgcggactgctgagtggccgagtggagtgttgtggaccggcctgtggtaggactaggcaaaaaaaatcgtaactcgaaacccgaacccggaatacccgaactcgaacctgaaatacctgaaacccgaattttgtttgggaatttcgagtagcaacttgcaaaacccgaatttatttcgggcaattcgggtatcacaatcgggtacccgaattacccgaactctcatgtgtcatgtactcatgtcatgcttgattattaatttgtgcatctataattatgtgtaagtgtgcataacttgtgattgtagattgcttgtgttttatatgtccatgtatatcattatttaaactatattttttatactaatttaatagggtgtatgtgtttttatgaagccgacacaatagttcgggtagttcgggaatacctgaacccgaaattccgggtacccgatttttcgggtattgcaaaacccgttgtaatttcgggtatcgattctcaaaacccgaaatacccgacccgaaattttcgggtaatccaaacgcccacccctagcctgtgggaacattcgcctctccagccccgctacctctccaagtctcccgtccacagcgtcatctttggttgaaccttccaagtttcaacaaattgcagttttgaaacaatactatggtatttaatgatactatagtattggagcttaaaaggtgtttggtttgtacagtcaaaactcaattttaaatactatggtttatccaaaactgtggtatttttggagtttttgaaactccactcaggacctcagttttcttctattctttctacatatactttgttttccagtagaaccaaacagatctcgattttgagtaatactgtaattttactgtggtaaaacaatatcgtagtatttatgtcatgtacaattgtaaactatggtatcttaaaaatacagtattttaaaactgcatttccaaacaggcccttaatttcattctcgctcctccaacggcccacgcccaaacctccaccccgtccaaaaccccaccgcagcc

SEQ ID NO: 3357 - DNA, 648 bp, Zea mays
gggggggggcacggttaccgcgggcggaaatgtccgtactccgtaggctccctcccgagtcagctgatgcaaattttattttaaggtgcacggaagtatatgctctctttagtaccaggataaatatatatgtccaggtgccttgcctcttctcaggggcatggctgctggatccacaagagtagtgatgcagctgtgtacgtgtgggtgtcccgtactgcgcagcagaccacgccgtacagcagcgcagctcgaaacctcaccggcccagccgcaaaagcgcccggtggcccgccccatttccttcgccgagaggccgcgacgtggcgagcaacatgcagcacgggcctccacgcctctccacgtagtcgccccgcgccaaaccacctccccacgacgccacgccagcctccgatagctcggcaaccaacagagccctcaataccgcccatgccggttgccggatacgataccgccccagcccaacccctataaaaccccgcgccaccaaccctacggttgttatatctcctcaaggcacgttcaccacagtcctctctttccccggcaccaccaccacccaggctaaccggactggaccgagtgttgaacaacactgagggcgaggcagatagagcgacggcaggc

SEQ ID NO: 3358 - DNA, 690 bp, Zea mays
ttttttttatttctgcttgtttatcaatgtccattgaacagaagggcatctttggtcagaagcaaggcttccatctcagagcagtttggtttgctttatgtactttaccttagaagactttttgggcacataggtactacttatatcaagttaggccaggtgaggtatgttcaaacttcagactgctccatggggattcctcacgcgagagcacaaaggtagtgtggttcctactctaaggaacaaaacttggatccatcctaaagccaagcaatcatgttgttaggttgatcttgctgcactttgtgtgatattgtgttacctgcaaacttataaaaatatctttaagtttttgttaacctaactttcacttgtcttagattgttggacgggagcagtacaaacgacttgcaaattaatttcgcttagaatttgatggcaatcttacaacagttgctgctggagacctgctgccttcagatgtactcctcctttcgtgagttcagatgtagtacttacccttcacctgttattttcagttgcaacaaaaatcttttacaaaccattttttgttgttgataagaatgcacaccacgcctgattgttcccctaaatcctgatcgagtccttttattttcctttagttgcagatatctggtcatcagtacagaacttgaagtgtagattgtg

SEQ ID NO: 3359 - DNA, 192 bp, Zea mays
aggtcgttgccaagtttgttgggggcaagcacaagggatcaaagacttgtgtttgggtacccaaagttcttgtttctaatgccaaaggacccaaaacagtttgggtacctaaagtcaagaactaaatttgttttgtaggtttatgcatccgggggctcaagttggatactcgacagcgggtgcacaaaccac

SEQ ID NO: 3360 - DNA, 223 bp, Zea mays
aggtcgttgccaagtttgttgggggcaagcacaagggatcaaagacttgtgtttgggtacccaaagttcttgtttctaatgccaaaggacccaaaacagtttgggtacctaaagtcaagaactaaatttgttttgtaggtttatgcatccgggggctcaagttggatactcgacagcgggtgcacaaaccacatgaccggggagaaaaggatgttctcctcat

SEQ ID NO: 3361 - DNA, 131 bp, Zea mays
tcaggtttctgagaagaaggctaaagcatggtttgcttcaaagggaaacatcccctactttgagacgtcggctaaagagggcttcaatgtagaggctgcatttgagtgtatagcgaggaatgctgtaaaaa

SEQ ID NO: 3362 - DNA, 1500 bp, Zea mays
gtgcgaacacaaggttgatttgtcccttgtggttcggattgatgatgactgattatcaacgggtagcactctggggtagtcagtggactgaccagagtgtgagattatgtttgtgcaaccatgttggtcgacttgtggtgtgcaggtgtggagcacaggaacggtggtcgatggctgaggtgaaggtcatgcgggctcgtgctgatagaccgggagcggtgaagggcgagtgctgggtcttgactgacggatcagagcagccaggtgaccaaccgcagtggctgacacacctgggacacgcacttatgtgaggacgtggtggagtggaccgtgttgccggcgtggtcgaggactggcgggacacgcgtctgatcgtagaggacgtgcacgaggtgcgctgctcacggcaggtttggtggtttgggcctcaaaaccacccagygctacagatgcctggttttgstgagtttrggtctcaaaactcggtggtggcggttccggatagaaccgatggcggcacgcggcgtgatcgcggagggtgcgtcaaggcgaagcactccgtgtgaaggacgtggtcgttggatcgaaaacctaggagttggtccatttcgcccccggtggagtggataggctctatgtaaatatgggtagtttaggaagtgagaataaccctctataaatagaggggagggctggttggttcatgtcacacccggatttaagggacaaatccgggtgcatctcatatgtgcgccaaggaagaacaacacacataacaacatagtgcatagagataaatgtcataaatatcataaatatacttattacatagcggaagtgtcggcgtttcgagacaggggggtccctaagccgacgagtgagtgtgctgcgtgccccagcccagatgggtcgagcgcgtgggcgagcgcgaaggggggaaaggcgaggtggccggagtcgggcgtgagagaggtggaagtcccgcggccttcgtgttcgtcccgcgcccaggtcgggtgcgcttgcagtagggggttacaagcgtccacgcgggtgagggaagcgagcggccccaagagagcgcctgtcccgtcctcggtcccgcgcggccaacctcctctaagaaggccctggtccttccttttatagtcgtaaggagacgatccaggtgtacaatggggggtgtagcagggtgctacgtgtctagcggagagaaagagagctagcgccctgggtacatgccaatgtggcagccggagaggtcttggcaccttgctggcgtgatgtcgtggctgtcggaggagcgacggagccctggcggagggacagctgttggagcggtcgagtccttgctgacgtcgccctgcttccgtaagagagctgagggccgccgtcgtcacagagcttgtggggcgccatcattgtccatctggcggagctggccagatgggacgccggtcttgttctccgtgacccgagtcggctcggggtaggatgatg

SEQ ID NO: 3363 - DNA, 756 bp, Zea mays
cggtgccctagcccccacgcccactataaaatcagctccatttctggacactctcatttcatttaccacaccctgctctcgctcttgttgtgacggtcgattcgcttgtacaaggtaatgatgtggaatgctttgttgcttgtctcacctatgtgtgattatgttttttttgttttatgttcccgtgggggatttatgtctgtagcagatttggtgttgtttctaggttcttaggtttgaattttagggctagatttcgatggatgttgcggtttgcttcgctgctggcgcggctatgtttttgcttagatctgcaccgctccaaaaatgttgttcaggcttttcaacgtttgattatcaaatcatgaatcatctatcgtcgttttgggattaattaagttttcggttttaatgttgggatggatttaaggtatttggttttgttcgtaggtgaaaccgcttcactgagatattctaatagaatttcagatagatctcaagctgctcctcccttgccttgtggagctacatcaaatgatttttttttctacgagcctcttttttatttgcactttttccatgctgtgcccggatctgtttaaattcgtgccggagcttgttattctccgtaaatctggttctccactctctcttggactaatatctccaacattttctcgctactgaccagtgaccacccttccgctcccttctcacctataggtagcaaccttgagatccagccaagatccagcc

SEQ ID NO: 3364 - DNA, 613 bp, Zea mays
ctgatgaggagcgtgaaccaaagccacgacgccggaaatcgccgaggccgccatcccatgacccaccacccgcagccctaccacaactaactcaccactggcagccacaggtccgccgctaggccaaggcccacgcgggtcaaggccccgacccaaccaccgaagggacaaccgcggcctccgctgcgggccagtcacacgcgcgggtgccgccgccgcgggctagccgcgcgatctggcacggccgccgccgccaggtcacccgcccaggccggcgcggagggagagggggtggggagtggcggagcaactccccggcgctgccgtccttgcagggcacgcgggaaacgtcgcggccctgctctggcagcggcaaggccaaggcggggtggaggggcggcggcggctgccgcccgagcagggctacgcgagcggggtctgggactctacatatccaattgttatactgctagtttgttgtttgtagtaaaaacataattcatgaagtactgatgatttttttttcttttttgcatctttagagcaagcttattgagtcatccttgatgtcaccttcggagatcaattgggtcaatgattaccacgaagaagt

SEQ ID NO: 3365 - DNA, 1500 bp, Zea mays
gtctagttcttattctgattggtggaatctgaagaagtgaaaactcactccttttgcctttggatattttccctccaattgtgtttgtccccatttcgcttaccatcaaagtggtaatgagtacaccagttgtcgttgtctgcatcatgatccggacaccttcagtaaagtggttgtgctgattaagttacaccacattgttccccttgaagaaatctaccttctagtctgaaattcaccacataccaatgtacaataagcagatataattgktcaaccatatgtcgctatgtcagatcaaaagtgataaatggcagatacacatataactcacagatagggttgtgtgcaggtttaatgtacgttaggtaaatacctggcatggaaaatggattggaggcctgaaaaaagcaagattattatatacctctagaatacaaaagaccaattatatttctctagaagcaccgtgagcatttatatacyttcagagaaatattgagggaatgatggagatggtctcacggccggaaaaaggtgggctggttctcagtgcaaaaatcacgagacaccgctcggggcttactggactgaaagggaaaacatcaccgagggtgatgaaaagacccaaatttagtctcagatgacggttactgttgtcttcaacctccggtcgcatctccagatggcgattacttcaaaaagaatattgcaaacttcatggagagagtcgggggctccaagatttcgacggacgtaggaggaagggtagagccttcactgactcacagctagatccgactatgcttttgggttttagatcttccatcagcatgctgccaacagttcatactgaaatcattctcacatctagacagagtataagagcaatgaaaaccaaggatctattcatgctgatgtaagaactaacaagtcatcgttccttggcattcagacatttggttcattaaggtggactcaactctgaagtctaaacaaaagagcaggaacgcagctaagctcgatgagttcgaaggaagcaaaagcggaaacaactaaggagtacttgaagaattgatcctgagtatctgaccatcagaaagacgcactaccctcgatcagtttcaacgatgcagaacattaccacgaactgacccagttcgagatcgccgcacacaggacgtgctgtgtcaacatcgtcccatccaggcttgatcgcgcacacgtgcctactgcgatgacggcgcctccggtagtatctcgtcgtccgctggaagcggcaaccggcaacacctcctccatgtccggctccggcgtcgacgtccgcggcaactacgctagcggtggcgccgatgttgaattgctgatgacgacgcttccgctagtttctggttgtgctcccaacgcagcagcgcctccccagttccccacagcgcccgccgctcccagcaccgacatccccgcagctgggttgcatcgtgtcccgctgactcctgggcc

SEQ ID NO: 3366 - DNA, 166 bp, Zea mays
ctttggaaacagcaaggtgacgtttcgcctgacaaattcgccccctcctttgtagccgttgcaaggcacccaacggtgcacgcccccttgcccccaaggcacccaaataatctggctcctccccacgtcaggggatctcgttccaataatctagcaacagaaaata

SEQ ID NO: 3367 - DNA, 51 bp, Zea mays
ggtgatgctggataatatggtgcaggagagagtggtgcaggagggagtggt

SEQ ID NO: 3368 - DNA, 1144 bp, Zea mays
gatgccactagtcttcttagatgttagtatagtttagtatagctagaataatgtagtagtaattagtgtagtttagtagtagtaataatgtagagtagtatagtgtagtttagtagtagtagtaatgtagagtagaagtagggaagtaccaactcgtgaagagctggtttgtaaactcgttaacttccctttaatgaagaactatcgttgatcctcccttttcgatgacttgtcgttgcttttcctgaatgttgaactgattcttttaatgtagtagaaacaacgccgagcgatgtgtaggttgtcatcagcgttttagaagtaacaccaagcaatcgaacacaagatctgcgttttagaggcaatgccgaatgatagaaggtcggcatcggcattttagaagtaatgccgagcgacagaatatagggtcggcgttttagaaacaacgccgagtgattgaaggtcggcgtcggcatttttagaagtaatgccgagcgattgaacacgtggtcggcgcgttagaggacacgccgagtgattgaaggttggcatcggcattttagaagtaatgccgagcgattgaacacgtggtcggcgtgttagaggacacgccgagtgattgaaggtcgacgtcggcattttagaagtaatgccgagcgattgaacacgtggtcggcgttttagaggcaacgccgagtgattgaaggtcggcgtcggcattttagaaataatgtcgagcgattgaacacgtggtcggcgttttagaggcaacgccgagtgattgaaggtcggcgtcggcattttagaagtaatgccgagcgattgaacacgtggtcggcgttttagaggcaacgccgagtgatagccagctttacaagttactttgaggaaaataaccgagtgatgaggtggcacgtcggctctcttggaaataactgtcggatatccacgtggcatgctgggatttcggagatgaccgccgggtgatgactgggcactttttgaaagggtatctggctcaagaatatcccttaagagtcgcgcttttagccgcctttgctttccgtgccctagttcttgcatttccgcatctgaatcttctctgccactcgcctcctactctgtttcgccagcgagaagcaag

SEQ ID NO: 3369 - DNA, 1358 bp, Zea mays
tgttgtgtgtttctttacttacgattcctccaccacccccatcgccggtgtgtgttgtcccctacgaaatctaaggtcttaaccgagggatcgaagtatcttacaattggttcgagaagtttgaatatgcttctatagaatttgaagaggattaaaggggggggggcattgccccctttcttcctcgagtgtttgttatcttacttactccattagtccattgcattgtcaacctagtgctagtgtatattattatgtcaataatcttgaggtcttgtttggataatcttgtattcacctaaattcacacgtacggaggtagatttcgcttcggattaaaatcgtctgtttgtactgctgcagatgtaatctatagagacaaaaacactataaaagcggtaaagccaagcaaacatgctataaatcagtttaagttacactctaatccacctagtaaacaaacaaggcctgaaatgtttagtttaacgatgatgtttcctctgatttatttttttattctatttaaatgtatatgtaagtaagtatttttggtatttcacaagtattggtctgttcctatacttggcctcaaccgggccggggaatagttaatgacgcaggaagcaaatatacttctttttgttagtgttgcagtactacggcattgcgaaaatggtggttaattaataggcgtacttgctgagattatcttatctgagctcaactgacatctggtgagatcacatggtccccaagtgcttctaatcggagttcctttggattcctcaaaacaaaaacaaaaaaaaaagaaaagaaaatcggatctccttttttcacgttgtttattacctaaagaaatggaccagtttgctgtcttttcggcccagtttgacgtgcgtctgatctggctctacgctgtcatggcttttgggctaaagtttttgtctggaaggatggtttgcttcgtacgtgttcgtccgtcccctagtggccagcgaaatgtgacgggcttttcgatcacctgtggccattcgagacgagtacggatattaaaaataattaaggaggtgtttgacgagacgttgatggtattttatcgcgctgattctcggtaggatgccccaatcacatgacgcgcaaccctcattggatcctctgcatgcatatattgtactatagttaattaattgtgtcaggttttgttagcctagatttatttgattgttttctgagccacgcactgagaggatcgatcggagctagcgagaacgatcgatcgatggatcgctagattaagtttgtactatgcgttaattgcagatggcggagcggcgtggaagagagcagaaggcctgtcg

SEQ ID NO: 3370 - DNA, 1113 bp, Zea mays
tgggccgaattggcattttcttttttcctgtaatttctaattgcttttctattttatttcctttatggattcaaatcaagttcaaacaccaattcaaatcaaataatctcaaacatgtgcatcaaacaaaagaatattttaggttcaacatgatgcaacaattcatgacttacatagttttgacaaaataaataaatattaaaccctcacttaattaacttaattctaatcaaaagaaagagagagagactagagagagactagagataacacctgaatttggtaggcatttagaaaagaaattgtatacaccaaattcagggtgttacaattactcacgttagtgtacatgtggaccaaatcttgtgtatctcaacataaaaacatattaatccacctaagttatcactcattcaccaaaataaaagcaacaacctttcactctctcctttcttagtattgatgataaatttaaaaacaaatgaaaactaagcataatccaaggtatcacttcacaatagtgtattttgttaacttggtttggatttttttgtcgctcatccaacttttaagctttgtcattatgatacaaataaacatatgtcgtgccatattagagcacactaatgaaagttcacatagcattcaagtttagggacccaagtgacacaacatgttaagttagagaccccaaatgactccgacatggtatgccacgtcaatatccggtttgtaaacctggttttagatgattttgtatgagctgataaagttcgatgatctgtttggccgttctaattacagagcatgccaatttcatctatggctaatgtactttacccactaggccactatcatcctactccggcctccggccgtcacccttccacgccatctagccaatcgggcgtctgtcctggcatgctcggtccaatcgctctacgccacgtcacctctcttacgcgctcttctctcttcccccctgttacgttgggctcctacataacacgcgcccccgcttccactcggcgaccaccggtccaccgcgcatcgaacccccacttgtgctgattctgctgatccctcgccgacaacggccggagaatcgacacc

SEQ ID NO: 3371 - DNA, 912 bp, Zea mays
ccttacggaagcaaggagacgtcagcaaggacccaacagccccgacaactgtacttctacagggtttaagcgctcctccgacggccacgacatcacatgaacagggcagcaacacatctccgacaaccacgtcggcatgtacatagggctctggctcctctctgctagacacgttagcacattgctacacctcccattgtacacctgggccctctccttacatctataaaaggaaggtccagggccctcgtacgaaaaaggtggccgcgcgggagaacgggctgacgtgtagtctcacgccctctctctctctctccctcgcaaacgcttgtaaccccctactgcaagtgcatccgtcctgggcgcaggacaacacgaggccgcggttccccttactgttttccccccttgtgtctccgtctcgcgccgacccatctgggctgggacacgcagcgacaatttactcgtcggtctagggaccccccggggtcgaaacgctgatagttggcgcgccaggtaggggcctgttgcgtgttgacgaacagcttcctgtcaagctccagatggggagtctccagcaacctctccaacccaggacgaagctccatttcgagagtctcgagttcatgtccctcgacggcagctacgacatgatactccttcctccgccgcgcgacaacgacaatggcggctgtcagcccgcccgccggcggcggaatcgatgacgtcttccccgcgtggcggaagaacagcatccgagtctatcctgtcacctttccccgttgacggggaaggaggcggggcaatcgtagccaagcaggaggcggcgcctcgtcggctgtcgagcgagtcgatgacgccggcgccccagcgggggacacgtcgggcgttgacctcgcgtctgagacgaag

SEQ ID NO: 3372 - DNA, 193 bp, Zea mays
ggtatgtcttgcttgacctttgtctgaaaagcattatacctccaaagcaataatgtttcgaaggacgaaggtccttaatgattaacaattgtgttggttcttgattcacagcatttgagaacaagtgaccaacattgacgtctacctccgatgaactcacttctacaatcttcggcaagcattcaccttcgtc

SEQ ID NO: 3373 - DNA, 1500 bp, Zea mays
ttctagcatggcacgcgacgtcgcatccggttgagcaaatccagttttagatgattttgaatgggtcgaccaagtttaggattcgttttcctagttttctgagttcagaaacccaagtgacacatcgtgccaagttcgaggcccattgatgcactttgcttacatatatactcgtttaaagcatgagtttcgtgtattgtgtgtcatacacgaagcacatatatctaattttctctcccaagtttcgtctaacaactagataagataagccttacctcttgcatgagcaaccaaccatacaaccaccacgagtgctttctcctcccccttgttgatgatgtcgtatattaacctcaacaacctaccatctctttcctcgtctgcttcttcctcacccaaattcttctgtaccaccatagatgacatcgagtaggccatcctgctggtctccgactcgctaaccgcagcgccccaccgcgacaccgtctttaccttcccccgtcgacaagcgcttcggagagacaataaggcaagaacaaccgagtgagaggaggagacgctccggatctcgagtttagttttatgttagttgttgacaaagaaattgtgatatattatggtcgataataatatatatatattgctgggtatcgaatgtttatgtgtcgtcgtaacatgcggatatgtactagtatatatattatttgtcatctcaagtgagggacctaaccatccatcacccgtagccaatgacgcagtcggatcaacgagacacaggtggttgactcggtcggatgcgttcgatcatgtcttagcgatagattactggtttatcagccttcgataaatgtgttgttttgagtattattctgagtgcaggcttttgtaggcttgtaacaagtgggcagtgacaagattattaatggttgttaacaagttagtttcatggtgggagagtgcgttagcagtgtcctagatataagcaatatcaacttctactagttgtacagtattttatttttatagattacagtgcaacagtcgaccatgcatctagctttactagcggtgatcatcgtcgtccacgacacaagcaatcatattctgtgacactctttcctcgtccttatcaacccaattccatcattccatggtcagacctctagctagtggggactgcttcgagccaagaaacatgggaaaagcatgagaggaaagggccagagaaagtccaatcgctgctgcgggcgtgtaactcgaatgagagagagctattaataagtcatgtagaaaacgtgcaccttcaagctgagctaaaacctttcatttattttcaccattcatcctgttgcgaccatctttggattataaatagcttgccagagccagcggatccagcagagcacgagacacccaagaaacacacagaagcgaggagcactacttgttggttggattctcttcagtctagcagctagtccagttaagtttcagacacac

SEQ ID NO: 3374 - DNA, 1038 bp, Zea mays
tttcttggcggcgtgggcagtcttggcgtcttcgtcgtttggtggtgggctagcatgggtgcttttcttgggaggcatcgtgggtgttgtcttcgtcgcacaaacggtggacgcaaaatgttgggcactgacacacgactgtrctgtcaggtggacccaaacactcgagtatcagggtgagagctcaggtgcacaacgaaacaaactatgggaaactgtagcttctcgttatgcgtgtcccgtcccgctataggacaggggtatttataggtatgtccggaggtaggtggtccaaagttgggtcctaccctcggctaccaactatatccaagaaatattccatgtaatggagtaattacagcaccgcatgcgctgcggtcggtgcacaccaaatataaccgccaactacgctgataggtgggcccatcgatgtgccatctggttaacacaacgggccgacgtgtagcttctgccacctttggagtattcacaatgcggaatccttcgctgcacttggacgaatgagtggagttgaaggccctaaggtgacgtagcgacgaaggccttggttgctgacaaccgtcacgaggcctttgttgttgttgtttcttgctatgaacgaccgctgggtcgaaggtccctttggctatagatctatgtaattagccaacatgaaagaaaggttaaagctttgctatatgatcaagtttgtgtttggtctccgaacaacaactgtgttcaaaagatcaratatataaccgtacaaaacatatttttacattataaataacactatttatagagtagagtttaaaataagagatacaaagataagaggtgaaagctgctcgaaatagtgctgcccagctgcaactcacatttcgggcccatttaacccgagtccttatcctttaaaatggagaaaaaatatctcccctccttcctgatcatcctctcagtccttgcttgtcctcccatcccggagatcgacggctgcttgccgcactcgctccagcggccagccggccacaggcaact

SEQ ID NO: 3375 - DNA, 187 bp, Zea mays
accttgctgccttctgcatccggtagcagcaagtcgccgcttgtgcccttcctcctcactttccctcgctgacgcccgatccccatgattcgattacgcgacccgccttgcaaaccctagcttctcccgctctctccctttccaatgcgccccaaaccctagcttcccgcccgcccacccgccggtc

SEQ ID NO: 3376 - DNA, 1017 bp, Zea mays
tgcaaaacagtgtttttgggaaaactatggatagactgctgcagacggccctagaactttgactaaacttcagttgacttgttagcatttctattttgtttttaggggctaaagtttagtagctacttgagatccagatagttttgtaagaacttttttcattgttggattcattacaattttttgtaacgaagtacaattccgtgttgccctaaatgcattgctggtagtcctagcacgcatgttactcgaatagtatatagcaaaggacaaaaaagaggacaacatttatggtcaagaaagtaagacgatttgtacaaaactaaatatatgcttatttttagtcgtcgtcctgaagtatagatgcttaatgagcctcctcctccagcggcagtgaagtcatccaatgcacagttattagaatcagatgaaacatcaaaccaacgttgctggttcacgtggttacggtttgattgaggatccaaccagcactgttaatgctaaagtaaaaaaatgggccatgcaagaaatagtagatgagggaaggttctcatgagccatgcatgcatgcatgatgacccatgtccatgatgtggtatccccttctgcgtgctataaaaccaccctccaccctcctccctttccccaacctctgaaccccgctctaataaatcttcctcccatctctctcgctcccaaccctcaagtccccaccaacccaaccctggtggcaccggccgcacacacgaaagcaagctagctagtcactattagagctatttggttgggagcggtttagctgagcaagatcgaactggcattgtcacacacatctcagcactcagctccttgggttcccctccatgagcagcagctgagcagccacacattgccgtcttccttgctgcacttgtagttacagctagatccattgatttttttggcaacaacaagagcaggagctactgagcaagaagtgcgtacgtgcttggtgagtgttacttatactagcttgcg

SEQ ID NO: 3377 - DNA, 1458 bp, Zea mays
tttcagttcttctgatttggtcatgatttatattcggaatttagattggaatttgtctaattattcaacagaaagacttgcaacattcaagccaaggccagtttctcatcgaaaattgttagctcaacatgatccattgtgcgtgaatttcctacctccaagttcaaataaccaggcacattgaaaggttcagcagacatcaccatgtgagcgtcatcaaggatctccgctgaactatctccaagcaatgtagtttcagttcttggtttctcttctataatccaatccccttcaagatcaatagaaagcaaactatcttcggtgtgtccatacataacatgcatgtttaagtttgatgaaggtccaacatcattcaactttggctcttgcatgcttgcatgttggtttattagaactgttcttgagatggatgtcgttctccatggttaagaagccaacttgaaaccattccatgtgccttctgatggttaggagtactgaagacccgcccaccccagaaggcaacattcatacacaaagctttgaagacctcccatgcgatgacaccccattgggatttcctcccacaacacacgtccagctcaagaggccggagacatcgtataagaaggtgaacacctgagaatcttagcggaagaccaactcaaaccgtgagccatccacataaaaaacaatcacttttagaagcaaagggagatactcacaaccaagagacagtgaaccaacatgcaggtcagagtgagacaattgatcatggacggggaggaaaaagcaagagcactcgttaagtgtttttttttaaaatatacagaataaataattaaatagaattactattattacaaggattcactataaaaataacatatagacatatatatactatgattcacatgacataatattttttagctaataagttcataaaatcacataataatatcatcacatattaaaattttttatactttagatctattcggtctatttaggttttaaagactaggaaccgaacctagatccatatcctgaaccgaatttgaacaaaaaaaaacctgaatagaagttagagtccaagttcaggtgttcggttttaaaacgtccactcctggccacctgcacgtcagcacgtgccccatcctcgcagccgaatcacaagcggggccagatcgcacgggctccacgcgagggcagttcggtcactcccggcggcgtgtcgctttccaactcggccaccagacagccacatcaactgcttcggtgcttccgcagttctgcaagtgctgtttggtttagctgcctcttgccgctggcagccagcggaagccaaccaccttgtccccgtcgagcaccgagaccgcgactcctcaccgcactgcgccgctcgcgagaacctcgcgtaagcttcggcaagcagcatccgtcccgccgatcgca

SEQ ID NO: 3378 - DNA, 1500 bp, Zea mays
aagatagctcgccatctcacatatatagttcttttgctttgattttttgggcaatgttttccatcacgacgcatatagcatgtcatcctaaaatcatatagtatttataatacaacataatgttcctgttgaccttctagactaagatgcattgaagtcagctaatcctagcccagtaaacaactgytgctttccaagtcaaacacgctcccttcccttagaaaagatatacttataaaatagacctaaaaaagcgaaacacaactgacatcaactagtccaagtgtagctaagcttcatttggttggacccagtagcactgcagtctattaggaggctagtttgtgcaaagtcaacaatgctagtttgtgcgagttcaaacgcatgatagaattgtctggttcatcgacagcgactgaagcggtagaagtagacatggagtggaatcgcatgagcgcatacccgtctctgttggagcgcctaggcaagtgaaatcgagctgtcaccgttgatatttcgataattacgtatagacatccttttcttgcaaaccactattttgttaccaatcgcaaatgctctgtatttaaattgttgataatttattttgaaagactgtttttgacatgatcgtacctttttttgtaattatgacaaattaaacatcctttttaaaagataaaagaaacaatcaaacttaaccatctgcatctgacttgacttgactttcgagtttgacttgcgtgtttatgggtatgtttattgaatgaaagaatgttcagaatcggatctaaaactatgaagttaaagtcaaactattatcaccattaaacgatattatagataaattagagttcgaaaatataaaacattagacaaagtagagttaggaacatattgcaggtaaaccaatccattgatgcaaattgtgtaaactaacacataaataaagtcaagaggattttttaaaaatattatatttcaaaccaatcatttcactcccctgactatttgtaaaaagaccatctcttttcatctcgatcgactataaacaacaccagttttcaaggtcgtcatgaccttcctactgtatgcaaaaataagttaaaattatgcacaaagattcaaaccttaaatgttggctctgcattcacacctatctaataaataaaacacatacttttatgctttattgaaccaaattatatccatcgaataatagattgatttggacagttagcacctgatttgttcttctggtattttatccaatactccgaaaacatctacggcccacggtcaaccccgctcggcccagcccacttgtgtgcacggacggacacggaatcacccgagtccgacccagaccgaggtccgtcttcctctcgtcactatattaatccctgcctcgccgctttgccttccccgcgtcaaacaaatcttgggttccaagcgagcgaataccttctcgagctaagacgattcgaggcacgagcgaag

SEQ ID NO: 3379 - DNA, 541 bp, Zea mays
taggtcacaacagctagtactcccagccgatctccacccagccagcactgcaatgtggatggcacctagcatctattggagagaatgggaaggaagaagagagaaggagagctgatctctaggaggaactcatgggcgacggcgccgggagcagcgacggcgttgaggacggcagccatgcccacgcagactaatcctcacaacggagaattaagcagtgtccagcgcgcctaagagagaatccatgtctataccagcgtctgcacgttgtgtgggtttttaaatcatcgaatcccttctcagcgcctccgtttcgtcgaagctgggtgtgtcgtgttttataatggcaaaaatctccttgtttcctagccgctaggctgttcctcctcatgccacttctcgctctttggcttaggcgcaggagcagaggcctcccatggcgccaccctctccccctgcagttttccctccctctcggccgcgccctctgtcctagctccctgctagccaccatctccaagtcggccatgggccttccccc

SEQ ID NO: 3380 - DNA, 199 bp, Zea mays
cctgcaagtattcgcaagttaaaagacgctaaattgagttcaaagacgtatctcttttacaaactaagcacgtaccttacgtttgaaccaggaaatgaaatcgggcaacccatttctcgcaccctttctaagaagagtgtcatattcctgtggagtggggtcccttgatcgacgccagaattcatgaagaaattgttcc

SEQ ID NO: 3381 - DNA, 114 bp, Zea mays
aaaaaaagggcatcgcggcaagggcttccctcctccgtcgcccggtcgaaccccgcgcactgccgtcgatcggcagaggcgagagggaaggggtgtttcccctaggcggatgag

SEQ ID NO: 3382 - DNA, 1500 bp, Zea mays
cgttcggttgtataggaataaacccggattcgttttagtttattaaaatctatataaattagagaagtaatccggctagaaattaatccggggctccaatccctaaaaaccgaacatgacctaaggaaatgtgtaaacataaataaaagtgtcatcgtctaggctacaattcaacggcaagaagcaacagctagggatgttcctatgcagggaagcctccggtgttttggactattctcccaggttgatcgtgtctccactccacacatctgtcacttgcactggatagttaccaacgcaagttgttttctagtagtttcaaattccacgccattcccatcaacaaggaattttcattgtgatgctatacacatataccccgctcctgtctctatagcatctacaagcttcgagagagatgtctataccaatccaggaaacaaccactaacaatatcatacactctctatgttctaaaaaaatataagtcatttcaagaattttggagagtcaaagtttttaaagtttaatcaaaagtatagcgtgaatcataaagttttatgacacagaatagatatagtatgaaaatatatttaatagagaatctaatgatatatatttgatatcgtaaatgttattacttcattgtataaatttggtcaaatttgaaaaaaaaatgattctctaagaattttagaatgacttgtattttaggacgtaacatataggagtacaactcatcatcagcaccacacaggagacacgacccgtctaaaacacacaaagccctggacgtcttcgcgcgcaaaaggccaaaggtagaaagggatccaaatgtgacatgggattatgggaagccagcacctgtgggccgccagctagcctcgttcgcatcatcaccgacaacaagaacaagaaaaatctttttttttcttttatttgctttccatatgggcttatcttaggtagatcgtggctcatgtcccgtgagactgagagattgggagttgactagccaacgccaagtcaagtcacccgtggccacaggagtgaggtgatgacgtttcgcggtttcgtcgtactggtacggtcgcaagtatagtaggagtagtatagtggtttggttggtttgtagtacttgttcttgcattcaacgcgtcaacatctccaggcaccggaaatgtcacaagaaaaccagcccaaaacacggccgcgaaggcgcaaaccatttgcccgcgcagacatggcatagcggtatggctacgcgctacggcacggcagtcggcagtacacagagaactacgccgcgctgtctccagtctccagtgagtttcccagtcccactcccacccacccacccaccgaggctatctatatatctccctcccctccacctatcctacaacatctcccgcaacgcaagcgcaacagaagcatactacgccgctacgcgctgggcggtgccgcacagctatagatagctagcagtgttgcatagaa

SEQ ID NO: 3383 - DNA, 182 bp, Zea mays
cacgtgaatgcctacatccaaacgaagcattaaggggatgaaatttagaggacgttgttggagacagcctcactcctcaccaccacaagtgaagtcaccgacgcacgcacggctgcagcgcgctcctactctcccgcgatcgccaccggggaaggggcaatagaataaagtgagggcagcca

SEQ ID NO: 3384 - DNA, 1136 bp, Zea mays
actgaaatgtcggtaacatcatatcatcagaaatttcatgaatatttccatcacagaaatctaggttcagctttgacatctaaaatgcgctcatagggtgaaaagatattttcatgtactcaagtggcggagacgatttctcagagtaatggcggctagaaaatattgatgttttggacaatccatccattccattttctgttttgttctcaaacttagtttcctctgcaaataccgcttcacttggttctacaacaggatttagagtagattcagattttgcacttgtatcagcatttgccctctcagaagacataggaagatcagtatatttggaagttcttctctgaagtgtattagcaagaaacctttgtgcaatgcttgaaaagcttgatgcagacacagcgttatttctcatgtcagttgagtatattttggtgccagtatcagcactcccctcaaattctagaagttcgcttattgaagtatgtttgccagtcatgttattgtgctcaaaggatgacgaaaaatctgagtgcccatctgtatgactatgaattggatcaggtattctggctgctgattgatttgcccctgagctattgaggtttgcagaaccaggacgaataccaacaagcttttccacaaagctgctggtaatggatgtgtttccatttgggacatctacagctgctgattcagttggctttgaacagtgcacttctgtgaattcagttgaatggactggttgagcttctttaaaaccaggtggagtatcctcccttggaccattaccaaatactggaggtttggatggttcaagtccaaagagcccagcatttgtccagagtttaacagatggtacaacagtagacgtggtagaggcatttgctggaacaccttgagttgcacatctgtcatcgattagttcggtaacaggctcactccacgaactagacacttcactggcaccagcagacatagtagaggtatttgtaggaacatcttgagttgcacatatattatctgatggtttgttaagaggctcactacataacttagacacttcagtcacaccacaatcaccaactccctcatagctctttacagcataatcctgaggcctactttcagga

SEQ ID NO: 3385 - DNA, 1500 bp, Zea mays
gaaggagagaggctcgaatggcggcttaccggcatcgaggcgagcacatcaaggtggcgggaaggcgtggaggttgacaacgaagtcggcgacgtcctttgctcgacggatggcgaacggagatgttctgtccacgcacgccggcgtgaaccgaagcacgacaacttggacggcgaagtcttggggtgcttcgagctcgaaaagaggctttgggcttgcacacgtgacgactaagcggttacaaggctaggctcagtcagaggagggtagaaatggcgtggccgcggcgctagtcaccgacgtccatggcagcgtggcgtcggagtggaggaaggaaaggagagcgagggcgaacgagagggcgcaaaggagagctgagtgaggcgagacgatggttctactgtgggcttgcttacgcgtccactatttttagatgaacatgtcggcgtttgaaaagaggtcaagaaatggacttagaaaaatcagattttcccatttcttctaacatatttctcccaacatttattattattgaaccccttttcttttataatttgagtccatctttttagtagctttatggagttaggtacttattccttatgttgtgattcttatccatatccttactcattaagcaaaacattcactaaaccataaataacatacaatttgagaaactatcatcacatgaaatcaaaggttgaaagactaaccaataaaacttaatttttttcaagtttggtttatctatacatacaagtactttttaatgctctaagattttagaacatatgctttctattaattcaagcatgacatcacttcacaaactacaaacaattcaagattttgatgtaggtgatgaatgattaatgatgcttatgatgatgcttttatgatgtatatgaaatgtataaacatgcttaacacaggggtgttacactatggttttcatatattacagtaaaaccgtagtattcgccaaaaaccacatcataggttcctatgtattggtgactacatgctgtttgcgacgcatggttttcactgtttatgtgaaaaacagaagtacataccaaagtttctaaaaccacaaaaatactatggcatactaagttttgataataccataattttgaatactaagttttggataaagttatcaaacaccttgaagccaaaaatattatggttttaaaaaatgttgccatatcaaataggtctttaagggctgatttagtgaccaaagaattagagcggaaagaattagaagaataatttggtgacccgagaattagagaagatctataaaaaaatccttttactattaaaagtttgttatagcccacaacgaaccgcctataaaacccacgcgggccgcgccaagtcgctgccttctctagtgcaatcgcggagctacctcagctgccgtgtcctgcacagccgccgcttccgacgcagcaaaggcgaacgcgaagcagcaagcaatcaagatcg

SEQ ID NO: 3386 - DNA, 1500 bp, Zea mays
gacacgtaattgcttaaacatggcagactcatttaggacggcccagaattataaaaacttgaaattcattttttttgccgaaattcatatcaaggccctaaattcaaaacaaatttaataaaataaataaaagataagacaaataaaattgaccaaaaacaagcttaatatttgtattaagttaccaaagctatgcaacgactacccaattgtccatccccttaaccgggcgcttgattggaagggtctatgctaacctcggttggagtctccggtacacaatactatatataaatgattaaggggtcgaaggaaaaagctaacgatatgactcatcagctaggtgtcagagtgacggaaagatacacccctaatggcggcctaggatcttgtcgaccgagccatctctgcaggacgacgacggcgggaatggagactacaaggttatatgtcatcctaatcacttctgtttatgtgttcacagtgagcacatgcatagattcactgctattcattcaagtaacttcgtattgactaagttcgactcagtagagatccttagaactaacagtcatttgcagtgtaagatattgtttattttctatgagcacatatattatctaaatgtgtactggcatctaataaagcatgtcattcaaaaggtaccactcagttttttttcctgtaaagctaccaaatgtccccattcgacgaattcttatttctataatcatttccagcacaatgatgccatctgcaacgtaacccaccattcgatgaattctaatttctaatcatttgcagcacataatgtcatgttcttactaatataaacttgtactctgagaccatcatgattcatgaacttgactgcttgttggacacaaaagtttgcaccaaaattccctgggttggaaggaaaatgaacaaaccgcccgtgcgaattgtcctaggaagactatcaaattgccaacgtactctcacaaacggaggcaaaaatggacacgcagagcgtgagcgtgagcttcgccttggcgatcgcactcgcaaaaaccgcccgtgcgagttgtcctcacgcagatgctgcatcatgccaagggagaaacagctggacgagaatcacaatctcagggcagaagcagtttttttctcccccttattttttttctgcagcttgggccgaattgcagatcatatgaatcgaacagaagcccattgcttygaaacagttgaaagcccagaccatgcaatcgccacgaccaaatccagtcacagcccaacatctcgtcacacaccacascagaaccctagagagacctcatcaacggttcccgctcccgcakcctacatccaacggcgwacgcatcagacacctgtggccaggggcctgccttataatgaccacgccattcccagctcctagagtttcctcctccactccctcccccccgcctccactaccccactcccaggcgccgcacaggtacgtcgccggcggcg

SEQ ID NO: 3387 - DNA, 229 bp, Zea mays
taaatagtaccctacgtctggcttgttgctgtgctcatttcaattcttctaaactagagatgtctaggcgtggtaaatatgctaaacaaaggtaagttttggatctgcctcttattttgtgagtctattatatttctgattgttatagagtttatggaaatttaggaagggtcctttgaccggaactgctttcgacccgctgcctttgccaagtggtgttccagtgcct

SEQ ID NO: 3388 - DNA, 547 bp, Zea mays
acggggttagtttgcggcagttaggcgtttcctgatatgtggatgagagtagcttaagtgattaagctgaaccggaggttgctgcgcccgggactagctcagatctacatgaaattgctacaaatggagtggtcgcgcctcaatgattgtcttgctgttttgtggtattacgtgctgagtcagcagatgagtatggcgtttggatacagattggattggggatagggatacatactggtatatataaggcttggttaggaatacatgtatcagtatgatagtatgtaatacattttccatgtttgtttaccactgggttaaggattgagaaatattctttgaaaagtcaaaatacccaaagaaaaagagaataaaaatcaaaagcaacaacatgcatcagtggcatgttaccttctcggtgttgcttacttgcttgacggaaagcccgctggctagtggttggcttttgcaagcaccactgcctctcgctgtccaccacgacggcctcaccgctaccgaagcccccctcggtgcgggcacttaagcg

SEQ ID NO: 3389 - DNA, 986 bp, Zea mays
cctaggtgagtgaacatggtttgaactcacaaaaggttcgttgaagaacaacgcacgatgacgcacgacgaaactcatgctttaaagatgtaagcgacgagatataaataaaaaaatgttaacacctaacatatcaaaagtatatagagcaacatttctctagtcaagggctagtttggaaactccatttttctaaaagatttttattttttaaggaaaaataaactaattctcttggaaaaataaaaatcccgtaaaaaaatagggtttctaaactagccaatattgatatctagggactatagggagtgatrcacctactaggcaaggacagaattgtccaggttaggagaagtcacgcactagcaatcagtcttgcctccttagctaagctagctgccgaatccagtccagcttcagcataagaccaactccarcaacactccccatcccactccgcatccgcattatacacgctctgagtcactatttcgctctccagcagcctccgcatccgtctccgcaaaacagacgccgtgtacctgcactccccttttccacggtttctctctcctctccgcacaagactgcatgcgccacctcctgctcgcggrccatagactgcatgcggagtgcaaatacgaagtctgctggaaacggggacagatacggagagaagagagaaactgttggccgtgctaaatacggatacggagagagagtctgctggagttggtctaagctgccaatgaaatgaacccgtagctgcctccaagaaacttctctccccgtttgccacatgctcaaacttgctgaccgtcgacctgtgtacacctggtggctggtgccctataaaacctcaaccatggcctccgaccacaacacatgatcagctgcatgcaactaagctttcactgaagcaagcaaacaaacacctaaagatctgctatttgagtatttcttgtttctcttcagcttcatcagcc

SEQ ID NO: 3390 - DNA, 88 bp, Zea mays
tggctgatgaagctgaagagaaacaagaaatactcaaatagcagatctttaggtgtttgtttgcttgcttcagtgaaagcttagttgc

SEQ ID NO: 3391 - DNA, 868 bp, Zea mays
tctcacaaatagaaatgccagggacaaagagtcctttttaagggtttgtctagtttgtaggaaaaaatttttgttcctctattttattttttttataactaaattgttaaatatctattttagtttccgtgtttaacaatttaaagactaaaatagaataaaataaagagactaaaaattagccactgtaaatcaaatatcccctaaatcaactacctactctttcatctaggagaaagtaccaaaacaaatgttgacatccgcagatccgcttcgtcccgatttttgtgaatttgatctgccctatgcctatttcgatctagaaactccccctctgaagtctgaacacaataaagtcgtgctatgaattagagcaggattaagatcccatactctcgaatgttgtggatcatcatgatgacactacagatgagtttcccattttaactgcaaatacatgaccaaatacatacctaggagtattttattggacactttactataccatgtgtatgagcaagttctcttgccatataccgactatctaataataaactcactaacctatgacataatgattcagattattaaaagtattctatataaaatgaaatagtaaaaccttaaccctaattccatgtgcgaaattgtgaatgaccactgtgccgacacccctacgtccagcaccactctccacgccagcgccgctactctccgcctgcgcccccgtgcctcccaccgggccacttcgctagcgccgcccgctgcagcactagccgtcgagcgcggcgctcgccgccgacttctcacgcggccgcgtcgtcgacccacgtccccaccggctggggttcaacgggagaaggaaccg

SEQ ID NO: 3392 - DNA, 442 bp, Zea mays
taaaaaaaattattagcaaggagaaaacaaaaaaataggactaaaaatagagtcacattggtttaaattagtacctagaagtaaaaaaagatgatctaaattagatacatcgtaccaaataccatattactattccagttaccccttctactatgcctagatatcatattatgtataagtatctattagcgctactatgttcttggtggtactccagaattaacttgatgcccatagttattttttatacttcaatcactggcatatagtataggcattatcatgcacttgttgggtggttgagcattactaggacgcatgtaacacttctaaaatggatcaactgatgtaatatgtcattcctttctattcaaggagcttatctgcttgaataactactttatgttttttttacatctgcagtctcttcttcaagcaagag

SEQ ID NO: 3393 - DNA, 73 bp, Zea mays
cctattagaagcacaattgtggttcatgcaaaaaaaaaaattctcgaacgcggcggatgcatgaaaacgagtc

SEQ ID NO: 3394 - DNA, 889 bp, Zea mays
gggactgttggagatacgtttttgtgtttttgtcaaaaacttgatttaggagagacttctgaaagctcttggagatgctctaaatctcctaccggtggagttgagtagtgccttttttgggcttggtgttctgttaagaagaatggtctatcgaaattggcgagcctagagatcttgataatagggtctcctgaacctggaagtgttaggggaacaaaaaaattgtatacttcatccgtcctaaaataattatgtatctcataataagttaaatttttaagtttaattaaatttataaaaaaatcttctaaaatttatctcccttaacatatttattataaaaatgttactttgtccgtgatacctagaatcaaccctcaacgtggcatcgaatatgtgtgtatagataaagaggcacctttcgtgaccatggaaaacgaggcgtgtatataagggggaaaattcacgtcttctaaataaaaggacaaacaaaacccatgtttttttatctttggtcctggattaaaattttgttcagatttaaaataccgattaagaggattaaagataagttaattacaaaactatttatataaaccatggctaattcttaagataaatttaatcctcagcaaatactggcgtgcgcgtagagccgtgaaagccgtccgtgccgactttattattatttattgcagccaccgtgcagtcgtgcacacytcatyttctcttcttcctctcttcccttccattttttctcttctcttccaccaaaccaagtgcggccagagaaatttctcccaaatttcagatcaaatcctcgaaatctccgacacctagcccaccggagacttctccccaacagtgtcgcgatccgtctcgatccggc

SEQ ID NO: 3395 - DNA, 1500 bp, Zea mays
gttttcacgctaggtgtaatgtctagggagcatgggtttagcaatagccgagctccagtaaattctatctagatttctgctggaaggcaacttggcaacgttcatagatataaccttcctcgaacattgacagaggcccctgggtggctagcaaacgtccacgcgagtatacatctaacatcacgcatcaaatgcgtctttcagaactggcgcattggacgcgtcgtgcagacgcacgacggcttgaagagctgcgcggcgtcagaagggacagcgaaatgttccttcacatcgccggcaaatgcatgcgccacgaatcgatgccttaccgatcgagcgagtccaccgaccgaccgaccgacctgctgcttcgtgcgcacgtctcttttgcgccggctgctcctcccgccgacgctcgtcagtcgtcagtcaccgtcggcgaattggaagccacccgaaggaggttcagggtgggtagagtagagtcgcctcgtcgctgtcgcccatgtgcgtcctcccagcgagcagcctcgcgaagaaaactgcaatcccctgtcccctcgcgcccggctctctgcctgcgccgttcctgtttcttcttctcctccgacgtaccacgcgtagtcaatcagcggtgttgcagtacagcacggccatgcaaaaatcacggggagagctacgtatgacctgtactagatcgtcccaggtttttctggtggccggggccgcacagaaagccacgcgtgcggggccatgtcatgtagtatgtataccaccaaggcaccaacgccgcaacgcgcgccgtattaattcggacacggacaagaacaattaccgatgagagtaagtattattgtagtagtaggatggacgagacgacagacgactgtgggtggctagcttagagtgtcagcgccagcgccagcgcgaccgcgtggccgtttgctagctctaccgccatcgcggccggcggcggcggcggcgaagatctcctcccagacgtcgccgaaggcgcggaggatgaggtggtggtggcacgcggcgttgagcgcgaggaaccggcgcaggagctcgcgcagctcggcgccgccggtgatgccgttctccacgatcatctgcgccatcgagcgccggaagtcgcgcagcgggtccgccgactccgtcaccaccgccacgctcccgtagtccagccgctccacgacgctcgcgctccgcgcgtgccggcggggccttgccgccgtttccgcggtcgtcgccgtccctgatgccgcgccgccgccctcctcccgttcccggacgcccaggcccagcgcgcggacgccgcgctccagctcccgcagctgccgcagaagcgagtccacgctgggcgtgccctcggcgctcgcttcgtcagcgccgcggccgcagcctgtcgtcgtcgtcgtctttgccgcagatgctggctcccccgccgtggaaacgcgtcgcctcgtccgcgccgccgtcgtgacagcggcggag

SEQ ID NO: 3396 - DNA, 492 bp, Zea mays
acgactgatttcatggtagccgcagtcacctgtggaggtcgtgctggttgcagcctgctgcaggctaaagaaaagcaccgggaagaagaaaaaaaaaacagtgcaaaattcaaacaaagggatagctagaaatctagccagaacccagaaactgttccagcttatcaaatgtcatataaattagtcaaacaattgttccaagcatggttcctgaggaaccgagtatgccttatgcgaaaatagtaagtttcaaatggacataagcatgctttgtcagtcattctgattgtttctgattatctttagtggaaaaaagtgatgatgagcagtttttttgtcacttatgacttatcacataaccaggtataaggatggtggtatatacaaaccagcccaagacctgggtaatgacgacatgatcaatgttgcattagaaaccaaattactccggttgtgcatggatgctacagccttcggtgcgtctgaaaatag

SEQ ID NO: 3397 - DNA, 365 bp, Zea mays
agttgacacaatcgtgcattcatgcttccttatttatttactggaaggatcactgatctgtctcatttcacaatagcattatcttttcttttcaatccacaaccattaatattactgcattcatttttccataggactgttcaaacgctgatgccacttttgttgcttaaaattggaaattcatgtgcatattatttaacttccgtacagattttgctactgtagcttctgttctgttaagttttgtcatgtaggatgtgtttttccgatgccatagaatataattcttaccatatgctatttttagcttaaggagctagagaaaatgggtcctaaaaagggagtgattagtcagtctgtgaaag

SEQ ID NO: 3398 - DNA, 1500 bp, Zea mays
tcccaaccacttctagccgttggctgattttctgctggcgatgggcgcactggacagtccggtgcgccaccgtacagtcactgtgcactgtccggtgtgtgacacgtcagcgcaaccgttagggttaggagcagttgaaagggaaatgtgcccttgggccatttctaagtattttggtgattaagtgtccaacacaaatggttatgtgttaaactatgccaaatggtggacaaagtgcaaatcaatacaaaggcatgattctagacttagtacattggttttagtgtactaacatatttgtctaagtgctagaatcagagaaaagacaaatggaaaagacttagctcgatcagccaagactctgctcaatctgggtgcaccggactgtccggtgcgccaggctggcgtctagtgaactgcctgctctcgggtctcgacggcggcgtacggatataaatcaccggactgtccggtggtgcaccagactgtccggtgagtcggctgcggcgaaatcgccgctctcgggaatcaagtcaacaacgtacgactataaatcaccggacagtctggtggtgcaccggactgtccggtgagccaacggtcggtcgcgcaatccgcgcgtgacgcgtgaccgggccaatggtctgatgggagcaccggactgtccggtgtgcaccggacagtgtccggtgcgccaacggctccaaatcgtcaacggtcggctgtgccagaacaggaaagaaatctgcaccggacaatgtccggtggtgcaccggactgtccagtgcaccagtcgacagaaggcaagatttgccttcctggattgctcccaacggctcctagctgccttggggctataaaagggacccctaggcgcatgaaggagtaaaccaagcattctttgatcatctcttagcaccaagacatctctctagcgcatttgatttgtggtgatagcaatttgagctcctcttgagttgagaacttcgtgtgtgatcttagagctcaagttgtgactagtgtgcgtgtttgtgctcgtgctttgaggcttgtgtgtgttgctcttcccactcttacatctgtgcttctttgtgatcatctcattgtaagggcgagaggctccaagttgtggagattcctcgcaaacgggaaagagtaaaggaaaaaagaacaccgtggtattcaagttgatcattggatcacttgaaaggagttgagtgcaactctcgtccattgggacgccacaacgtggactaggcaagtgttgtacttggccgaaccacaggataaatctctgtgtctcttgtgcttgttctcactgtgtcaattgtggttcacaagagctctccttagttacttgatttcattgtgctaacacttaatcaagtttgtggctttaagtttcaagtttttacaggatcacttattcacccccctctaggtgctctcaattggtatcagagtcgttgtcttcaagaaagggactaatcatccgaagag

SEQ ID NO: 3399 - DNA, 972 bp, Zea mays
cccccgtccgcacccctaccccgagcatcacagcgcctcccgcacgaggtcgttgcgcttgtcgatctgatggcgkcccatggcaaaggagcaggtcartcccgtcccctagcctttcccgactcctcccctcygcctcactccatcgtygtcgttgggcccgggtccagaggcggaaggctaggtgggggcaaaccctaacccctcccttttcttccagccgccgcmacctcyattctccctctgcccctcgatagcgctcccgtcgatgcccacctctctcttctgcaggcggtgatggcagccacagcagaaagccgacgctcggcgtgattcccacccgtcgcgagccaagaggttcgaggtcatttttgagccaagaggttcgcggccacgggagcaaccctacagaaccatcaccaccaccgctctctcttcctctgctcttctctgcctgcctgagctcaccgcacctcgcctcctcaccgcggatcctccgttaatccggtaactctctcaccatctctgcagtcaccctagagtccctctctgcctgctcctgccagcgcgtggtgcgggggcgtggtgcggctctccaagattcgcctagcattgctcgctcggggtcatgccaagccgattcgatctcgcgcttgcgcactcctgccgcggatccggctagatctcgctagaattggggcgtgcgtttatttcaaatgcagcagatccgcgtgcttgcgcgcgtgatctagcgtcgtcgcgggcctttcgttaacgaaatgcatggcccgatctgtggtttggtggtcaatgccatgttttttttattactgtcttatgctgggagcaaaatagaaacagagaatagcttcaattgatgccttttagaacggattctgtagagcaactcatggacactttcttcttgttttaacaaacgtggcatcggccgagctctggtgtaagtagaaa

SEQ ID NO: 3400 - DNA, 217 bp, Zea mays
acggatatatggatcgatgtggcaattaattgatacacaaaactaggttaattattactaccagctgctgcggtaaacagatcagaaagggggaaaaaggagaagagagagctagcaatggatcgatgcctgagggagcattgctgccagtgatagcacatgtggttttaccatagttcatttgagtaaagattcaatttactggattagtagaagg

SEQ ID NO: 3401 - DNA, 367 bp, Zea mays
tgataaatattcaaaaacggatgtagtatatttattcaaatacaattatattttttgttttcaatatattagtatacgtatatatttataattttttgtataatataaacagcaaggatcctctacaccgcacgaaaaaaaccgtcaacattgtgcaatatttagacgacagttttcagcgtaactgacagcgtaagaacactcagcactttgctaaatctggaattcacgtccagaaaaaggaacacggttcccgtccacagaccccacaccatcgttaacgtagaagtatcgcccagaaatctggccaccctcctcgcgcggaacgacccgagggtgccccgtccactctcgtgtcggtcccgcg

SEQ ID NO: 3402 - DNA, 697 bp, Zea mays
tgtggtgttcctgtttgttctgtgcaaagtgtgtggtggttcagttgtgctctcccagtttcaggaggtgttctgttcatcttgaaggaccaagtgttctgtgtgtaatctgtgcaatctgtgataatttctgttgtaattttagttcaaatctgtgtaatctgtgcaatctgtgataatttctgttgtaatctgtgcaatctgtgataatttctgttgtaatctgtgcaatctgtgataatttctgttgtaatctgtgcaatctgtgataatttctgtgtgtaatctgtgattatatttttagttcaaatctattgtaatttgtgcaatctgtgataatttctgtgtgtaatctgtgattatatttttagttcaaatctattgtaatttgtgtagtagcgtttaaaattttaaaatttggcgggagcttcattgtacagaagaaaactgtcgacaacccacctaattgagccaagctaaaaaaaagggaaccaaacaatgtataatatgagcctggtttatttggaccaggcaaccaaacagtctttgttggctcggtacatccgggctcttctgagcctggtcctcttactggaccaggctcaggctgggccagacaaccaaacacatcctacgtctcctcattcacattcatcctgtcggactgtagcgcgcacgccccggccggatcagagag

SEQ ID NO: 3403 - DNA, 1500 bp, Zea mays
aatttgatgtacttattaccctttataagcctcttttttttttaatatatgtatttccgtggtcgctaaaaatgaccgtgacatcaaatgcgttacctcagtgcgtaaggaccggaagttccatagatacacctttctttaggcctccgcggataaagccggtcactgcttgttattacgctgtgagcctgtggcttggaggagccaaagggcaccaacacgacatgacgcgtagctcatgctttaccggactgctagcttatccagagatgaacgccgcggatcaccactttggctgccactgatcattgtgctgctcggcttctttccaagtacacgtactacttacaatttttctttaatccgccgtgtcgaccaccgagtgcaagcgttctgccgccacggcctttttttttcatgaattgcgatccgacacgaacgaaagccaaaccaccatccccacctccggcggcggacccactagctggacgctacacctccccaaaagtgatcctctgacggttcacggcatggacagcagtgccgctctggttgaagttgaagccaaggatccaccgactcctaagaaaaggacaatgggtcagatgtatgggtcagaagcagtaatacgtataggagcggcatctgttagcgtcgtctgtagaatctgatgagcaatgcgacgtactccgtgctccgatccgatataccatcccctgctctcgctacggagcctgccctccccatttaaaatacgtcaatgtccttccatgtgggtggccgctggactgagctgggctgggctcagagatgtcaatggagacccgatacccgtcaacccgtggggaattcccctattagggtacgggtatgagacaaaaattgtacccatgagtatggatatgggacaaaatctccacccattgggtaaacgggtatgggtttgggaagcaataatccgaacccgattacccatgggtatttcatacgtgtagacctgtcgtgtttgtatgaatgagttgaggccgagctggccaccaagcctagcacgacagcacaccaggccccaggtcctagcccaacaaggcaaaatgacaaggcaactagcagactagcaaaaaaacaaaaccctaaaataaccagccatatgctacgccctgcctagacgacggtgacgaccatggattctcaggcgccaaccaactcagatggtgaccaaggaaggtgagcaaactctatttctccatttcttctatcggtctcgaggtacttatttcttttctgatggatggatgaatagatcattgttcatagatgagtgctagcttgtcgatgtggtgatgtctgaaatctagatagtttgtgctacctgttaatacctagttatcccttaattggggatggggacccattggggacccgaaacccgaatgggtatgggtatgggatgagtttttcacccatgatgagtatggggatgggtatggggacggatcaaac

SEQ ID NO: 3404 - DNA, 489 bp, Zea mays
tgaaaacgtggaatttaccctaactccactaatttgatggagcagccaaagaggggctacacaaattcatgtttttagtccttgtggagttagtatgaaattaaccactatgtcactcgttacacaacgtcgttttgttttattttcttacactctttcggtcttttcccattcaaggccattttttaagttggagttccatgattggattggtgaaacatagttaaaaatagtgaggtggaggtagagcaaggtggaacgcgttaagtttcgtcgcagcagcggtgcgtcaggtcgctaacggcttcctttctttgcttagcacccaacgctaccctcttggtccaatccaacccatccatctactagcctctcataggttctggcacgccgaaaactccgtataaaacacacaccgccctcctacggatcaaaccacccctcggaaaaccccaaaaaagcgtcagaaaaagaagagagagctggggg

SEQ ID NO: 3405 - DNA, 1229 bp, Zea mays
aaatcataattgcataatataacgtaggggtaaaattacaatcatagacatttttcgtctttcatattaaatttaacacwgttaactacacgtaacggtgcaaaggtatgacacaactttgtttttaaaataaatgggtctaggttaaaaaatgagaggtaaaattacaaatgcaagaccaatgagaggtatgatcacaaatgccccatatgtaataatgcacttaggtggtgtttggtttctagggactaatatttagttcttttattttattccattttagttcttatattgtcaaatacggaaactaaaacagagtcttagtttccgtatttagcattttaagtattaaaatagaataaaatgtagggactaaatattagtccctagaaaccaaacacccacttattaggttatctctctttgttgacttcttattgtattttgggtacaaatatagtctttatccaattttgaccttaaaattgagacgacatacatgcacccattctcaacgaggaaaagaggaaccttctcgaatttcgataatcctatacgctattgttttcttgtgtcttctaaaaaactatcataagctttacgctgtaaaaaactgttgagagtgtacaaaaactataagatttatggtttaaccaagtataaaatctaacttctatctctataccactttaaaataaagtataaaacagtttccaccattttaaaaaccaaaaaaacagaatttaaatactttcaaaacccacactactaaaaaaatagtaacttgctttttgtttctatttttctatgcttttacattttttaaagcaaaagcagccgtttgcttctgcttctatttttagttaccttttacatttttaaaagcaaaagcagtagctaaaagccagcctatgccttcgcatatgcctagaaccttcctcatgcctctgatgatatgccacctcgaccccaccgcacagagacacaagcctccacgtcacgcggcgaatccgggccgtccatcacctctaccccgcgcccctccccgccgttaaatcccacgcgtcaaaccgtgtctattcctcgtcagactttcagttcttccaatctcttgcaagcacaactgcacaagggaacaggaggaaaaaagagcgagaactcgcagctgacgcgcacacggcaagccccaatcggagccgcggaccggatcagaactaggtctcgaggcg

SEQ ID NO: 3406 - DNA, 851 bp, Zea mays
agtggcggccactctaccaccaacggtttggtcttcgtctgtacacccgaacctggcatattcatacggtgactgcaaggtgagccacaactcagaggcaagtagagtcagcaaagatatatgaaagggaggagaggggttgaacagattattactctcagaaaccagccccttctaccctaccgttcttcctcctatacaatacaacaactactctcttgcgttgtactcggagccaggatcagatggatgcccttgctttgctgcctatcctgatctcttctcctctcaggatgtaggcagatcgagtaatcggtggctcacattttgacaagacactcaaggttcgtctcgatctccaccctgcttccatccccctttgtttttgtatcagagagaaataatggcttcctagttgctgctacccatctatgcggtaggcaaacatgcgaatacttcctcagcaaatcctatccagccactccaaaaagtatccacagattccaaagactttcagcaaatccttaaggtatagtagcagatctgacccagcgttgacttttcagcaagcctcaaataagaactagctgatcagactttcaattagcttttttttttgttggcagatcagacttcaaaataagaactagctgatcagactttcaattagctttttttttgttggcagatcatcagacttcaaaagaactagctgtcccttttgcattacatcttatagaccagttacagtttgctgctcggtaacagatttcttctattcatgtagggagcggcactgatgctataaggtgagccttgaccttattccaagtctgatcgaataagaagag

SEQ ID NO: 3407 - DNA, 446 bp, Zea mays
agtggcggccactctaccaccaacggtttggtcttcgtctgtacacccgaacctggcatattcatacggtgactgcaaggtgagccacaactcagaggcaagtagagtcagcaaagatatatgaaagggaggagaggggttgaacagattattactctcagaaaccagccccttctaccctaccgttcttcctcctatacaatacaacaactactctcttgcgttgtactcggagccaggatcagatggatgcccttgctttgctgcctatcctgatctcttctcctctcaggatgtaggcagatcgagtaatcggtggctcacattttgacaagacactcaaggttcgtctcgatctccaccctgcttccatccccctttgtttttgtatcagagagaaataatggcttcctagttgctgctacccatctatgcggtaggcaaac

SEQ ID NO: 3408 - DNA, 1355 bp, Zea mays
aggcggggcacgtacgcttcggcccgccatggtcctccggccggtgagccgacaatagctagcggaatggtggtagagtagctgtatatgtctacgtgtagttccctactaggtgtacgtaggggttcagctagcagcacatcttacctttccttttggggggagtccttttttgtgtgaagattgctgctctggtgcctctgtgttagctagagattgacaaaagcagtaggagatccatggaggtccaaaaggttcctcaaaagcttggaatctgcgtacgtgcgtgtgtgtgtgaagtacttacctgttacgagcatatgttgtgaatctactttgtgaatctcccgttttccgaatcttctctcttggaatcgccgatggatctatacatctgccgatctgcgattgtgcatcaaccttccatcctcgactttccctctttgtcatttccgctctttggcttcatcatccatacgatatgtaaaataaaaaaaaaacctatagcttcatcattcgtgtgcaccattcttattttcaaggagataggcaaattatataattatatctcaaaaagtatatactagatggataaataacaaaaatagctaaaaggctgtaaaaaagctgcgtgttgccatgttgaaactattttctatcaaaacaattgagataattttaattggatctatagaattataaatctgaatattattccgatctatcgcttcagatcctaaatggataaatgacaaaaagagctaaaaggctgtaaatcttgccatactgttaactttttctataaagatttattttttgcaaagatgtataacgagaaaaaattggagaacttgctatttcaaacggtgaaatggaagttttgagatgatagaatttaaatctcacgattctaattgtcaagatgagcatatttctacacattttttgttgcgtcgtttcgaaaaacaatcaaaaaatgttttataagatgtagatgattcgtgaaaactttagtgggcccatactctgtcaaagaactccggtgaaaatgggccctcagatgtcaaattcttggcccacatacgtacattatggacgccgccggccacacaaaccgcaggctcgggagtgctccggaacccgccgccgcatccgcacgacgccacggctgacgactgggagccccgttcgcctccaccgccacctccccccgcgtagaagtagagagggaagctttgcagcgagaagccgagaaccctgtcgatctttcctgaagcaatccgctcctgtcgtgagctgaaccctacagttcgtatcacctcctctcgcagcagctgcagaaagagcaagggggg

SEQ ID NO: 3409 - DNA, 656 bp, Zea mays
gataaatactgtggtaaaagtttgcaacaacgtacctaatcaaatgacaatggcaggtacatataaacgtaccccacatcgatatatactataaacaaacaaatacaatatggatcgagatatgtatggcgctccgcggattaatcaacgaattaataatcaattaatgaatcttggcgcgggcggcgggcgccggcgccggcgcgtcaccggcgccaccggtggcccgcttgatgagcgcgtgggcgacgcgcatgagcgcctcgaagtccttgttcttggcgagcagcgtggttttgacgggcgtggatggggcgtgcttgcagcagacgtcgcaggaccacgtgtcctcctccgccgtgtccaggaacagcttcacgtcgtggagcttgccgtcgtcgaggccgccctcggtgtcgtccaggtggtccagcgcctcctcgatctccccggcgcactcgttcaggcactgccacatgtcgttgtccttcaccacgtccatctcgtgccgcgcgtagtcgcccgccgcgccgcccgcggtcgtcgccgcgcggagcgccgcctccgccaggtcccgcggggtcttggagtcgctgtccgcctggagcgcgcgcaggcacacgtccgggtccggcgtcgctgcacacgacaccttg

SEQ ID NO: 3410 - DNA, 123 bp, Zea mays
atagtgtggaagcagaaataaccttaaggataaggaactcccctctgcgggatcctgcatctccagcacatttctcttctcaatgttaagaaatcatgcaacctggcagttgttttaaaggca

SEQ ID NO: 3411 - DNA, 1500 bp, Zea mays
ataggtagaccatgaagatggaaagcatgtgattggacaaaagaatattatgagaaaaccatctatatattacaaatatgtttttttaacgtgtacttctcctatattattctgtgtgcctgaattgcaacgaactcaaaactatagttttagtgcacatgtcaataagagcgcgtaccgtacctcgagagaggaaagataacgtgtagtttgtaacaaatttggcaagtataaaagctagactttgccggtgcacgcatgcatgcatgtatgccgccactgccactgccactgcgtgcacgcactgtccatcttttctacagcgcgcggctggaagaagtttcgcagaacctacatgcctgatctccgacgacgacagcgcgcagggtcacctttgtattgtcgcgcacggcagctgcatgcagccgtggagtgagcgacagaccagctagccgccatatatcgctagcaatgcagggtcgtcgtcgcctacttaagttaattagctggatcgatgatggcgactatggggggttacggtttccaattccaccccgtaatctccattgattttccggcccgtttccgcagagcactatactgcccgcgcgcgtggatggtcacctcggttctccgcccgcgtgcgtgcgtgcgtgcatatgatccgtacgtccatggaggagaccagcagacacacggcaaggtcactatagcccacctacaacgagtaaaacgacgctagtagtagtcatgattcctgaaccctgacgacgacgagtggcggctgcagttcaccactcaacaggaaacaatgacgacaagacgtgtcgcacgggccccggcgcctgccgccgatgccaaatgttagatgccaaatgttagactctctgcagcggttctctctaaatttcttttttttatattacttttttatcatatcatcaatattttatctcttattttttttatctctcgcagttgtttctctaatattctccctctatactccactacaaccataaaatatcattataaccctatttatcatctattacttttttttcacctattaaaaaagtatcgtacgcatgaaccgtgaatagaggggcggctgcttcacgctagcggtagcggttcacctttcaaatctactggctagggggtcctgtggggaatgctgttgcagccttggggagcatctgtagccggcaaggggaggagggagctggctggcggacgcgactgcggacagccttacactccagcccagcccctgcagcaatataccagcactgcacaatgcaggcctcctcctagtcccagctttgacgcactgtatttaaggcctcccacgttagacgttattctttatatatatacttagggcagggggttttgcatctctctattcattcatccggccaccaccgctctaactactcttcaagagacgacgaccaacaggcacgtcgatcgtcttccggcgagggcgacggaagg

SEQ ID NO: 3412 - DNA, 1349 bp, Zea mays
gtaattgtcgtgtatttgtgcaatgttctttccaaactgtctacaaagtcaaagaactttgaacattcgaccgttggacccgacaaagcgagcccaacacttagggaacaggtgagatagacgatgcatgataaaatagggagctgggtagttrggatgtcttgtcaagtgtgtcccgtctggggtcggtatagggtatttaaagggtgaccaggggttccacgcttaaagtacgcacacaccctcagtttccaacatattcagtggcggagggcctaatgtggccgggtatggctcacgcataccttggtccagcatattagcatactagaaggtctcctctctatgacttcgtctagcgctaggtcttctctttcgactctgatctttgccgtcgtcactcggttctctagctcttgaarcgtgcacctacaagtcgcccactctccagctctctccactcttcggcaagggtgagactgaggcgggtcctgtgtcgtgcatgttgtgcggtgcgccctgctggccagcccggctgyccgacctgagctagcactacgcagctgcttcactgaytttggtgcttgcagcttccttgtgccttgtgtggcccatgaccgtgtgaccatccttccagcgtagcctaatcaacctcatacattcactgattgtgagcactacgacactatatgccacaataagcaacctcaacattcattcatgttgtgctactccgaacctattagcctattcatcacacaatacaatttcattatacaaataagtgaagcggtgaaagcagaggcgcctggtacagaaacttttttgcctttttagaccacgcaccggcgaggaagcaatcaattagaaaccccacgagcgaagtttgacataggcaaacaccaaaaagacatctctgtcactgagaactgcaagttcaaagtcatgtaaaaaaccggtcataccttaaattttactcgtcctccgcaactcccaatatattgtacaacgggtaattacggaacaataactaccttacaatattaatgattgaaaaaaaagaaagcataaatgataaaattcgtatgttaagcgtccattcatttttactaacgggtcacactattactccaatcatcgtacattaatcggcggccgtcacccatatattcaacattcgtttcgctgttgtgttgggccttactacatttgtagacggcatctagggcctcttttgacctttctagatgtcatctataaatasgcatacttggcaagctgatgcatcaactcatcacccgtagtatcaattatcataacctccgactccgacgatctgaactgtgaag

SEQ ID NO: 3413 - DNA, 980 bp, Zea mays
aatcaaaatttaaatgggatcaaaacatttttagacttgagctaggtcgaaccagataacccgaaggtacacctatacttccgacgcatgactcgacctagagcacacgtctagctcccgttctcttctcctagcatcaataaggtgttttgtttgtctacaaattttacaagaccggcttaattgagccattgtacatgcccaaaaacaaagactccgagggatgtttgagatgactctaggtttcaactctaatatgaaactgcagtttataatatcaatttaaatagttttaaaaatatttctaatctaaataataaataaaatgagttttctaaatgtcttttaaaacttataacttgaactttacgattttttgagcatctgataatggtcagaagctgaaaaatggaacaaacaagtcgatagatcaaagaaaaagggtgtgtttggtttgaggaataaagtgatccatcttcttctcactcctcgcatttttatttggtttgttgaatagaatgagttggtccatcaccacctcattcctcataagctaataattagtatatacatgaggagtgagttgattccactaaaattgatggaattaacttatgatgcatcacctcatgaagcattgggtgactccacaaaccaaacacatcaaaaggctctagctaatcatactggtttaggtttcaagttccaaatggacgcgcatttgactatacgtaaaaggagcctcaccctacagcctcaccctacagcctgtactcgacatttccccaaatatgtgcaggtcagaaaaggagcctcaccctacagcctatacgtaaaagcgggcccggtcttgaaatccataaagaacgcctatttcagtccatttgcacttcctcgccaccgccgcttcgttggtacatctctctcttccccacgccatccccgacaagcggcaaataacctctccggcggcgagacag

SEQ ID NO: 3414 - DNA, 448 bp, Zea mays
tggtgagcccgtgagcctaggccctagcccctaggggaggagttcgtcgactcgtcggtttcggtgttggcgtcgtgcgacgaaggcgtcgtgcggtgagtttatgggtcgtggctaactgcgccacactttgtctaaggttaggcgttcgaattgaaaaactaaccttatatagaaaagtttaaagtgtggcaagttagacagtgaaccaaacagaccttatatgttccgcgtacgccacgcgcagaccggatgggcctccgacagtccgaggtcgggaagggcccggattctctcgctttccatgttttactattaggcctgtttgatcttcgtcagggctggcctcactgtgaagtccactagaatttagcaggcctgaatctttttacctcatttttttttctrttctctgccccaaacgcacaagccctagccgccgaccacc

SEQ ID NO: 3415 - DNA, 106 bp, Zea mays
agtcttagaaacatacctttttacttgatttgcactttgtccaccactttgcatagattgacataagtccacttgtgttggcactcaatcaccaaaataattagaa

SEQ ID NO: 3416 - DNA, 1425 bp, Zea mays
gtctgatggtaaaatagagaagtccataactgagagcgacaaaataacaaattcgtacacgttctcagggtgctggacaggcggtacacatcagtggcgaacagttccttccgcgcacacaagtctgtcctgggcgaggtttgtggctttgtgcagtgtgtatctcctatccctgctccgcacacaaaacattatattgaatatagatttttttattgaatacaactatacaaactaaacgtatgtaccacaaaataatattgaacatagaaaaaaactttacaaggctgatttggcaaaacaatatagaaagtcatgttgtcaaatagatttttataatgactttggcttttctagaaaagcagaaaagctagagcagaagctatttatgtaattactccgttcataaatatatgacactattgactttttttttaatttttttgaccactcttcttattcaaaaaaaattaatatattgtaatttattttttgatttgttttatcgcttaagttagtttgtgtttgacttaaaattttaagtttttgaataaatattttaaataagacgagtggtcaaagttatttttaaaaaaaatcgacggtatcatatatttgtgaacggaggtagtaaaagctaaagcccttgacaaagaggatgttagatgtacactttagagggtgtttaacattgctttaaagttgagcaactctgcttcaaagttgtagagtttctaaaagtgtttagtttacagaatagctttagtttcactaaaatgagattttttcttgtgtagttggtggcaatgatgggtaattactctctaactccatgaggttattgaaaaaccgtgtttgtgaagcacactttgctcctttataaaaaagtgaagttaaccctcaactttatatttttttggtgaaggcgagtcgttgaagttagaagagtcgttgaagttagaagtgtttgactagatgtttgtgaagctaagttgatttccgtaaaatgaagcagtcccaaatactcaagctggatgatacaaagttaagtttagagcatcttcaaaggacacttcatttttttattactttttatttgactctttatttatctctcaataacgattatactctataatatagcatctcatctcaaccgactctctaatatgcaatttagtttggttaggaagatgaytaatttagagagccagatatcttgacgatttagataattattctgttgaatagttattttgctattaaatagctaaaatttagtattttagagatgttcttaaggttagtatgctactaggaaaaacctagacacgaagtccaacccaaatctcaatatcccaaccctccgatccccatttccatccactccgacaccaatcctccgctccgaccaccgccggagaa

SEQ ID NO: 3417 - DNA, 1500 bp, Zea mays
tataaatctcgtctaaagctcatttaatcaactctcggtagaagctagtcgatctgtgtccgagtctggttacttgtcacacctaaaagggaaatgtgcctttgggccatttctataatgttttggtgattaagtgtccaacacatattctttaagtcctaatgtaccaaagattgaaaaagtgcaaatcaaggaaaaaggtatgtttccagacttggtgaattattttatgtactaacatggttatccaagtgatagaaacaatgactaaaataagaagagaggaaaagggaagacttggctctatacaaccaaacttcagctcggtctggcacaccggactgtccggtggtgctcggacagtgtccggtgcgctaggctgggctccgatgaaagtgctgctctcgggactcgacggcggcgtacggctaaaattcaccggaccgtccggtggtgcaccggactatccggtgagtcgtccgcggcgaactcggcgccctcgggaaaagcaaaggggcaacgtggctataattcaccggactatccggtggtgcaccggactgtccggtgagccaacggtcgccagcgccaacggtcggccacacaatcttcgcgcgacacgtggtcgcgccaatggtcggtaggggcactggactgtccggtgtgcaccggacagtgttcggtgcgccaataggcccgaagctacaacgatcgactgtgcccgatttggaagggaattgcgcaccggacaagctacagtagctgttcggtggcgcaccggactgtccggtgcgccactcgaccagaaggcaaggatggccttctaagtttgtctccaacggctcctagctgccttggtgctataaaagggtcccctaggcacatggaggagaaaccccaagcattcactaagcatcctaagactccaacttttcacattcgattctttgtgatagtgatttgagctccatttgagttatgaactccgtgcgttgtgtttcgagctcaagtcgtgacttgtatgcgtggttgtgctgcttatttgagtcttgtgtgtgttgctcttcccaagcttactcttgtgcgttctttgtgatcaatattgtaagggcgagaggctccaacttgtggagattcctcgcaaacgggaaaaaagactataaggaagaaagttgtggtattcaagttgatcattggatcacttgaaaggggttgagtgcaacccttgtccattaggacgccacaacgtggaagtaggcaagtgttacttggttgaaccacaggataaaatcgcgtgtctcttgtgattactttctctgtgattgttttgtccacaagaactcgcttctcaactacttagtcgcactaacacttctataactaagttgtgtggctatttagtgttgaattttacaggatcacctattcatcccccctctaggtgctctcaattggtatcagagccgtactcttcatctaagggactaaccgcccgaagag

SEQ ID NO: 3418 - DNA, 835 bp, Zea mays
ggtatgtgtatgttgacacatgttatttctgtaatacagggtcaatcatttaggcattatttgagcgtaaacttcttctcttttaaatctagcccttgatcttttttaaatatagccgaatcaaattagtgatttatccaaggaaatagtaacggttgtgtgcaatagaaagagtatgaaatgttattgtccatgtgttttttttctttcgaaaatttgcgagctcatttctttgtagttatgtcttctatgtcttatcagcatagtttgttgcaactttcataattctcagatttcatatttgcaatgaataggcgtggtctgttgatttgatagccatgatattcttaagcacatcaactaatgcacatttactgctgaaagaagatacctgacgcttttattgctcatcaagttaaaattgtcaaatttgttggcaacttgatgttggttctggggggttctgttgatttgattaccatgatgttaagcatgtcaactaatgcacacttactgctcatacctgacacttctgtctcatatcaggttaaaattgtcaaactttgttcgcaacttgggtgttggtccctggggggaatttatagaccctggctaccgaaatgggtgctttgctaaaactggtggatgatgtgcttaagggaagactggggatccagattcatcctcgtatggagatagacgtctgtttgatggtgctcaaccaccgaccataccagaagaatttcagaagttcgttcaagatggcatccaagcttcccatgaattcttgaaacaacaaaaaggagctaccaatgttgtgcaagaaatccctgca

SEQ ID NO: 3419 - DNA, 155 bp, Zea mays
attggatgtgcacaactgtcttggtgatacttaacaatatccattctctttcgggaacaacgggaaatgttttgtttttcagaacagtggaattgtatgatgcttctgccaattatctttgaaagaaccttatgctctctgttttgtctttccag

SEQ ID NO: 3420 - DNA, 1500 bp, Zea mays
tgcaggcactgacagcgtaactgatatatatatatatatatatatatatatatatatatatatatatatatatatatatatatatatatatatatcatgcacaaagaattaagcatgacgtagcgttatatatggcctaaccaaccaattatgtggtccaagtagctagcttttgtgctggcataatagtgattgtgctggcagttgggtaactttttgtttgtatatatggttaattgacctgtttccatagctgtgattgcttgagtcttgggttttggttaggtcagttatatagtctgtagtacttttctgcctccgctacctcaaaatccatgctgcgctgcacctaactttgatagatatgtcttgctgttttcaataaaagagttttattagttgggtctgcactaaggactgcaggtcatgcatggcattaactgggctcagatggtaggcaataatttccattgaacaggtggtaggcgcgcgcatccagagaccatacatacctgctctatctctgtgatggatatttttgttgtcgttaatttccattgatttgggtataccacaagtgagactagcagagacatggagagatgcaatgaaaagaacaagacgataataattggtactaacttttatatgtcaaacctttatgtaccacacggtagtctttgttttcctctgacctaagttgtgtttggctgtcaactgagacagtatggcaccaagagcctagtacacaattgccatctgcctttgtttctccccctgggccctctcgagtctggactttttctccgctcgtactagcccatcatcaaccgaatttgggtgaagacggtcggtcggcgtcagagaggtttatttgtaaccaatctttggtagatacgtttagcggttccatgccgacgcgtgttccatcaaataattatcgtcatatcattgtcaaactttacagtggaatgtaaaaaaaaattactgttgaagaatgcatgcatattttctggtgatgcgcatgtaactctgcttgtatgcatgcacttgtcttctcttcctccaccacatgctcacggcgtgaagtaaaccccatggcatgtgccgcagaaatagatgggaaaaaaaggatgtgtttaatattctaatctgatgagttctttcttgtatactgttctacacgcacagataaaataaatataacctatgcagaagaaactccagttagttactggaaaacagacagccccagcgccggccccaggctccattccatggaccatggcaccggttgttgactgctctgctgtctgcacactaatggcagtctctgtcagtctacatatatatataacacagagtgagcctgcagaagcgggcaagttgagcagcaactcagcagaagcaccaccactacggccggttcgtcgtccctagataagctggtgcgtctcgcggcgtggtggatcggaggagaggtgggacaggcaggcaccc

SEQ ID NO: 3421 - DNA, 1500 bp, Zea mays
gcagatcagatgccatggtcgtccgtcctctgggcggctgagcttcaggacaggatcctcatctgaaatgacatggaagcaccgagtcaccgacaggaggaagtagctcgagtctgtccagtggtcgcagctagctgttggtggagtggaggatgcaggctaggggcattgaatggcgaggagaagaattggggcgggcacagggcatgacagagacgacgacgacgacgacgcaggctggttggcggtgctggcatggcatggcattggcatcttcagtgttgacactgcagatgagatgggtggcggatgattgagagtagtagcagtgtgttaatttacaagttggtgggcgacttgattgcgctgtggaggccgagagggacggccatccacgccgacgtcgatgtgaatgtgagtgtacactgtacacccccaggactgtgatgaggagtccgccgacgctcatcgtctaatgccccctatatgtgacgactgctggacgccgtctctttccccggcaccttctgggccaaacccttattacgtctctgttggaccacagacgactcgtcgattgatgaaccactcgttctccggtacggtatttaacagcttaatctgacgaacagtctccagctatcgcatcatcaactgtttcttaacgttcacagtccagtggcgtcctcgtgcgcaactggtagtcggcaccgcactggtctcgatcggcatgtggttgtgtaaaacaccccgtaaattaagatgatgccactcatgtggtcatcaggttgtttagaaagaggcgaagaaagcacgattaaaaaccaaacaacaagagcaacaaatgaaatacagtggagagacaccaaaacggttctccaaacaccggagacaactaagagactctattgtacaatagagtgtctataaacgtagtctattaataaatacagaattaaatgtatttgtatagcatcagatcgatagaacagacgacaaattcgtacagtaggaagtgaggcgtctgttgttacttggtttacgagccagaggcgtctcttcacggagagacggctctaagatttttttgcaaataaccctctaaaacaccttaagagcccccacattaaacaccactgtacatgcccttagttagaccaaacaagctagttagttaccgctaatagttagctaattcatctaaacagagcctaaaatgaaagtcagtcaataatcacagaatcccaccttatttttggtggtcagctgggtgtagaaaaacttgtggcgcacactgactctgaggcgccatgtcacgctggagcacctgcgcccgtgtgtatatatatatatatatgagccgccgcctgtcgtactgccttgcacagacaacaacaccaagccacttccagcagccttccttccaggccagctacaactgctgggctcatcaccagaaaccagaacgcagtcggcaggcaacacctctcctgaaccgaa

SEQ ID NO: 3422 - DNA, 658 bp, Zea mays
cggaaaagacgcgtgcaaggtgctcgatgtaatgcctgtgtacaacaaatgtgaaggaaatatacgactagtaatcagtttgtcattttatatccatacaaaactattaattaattcatgatgctggagtatttcatcatttttaatggcgtacgtttaatccaattgaaatataagaaaaacaaagaataaatatggtagtttatgtattctaacgctatagatatagaggaccgaatttagaaaatattgttgaagatgagaaatatatagaagaccaaaatcttttaaaatgtactataaagaaataaaatatttttttagagggtgaaatttatgacgttcctcgaggctggagaagcctgaaggtgctcctggactacccagccggccaggcgttcgcgttcacgtggcacgtgagagtcgcgtgatgcggtgcatgggccggcccgtacctatttggaatttcacaaaaaaaaaggggtgggggaagatcgggcgtcgcccgtccgtctcctctccccgctccgctggtcgccttctcccctccccgcgaactcgggctcaaagcaaaccaaaccccttctagggtttgcgctccgggcatgatccccttgtagccaccgcctcccatggccctagccgtgtcctgctggcc

SEQ ID NO: 3423 - DNA, 1050 bp, Zea mays
tgaatttacttgtcggaacgaggtttgaaacaccgacaataactttagcttaagcttgttacatgcatttcatttcaactagaacatactcaattaataatattatgagacatttataagttatgtaactttagcttaaactttgttacatatagttcatttcaactaaaacatactcaattaatactattatgagacatggttgtaaggactagtttgaaaactgaaatctcctccacgattttcggatgaaatttacgtttccaaaatagttctaagttatgttgatttttagggtgggtttttagaaacccatgagtttttggttatgtgtagtgcatacattgagtttccttttgaatccattaataatcccattaggtagagaaattaggctaaaatacatacttaagggctagtttaagaactctatttttctaagagactcctattttactaacaaaaaataaactaattttcattagaaaaatgaaaatcgtgaaataagggattttcatttttttctttggaaattagttcatttttattggaaattctttagaaaaatggagttattaaatacaaaattcaccgggtttagagtagcggtatctattgccatctttaggttatgatcggtgaattttctatagctatcaccgttccatgacagcgtcactcctgcacacgatggagcccgagtccttgcaggacgagtttgagcttcaacctgactagataagtgtggcgttctggcaagttagaaaccaaacaggccaaaccttccagaaacgagcgaaaaagcgtccccgatccagcacagacagacacacaccggaaggaggcgcaccttcccccagccccactatacgacgaccgccgcggtcgaaccaaaacagcttcctcctcccggcgtcgcctccgcgacgatcctttccgccgccccatagggttctgctgctcccgatccgggcgccagatctcgcgtggcgacgcgcggatctcggatttctctagaggcggcggcggcggcggccggagcaggaggag

SEQ ID NO: 3424 - DNA, 442 bp, Zea mays
ggtacgtgagctatatattcctttcattattgctatcttatrctagacttgaaaaaactcaaatgcagttaaaaaagttttatgatgagatatctcttgctttgacaacatgttgcgtctgatgcatctgcattaataaggttactcgattttttgcagtattattgtgtccataacagctggagtaggaacctatattccatatttttgtaatactatgttactaattgatcaatcaattgacattaatttttagtttctgaatgttctcacctaaatatgggtggtaatggggctttggcctctccagattcaataaaatattgtgggtggtaatatattgtgttgtggttctgtaaaagttacatctgatgcattttaaatgactacagtgtgcattttttcttgcaaaatattaaaaatggcagccagctaattctct

SEQ ID NO: 3425 - DNA, 662 bp, Zea mays
ggtacccctgaacacaggccacatgctactgcacggcgtacgctgcctgcatgggattagggaatatctctctatctcggttctaggcgacaaaaaaatttcattcttccccatttccgttccccatggaataaattctaacatcatcgtttaaattataattaagatatacattctttgtttttaatgttaaacattgtcacttatacacattatcagatgtaagaaataattatgcatacatcaaaataaacatatttgtacaattagtagtctcttgataagctaattatttattttttgtcgttaactagtacacaaaatatagtcacgtgcaagtttaataaatcctcgcggagaacgggtataaggaatatgtccccatctccttttacccgtcggaagataattttttctcgtttatattcccgtagtgaaaatttcttttccatcaccgtctcctaacagagaaattttcagtgataaatcgaagatcgggtccacgttgccatggatctctaccgtacgtggaccatggcgtgacgcgacctgtcctctcgtcccggcaccctactataaattgcggtccaacacgcacgctaattgcacacagagctacctactgtaaacattcaacactcaagagccaagagggagagacg

SEQ ID NO: 3426 - DNA, 1383 bp, Zea mays
acatgagaaaaagaaaagctctaaaacaaccacctcaataagacaatgttgatgaagaaatcgagtgtctccatgacattaagagatgtcaaaatccaaaagcaaaagatgcttcacgtcgcccaccttcattggcagatagatgaaacctcaaaaaaaactacaacatatgagaagggaagaagaagaagagcatatgcaaagatcaaagatgtcatgacacaagggaccttcatctaaaagagccaaatcatgtctccttcgttcatgacaactatggaggaaattttggcagtgaatttgtatggggtggatcatgacatcgagaactgaaattaaatgcacaacggacaatcgagaattgaaagtaaatgcacaatggacactaggatttagacatgtacaagctctcaatgcgagataatacccacatcatatgtgttacagtgtctattgcctatgcaatagtgatcagatgatctgcccttgattgacgctattgtccccctttatagtatatactataaattcatttccataattttatataaattataaaaccttttggatgtcgaatcgtgttttgtaaaagctggagattgattctgttaaaaataggacctagacttaatactttacgcacttggcggctccttgtacccaatcagtgatccctggcgattagcgacgtcccgggtggcttgccgaccccgaagcagcccttggaactctcctcctcgacagtatctacctcggggagagttttaggggtttttacggagaagaagaccctctgcgccatcacagaccttccgagccccagacgtggaccggccggacgtaagcagggaaggagccgcttctgcatccaggtcgtggaccgtccggccgagagacacggaccgttcgcgccttcacagatagtacgtaccgccaggtggttcactttaaatgtttggcgtctagatcggtgccaacaacctgtcagtggtttgaatcaatattaatattttgtagctatagtatggattggagacgccgaacgatactaactttttaagcataaattagtaccggttgagttattactgaccgatacctactgttttttctaggtacgcgtggcagcttgaatcgatatggtgaggcttacgtcagtatcagttttaacctaaatggtacttaaatttgaaattaggtctagtagtgcacgtgtgacacgtgccgctgctagctgtggacaatacggaaccccttccctcctggagtatatataaagaagccctcatacggtctccgtcgtcgatcaatactatactactatcacagtaggaagctaggaggaaatcaaagcaacaaagttgctggccgagagaagcaacc

SEQ ID NO: 3427 - DNA, 1095 bp, Zea mays
aattagtttgcaccagcagatatgatcccgtgctgacgatgattaattacgcgtgaaatcgcgcaggattaaagtggctttcacgagtgtgccatcgtcattccgattcgtggtgggcagctagaggcttgctccattccaaaggcgaaatcgaccccgacgacgcatctttaccatgagctagcttcgtgcgcaaggccggaccacgttttcttctgcacttgtcgtccttctgaaaaagctactactgaactaaggcctagtttggatactctaatattagagtgttttgaagggattggagagggtgtaaatctctaatagatcaaatactctctcaatatatctcaatctactttaatcccactcattaatagagtatccaaactaggtctaatgggatgggtagaccacctaactgtccgtctatcttcttttcctttctgccgagttttaaactgaagtcggcacgatccatagtagtagtagtagggaactgaaagctcgcccatctctagggtgcagttccccataccaatctgtccatccagtgcatacgaaaccaagaccacaagcatctttcagacgcagttcaccatcttctgtatcttctctgtccttgcgattattattattaccaaacggattctgccccgttgccatgtcctcatctctcctccatcatctagactcgtagcccacaaacaactcccgacgtcaacaaagtacctggcttggtcggtgctgtacacatgttgccacgtgttcgcgtccctcccgtctccatcaaatcgagacaaagaaccaccagtagcgccacgccagrtgtcctccccatccctatcgcactgtagtttccaagagtatatttcgtgtatgtgtatattaaacctcagcgccccctcccctgaaacaccacccaaacccaagcagagaagcagagacacatttggctcactcactcacactcactcgctcatagattgtcctgtccgtccatcatctctagctagcagcttccagtgagagcggcaagcgacaccacaaccagacaacacaccaccaccgagctgtgagaataagttcgcagacagg

SEQ ID NO: 3428 - DNA, 1198 bp, Zea mays
atggttctattgagaaacaacctaatttgatgtttagtaaaaaattagttatcgggactaagggcatactcgttttggattataatttgtccagattatataatctagcttaaataatctaaatagaaatcaggttatataatctggaagtcagattatcacaattccatgatttactcaagacatgtttatttgagattattttggcaaaatacccactatccatggtaacttgaagacaaattatccaccattacaacttcttataaaaaaacatttcatctatttttacttgctcccatcacgcaacatataactaaaatcaatgataaaaaatttcaataagttggtttgtcctaaatcgtttgatctagattatttaatatcatatataatctagattatataatttataagctgaaccaaactgctaataacagccttcacgggttacaagttgcatgcattaatcgctaaatctgattatcctagattaagccaagtaaagaagcaactttgtgcaatcacctatctcaagatcactagctagcgatctactcagccgattcttccctccaaaccactatatatcgtatcgaatcacaaacacgggatgtctggatgaatgaacagcacgtatgtatggagtcacaagaagctgcctggtgctacggggaaaaaaaacgtccagcatcgcattcgcaagattcagcagcggcattgccatttgtgatttgccgccacctgaatgctcaaccttttcagagttcaaattcaaacttcaaaagggtaaacttttgccggagcggagagcgcgcggagatggtcacggcacggcggcgttccacgtctcgcatagggcgcagacaacggggatgggtacttcccagccgccggcgacgaggccagacgaggcaaggcaagggccgacgtgtggaggggcaggggcaatctcgtcatttaccctaacaagtacaagtacaacacgggggcacgtgactatctcgtgttcttaccttctctcctctcttctcaccagcggagagaaagcaaaccctagtccccgtcgtcgccgccggcaacccttcggatctgcggcgagcgccacagcggttagagcgaatccacccagggggagttgaagcccctttgtctgggaatttcgcggggaagcaagcggttggtggtgaaggaggct

SEQ ID NO: 3429 - DNA, 401 bp, Zea mays
ttggttgtgaaggcgatggttgctcgtggacaaagctttatgaagccgtggtggatgctgtggaacgggaagagcatagttccactggcattggccctgttggctgcagcttcggttgcggctgtggctgcagtttttgaaatgcaaactgctgtagcttgagctgcttgttcataggatggaacgagctccagggctagttgtttggttgttcctaggggaaatgtatagatcaatatatatgggcacacgaatcacggtatactgatatctctttgtatactgtagctataggacagcaaatttagataaaacacgtactagatggctatatttgattacccttgtgaccttgtgttatacagggccacaggggtagtgctttcactgctttctttcat

SEQ ID NO: 3430 - DNA, 717 bp, Zea mays
cgttcggcgttgcaccggcatcgcttcgctgctgtcttgcatgtttgctctccctttccttctccttttgctgccagcattgcctttcctcagctccatgctctgctcgtgcttgcaatgtgtcacgtggagcaataacacacgaagcatacgcacgtggtcgcagcacaaaccccaagaagaaggatcccgattcccagcacggtagcagcagcaagttgattgatagatgatgaattctccgtacgtaataaataaataaaatcacactaaagtactaaactaggtagctacttccaaggaaaaagaaaacaaaaaagaaacggtatcgtgtccgtggataagactgcccgtcgtggctgccggctgcgtcacagcctgcggcggccgaggtacacgccatttgacccacgccgtcgacgtcggcgcgcgcgcgacgtcggttgcgtcgcatggtctccgtcgacgcgccggcgccgcgcgcccgtcccactagatgattgcgcgcgggcggcggcgggcggaggtcgatcgaatcgacacgaacgcaagcgcgccatgcattcccaccgtcgcgcgtccctatcgatggagacatcgctacttttcgaaacaaagaaacccagccagaagaaaataaattcgcctgacaacgttttcacggacgctcgctgacgcaggggccttctggacgagtacacggtggcggtgcggcgg

SEQ ID NO: 3431 - DNA, 148 bp, Zea mays
acttccctgcacggcgcggtaattcttaggaaatttcctacaattgagcgatgctcatgtattttcggcgggtgcatttcatggatgaggccttatgccgtccatggcgttggcacgctcgtacgtcggctgtcttacagaggtctgt

SEQ ID NO: 3432 - DNA, 1500 bp, Zea mays
cacacgctcggcttggggggtggtccaaacaccacgctggcagaagagaagcgacacggttccgatcctacgtgatgagacgacgacgcggttgcagtggcagtcacccgcgccgcgcgcggctggcgtcggcgacacggtctctcgcccgccgccagtcgccaagtccctcacctcacytcacctcacctcacccacgccagggccccagcccgcaccctccccgcaggcagagacagtggacgtctccaccagaccactcgttgtcgttgaagcggtcgctccgcacccgccgcgcccccgccctccccggctccggctccccctttctccgccaccgccaaccgcgtataaatatctgccgagaacgcgccatggcctcaccctccgctccgccgcccctcttcattttctattgctcccccggtgccggccccggtctccacccacgtatccgcggaggcggaggagctgccgctcagcgaactcgacgcgcccatcccgtctcccccctggcgattcattcggccgcccaaacccacagggagtcggagccggaggagggaggcgttctggagtccgtccaaggagcagttggcgacgacggaaggcgcagcacacgagcaacgtacgagggaaaggggaaacaaagaggtgagtgtgagtcctccgcccccggcctgctgtgctcctgttcccattcttggaattgcttttctctctttgctctgcttgtttcttggtactgctcctacgctacttcggattatagatagatgacagaattccttgaaagatattgttatcacttgagaccaaaatgctccagcccattagtattattatagcatccatatagaaatggactcccgactgatgtttgaagtgtcccagattaaacctctttttttttgtcgatcgcaaggtaatccctagagaacccttggaacaagcaaatgtgtttgccaaacagtccaatctatcaagaggaacattggtaggcacgcacaattatagatttggagtagttatctctcaagccacacgagtctgcaactgtatttgttaaaaattttatgggactgctgacaagtcttgagttttgacaagattaagattggaacattggacttctgttttactgttaccctcattcttttcttttggttggcagcaaatgagcgttttgatgcatttattttttaccgaaaaagaacagttcaaacgtagcggggtcgcttttaccattctttctgtgtcaccaataccattcgccacctcgtcagactttgcctgctaggcatataagcacagaatttgtctgctagcgatgcccgtttatttatctcttcaattacaaggcgccagaatagacagatgaactcatgaacagaatgctgatggtgtttccctgttgcttgcttttgacgccacacgcagccttctccgatcgtcgccagctagctacccacctgtcctccggatgtcctggagttctgc

SEQ ID NO: 3433 - DNA, 1500 bp, Zea mays
gaactcactcataaaatccacaaactttataaaaccataccgaacgtatggtaaaagaaaattcggtgttttattttttataataatgatcaaacgttttaatttcctatagaaagggtgagcatggaataatataataatgaggagaaaagaaacttcttttcactttgctctcctttagccgtccactctccagatgcaaaatcatagtccacctaataaggtggtagttacttaaggagagtttaatcaagtgggacaacgacttgtttagagatctacttagatgacaagtacgtcgccatcaagcagcgcctacctcccaagcaattaaagtggacacattaaaaaaaactatgagagagagataaagataccgataaatcctataatttgtatgcgacaagggcatctcgaattggcgcaggctatatctttttcgaacaggacatctatcatatagatttattccgttattataccccctyagctcctctgtcccaaaataaaattcgttttagaaaaatagtagattcatacaacaattaatrtatatgttttatatatgtgtctaggtttattatcatctctatgaatgtagacataaaaaacacgaagagagtacaaattaatacaatcttgttgtgatcggtttaattttgaagatgtattcaatggcacggtatatattctttggagtgtggtgtgggcatggccgtggcccctctagaactctaaaacaaagtcttaggagcgagtttgcatttatatgctgtagggatgacaatttaacccgcaaactcgaaactcaacgggtacttgacccgacgggtgcgggcaaggatgaagattttgattcgcgggtgcaacccacgctcgatttgaagtttcatgggtgtgggtgcgggtttccatgcatttcaacccgtggacgaccccacactcgatttaaaatttagtttattctttattttatatttatatgttgtactattttatgaggaaaagaagactgtttcaacagatatgatcttgagatcttgaaaattaaacagtggaaaggctcacaatgtgaaaattaagaagaactttgatttgtttagaatttaaacctaaccaatctcaatcgatccatatgaattgagagcgaaccgaacaagtcccttacagtcggtgtacatcaaaatgtcacaaaatcatatatatatatacacacaagcagcagcacacatttgtggaattgaaatgtgacatatctcagcagcagcacaaaaagaagaattgacatgtgacgaatctcagaactttcggatcagctagcttttgagaaacctccacgaaggcttgcagaggtcgcaggccggatgtataaattgcagagcccggccggcacgccaaaaatattatccagacagacaggcacatcaacggacagacacacacaagcaargcggctagcggtgcaagtagtgcgaagctagctaggtgctggtgcatgca

SEQ ID NO: 3434 - DNA, 699 bp, Zea mays
attgttagttgtagggttatttggcaattggcagcgctctactcatttttttggtactatacccttggagcaaaaagtacctgctcccccggattctcactggttatctcatgtgctgaagcgggagtcacaacattgagctaatcttctttaccaaacagctgtaggagtagacggaagcagctagaattgagagccgtgagaagaagcggagcggagcggagccgtgagaagaagcatgggttgagttgttagttgcttcaccacagctaaaactaactaattagctaatttcttgagaaaatagtaatcatgtgtgaaaacggagttcctaaaacagccttaaaaagattatttttacgacagagatacaaacatttaattattgtgggactattttttttctagcaacgcacgagcatgatgctggttaaaatacaaatcgaataaacttacgtttacgtggacttctatcatgcggaattggtaaagcacattcctcaacgatcttcgtgcgtcccggtttcgttgccgcggccgcattcaacattcatcaaatggtctttatgcgattccgccccccagttcattttcttctcactccccggctccactcctaaacccagaacccagcccgtcgcaaccctagccgccgccgccgcgcgccgccggcaccacaccaccgccatagtcacctcc

SEQ ID NO: 3435 - DNA, 1500 bp, Zea mays
tggcttcgaggaggcgctggcgctggagcggcagtggctagtggccactggccacgcccccaccccactgcggcactgccccagcccagtccgacccactcgccatttggcaaaggcacactcagcccccacccaccagccaccatgccgtaaaaaaagttattcgtatcggctcatacgtgctaactgccataacgccaagtcagaatggcggataaactagtttgataaccatatttttttctaacgagacgtttagatctttttattttagaggaattgaaatttcacttaataaagtaacctatttagcttgagatttcatattccattattttcaaaattctgatataaacttatctcaaatttgtgggtagaggatgagaaatgattttatgtattactagaatttgtttctactctgtaacttgcaagatgatcttcgactcacttctttatagtaaaaataaagcaaataaacatctcctacatcttgctaataatagtatattgatatattttgcataaaattgaattagtttaattgatatatgtctaaattactattattataatggaattcaattccaatgatccaaacaagacgtaaaagatttctattttatcaagaaaaattaatttatttttcattgtgaaaatattaatcacttagaaaaatggagttatcaaactagctccaaatgttatctattgcatgaatacttaagttgtattgtattcgtggacgctgacaccttcctggctcataaccataaccagcagcaaatatatacggatatacaatgaagaaatattaaacattagtgaaaaataagtctgttagagaaactccaaaaagaagatgtaaatttatgtcaaaactgatttttgttactccaacagccctcttatccttctcaaaaaaaaaccgcatcctagtacagttctatacccatcaataacgaagcaataaatcaccatggtacaattcttacctaagatgatttattaggtaaatgtctatttcttttagaggtaggtgtctatacccatcaataacgagacgtatatcaatcactttttaaatctcagggtttcttggtacagttctatactcattgtctattattaattgctgatcaagtgctgctagatagatgtttcaggcctccaacacggtatgtctaaagacgatttctaatcagcccatgggccgtgagggaaaaaataaccctagcagcccaagaagaccaccaaagcagacggcaagtaccctgtagcacccccacccctccgcctccaaacatgttcttcttccgctacaagatagcaacacaggcgaggatcccaagacccgagccgtgtaggctgctgcagtctcttcctccccggcaagccgcggcggtcgttgccccggcccctcatataatatagtcgccgcctccttgtcaccgccgattcgattaggttgatacagggaggagtcgcgaggggacgtag

SEQ ID NO: 3436 - DNA, 789 bp, Zea mays
aacacggtagtggtgtccacgcacttatttcttgtaggctactagtttcatcattcccatttaaaatcaattgagtttcatgcggataaaaccttttttgcatagttagcaacgaacacgctgcaaaccatgtgaaactccactgagagtgttttgttatgaaattgtgtgttgttggccttgtttcattttaccacctagtacaaggtactttttggatatagtgcaattaaatatatcatagggaatgggtatcaaaattaaatgagtcataccatgttgcatgtctatctttagcaagaattggatcattgatgcaatgctatctgttcgaagattccatggcattaatttttagtgagacttggactttactctaaaacttatagatagaagggtggagtgcaagcatgatagatgaaaccctaggatcatttattttcattgcaccatgcaacatttaaatgcgtatggatatgaaattgtaaatgaaactatagattatgtccttgtttcatttcatcacctacaatgtactctcttgggtatgctggaattaaatctagcactaggaaagggtatacccatgttgtctgtctctctctygaaggtttgcatctttaatgcaatgctatctgtttgaagattccttggcattaatttgtagtgagacatagaggcttatggtttgctataaatagaagtgtgcaatgcaggcatgatacacaacattgtttcagtattttgttggctcagtgagatagacaaaagttgctcttggcatgatac

SEQ ID NO: 3437 - DNA, 96 bp, Zea mays
gctctctatactctcttcctctgcaagccgcctccgatgcggccgctcagtgacgccttctgattctgcgccgccggcgccgccactcgtccgcag

SEQ ID NO: 3438 - DNA, 299 bp, Zea mays
cgtttatccatgagtcgtagcaaatgtcatcattcgtgacataccacgtcgacatcaccattccatcacgcaggctcacctcgctcaccgacacctgggccctaaccccggcaactcgtgctcgccacccgattggccggtataaagccggtagcgcgtcgcgtgagccacacgcgcacggcgcacacatatcccttccttcactggctcactgcggtcccggcaaaagtcagtcaactcagccaacaagcgctgctgctcgggcacgggtggtttgggaggccggacgcaacgtcggg

SEQ ID NO: 3439 - DNA, 247 bp, Zea mays
cctaccattgtcaaagaagacaaacataaaaaatgtagcaccaattaccgaaggagcacccaacacaagaacaaactgaattcctgtgcgtgcaaccctaagatccaaacatcaccactacaggaatctcagataattaacgccttaagccgatctgaaaggggcagcaaaatctaggttttgaggagtaggtacgattacaaaccagaggctggtcatcggcgtcgacgctctcgtctacgtcgtg

SEQ ID NO: 3440 - DNA, 1500 bp, Zea mays
ctgtatgaaaggtttggagctggctgctttccttggaatgcaaaatgcgatgattgaaaccgatgctgcgatcctgaagacggtgttgacctcacatgaatatgacctctctgctttgggcgtaatattcaaggaaataaggagtacaatgatttctgagtttgcttgctgtattgtatctaaatgtcaaagaacctgtaatttagttgctgactgtttagctgctcatggagcaaattcaggtgacgttgactctagtttatggctagatcatgcaccggacttcatttgtaatcttgtctccggcgatgtgcctggagctgcttaatagctatggaatgcggttccatttcaaaaaaaaaaaactaactgccaaggctcaagggcaagggctgcaatgagttcacgttctgatcgcgcagggaccgcgctgcccgtgcgtgctgaagtaaacgttacgaccgcacatttaccaattattaacatttttttatacaggtcatttctaaccgttcccgctcccgtcgctatatacactataacttagatgtttagttttcaaagttttaaaatattacatcatatctatagtgcagtaatatacatttttattaagttgtaaagtttaaaatgaattagttttataaagaaaacaaagtaattaaagattggccccatatatggagttctccgtctccctccatatgggggtagtagggaggagatattagaaccgcatatcaccagtggttgtgtcactgttgcgctgcgccatgcgacatcgtcttcccctcatcatttgcaagggactcgcaaagtcgtaagcatgagttgatgacggtagggcctcgcggccgtcccgctgcgcgtgtccatgctcctacaacacatgttrttatctgattcaataatatatggccaatatggggaataaaaaaaaacagagctaatgaggcaaatgctgttatctgattcaacagatgtagaccactttatactttttgcctttcaagtaacactacgacgagcaaaagcctggtgctgctaggtaaaaactggattgattggctgtacaagtatacctcgaaccaatgatgtacaaaacctttccttgcagtactaccccacacctcaattctgtttcctatttatgctacttttgctaccacgctagtttaatcctatcaaaccatgctaaacctgttacagctactcctacctctcccaactctgcaccacgcaccgttggcaactccgttgccacaaattcacacgcacacaacttggtaagaagtcagtccatttatagctgagactcagcagatgcccaactccaatcctcagtccatttctaagatcttaatgttgccgctggagtttgcagaaagtagggttgaagactgccctctccaacagacgcatgaaatgaactgtgactggtcatcaatctcctgccctgatatagggtccgtcacgctgaatttataggccaacactggc

SEQ ID NO: 3441 - DNA, 623 bp, Zea mays
cggcctacctagaaaaataattggaccctaaggtctagtttgatagccacagaagcggaaatggttggaggggctaaaatctcctcgttattcaattttaaataataaggggattttagctcctttagccactctgttttttggacttctaaactagccctaaaagaattttgattcccaggctgaccatctagcagatcgatcaccttgtgagaacacatgggtccttttagggattttggttcgcaaactagccatatagcagatggaatttcatgggcgccgcaccggtccgcggatcccatgtccgtgaagcaaacatcgaccgaaagttaggcaggccatggctgatggcagcatggcgcggagatgctgtggataaggaggcatccattgtttgtcgtcctaattttcactttcttccggcgtcccagcaactgataccgtgatagtggcgtgggtgcccaccgcctgcgtcgatcggacgccgtcgtccatcccacggccgccatcgcccggaatcgcggcatctctctctcgcccggccgcccgctttaaaatgcccgtgcgcgaggaatgagcgtgcggcagagctcgagcactcgacaccagcgtctaacggg

SEQ ID NO: 3442 - DNA, 213 bp, Zea mays
tgcagtagttcttgatgttcatgtaacagtacactacaaaccgtgttggttacatttttcaataactttacatttctagtttatatattgctaggttctgctgcataatcatggctcatgacgcctctgcactgttgctaaattgtgaatgtgcgggattttgattatgctgatctataggttgatgctcacatccaacagctagatcagttt

SEQ ID NO: 3443 - DNA, 1500 bp, Zea mays
gaaggtcgatcctaccccgatctaatctaacccgcccaccatgaatcctacggacacggtttacttgagcaaaggttaccctatcctctaatctcgatcgtcagcgccggatccaacggaccacggagttcttcttccccacggcggatgaatacggccgcgcccacctcgcacggcggcggtcccgccggggactcccatatcgcgcacccgaacccaaaaacggccacggtcggcccaaagcgtagcagggaaagaggcgaattcgttggaggttcttaccaagcgttcggtgtggccgagaactctggccacgacaaggtgctacccggcggcgccgagaccccggtgggaaattcctggcacccaggtcgcaagcccagtcggtagaagccccaacccgtttggcgtgtccaatcgaagcgacaggcaaggacgattctgaggtaccgggcacggcgcgacgacaacccctccaagcggcgctccaaagctcccgattccaccctgcttgcttgtcgccagcgaggtcacgaacgaagcgccgatgatgcggatccagggtaacgggcttagttttatagtgctacggcggagtccgaccggtgaggtcctgcggattaagcgcggttcggtgcaacgacccgcgagctccgcttcagggaggaagaacggcgagctgcgcggcaaccacgcgggttgttacgcgttggagccgggaagaagcacagtagaccagaggtctccacgtgcgggcccgatcggtcacagtcacaagcacgcgcacaggcaagtggctggcggcgctagggtaaggcacgacaatgggccagcgcagggagaaaaatggagatgggccagcgcgaggagaattcggcccaaacggcgattttctttttttttttccttttattttctgtttccatttccttttcctttattttttttttcatatttgaattcttaaatttgaatccaaatttgattgcaaactttgaatttgaactagatgtactagtccaagatgttgatatgaaatgtcacgtttatttatatattttccttacattgtatatagggcttttcctattttcctcttcaccttctatatcttatttctcaaattattggttcccaaaattaggtttaatgtctcttccaccatttgcatatttcttttatcattatcttcatgagtgaatgcacaaacaaataaatcacagcatgatgcacaaattactttaagtgtcactaattaattactgacttttgaggtgttggttcacatgttataataaaataggcaaaaatcatgtatgtatcccaactatgctttcatcttacatttttgggtattacccggcggcggcaaggagtgtcagaagactcggaaatcgtttggcaacccacgcggcgggggcaaaatagtcaaaccgttttccatcgttccgtagcatatgcatatcctaaccacgattcgggggcaagcgaacggacacg

SEQ ID NO: 3444 - DNA, 243 bp, Zea mays
attttttttgtcacgcttcacgcacctgtaacccagacgcagtctgcttcctcgaaacttcgccttctcggttgcctgcctccgccgccgcaggcagacacgtatatataggagcgcaaacaccttgccctgtctaagcggccacaacctcccagccgtcgctagtcgctcgctccatcaccgataaccaagatcccaagacctcctccagcctcctctgctctcgcgccggcacccgcacgc

SEQ ID NO: 3445 - DNA, 1500 bp, Zea mays
ttaacctaagctggccagctgaacctgtggattgacaacgcagtaccagttgtagcgccgatcaatacaacagatcgccggattttggctgaaaaatgtgtaaatcaggaacttttggaatacaagcgtcaaccaaagagcccggtcttcagtaaaatcactcatgtactgtactgtacgtaatgcatgggtaggtacggtccccatcggcacgacggcaccggcactacacaatcacggggagaggacggcaggctcccatttctctgcagtccatgtttaaggctgaaagcgatgtgtacgtgaagtggagtggagaatctacgcgagccgctcgaccgcgctggtagcagagaaaaagacgggcgccttttcctttacgccgcaccggatctgtggtctgtggacgtgagcgtagcggggctcacggccatgcaacgggaatctgctttttttccccccgcagcgtggggtggtgcgacatccaacaacgtcgacgggagccgctgctgcggttttatgctgattccaaggaccatttctctctctcctttctcaaacacacacacacacacgttgaaatcaacgcttcttttttgttttcggacatgtgtcaatgtcgctatgtataagcagcactatccatatttgtttcttcctaattcctaactacgcccttcgccctggaaatgacagcgtagtgttaggtacttggataaaacaatttaaaacttgaccaaaattatattaatgatacactattacttatcatactaaataaacaatactccctccattcccatttctaatttgtttgacttttttacataaagtttaactgctcatcttatttaaacattttgatagttattactaattttcactgcgatatcatttaacatacaatatactttatgtatgtccttgaccttttattaatttttcgtaatttttttgaataaaataagtcagtcaaatttaataaaaaagcaaacaagctatatattaggtccgatggagtatttaaaatcatgtatgtttatactatttattttttttactaaatttagtcgaacataaggtagtttgactttagctagactgaggatctattgcgtttcttttctaaaaaacttcaccacgaccacttccatgtaggaagtgcaaaaatgtcaatgcatccatcgataccatgttacttttcttttgtaaacaataatttatatgctttactactgccgctagcactttgcaatcgtccagtcattttcaatgatttttcccaaaaatttggtcaaagaagagtaaacccatactactgccaccctcctatataatactccatgtggattgtggatagcagaaacactcgtggaaagcattagacaaatcagcacctgggcttgtcatcaaccgccgcgccgcgccgcgccgactagtcggtggccgtagcgcacctgtaccgcccgcaccgcgcggtcgaacacctcgcgcgcatcc

SEQ ID NO: 3446 - DNA, 1500 bp, Zea mays
aactaaatgcagttttttccaatactttgcttcccaataaatatcatcatgtcatcttcttcttcttcttccctcctctttctaatacgatcccgcaatgagatactcattgtagaactaaataatatagacttgttgtcagatataagctgaatataaaaacagaattaaagcaaaccatgtatagattgaaaagtacaagtaataaggactaaagcaaattactacggactaaagcaaactatgtataggttgaaaggctgctgttccaacaaagcaacatacttgcgatgtttgtctcccaaaaaaaagagccagtatgtatgcagactgcagaagtgtcaagcacatctcatcaaaacagaagaaacaaacgggaaacctcatccacagcaaggaggagcaacttaacggcaacccaccaggcattgtaatcctcgagtttattctaaaacccaggagggaaatagacttttcaagcttatcgctcgtgcaatcacccatgcatatccagatagtatgagatgagcgtgagctgacgcagcgtcaaaacaaaacctgtacggcgccgctcgcgctacagatgggataagctcctggctgcaccggtgtcctttccatcagtcctaaaaacccttaataacagacaacttcgcctagtccatccagctccagagtccagcagcatgcaactactcacacgtcagctgcgaccgccgaccggtagaattacctctcatgcatgcagaagcagaattgcagttacctgcaccacaagcagccagacggggtccctcccagcgtagcgtatcatgagcgggtagcagccgcggtgaatatggcaaagcgacgcccatactccctggcccgcagacgccgaggcggaataattggcctctgaattctgaaaccgttggaggcagccccatgtttcccttgccgtcagtcccgctcccttatcttgatgatgagagaccgccggagcccacggacggcgtggccgtgatccggccgtgccgtgccgtgcgcgccagccactaggaacaaacagcacacaggccgcacataggcacccccaccggccaccggcacaggagaagacacgcacacacaaacctctccggtcggtctggccctcttcttcctatctgtccccgtctccatctccatcctttctttttttccgatgactactcctcttcactctcctcagtcctgagcttatcttccttccccacacgtcaagaaccttgtgacacctctcagcgcctttagcgagttagcctccctcttgcgcgcgccgcagtggcacaccataataaataaatccccaccctctcccggctctttcagtcttcacctagcaacaacctgtccaagaaccagcagccaaaggacaagacaagagacacaacgaaaggaaaggaaccaagagaaagatcgagaagagaggagccttcgcttttggacttgcaccgtcgtgatctgtcccgcgaccac

SEQ ID NO: 3447 - DNA, 1341 bp, Zea mays
tgggacgatgaactgacgtttcgtccaatcacatgcatcagattaattgtggtgaatagcctatcaaataacaaatcacactgcgcattgcaactttttttttcctagcatgaatgctgacattactttagaatctatatatacataggtcctgagaaaatcccaatgcacttcataatagcatctctctctctctctctcgaaaataaagattcgccgcctttgtattgtgactggtctgatttctgtcctcattttttccccaagttattatcttgcaataaaaaaaaacttgacaagatcgtcagagaatcgaatccgaggaggaagcgcccactctgaggccgcctagtacagagaatcagggcctactttcacacaaacacaatggaccctcctcccattctccactaaccaagtaaccaactgctagcgcaatgccaaatccacacccaataccacctttagtgagacaaacaatcatagaggagagagaaagcatggtactggagcagcgcagcgcaggggtggattagcagccacaccaaaataaaataaaataaaatagaccaaacagtcctgtctaaattaaaaaaaagcaccccatagaaagagagagaagcaccattcatacatacaaataaaaaagagataaataggtgagaataagatagagtgagatacaagccatactgaaagccccttttttcctccctcatgatcttatcccttctttagggtctcatctaccactacaattgccaatctgcctctagtttctgcactgttacgattcgcctagtactcctctccttcaccttgatgtgcctcggaatctgatattctatttttttcagaagctaggtagtactacctcgaaggggaaaatcgtttcttttttttcactattattttctttttgggagtgaggtctctccccctgtgggctgtgggctgtgggctgtcactgacctcttcccttctgtgtccgccaatttatctggtgccctgagctctcttgtgtgtgatctgtgaatcactgaatccttctcgccaacagcccaacacatggaaaagagagctgcagaagcagacgcctaaaacatggccgcagtatgctcctcattcacctgccgcgtctagtatttcggaaatattttgtatttattaaagcaggagagggaggcaagcagcagccgaggccgagctatctctctatttccccctcgcccagctcagatccgaagcctgaaggaaatcgcgccaacaggccctagccccagatgcgcgccgccgcttgctgcctgcgctgctgctactccttctaggggtcttgcggcg

SEQ ID NO: 3448 - DNA, 345 bp, Zea mays
gatgaccttctcttcctattggataacccttttgtactgtatacgtacatatccgctacatgccatatccgctgcataccttgcgtagatatcccatgagctgagcctcaccgtttgcatgccgcgtgagctgcgcctcaccgttttgcatgcgtctctatctgtaatgcacataacctatttataggcatgagatgaatgcaatggacaacggttcatagctattctacatggtaatcagagcgatacagatctagtcgatccctcgatcctcttcttcgtaccctcccttgcccacccttgtcaaatcagtcggctcccgtcatcaactccaccatygcagtc

SEQ ID NO: 3449 - DNA, 395 bp, Zea mays
aggtggagacaaggcaacggaagagcagcacagccgccgctgcggtaatggtgcacatgagctggccggggcgcggcggcgtggcgttgcacgaggggcgatccggagcgctgaagcagccatgggtctggtcgatgcccttgccgccggcctccaggagaaaggtggagttggggctgccgctgctgaagaggaggcaccagaagaagggcccgcggcggtcgaagccggcgcccacctgggtgtgctccttgccgcggatcaccgagagcgcggtggctgatgccagcgcgtcctccgggccgtcgcggtcccggtggcagccgaagaggcggccggagatgacgtccaccgtggggagctccacgccgcagttggcggcgtagacctccgtg

SEQ ID NO: 3450 - DNA, 221 bp, Zea mays
tgcatgcctgcagtctgcacctttgcccatggcctaggcgcctagctcaggccgtagctcagcgtccgtccatgggccagggagtctgaaaccttgcttgccttgcctgcccgctcctctcacttctctctctcctcctcgctcgtgtccccggcgttctgctggtccctggggactggagagcgaaggtctgtctcctttgcgcctgctctgcttcttca

SEQ ID NO: 3451 - DNA, 1500 bp, Zea mays
ttcattttcacggtcattgtcaaagacaaaatccttttttgttggacttggcacagaccgtaccagtaccattcaaatttaccgttccttcaagtttgctgcaatcgtcttgttcgtgcgactgcagaatgtgtaggcagctgccatggatttcgtcatttttttttctaaacaacaacaacaacactgccatagaattgcagcgcccagtttgcagccaatcttcgtccatcccatcatgtggcacatgttctgacaataacagaaggttgaacaggaagagaggagaagagtgcgaactcgttcgtggcaacaataaacaagtagtaaaacgcaacctcaccggatgatgcacgcccatatacattcgacatgcatatgacacatcaaacgggggcagttggatcgtctacgtgagggatagatgagaatatcataagaaagatccagagctggttggattataaaaaataaaaaaaaaaagatgagaggacgcgttgtgctgcgcaaacatccggccaccatctcagactcagagacagacatgcgcgtcagactgggaaatataccatgacagatgggcactcctccttccttgtcgctccaggatcatggccgatctggctttgcgcaaactaccaggataatttcccgagtcccaattcctcatgccgatcgagtatcctgtctgttgccttggaatccaaatgatagcaccatcatgcgaagaaccacagacacacatatgcaagactgaatagcgtgttagctagaggtagatgctaatcatacaggcctaatcatgcactgacgaactaggcgctgaattgtccatttggtctatatatatcctcaccaaacacccccaacaaacctctctgagaaaacgcaacccccctcaacaaacttgaactaacgcctaggcacacatgtaaactactaatgctctccccctccctctgcttgtaccaatgcatgacacggaaacgaagtcaaacaaatccctcagcttccatcccctcctcgacccaaacccaaccaccatgacagcaaaccatgagctccatatgcccaaaacacccctacccccctccccattaatcctcgctaatggcatcagccatccagagcacatctttgctgggcacctttgctttgattagtacacggtgtttgaaaacttcacgttaaagggcacgcttggcaagttccttcaatgtcgccagttaaaccttccctatccagttccaaacttgcaacccctctcccctcccctccctcctcctacaagcaacagcagcagcacaccggcctccaagaggaggagcggagaggaggaaggtgagcggttgcctccgaaagcaagccatcactggcggctaccaaatgcaggcatgcatatagcgaacaggacaagaagcagcagaggaggaggaagaaggacaagtaggggcagagagctcaaggacgtcaagaaacggtcgctcgctgccacccacc

SEQ ID NO: 3452 - DNA, 1357 bp, Zea mays
aggcactttgtgagtttcataagcacaactctgcaatatcacaagtagaggttaagttaaaaagataaagcttcttgctattatgtgcaaaaccctagaaaacatggtgacatcggttcttgtatgtaattagtttgttttatagaattttaagatttcatcaactggatcatataacgatagtagtttcaaaaaacataagattacctggtattttaaatagggtaatctggttttaactactatcaattgacgtgaagttttaatttgaaaatttataaaacatccctctttacctgcacctaagagcaacttagtagttctctaaaaccctataaatcaataatttatgtagttaataaccaaaaaacttttcttcgacagttctctaaataaaatgtttaaatttagcgatttctcatctaactccatcttctctctacatttggcaacaatttaccaactacctaaataaaaaatcggttgtattgtttaggtaatgaagttgactattgacatttgtgacttatttttttgggtgtggatagattcaaaataaaataacaagctaaatttaaagagctagtaaagaactcaatattcttgatatagtgtctccaaggaactctccatttttgactctatatttacatcctcataaaaattacattctataagtagcatctcgctccaatagacttttcatttcccattcttcaaatcccaaccgctacattcaactcttcttctccatacaccaatgtgtgggtcttacacatcatcccacagttggcaagctagtttggctattgtgagtggttagccaaatttggatagaggagggcaatttggagacgaatagcttggcaaattggatgtattggaaagttattttattattgagtattcaaaatttagcttgatgaaacatctagctggtctcttgaagacgctctaaattatttagcaaatctatgatttggataattaaaatttacttcttggcttcatgacttatggcgctgagaaaatggtctaaaaatgatattaagttgttcgggtcaaatatgttttttttctttcgaaaaatgactaaatttaaaaaatacgggcccagcccatggcttcgagatgaaggcagcgccaacgtatgcccaatcataacctgccacgtgttaccatccacgtcataccacgactggggtccctcacggcctcatctcaacatcttcctatccttcaaaattgaaattcattttagaaaaacaaaacaattagagggggcaacgagtaaaaaaggaaaggaagaactcccttctctcctcttcgatcccgacgaacgccgagggccgcggcg

SEQ ID NO: 3453 - DNA, 153 bp, Zea mays
cccagagcccagagttctacttccctccccctcctcgtcgtcgcattcaactgcttcttgcggtagcgactagcaatcgacccaacttcccacccgcccccgcgtccgcgagctcgccgaagctaaggcctaagggtacccgccctcggcgct

SEQ ID NO: 3454 - DNA, 129 bp, Zea mays
cctgccacacaaaagggccacaaaccacaagctgctgatgaatgacaagacgctctctccatcttcggcagagctggcatctcctcaaagcagcaaaggcatcacgagccaaaaagggagaaagcagta

SEQ ID NO: 3455 - DNA, 864 bp, Zea mays
acccaatcagctagaatatttagctcatatacataacctaataaagtaaatatcaatcgccgggtatccattgccatctcttcacgaggggaggggaggcaaagaaaatcattaggggcggcctcgctcgaggtaggtaggccatggctgcgtgcgcacaatttgctggccgccagggcacggcaggacaaggaggaaaaccaaatcttgcttaaaagtaaacctgactaacaggagatgtaatgcgcgcgccggcgggtgggttgctcgcggacaggacggtggtgcggcgcaaggtgcggccttgcgccacggcgcccactttgcgggccacgtgcccgcgccagcagccgcacgtacggccgccgcgccggccctcggcccgctagctgctctgctctgctcgctccgttcccttccccccagtcccacgtaacggccaggtcggtccgtaacgtgcactctactaagcgctagtgtacgtacgtacgtactccgtccgctgctatattatggccggccgtggcgtgccctctctagccagcacagcacacacactggaaagtgcaagctgtagtgagacctgcgcgactgccagcgtgtatccgcgcggcaaggagcgtagcgcgcggtcgtcggcccgcacggccaccaactcccttggacgcacgcgcgcgcgcgaccagctgctaaccgtgcgcaagtagtagtgcgacttcgccgccggccgggatcgctagctcgatcgatcggcgggaccacatacgactccggtgtggccagcggcggccgggccggggaacgcacgtgctgcgagcgagcgagggcagacgctagctgttgccgggagctagccggcgcgcg

SEQ ID NO: 3456 - DNA, 1415 bp, Zea mays
aggttgcggaataagatggaagatgagtatcttgctaatagtttactagtacatatagaaggaggaattgtgggaaactacagctatgatgatataattaatgattttaaggatcttaaggagagaaaagtggtgttctaacatgtgtttaagctagtataatgacatgcttgtattttagtatattcaagtaaaatgctttactatgtactgatacactcattatcaatattatattattacaacagaatttttgccttttcttccactgtaattagctttgttttgtgtccaaaagctttgattggcccccctttcactcggttgctggctccgccactgacgaggatagaatattttttttagagtacggatttagagtagtgtgagtgcggatagccttacaaccctgtacttttggagttctgctctagagtcgtcaaatgaaacaccccttaatttttgtacttaaataaaagactaaaatcatacaactggtccctactccctagcgaggctgcgggccggcggcccggaagtcagagaagaacggaggccacctttggttcggtgagggggccctgcataggtggctgcgcgacagtcctatactcctaccacaaacgtggcagcctgcggcggggcccgcgcgcccgttctctccaccgcacccgcaccgcaccgcaccgcacccaacggtcatttttctgaccgtttgaggctcggccggccccctcggctccccgcgtcagtttcccttcatatcagcagggcctggggggacacgcacaggttgctggcttgctgctgatttgctagaatggatgaacgtgaaccccacatgcatggcccaaaaactgtgcgaatgcaatggccatgacacgctccagcgacgtgacagccgtctgatcagtgcgtggccggtggacagacgcccgtctgatgcacaaaactctcgcggaattcccgtgggcgtcgttcgagcctccccgtgaaggtgaaggtgaaggtcgccctccactccacttgtctgtcgccaccggccatcgaccccgccgcggtcacgctctctccagtctccactgccgctgcctgatctcgacctcacctgctggtgctggcccttcctaacgaagcaagccacgacgcccaggcaggacctgcatctagttaatagtagcctagtaggcatcggcccggtcccctcgttataaattccgcgcccaccacctccctgcttgtctgctcggcgctcgctcgctcactcgttcgcttcgcttccttccttccgtccgtttcgctagctgccgcggacacgcccgcacacggtcgaggagacgacagtcgacagctgccgcgcggcactgggctcgggggagctggaccccgccgggcgaggacaagagacggtgtcg

SEQ ID NO: 3457 - DNA, 857 bp, Zea mays
cgtttgacgacctgcacgggtgccggcgaatcagatttctggtaagtgcttcgcgcacgtccgctcgggtttcctctacaaaactcgtggaaatcagtgtgaataaaactgcagttttaatttgttgcaatgacagtcttatggttagatccgttgttgattcttattttatgcgttaatcttgttgagttagtttagatctgttctgttctaatgtcatggttattatttgccagtatatctgagtttttcgttttatgttgcattatcaaattaatcttaatcctgttaattttctaccataagagtcatagcaaattttacttgttatttttctctaaaacttgtatgtagaaaatcaatcaataggaatttaaaaagaattgatgggattaaatctcgtgtttgacggactcatgtaggaaacttttctatatgaatctgttgggggtatgcttcgtagccgaagatcctaaagaaatgaacaccttcggaagatcctccccaaagcaacgccgaagctatcgactataaagcttcggcacagcgacatgtctcaagacgaaggggtgaaccgacttaaagatggaatgacttaaagacccatgatatgctgtgtcattattgtggttcattataaagggtataaatgtaattatatacaggctgtgaattgtgcctataaataggtgaacagtacccctgtactgttcacgtgctctcctgtaatcacgcattgggcatttgtttttgcttcacgctggtatttttgctttccttcaagccgaagcatttgagaacaagtccccaacattggcgcccacctccggtgaactcacttccacttttttgagctg

SEQ ID NO: 3458 - DNA, 447 bp, Zea mays
aaaatgattttaacgaaaaacataactagagctattttaaacgagcctgagctctactaaacccggtgaagccgtttttgttagaacacaaaaatatattctctataaaccaatagtagagtatacatatataatatacataattatattagcttaattaatttatatctaatttataatcactagaatggacttcagttcgataaatcttgaaaccaaattcagaccatccatacactaaggagccggtaatcccaagtcacagaccgaaccgcccattcgcttggcaaatcatctcccgacgtcagatctaggtcactaggcctatcagccatcctataaaagctcccctccatctctcctcctcactcccttctccgccgccacgctagagaggaagagcgcgcggagagcgagagcccgggagaaacagcggccggcggcaaa

SEQ ID NO: 3459 - DNA, 819 bp, Zea mays
ggtgccactggtcttcttagatattagtatagtttagtatagctagaataatgtagtagtaattagtgtaatttagtagtagtagtaatgtagagtagtatattgtagtttagtagtagtagtaatgtagagtagaattagggaagtaccaactcgtaaagagttggtttgtaaactcgttaacttccctttaatgaagtctgtcgtttatcccctctttttgatgacttgccattgctttttgctgaatgttgaactgattcttttgatatagtagaaacaacgccgagcgatgtgaagattgacatcagcgttttagaggtaaccctgagcaatcgaacacaagaccagcgtttttggggcgatgccgaatgatagaaggtcggcgtcggcatttttagaagtaatgccgagcgattgagcacgtggtcggcgttttataagcagcgccgagtgattgaaggtcggcgtcggcattttagaagtaatgccgagcgattgagcacgcggtcggcgttttagaggcagcgccgagtgatagccagcttctcaagttactttgaggaaaatgaccgagtgatgaggtggcacattggctttcttggaaataactgttggatatccacgtggtacgctgggatttcgaagatgaccgccgggtgatgactgggcacttttgaaaaggtgtctggctcaagaatatcccttaagagtcgcgcttttagccgcctttgctttccgtgccctagttcttgcatttccgcatctgagtcttctctgccactcgcctcctgctctgtttcgccagcgagaagcaag

SEQ ID NO: 3460 - DNA, 681 bp, Zea mays
actctcaactgccctgctgacagagcaatggtgctgctgatgtaccaaattgagttgagactgctcaattgggcctgggaagacgagtgtgttttcaacctgtgtctacttggattacacagtgctgttcatagcagcctagccaatgcttataaatcctggttgataacaatgattcaccgaacacactcaattggccaagatcatttttggcataacgtggataggtgtgtggtgtgtggaattaaggatagatgctgtgcaagattggcaaagctagttttatctgctacactgacacaagattctggcaagctttctcaacttgaattgcaccatccattgttgttgaatactcagtcaagcggcttgaggacaagccgcatttcaagcagtggggaatgtcagcatatcatcttctcctcaagtcaaagatggtaccagaagaatacggacaatgctactacgacgacgatgactatacatggagtatatgaagatggaggcatcgcgggaaaaggcacaggcgtgccaggagagcgggctcggtgtctaatgaaaactagcgtccgtctagcttgggctggagtgggccttgtaaatgttggcaggtcgattggtcgtgtggaccgagtggtcgtgtggttacaagtaacacccaaaccctggctgtaaggggtc

SEQ ID NO: 3461 - DNA, 1500 bp, Zea mays
catatacttctcaaagcgagagtgacagactgacagttgttcttcagctgtcgtcgtgagcagtgaaaaccatcgagaagctagctaccattaacacattagaatactcaactaatctcagttagatttggcaaggctgaaacgactccagctaatcgcagtactcaaacatcgcctgccgaacaagaatctcgctggctaatcaccaaccaccaacacccaacaggccaccagagagagaggcaagcacgccacgacgaggacagaggacggactcggtcgccactcgccaccggctggagggcacgaccggaaagggcaggacaggcacaggtggtgtcgcccacctctcaaccgtatggaatgcgagcgagacacatgttcctttccgttcccgtctttccagtgcggctgcttctcccgtgcttcgggctcggatcgcgcgacacagctttgcaggctgcaggagtgcaggtgcaggcggccggccgaggcagcgccgagcgcccgagctggcagccagccagccttgagtcttgtgcgttcgacgaggcccatctgtcagcacctcagatttctatcccccaaaaaatattcttccctcccagctcccacgcgcagtggggaaaaaacgcccacgcgttgcgccgcacgccggctacgagtatccagcagcaccagcagcgctccagcctccctccagggctccagcaagccgggccggtgaattaacagcgactgcggtgaggcgaccgttgcggtgccgtgcattaaaccaccctgccccccctgtcccccgcccccctctgcccccgctcctcgccgtcggcacccgcacccgcgcggcacggcggcgtccggggtccggtgggctgggctgagtcgacgagcgcttgagctgagccgtcccagtgcgggggcgatcgcgtcgcctccggcctactccaggtgggtggatccgtcgtcctcgcccgagttgcttgtcgccgcttctttcctcgttcggcggcgtgatctgcgtctcggcgctaagaaagccgtgatctttcgcaggagcttcaactgatcgggcaatcggttgtcttcgtcccgcgttgaagtagattcggtcaaaaagtcaaaccgacgtgaggggaatttttctggtttggtttggtttggtttggtttggtctggatccgaaatgctgtgctggaaagcggttggtcagtaaatcgccgctgctaaagtttctgctccctgagctcagttggatcggagagttttagttcagtgtgcccatcctaaaacagggcgagttctgccgtgaatttgttggcttgtgttgtttgatcacaactgtattaaaaaaaaaggatcgatctttgcggctacaagagagtgacaacaaggaggcttggtcagctcgttcctttcacctgtttggcgagtgcttgaggaagaagacgacctgctcagctcctcctttggttgctcatcgaatcaaagaagactagggaa

SEQ ID NO: 3462 - DNA, 246 bp, Zea mays
ggtagatctctatacagaaaattctgaaaatgctggtactgtgatagaagtcacactttgttacttcaagatcacagaaatttatcactttatgtatggaccatatcttattgagtttgagttgctgaattacagaagggagttatatatggttgcccactggaggatgtcattacaggattgcagatccagtgccgtgggtgaagatcagtttaccacaacccgccaagaaaggggtttttaggc

SEQ ID NO: 3463 - DNA, 1500 bp, Zea mays
tcatcctcgcacgttgaacaaagcgtctacaattttatcatgaaactcatttataccttgttctttatcatcatgttcttgagacaaaaaaaaacgtcaccacgggattttttttttgtaattatcacaccttcaaagtccgcatccgccataacacttaataaagttatgtagggccattcaaagaagtattattttgtttgttttacgattagatacaatggtaggtgcaacatatcattttatcttgagtacacaaaatgaacactcgatgatgaatggtaaaataatttgaaattttttcttttcctccacttcttggatcttgtcgaaactcagatggatggttctttattcttctgtatggtacacccttcatggttagaatatctctagccaactaggtcttttttacataagctagaaaactagaaaataacaacaaacatgtttgtaaattaaccatgaattaacagtaaaaatataaaacaaagtatttcagttcatgatgaggatgatgttagaatttcttggtatatttgtacaaaacattattgaacacttcggtatcatgcatgagttgagaggtgtgtggtcctctgcatggataaaatacatgctagtcttttagtactttttagatagttttagttaaattagattaggtagtaaacatatttttggttgagattaagctaataattagctagaagtttagataaggggtttagaacctataatttaaactatttgcaaatttgcaaccatcaagtgatgtttctttgctattatatcatctgtgtttataatttgtgggtccgtatgtatttatgatttactgaaccaatggcatattagggaagcccactgcccaaggatggtagaattacaaatccctcaactaatgttagctcctaacaattagtatctatctataaggttctaaccaggccaatgccgtaaggaaaacagcccaaacttcctggttaaagcggcccaaaaagaaagctgaacccaactatacaatgcgtacgggtttccttcgcaactttgactacttgtctggttataacttgtgagtcacttcctgagcccggcgctaataaaatgggtaataaaaccgaggatgaaatctgaactgccacgcaccaatctctccgttcgcccgtactagctcttaccaagtcaagcaccaatcacgggccgtccaaatgggcgccgggaagctccaaccaacggctccaggagaagcaacgtctcttccccacggctgcaaactgccccgagcatttcgcacgtacgcagtccaccactccacgtcatccacgttcgccgccgccgccgctcccttccgatccgtctatctagataggtctttataacaccctgcagcgcccatatactggtcagtgctcactcgcccacttcctctagatacctccacacaccattcacttggccacacgctgtggtacgatcgcgtgggggcgctgcatctgc

SEQ ID NO: 3464 - DNA, 1500 bp, Zea mays
ctggccgagtggtgtgttacagttagtatccgagtccaaattgccgctgctggctagaaaagctctgggtctcttagaggtgggatgtgagggaccggtatatacgcgctgtgttagtaccatctcgtctagccaaaaggaggggtgtgatgttcttataagggcgggcctttttcctctcccagctaggttttaagagcgagatgcccgtctaaataggttgctgttaacgtattaacgcctgacgctgacgatggtggcctttggacggagtgacctatgagatacggtttccgaaggaaataaatttcagatggagtaaggaacacaaactagctagctagagatccagagaggcacgacttgcaggcttgcagcaactatacgtcataaaaaagattattaccaacttcctaggttagggtcggctcgtgctagccacagatcagctagagatccctactcactaaaatactgccgtgtggcgggcagacgacgcggcacggcattgctagcggacagtgtcgacgacggcacggagcagttttcgatctggtyccamcctgcgcacgtgaagctttgtggcggcagagctggttggtggccgcgtggacctargtcatggttgtgttgtgggggaatggcattgggagggagaaggaagagaacggagggttaaaaaaacgaactgtccttgttatgtacaagtactaataataagcattaattaaagagatgtttggtctctagggactaatttttagactatctattttttaatttagtcactaaattgataaatatggaaactaaaatttagaaaataaaatggaacgaatcgagagcactcgtcggcctagctagggagaaaagacagagaactagttatatactccctccgtttctttttagttgtcgctggatagttcaattttacactatccagcgacaactaaaacgaaacggagggagtatttattaaggagcctctgcccctcatagatcctcacataataacctgctgcatgccccgataactctttatggtcgagaatcctcatattcctctcacacaaaacctcccaaatcaccaacatgcatgatcaggctcatcttctattattttccattgaggctctatagctctcacctagagatggcaatgggtacccgcgacccgatatccgatgggtatttactccattagggtatgaatgtgggctaaatatttcacccgtgggtatgttattgggcaaaaatcttcaccccaattggtaaacggggtattagaacgttccaccttcactcatacccgttaacccgtgggtataaaataaccaatataaacttatcccaagcatgaacttagactttagtcatccatcttttttactatttaataaccttttaggccattatgtcatagaaggcttaacgacaatttaatgaccatgtaatggaacatgtaattcacccaatgtgtgttgaatggacagttaa

SEQ ID NO: 3465 - DNA, 867 bp, Zea mays
tgaataatttacgtgggtagtgttgtgagccgtcgcgcacaagtaaccgactagttgcaaatcatgttgtggtggcctgtgacgttgatgtgctggcccatttcagatttttggtttattttttggtggcctgttggagagcataacaaacaaataattgatgaacattttaagcagctccaagaactacttttaattttaagggtgattttataggattttttttttgagatgaaagtcatcccctcggcaacctgccttcaaacgagtcaatgcgccatccaggccgttaaattcaaaacggagggctcgggatgggattcctccggatccggccgctaacggctctctgctgctgtccccgtcccgagccaaccaacggatttccaaaccccaattcttctccgccattcttgcctctgccgacgccctctaccctatttcaaaacatttcaaaccactcttcgcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaagaggtgagtgtcctacttgtgattcgcccagagattggatccggtcgtccgctgcatagcatgaatcctccgctgaggggggaaccgttttgagagatgggtggggtgttgtctcagcttcctgtttagcgctgtggaaccgttgctctggggtacgtggtgcgcgcggggaggtatgtgtgtgttgccgcgaagttgcgtttgatctgtggaatcgcgcctgcagggtgctgctgcagtgtctcccctctcgct

SEQ ID NO: 3466 - DNA, 350 bp, Zea mays
ctcggtacccctgcctgaagaatgtctcggccttggcggtgctaccattgctgcacaggaactcgatcaccgggttataagccgatgcttcaagcacaggactctttgggctcagcaaggtgcccttctccataagctcatctagcacctcaatagcagtctcgcacttgccgccagcgcaaaggccttccatcagcaccccatactgtcttggatccaccagcacatgcttgaactgcccgctcttccagtgcacctcgagcgccccatccaagtcaccagccttgcacagcgttgtgacaagcctcagaaacactgacttgtcctttggcgtgagcctccgctctgcc

SEQ ID NO: 3467 - DNA, 323 bp, Zea mays
tgcatgcctgcaggcgccggcgcctcgccgcggcgccgcccggagcggcagctcctcggccggctcccctcagcggcactttggcacggcacttccgcagggcccaggtcccagcgacagccgacaggctcacaggcaacaccccttcaggcctcaggagctgtctcaagcctacagccgttccgcctcgctcttgtatctgacggtctgaccctaccctatctctgaggaggtcgaatctggcctgcccttctctctctttctcctacgatcctttctctcagtccaacgaaaccctcggaggcacggttcggttcgacgac

SEQ ID NO: 3468 - DNA, 421 bp, Zea mays
atttaatttaagtaataagtgagcagtcacaaccggatgagggataagattttttggaactttctcactgtgctctaaacattttttcaatgaatttctttatttggtaaatatattaccctttttcaccatggttgaaacatattgcttttgctgtgcataaatatacagatgcacgtatttcctaaaaacctcatgatgagtttgttcaaacaatctattcattttattatcaatttttttataaacatggcattcctggtatgaatatgcagtcacttcattcgttgttattttggctcagctaaccatcaggaggtctggaggatcacaaagtgccttggagaaccacaagtatgaaattgctgactgggaccttggtgccggaatatacatagacttctacgttctgaagaactca

SEQ ID NO: 3469 - DNA, 728 bp, Zea mays
tgtgaggtgatcagatggcaaggacggcaagcgcagggcacaatcgcgcaagggcaaggctttcgcgtgcgtttgcagcggccgacggtgattagggattttttttattccaattaccgtggtgtccaggcagttgaatcaatatagacytaattggattagttttacttggacctaaccataatacgtatatacatatacactgtatgtatacctggggcggggcccctggaattttggggcccgggtgcggccgctccggttgcccgccctcaggaccggccctgcgtacaggtacagccacctagcctagtcaacacagccgcgacggaggacggactaacgctcatcggcggttgcggcggcggtgctctgctgcagtcgaccacacgctcatcggcggtcgcggcggcggtgctcggctgcagtgctgttgctgcctcgctagtcagcgtcgccaccacgcgcatggtcctgctgtcagccagtgaccgcggagattcgaactgagatccgaaccagtgaccgcggactgtcagccagctgcccagtgcccaccgtcccgggctcccggcgtctcggcttcatgcggccctgcagccggcagaacctccctgatggtgccatcgcctcgcctaaaaggttagcgcatgagctcctccatcctcttatttttttgtggtgtagttagtgcttatgtatttatatagttgtgtgtaatattttaa

SEQ ID NO: 3470 - DNA, 385 bp, Zea mays
tgaaataagaaatgtcaccataatcattatgaactttgaaaaccttattaaaatctctagtttgctgcagttaatgcagttggatactgttgcaacttgcaagtaacaactactcttctccggactctcggggtttcccgacgtccaccacccatcctcgcttctctcgagtcctcaatccatcctccggctgttccctcccagcgacgaaaccctagcccgtcacctcgacgcctagcccgccaccttgccgcccgtcgctgcaggtttatggcgcctgtgtgatcggatcagcagtccgctccgtctccctcggcccacgcatctgatgttcctctcccgcatcgtactccgcgacctggattccatcgactctccggcctcc

SEQ ID NO: 3471 - DNA, 975 bp, Zea mays
agcggtgcggaggtgaaggcgagcaaggcggtgggcgggcatcggcggtagggtgtgggacgcttaatagagagggcagcatgccgggtgtcgccacgaggagcgggaggcacggtggcctttggcgtccatcggaggatgccacgagggaaagggtatgagagggggcagaggagcgcggtggtggtgggggaagtgagtgagagagagagagagtagtagtaggagacacatcaactccagtcacaagatccacggccttgcgtgggcgagagtgtggacgtcgccgagtggggggggcaggcgggggtgggggcagagtgtggacgctgacgttaggttcttaatagagtaatatagattagtggaactgacaacctattcggctgctcggctggcagctgtggctgcagttgttcatactgctctagctacaattcatagagataaaatactgtagaaactgcagccacagttgaattaaacccgcaccaacccgtagcgaacgatccagactcaataactttagggctagtttggaaatctcatttttctaatgaatttttatttttttaaaggaaaattagtttatttttctttagaaaaacaataatttcttgagaaaatagtgttcccaaactagtccttaatgtcgggtttcggccctgttgcaaatggctaatggcttttaagccaaagcgcttgtccagtccaagctgctggcctggcttatgctgccttgcatctgctctcccgtacagccgcagcgtgctcctcgacctcgctaaaaaccaaccgccctgtctccctccctcactcaccacgcacgcacaaagcagagcaggcaacggcacagcccagcacaggtagagagagaaagagaagcgcggagtcaagaagcggagcaacaacagcaggccgaggaagagaagagaaggccaggaggcagcagccaggaggaagagcaagagcaag

SEQ ID NO: 3472 - DNA, 101 bp, Zea mays
tctgtccccaatttctcggtgctccgcactcgaaccgcgcacctcaccaatctccagcgccaccccgagatcttccgaccagcctcgagatccctgcggac

SEQ ID NO: 3473 - DNA, 1500 bp, Zea mays
acacatatttccctctgtaggagtagagagtggttgcggtgggcgaggtcctaccaacggtgcaacggctgagccacacgtgagggtccaataaaccagtgtggtggactctcttaaaaaaagccataaaaataataatatcaaagcgaacatatagtccacatactagatattaaactgataagaacaaatattatattttatcttagtcaaaaggacgagaaagttataagctaaaaagaagttcgactttttttatagctcgctcggtctatcatcatgcttcacctaacaggatgatactatttaaaaacactgcaatacgtgtggcttcgtggcagtggtttctcatagtcatctgtggggtaacgacatatgtgtggtgctatatcggtcactccattgtttcatgccaatcttttatctgttaccgtcttgcatgataaagaggacaagcawttgtttgcgaggctttcagtttaaacctgaacatggggcgacctgatttccaagcacctgttatcgttttcattctggatcccgctcagctcaccatcccctacgctgtaggtctgttctaggtctcttgcaccacttccctgaaaccatccactttaaacaagtggttcttgaattagaatgtagccttgcttgcgttggtctctttgccgactgagaatgaccgggcgacggtttaaattctccagtgaagtctcaagaccgttcagtgcgaggttggggaacaggaggtctgcagaacgttctgtcccgccaaaccaagtaaactttcggttttgcaggcagatttccatcggctgacaatcatccagagctgctctgaactttctcgtgtcatgttaaagtactgaacatctccatctgcgtatgaacagatctttctgcagattaaaagaaattacataggcattgggtgcatcaacacctcgttcgttagcgttatcttattatactggttaatggcaccatagtataatccccttctcctctctcttgacaacgacgccgtacgtagcatcatctgacagcagctctttgcttcaatcagacagcggcagacccgttccgttgttccggctggaagcgatcgccatgagagcgacccttcaaagcatgatcgttgaattcttagctacatctgtaccgatttgtaccaaatcatgcctgctagtataaagtaatacggcctagtgcaggtgcagtgcagggggctgggaccaacgattaacgaatggcatctgcatcgcgcagcgagactccgaggaccgaatcaaagcacccgagccgcgacagaagaaaggccaccgcgctattgacttgcacagtcctcgtccttggaacgccggactgcatgttagctaccctatgcagtttaaccaagccgcgcgccatcgatcgcctgcctcactgcttcacaacctcatttagccaaggagctcacagaaaaaacagcccgtgacacgggcaccgatcgagagcgaa

SEQ ID NO: 3474 - DNA, 1374 bp, Zea mays
cttcgcgatggtaggaattcatctttttccagattctgaaccctttagaccacttcattttcttccgtatgcaatttccacgatactcagattttwattacagataaattcttacacagattctcgtcagaaaacggccgccctccgccgcactacgcacgcggcacgaccaccagcccacgcaagcaacggttcgtggtcacagtccacagaagatggaaacggacactgacatcggacccgtctcaccgcggggaccgatccgaacgaagccctcagtggccaaggagtagcgacgggttgacagctagccggtaagaaaagacgagaggtcctctgcaagctcttccccctggccctgggaaaaagttgtttcacggaccggacgcgaaatatctcctgtatctgacttgtgggccaagtttttaccatgatatttgattcgcctcaccttcgcctcccactcgcagccaccttttcgccttcccccccgtcggtaacgtagcagtaaatcatccatgcaccattccaccacctgcggcagtgccggagtgcccacgagccatcctccgcaataaaccggcggcgtgcgacgtggggcccagacgtcggtgtcaccgaacccgtcccgccccactaggaggacgaagcgaagcggttacgttccgttgcacggtggggcccgacacacgagctcgtcacagtcacaccctccagtggctcgggctctttttttttcttccctttttcttttccgcgcagctgatttattttctctcgctctcgccttcgcggcgctgcctgcgcagtactacgagctagcaggctagcagcaccaggaccaggagcctcttcccacacttccgctctccctctctctctttcctctcgagaatggttgtgtaggcgggcgcaggagggaggagagagaggggagctagctagggttttgcgtcgccgccttctgttacccttaggtgagcgacgctcccgtagatccgggcgcgcatccttcggtcgccgccgtcgtctagatctgtgccgtttggggccgtaggggggcgctgtttcgcgctcctccgtgacggtttggggtgcattgcagcgtggattcggttttcttcgtgcggcatttgtcggcgttcgccgcgcgctctttcaagcgtcgttttttattcgttctgtggttctaatttagcccttcgcaaggttgcttcccatgggggcgtagtaagaatccaggctttggccgcttccggcgtttcttgtcttgtggatgaatttgtggtcgtggagtagatctgtgaactgatgttcggttctgctgcaggctctgaacccctccggtccggtgcggcggcggattaggctccg

SEQ ID NO: 3475 - DNA, 1500 bp, Zea mays
aaattgtgaaaacaatctactgaagaccaaaagcaaacaggctagcttcacatctagccgcgcttatttcagccaataagtgtgcgtttattaaagggcattctatccatgacaactatatgcaagtccataattccatcaagaccttgcagaagaagatttcaatcattttcttccagttggatatttctaaagcttttgattcagtttcctaggccttcttgttggaaattcttattcacttgggttttgggactggatggtgcaatatgattgctaacctgctaccttcttcttcgactcaagtgcttcttaatggatatctgggagattcctttaagcattatagggggttacaccagggtgatcccctctcgcccatgctttttgtcatagtaattgaagtcctttgcaatctgtttgataaggctaaacatatgggtcttctgcattctttgagttgcaacatgtcaagaatagaatctccatttatgttgatgatgtggttcttttcattaaacctgaggaagaggatttgagttgcactaaagtcattttagactgctttggtgaagcttcgaggctgaaagtcaatattcaaaagagtttggctattcctataagatgtaatgatgcaggaatgtaggtcatatctaattcccttcactgcaccattgggtccttcccttgcaaatatctagggctccccatctccaaccggaagcttagaagatcagatctgcttaactgggtggagaagattgctgataggcttcctagttggaaggttaatctccttaatccgactagaagaacaactcttgttaatttagttttatttgttgttccagtttatctgctaattgccctaaatgttcccagttgggtcctcaaagctatatataagattagaagggcttttctttggaaaggtcggaaggaggtcaatggaggtagttgattgttggcatgggatatagtgacacgacccagtgcctaggtggtcttggagtgccaaacctttggttcatgggttgggcgctgcaactcagatggctttggttctgcaaaacagacccttctaaaccctggtacgatctaaaccctggtacggtttagattttaatgtccaaaaacaagttcgagactttttgcaatctcagtggtggccatagttggcaatgggtagaacacattttttggaaagatmggtggcttaatggtgagaccattagtgagttagccccagtggtggctactattgttgcgcttaaggtggctatttctagaacagttgctcagtgtcttactaaattaaagttgggttgcagatatcaagccagtgtggttcatcaatggcattcatcagtatcttatcctttgggacttattagagaatatggttttcattaaggaagttaataggaaaatctgaaggcatacggtcagtggggaagcttttcttccaaaccctgttatcaagcattttttttggggtca

SEQ ID NO: 3476 - DNA, 142 bp, Zea mays
ggtattgcgcttcaatccttttattaatcccatcatctgaaaatactatctgacaaagtttgtatcagcaatattgtttagttaacattgttcgaggaatacatatatatatatatatatatatatatatatatatatacat

SEQ ID NO: 3477 - DNA, 838 bp, Zea mays
aaaataaagaatgtgacaaactaagagcaactccagtagttctctaaaagacttcctaaatcaataatttaggtagttaatataaaaactcatatccaacagttctctaaatgaactttctaaatttagcaactcatcatcttacctcatttcctctctacatttggcaaccatttaacaatttcctaaacaaaaatgttgactaggttatgtagttaatgtaggtaattgatgacatttgtgacttatttttttgacgtgaatagatacaaaataaaattacaacctatatttagagaactattggagaactcacatttttttattcctaaaattgtttagcaacttcttaaatttgtgatttagagagctcaaatttacataactattggagttgctctaagaggttagaggtcttgttattttcctccaaaatttgaatggaggaaagcaattcataggaattttaaaggattgaatcctgtgttccaaagactcacgcaggaaattttcttgtaagtaatgaatccttcaaaaatcctctatatttcctctgtttcaaagggcccgttatgatgagaaacaaaggtgaccttaccgtgctgtggcccacatgtcaacgactaattagcggtcgatcccaatgcaagagcagcgggagtggccgagtgggcgagtggcacactggcacaggcacagatctcatctggtgtgtagtagactcgtcgtctcagctcgcgcgtgctcaccactgacctaccccgcttcaaaacagccaaactggaaaaaaagattctccgtccacgcctcgtcccaaccctagccccgtcgatctcgc

SEQ ID NO: 3478 - DNA, 433 bp, Zea mays
atcaattattaaatatataactagacttttaattgactatatgtgatgtagcaatattataaacctgttacgatctatattattaattgtttttatagtcacgattagttgctacacgtaccataagtatatataagagtaggtttagttgcgggaccgctgtgacagctggagatggccatatactccagtgtcagctcttgtctgtccaattttgagacacctaagacgacattagagtgatcatgtatcgacctctaacctaaaccaaacctagctatgtaaggtatatcgttccatcttattccgttgcgtcaaataaacacagcctaagatcattctttctccacggcagtgccacgcaatcgtttcgtagagagctagctagacgcaaggcaactaggcactagctagctagatacggcctatgggc

SEQ ID NO: 3479 - DNA, 838 bp, Zea mays; identical to SEQ ID NO: 3477

SEQ ID NO: 3480 - DNA, 130 bp, Zea mays
ccaccaatgtatatggatgacccggtagagttattttttttgtcctgagtacccgatgagtatttacgattgcatctctaatcctccccaaccctcttccggttcttctcatcccaactgaccgactacc

SEQ ID NO: 3481 - DNA, 109 bp, Zea mays
tttgtttttgttgagctatttttacaggatcacctattcacccccttctaggtgctatcagttggtattagagccattctcttcatcaagggactaatcggtcgaagat

SEQ ID NO: 3482 - DNA, 355 bp, Zea mays
caaccctaaccctatccctttcgacggttccacttgcaccctaccccaaccccatccatcgtaacccgccgccgccgcgatagatgccaatcctgccgccgcatccaaccccgcccgacgtggacgccagagaggtgcacgactgccgcaactcgtggcactcagtgtggtggtcgtccaagctcgtcctctagctcagcctcaacgccttcagcttcctcgtgccgtcgccgctcgcctagatctacgatgcaatggtgagtggctctgtgaggaggcacacaagctcacattgacggcagcaagaacggtgtcgcctccttggtggcagccaccgcgtccacgacgacgacgg

SEQ ID NO: 3483 - DNA, 1500 bp, Zea mays
tcgtggtgaataatagactcttcaaacatagccggctgatctgatttcacccgctttcattgtcatgcttgccatatcatagcaaatccgaagcgagcacgaaaagaatggcgatcactgtggttgcagcccttacacaggctgctttaccacttcactgacagaccgcaggtactacctgctgcagcgaccactctattaccagtacgtacctggtagtacgtacatgcgccgagctactgtgtacggttaccaaccaaaatgacgcgtgttcgcggcgccgtggaagtgcgcgccggcccgagtttcccccataccgaaccgagccgacgagcggtgactcagcatgcaccagctgccccccattcggcgcctgcccgcatgcagtgcaccgggccaccgccgctcggcactggcaggcaccagcaagcccgcaacgtgcggcacaccgcacaccggactgtcagccgcggccggccgcgccccctgcatcttgcagcggcagttctctcatctctgcacggcgtggctcctatctgcgtgcgcctcgctttttcccaggttcacctcccctcgcccccatcgtggccacgccagcgcccaaccaccgctcgccggcccgcctccccccacgcaagccctgtacacgtgtccaccggtaccgcgaccgaccaccttcccactgattgcgaccgccccaaccacgtgtcccttctccatcactacacccgttccctcgtgctcccgccctgagactctctttctcgctggcaggtgggcgacgcttcagccagtccccacatgtcatcgaatcctgaacaaagagcggtagggaagagtacgtactactgtggagtccggatatttttctgggcagcccgagagacagaacccatgtggtggggaccgcaatagtaggcatcaataaatcagctgccgaggcggactgccccacccaccccaggagcgccacgtgtgtgcagcacagggattaggcgataaacacaccatcaaacttcctcgtgggcccgcacctcgcccgcctcggtggccgatgcacaccacgtgtcgatcgcgctgagcaagataccggcacgcgtccggatcctgccgggacggacggccccggtgcgccggaccaggagcacgtcgcaacagctgtacgtgtcgaggcgctgcccgtgacggcgacggcccccctgcccggctgcccctgcccgcctcgcctcgcctctcttgtactgcccccacgaagcattcgtgctcgtttcgcctcgcgcccgcgctgctgtcctgctgctgctattttgccattgcatccatttccgggggacggagtggaggaggagggcgtcgcctgcgttgcttcgcgtgggaagcgtagcgtgcttcgtttaggcctctcgccaatatccgagggttaatctagagaggcctttggctttgccagacgcgcctgtacgcgcctttctgggaggcagccgcttgctctcgcctcca

SEQ ID NO: 3484 - DNA, 792 bp, Zea mays
tatgatcgtgaagggtgaaaggtcgtttaatttgtcgatggtgatgagtcacacaatgtgaacctccgatctatatgctgatacagctcccttcactgacaggtggctcctcttcttttaattggacgtggataactttactgatagtccattcttttgttagagatgattaacggtgtctttggcacggctggctctagcttaggctcattatgaagctccgccaaacaaacggttaaagaaatgactgctcgtcgagagctctctaagagctagagccgattttttgttgggagcaacagcaccaaaaacatgtcttctacgggcttctcttatatttttctcatccatcattcgaaaaagagataagagaaactgttcctctaaagaagtcaaagaatgaaagaagatagaaacgggactgtttgtttttagaggagccgaatccctgttataggaggcctaacagttttcttgcaaaagtagacaaattgcacctactggtagaggcatccattctgcggcccatctgatggtatgaaggcatgaagcccagacgaatgggccagtgctagtactggcccacctgacctcttggacctgcaagcaaaccctaagccaccgatccgacggcggggatcgcccgatcaaaccacagacagaaccatacccgtcaccacctcctttacataaaaggctctccctcagcgcgccgtcctcctacgcggtacgcgcacacagccaaaccatcctcctctccgccgcccgccgcagcagcacccaccgggcaag

SEQ ID NO: 3485 - DNA, 1500 bp, Zea mays
acatgtttttgtgaataaaatacatatggttctttgttccaaaataatggtctccaatgtatataacttggtggcttataacaacatttacaatgccattgatcttgtgaaagaatgttacatattatatgaaatattacatgaaaattctcactgtgtagcatattgttggaacgaacttcgttaccacaatgccatattggcaatgtactaagtttggatggtattttggcactcaccagcatcaatggaacaaaataagtatggaagcaattttaccaagtattatagcaagatatctatggaacaaatgtccagttaccgtgacaaacataacttcgattttcatgatcattcatgcaaggtgccctacttcctccttatagtgcacacaactacatacgttggtcgtgcccactttgcaattggtattatttcctttttctaacttactaagtaatcttatcttacactcaatttaacatataatttcatcctaacatggttttccaattttccttggctgattgagttggttagatgacttgaagatatactctagtttctcggagttattgaaattaaacactagacaatgatggcccatggttgataaagattttgttgtgctataactttcaacaatgctaaaagatgggatgagcctaaagaattctaataaatttgtgttacaggaaagacgccactgaatgaaataactgctgagaaaaatattatgataagctttggtgtaacttataacaatcccgagaaatgaaagtggatatccaaattgtttgaataaatgtaatcatttaaaatagatatgtatgaaatttgatgctgttacttttttatgttatcaagcaaattttgcacaaattgttttatgcattatttgctctagctatacaacaaaaaaggtgaataaatatccgaattcttatccaaattttatatctaacacttgagaaaatatatgataaatttgaggtttaccttttatatatgaatttttacaagctcaatgctaaaaacaagaatacaaatttgtataacagattctatatcctattaaaggaaaacgacaaaaaaatttgataccaaataagtatatgttttcgtcgttttcatccctatgatcatttacgctgtatgtgctgacatgagtagctagacgcatgaacatgcctagaaagtcatatgctgcacctgcgcagatatagcacttcttcacatctggagaacattttccacgtagtacggtatttaacaatgggtcttttttattcgaccagtgtatggtatgcagaacacaacagcaaggcagcaagggcgaacgtgcactggtcgcgcatgcatggctctgcatgcatgacacaacaatacaacatgcatctagtcggaaccagaggccttagtcctatgatcgtcgacgaacagcttaatgtcctcgattagtttgccggaatcagcgagctccgggaacacgtagaagcc

SEQ ID NO: 3486 - DNA, 454 bp, Zea mays
atttaatctttaaaaattacattaaaacacaggaaaatcataaaataaaaaatactaaacttcacataagtagatatatacattaaacatagtatatgatatattttattatacttttgtataactttagatttatattttttataattaattcacaactaccaaaatttgatgtttgatttatatctacataaaattagataagtcatacataattcaataagaatacttcgtatggtttttagtttttttctgccctacatgtttatttttaactaactaaagatgatggacactttatgtgacagcgtatgctaacggatccggcgggccctgcaacggcgcggcagcaggataagaggacgcggcgcgcgcatccacaagcagcggaggagcccgaccacgccagtgagcccgcccgattcgccgtcgcggcggccacgtttcccctcca

SEQ ID NO: 3487 - DNA, 94 bp, Zea mays
tcagaataaaggagcaggttcccgtaggttctgatccaaaagctggattatcttgctcgttcgttttctggacagctgctgggcaagaggctgc

SEQ ID NO: 3488 - DNA, 208 bp, Zea mays
ggtaggtgtctgagtaaaaaagatccattattttgtcgacccttgcttcatatctgttgaatctgcaggcatccaagtcactgcctgacttcaagaaggatgaccagaaggctgtggattctgctctgatcaaggctattgaggctgttccggagctgaaaacctatcttggcgccsggttctctctcagggatggtgacaagccccc

SEQ ID NO: 3489 - DNA, 1198 bp, Zea mays
aagtgtcgaagttagagaccgtagcctggacgtctggtataggcatactgtgcatgttggttaactgaccacttggaagggagcaatagatggaatatgactgggctgcacgggaaaagaaaatgaagctgtccaatgcagatagggatgtaatatgttggacatgaatgttattttggacacgactgtagatacacgtatctttttgaaacgtgtggattttcgctgtgacgaaagtcctgtaatgttttcttgtgtttccttgagaaaaacaatctagaatgatattttggattctcacatgcaatgcacattatttctgttaactgaaaaaggaagaaagattgcaatgtgcgcgtttaacagtctgaagttgcgttttgccagtcatataatgacttcatacaatgattatattagattcttgaatgatgaaaggaatacttcgattgatctgtcgtctatgtacaagccttgggaaacaatatcttacaagtacgtgataaaaaaaggtcatattaggagccaccgtatgacatgaatggtctgtattagttttaacagcattattgaagtattcctttactaacaacattaacattattgaggtattccttcaactgtaattagtactccctcagtctctcagaggttggttatgttacctctgttctctaatatttgtcgttggctaatttatttttaaactaaatcatgacaaataaaaaagaatagagagaataccttatatacatgggatagagggagtaataaaaacgtctctagttgaagggaacgtatctgatgcttaaaggggtatgatgctcatatgcacattttaaatttagtgtatccattttatatctaacagtatatctaacagcagcaccaattttgtgaagcaccctttccaccttcgtcccctggtggaaggggttcttcgtaaaattagccggtgccgttgaatgtaagatggatgcaccagatttaaaatgtgcacatgagcatggtacccctttgagcaccagatacgttcccgttaccatctaccttgcttcctaagagcttgtttcatccacctagatggctggagcttgtttgcgaaagattgttcttgttctatttggatgaaacctctggtatcagaagcaatccggttaccacttgtactgcaagcaagcagtgaagcagagagaaa

SEQ ID NO: 3490 - DNA, 907 bp, Zea mays
ttttcatttttatttatttgtcatcaagtagtttaaatttgtgctaactaacgatatatattaacgaacagatagagtataatatgttttggtagtatagattagtttgacgtaatattgatactattcattttcctcccccgttcgcatatatttggagaaaagttagatacaatcatgtacaataaaaagacgcaaatctttattctttttatttcgtgtgtgtatatatatatatatgattaacaaataatttgcacttgcacctatacattctgttattttattgcataatagtacatatacatagcgtatctttttagaataccatactgactctaacaaatagaattgcaattatgttttacgacttctgagttctgacacagtggaacttcacgtggacggctgctcaaccggacaaccgctcgtcttggccgcacacacctacgaacgtggacgctggcctctgtagagtgggcccgaacatcggatctcctggtagctcacgtcgtcccgcttcgcgagtccccgaccccgagcggccgagcccgacgacgtcaacgttgtggccccgacatgcatgccccacccgcgccaccgtcacttcaaaagacaagggcgtaataatcgtccaggccaggggaccaggaaagcgctctttgcatctccgccggtccgtccacggtgtgaatcgcgtggtccgccgaacctcagaatagccgctcgaaccgcttcataactcccaccgcaccggtcgccccggcgcgccggcgaggtgacctactgacctcgacgagcgcgcgacgttgaccggggcgtgcatccggccgcatcttgtcctcgttccttacgcagaggagcgccgctccaaaatcgcagaacgccaaggcgggcgtagcgaagg

SEQ ID NO: 3491 - DNA, 1500 bp, Zea mays
ggggctacatctagcagatgccactgaattggagtttggatgtcactgaatcggagtttgggattgtatggtataattccacacaatactgaggggtgagactttgtattgagagagcggatttctagttatagtccaattccagagaattaagtctctaattctaaatcttaatttcacatgcaaccgaacaacagaatttacgaaagctgattccaattgtcaattctgtactccaaagtctacatccaaacggagttcagagcttgattggttggatggaccggaattgttatattagtacaagaggaaattattttccacggtggttgaagattctttttctttgtggaaagcaagataatcaataggatgggatggagtgactgctagccggcctgctttgagatttgagcacagagcccagtactgttggagtcctagtagatctgtactgctatctcgcctaatcaagcatagcatcgcgaacagcaagtatatcttcctgggcccaggaagattcgcctaatcaagctgatactttaggtgcccattctccgtttgtccttgcaatccagcctgaaaaccgggtacctgcactggtactgcacgtgtataatgctagctttgattcctgggttccagacagtataccgcttagatcctgctgcaagctacctgctggctagctgctatctctctctgtatatatatgttgctgatctagatctgtgctgttgtgtcgtttaaaggtgtgtacaacctcatttaatacgtgtctcttgagagatttctaggagactaattataaatacaagagacgagcttttcaccaagaaccgtgtctacacgattttccatacatattatctattaattgtattccttattcagagaggattgtgtcgtctcttagctgtattttatgcactaccagaacagtctcttagctatattttatgtactaccagaacagagttctttgtggagtgccacaggcaatcaacaaagcctcgataacactcgataaatctctgagcactcgtcaaaaaacacattaaacacgtttctggtagtggtgcttggaaaaccgattcgtggtatcatggttttaaatgtcctaatcatgctgctgcccattatctgtttgtccttccagtcgagcccgaaaatcaggtacctgcactgcacgtgtatcaatctatttgttatgctttaattcaaactgatttctactgtttttacagtgttttttgtctctataaattatagctgcaacagtatgaacagctgtctttaattttgaagcgaacaacctgtatacagtaaaagcaggagaaaccggttcaaattacagtcgaccttgacaaccagtacagtcgctagctatgactcttcggtttcagtgacgtagtacctgctagcttgctgccatctctcttcttctctatatatatgtgcatcgccgcgcgcatacatacatgcatagtaaagttagca

SEQ ID NO: 3492 - DNA, 157 bp, Zea mays
cttgggatgggattaactgcagctgctgcaacgaggtctattcagtgcttgaatttgtgactcatgctggttttttatatctcataagccatacagaaacatacttgtggatgggctagacattgaccttttgcactgtctcattaatgcatggaat

SEQ ID NO: 3493 - DNA, 280 bp, Zea mays
agagctagcgccctaagtacatgccatcgtgcagcccggagagtttttgcaccccggttcgtgtggtgtcgtggccatcgagggagcgctggagcccgacggaaggacagctgtcggggctgtcgagtccttgtggacgtcctctgctttccgtaaggggctgagagccgccatcatcatagagcgtgcggggcgccatcattactcatatagtggagcgagccagatgggacaccggtcttgtttcccgaagcctgagtcagcttggggcagggtaatg

SEQ ID NO: 3494 - DNA, 293 bp, Zea mays
gtagatcagaggcggccgaggccagggtcgtaggtgccagtgccaccccgacgtcggatggaacgcacccgcttcgggagctggctttgcgtgcgtccaagcgctggtggcgcgtcagccattggctgtagtagctgatagctaggtagtcttgtagaagaagtatcatcaattagtaatcttgtagctgtgtgagtatgttcatatgctgaggcctgagaggtggcgatggcttgtaatcaaggatctgccgccgtacgtcccttgacgactcctcttcccgtggtcggagg

SEQ ID NO: 3495 - DNA, 1500 bp, Zea mays
agttatgtgtgaatggctaaactttcagcccaatatgtgcttcttttgctatagattatgaagaagacctgtcctgatgacttgtggatctatgtcgaggaccaagatgttgttgacacggagaatatgtcaagtgagaagctcaggtgacagttcatgtacataagcaagctgcctccggttgtcctagacttcatcttcatttactttgattccaacataaaatgactatgatgcctcctctccgaagaccttcagccagtgctgggtgaccagctccagttaatctagtgctcccgtgttctccattttcatgttttactcaagctttagaaacttatttagcgactgcatgaattatgtccatcttttattaggtgaatacccaagctgctgcagattgatcatagcaatacaaagaatttaaaatactatgtcgttattgttcagataaactttaacatatcaatgtaccatttaaaaattatatatctcatgtttacattgatgtaataataggtgaacacccgtgcgttgctacggagtgaacatgttatgataagatatattaaaattattttgttctaatttccattttatgtttttgttatcatcttttaaagttcttcgttttgttttcttgtaacaaacatatttgatagacctacatgtacttgtactcaaatgcaatacatgatatcatgtattataatttttttgttattttctaccttaacacaaggtggttgctggtcattgcctaattttagttattttaggttacaaaagcagattacttgagtggtcgataagcaatgcattttaatttacatggtggatttgttcgatgtgtaaaacttatgtaaaaaatcttaactttaaaaaatgataacaaaaacatcaaatgcaaattaaattatttttaattttaatttattttaccataacatattcactctgtaccaacgcaccatcgtgcacctagtacactattatttctacaatgagttatctagagctacagcatagggtactggaaaaaaaaatctcatcgactctctcctgagtcctgactcctgacatctccgatcgtcaccgtccccgtccccggcgccgtccctctcgctcttgtcctcggtgccgcacctcctacatctctgtctcaccgctttagcacggccaccacgcccgcctgcgctagatcccatctgaagccggcggccatcatacccgtgagcgctagctgggctgcatctctcacctccacagccagcaagcgagcgtggttagcgccgcagtggtttcaccgaccttagatcgggccgtaagctcgaggactgaccttaatttcttgagcttaaggtctcagtgggtttaatcccgtagtgtatgaggttgacctttaaaggccttacggcccccttgtttcgcacgctacagatatcgagctgttgacatctgcgggtgcatctgcggacagccttgacgaggctgccgacg

SEQ ID NO: 3496 - DNA, 682 bp, Zea mays
tgaagacatgattaccagtcacagttgagggctactaataactctccaaaacagaactgcactctctccaaaacataactgttagatrtcaatatgaacgttcagttattctctgcatgaatacatgcgacttctgatcatatggggttcctctcaaaattgtaaattatatttttctaatttagtttttttaatagttgatgatgcgatattctatgattaaccctacacattgggttatcgtgcacacatattttatttgtttactgttgattcagttttattatggtaataagcacagattcaggtgctttgctatgtttactgatggagcaatggatttgtcatgttcctttattgacaaagccacttgagttcttttggtttgatgtttgttaataactggagaagtggagatgctgtctaaatttcttggtcattggtattttatttttttatctttctagacatgttgcttgcacgctgcctcctaactaagacccacctaaatatttttcttgagctgaaaagaaataactgctacattctggaatatgttgttttgtttcatattcttgtggagtggcagattgcaaagtgttgatatccctccttttggcaggtgacaggaataccagctgttttcgtgtcagcgctggaggggagggggcggattgctgtg

SEQ ID NO: 3497 - DNA, 505 bp, Zea mays
tgtcgaccaatgatgtagagagagtagagataaaaaagaagataagatatagatgatgaaatttagaggactttgttcgagacggtaaagatatagatgacgaattttttaaactgtgttgtaaaggacatataatattattttagaggatgaaatttaggagacgttggtagagacattctaccctgtatcaaaacatctaactaatagctagcggctaaaattaactaagaggtttagaacatgttagctaatagaccaactatttaagctagctgcacggcggaactgcggaacttgagctggttgaaccggaccaggtcaccagcagggtacataacgagaagagggccaacgtcaccactcaccacactctcgctggtcgctactccgcttcactttcctctcccctcgtatccgatcaccaaaccctcgcttcgccgccgccgggccggagcccgaaatccggccccgcaccatggccgcgcggcagccgccggcgctg

SEQ ID NO: 3498 - DNA, 478 bp, Zea mays
tgtcgaccaatgatgtagagagagtagagataaaaaagaagataagatatagatgatgaaatttagaggactttgttcgagacggtaaagatatagatgacgaattttttaaactgtgttgtaaaggacatataatattattttagaggatgaaatttaggagacgttggtagagacattctaccctgtatcaaaacatctaactaatagctagcggctaaaattaactaagaggtttagaacatgttagctaatagaccaactatttaagctagctgcacggcggaactgcggaacttgagctggttgaaccggaccaggtcaccagcagggtacataacgagaagagggccaacgtcaccactcaccacactctcgctggtcgctactccgcttcactttcctctcccctcgtatccgatcaccaaaccctcgcttcgccgccgccgggccggagcccgaaatccggccccgcacc

SEQ ID NO: 3499 - DNA, 84 bp, Zea mays
ttctgtggcatcggaactctgtaacactgttggtttctgtgaacgcttcaggtaaggcaaggcaaggtaagtgacgagacaaag

SEQ ID NO: 3500 - DNA, 996 bp, Zea mays
gcttgcatgcctgcagtcagcagtgcaaatctcaatatttgccaactgccatgcagtaagtcacattgtttacttgctctttaccataatctaatattggtacctgcacgtgcgtttgtatctcatcgctcaggctcgctgttaaccaaacacattgtacctgcacgcggaggacattattaggttgaaaacagctaatcaatcaactattgtatcgttggacaagttattattgtcatactactcgcgactttgtttttattatatatataatttaagaagttatgagttactataagacaacttaaaagataatcatattacatgtcatctataaaattgtcctaaaattatgtggtacgaacaataccaatgtacatacctaagtcttgaaaccgtttaaaaatatatgtatatttggaaaagcgaaaaacatatgtaatgtaaaataaaaaacctccaatgttatgacgggtttggctttaatttacctagcactttttttttaaaaaaaaacatctcggtccaaccgtgcacacctcgggaccatttccttcgttcggtcgttcccctactatcctcctcgcgttcatctcgtccgtacgccgacgctgccgcctggctcgcaccgccagccggcagtgcctcagtccagatcaagcctccctcttcccagatcgggtcctagttggacggcagcagccgccgccgcggcatctgtcatattcacgccgcgtgtgctctctctttctgtctccctctctatctgcgacgactgggtgtgataccgcagccgccgccctacgctaggttcccgagccttcgccgatctcttctccggcgaagagcgcccaccaggtatttccacaccctttcccttccacgtctgctgtgcgaaactctaacctcaagctatttagctattcgatgcctaccaacttctaactttttgcaaacttttttggatgcctttactagatccgccactgagcatcg

SEQ ID NO: 3501 - DNA, 1146 bp, Zea mays
taattgatttgaatgtggacgaaaaagggctataaagatagaacagaggaagtatatattatagcatctctaacaacgcattaaatcattgccaaatcttaaaatataggatttacagtttgtttgcttggttttaatccgtatcgacttctacattgttttgtctttatgaattacagctgcaacagttcaaacaactgatttaatccgaagcgaacacgccaactcataaaaacagctcaacgtaccctattttacgaatctttatttaaaaagtatggcacaccatgaaaacacccaagactagtgtcctatccttattttatacatcattatgaatatttttttctaataatataatttacttcctaaattactgtttttagtgttctaaacacctaaacattttaagtgatgtagtattttaatttttatatactattttgagtcatctgattgtacataatcttagagcatcttcaagagctttttagaagtctctcctaaattaagtttttcttggtaaaacacaaaaatgtgtcttcaacaattcccttaaaacgctccgaattttttcatagtccttaaaacttcctcatttgcaatacaaatgagaggttttttaggctctctagaaacaatatgtcgctttaatggatacgttggagaatagattaaaatctacctctaataattttttagatgccttttaaaattgattttgatgagttattttctagtgaactgctggagatgctcttaatcgtcaaactcccgttaaatagcacatgacgtgcatttttttttcttgcagaccttcactttccacccgcagctcctgccgtgcatgcccacgtccaagcgttctgtcgtcagcactgactgaagccctcaggcgcccgatgcccaccacgtgtctccgttgatggtcgctatcgcttggcgcccgcacagcgtccctgcgcgctatatatggcgcgcgtgcagcacggcgcattgtttcatgcctttcgcgagagaaagtggtcgaatcggcggctgatttgacccggctcgctattagagctgcgaaagtgatccgagcagtcacggtttcggaagcggcgcgtcggccggaggagaaacgcaaccagctgtcgaggagct

SEQ ID NO: 3502 - DNA, 400 bp, Zea mays
cccgacgccggcattgcagatgttggcgaagccacgcatgtgcttcatcccgtactgcccgagcggcccgcagctgcgctcgtacgcacgcaccaaggacttgaggcagtcccagtcgtcggccaggggctgtcccgccggccgcacggcaccgagcaccctgggacctccctccgagccgaacaggaggcctccgatgagctccatgatgctgtcgacgcgggaccggcgggacaccgcccgcagcagccgcgtccgggcctcggccttctcgggcgtcctctccgccgccctgcggtacctccgccagaagtagacgaggtcagcgtcgcgctggctcacggctggctgcccacggccacggccggataagctcgcggcggtggcgtcgtcgctgccc

SEQ ID NO: 3503 - DNA, 1224 bp, Zea mays
ggagggtgtaacagtaactactcccacaagaggcaactgggagagtacaaatggttcatgtatatatttggtttagccgttttagcctagccgctgttagacctttctccccatgtacaatatctaataatgaagagctgcagctattgtaaagtgcaagtattgagcatgcttgaaagttgaaccggttgccctttgtgaattgaatacacgatgtgtcgtattattattcccttttaaaacaaaaaagtggaataatagtagctgcagcattttttgtgttcattttgttggcgacaactaatatgcaggcagatactaggtacaagacaactaatatgcaggcagatactaggtacaagcgtgcaagcagacattttactccgttattcaacggtatgttatatttagcacttaaacccttccaccaccacctggtgtagctttataaaaaactttctaacaaaccacaattatatctaccgttagatttgtacctaacaaacaaaaaaaaatctgcttgcacatttgcatatatgtttgcatattagtcgttgtcttttagatggttttcagtgataaccacggttaattgagcaatggcggaatgaacaggactccgacaagggtgactcagcaataatgggatcactagcagcgaccccacgttgtttaatttaaatatctttcatttctgtacatttatgtattcaaattcaaactagtggattttaatcatcttgtttagatcgtgaattttaatatttgtcatttataaaaaaaattaacattattgtttgaatttatgttagaccaaataggtaggatacatgaaaatgtgggaaagattaccggtcaaaaaaatgagagaaagaatactttactcgaaagccatagcttttgaaccaaacggttttgaattttttttcgcaggccataatcaatatctacttttttacagctcagacctcataataactttttctaaaactatagcttaaccaaatacatcttctgcagaatttaactaaaaatagccaaaataccataattgacttgtttttttatcgacgatgataatacttctcgtagccgccaagacaaataaaaaaacaataataagagagagaatagtctaaggtattgataacccggatgtcgcgggttcgttcgttcttttgggaattgtgatgtccgttcttttgagccaaacagcaaccggat

SEQ ID NO: 3504 - DNA, 127 bp, Zea mays
aggattacgcactagagtctgaatatgcgagatactgtggatagacatcttaaatgcacatactttgttgggtgcaagcaagcagtagtttcaagtctttttttaatcgctaacatcagtgacttgt

SEQ ID NO: 3505 - DNA, 183 bp, Zea mays
atgtgttcgatgttgtacactgtgcaaggtgcagggtccattggtatgcaaatggcaagtattctatttcttcacaatattcataaaagccaaaataatatcataattatatttttctgtcctgttttgtaaagtgcatctttattttccttgattttttgtttaattaatcttccactttga

SEQ ID NO: 3506 - DNA, 240 bp, Zea mays
cgtcgaaattgaaaaactaaaattagacagaaaagttaggtaaaatttgataaattagacagccagcaaacatgacaccgctggcgcaatttacccatgtttttactatcgctctttctcctgttctttcttgtctaccttttcatgtcaccggacccgaaaccgaaaagactagacattcagctgaacgcctgaacccaatcctaaggagtagccatttcccccactcttcccgccacc

SEQ ID NO: 3507 - DNA, 1500 bp, Zea mays
tcaaaagaacggacatcacaattcccaaaagaacgaacgaacccgcgacatccgggttatcaataccttagactattctctctcttattattgtttttttatttgtcttggcggctacgagaagtattatcatcgtcgataaaaaaacaagtcaattatggtattttggctatttttagttaaattctgcagaagatgtatttggttaagctatagttttagaaaaagttattatgaggtctgagctgtaaaaaagtagatattgattatggcctgcgaaaaaaaattcaaaaccgtttggttcaaaagctatggctttcgagtaaagtattctttctctcatttttttgaccggtaatctttcccacattttcatgtatcctacctatttggtctaacataaattcaaacaataatgttaattttttttataaatgacaaatattaaaattcacgatctaaacaagatgattaaaatccactagtttgaatttgaatacataaatgtacagaaatgaaagatatttaaattaaacaacgtggggtcgctgctagtgatcccattattgctgagtcacccttgtcggagtcctgttcattccgccattgctcaattaaccgtggttatcactgaaaaccatctaaaagacaacgactaatatgcaaacatatatgcaaatgtgcaagcagatttttttttgtttgttaggtacaaatctaacggtagatataattgtggtttgttagaaagttttttataaagctacaccaggtggtggtggaagggtttaagtgctaaatataacataccgttgaataacggagtaaaatgtctgcttgcacgcttgtacctagtatctgcctgcatattagttgtcttgtacctagtatctgcctgcatattagttgtcgccaacaaaatgaacacaaaaaatgctgcagctactattattccacttttttgttttaaaagggaataataatacgacacatcgtgtattcaattcacaaagggcaaccggttcaactttcaagcatgctcaatacttgcactttacaatagctgcagctcttcattattagatattgtacatggggagaaaggtctaacagcggctaggctaaaacggctaaaccaaatatatacatgaaccatttgtactctcccagttgcctcttgtgggagtagttactgttacaccctcctacagggcatagatcctcttctcatgatcagagaaggcttccagatctgaaaacccatcatggattgaccaggagaaggatttgctgccgcttgccctcttgatgcggcgctgtctgtcttcgccgaacttgaaccgtgggcgcaacagaagataggctaggaacaggaaagttccaatcatgatcggccctccgatggctgatgccgtgaaggccatccaggcatgctgcgggccaactacaacataggccagcgagataaaagccacacccgtgctaaggcatgccgtccac

SEQ ID NO: 3508 - DNA, 219 bp, Zea mays
tgcagttgcacgaggtgtggaacggtacacaatcactgtgactattgcggataatccgaaagaggctgccgttttctaagttctaagactctatccccccccccccccccccggccacctcacacacacataatcccactgtctggaagccacttacacagtcgcagcacactcggagtgactctggagacccgcacccggccggctcatctagtcagc

SEQ ID NO: 3509 - DNA, 1500 bp, Zea mays
agatgctttgtacatttaggaataagacaagaaaacatgattacttttggtattttgaggaataagacaaaaaacatgattacatttaggatatgctttgtgcgaggtcaaatgattagtgaatttctcattattgatgacggtattgtttgatttgttcaccaccgaaaagtgaaaacttggcagtagtagtctctgagattaatgtgacaatggcagacatgatcatttgcttcaaaaagcgacggctgtttgtattgatgaataaatatcctattaacatattttgaatgaagtactttggttgatgtctaggatactcaagttatatatttcttcagtcagatatcatacaagagtacaaatgagattaatggtaaatgcataaggatagagggtatgaaggaagattgtttgctctgctaagaagtctgaatactcaaaatatcagctttactgctatagtgattcaacaaaaaaaatattctatagtgctaattttatatgggaagatgatttctcgatggacattcacatgtgaatttggatagtactccggatataaatgtccaaatgaaggttattgggttctcatgtacaacattgcataagtgctcactttattcatgggtacaacattcaccacattatcttacacttagttgtaggccactttaggaacatattttttatgccgcttatctatagcatggagttcccatttatgatttatgtcacttacatatgatactatcgttatctctcctgttacttgtttcaggtatcataattcatggattccaaatctgagacggatgttgatgttgactataacagcttgtactcaaagcagggctttctacagggtgaggtgctcgtttcgttgtggctagagtaacttgtgtactctatctcatcgtttttaatttatttagttttcacagcaactgttttgtgatatgtgctatcacttgctacttagattcatgctattagagattcatacctcaggtttgcaagatctcacacggtgaagtatggagtagaaataactctgcagcaattcttaaaaacagtggataagtagagcggaaactgggcatgatgcttctagttgagaacttaggcaaatgtgtcaaagtcgaacagtaaaaattctaagctaaacagctataatctagaatttatctgttgtcagtatgcctcttatttgtagaggattttcactaatatgtaggtcctaagatttttatggctttcataccttcatacatttgcctgataaaatatatttttatgcctttcataccttcatatctgaacatttgcgaggatggcatcccacattggatgatgcgacaggcagggcagtacatggcggagtaccaggcgtcggctaaggggaaactcacattcggccatcaggttcggggagctcccagctgcgaggttttgaggtgggattgtgtcattgtgacctcaaggtccaaggagatgctt

SEQ ID NO: 3510 - DNA, 1446 bp, Zea mays
catcaacatagcagcgttggagtagtactagttcatttctttgatttttctttggcatcagctagaacgacgcatggcaatttaactttagttgtgtggcgatacttccttatgccatactacatagttcagtttaccttattcgatttctcataacttaaagaaatctgcacattaacttaattcataacttattcaatttcttgccaatcttctcttcttgtttctcttgcaggttttaattctctctttacacatatcttggtctttaattctctcatcaccagcgtaaggtaacaatctaatctgttatgtttttttcatttttttctgtattattccttgtctattctgtattgggttgggtctattatgtattgtattagctagactgtaaattatgcatatgcaatcaattgtattagcgtaagataactttcaatattattataatgctgagctaaaaatgggctggatatcaattgtatgatcggagtagatcaatattttaatgctggataaaaacttctcaatttttaatgtatatgctggataatggctggataaaaaatgtaaccttttttattgtatagtcctctagaggatcacttgggagttgtgagtgtagaaaagtaaaaaaaatagtcgagatargcaaaccggtgatcatatcgcttgggagttgtgagtgtacgcactatcagataaaaatgccatgccagtgagcgtacgcacaagatcgcttgggagtgatgtctgatgacctggttcctcaaaacaaacaaaaaatggattcactccatttccctaaccaaacacaaagaaagaaccatccgatcctatgaggaatgaatccattctggatcaactggttccggatagagtcaatcccctaaccaaacacgccaataattaatagtgaattcgacttagtttgatgatatatatgatataaaatgtaaaacttatctatgtaaataattcattctaatctcttttattaaatccggggaggattttttataccctctccacattctgtagcccgcttgcctctctttctctatgaccaattcctgctcccgcgctctacaccggcgcccaaagcgagcggaatcacttctcgcggacgggattgctccactgccacctacagtccacttcgtcttcctcccttccccagttcagatctactccactgccaccttcctctcccgagccgcttctcatgatgtctccgagcgaaaaccctaaccctaatcctaatacaccatttgagatcgggaagcttttcaggccaacgaatcccatgcccaacgccaccccaaccccatcttccccagcgtcactggaggcccggcgccatctggcccctactcctaccctccggtgaccccgcccttccaccgcggaccctacatccactatccgcaggacctccacgcc

SEQ ID NO: 3511 - DNA, 1500 bp, Zea mays
tatatatttttggaagtgagtttcatatgaaaaatgcatatagcttgtttggtcatgaatttataatcctttatagctttttattgcagtagaacttattgaggaaccccatgagcaaaatcctaaagatgatgacattatgctaaccggaaacagtaagatactacaaagtattttattgatgactacattgtgtaccttattattagcaaaaagattttgaaaacgtctaacaatgagacgctaggaactcacatggttcttttggaccagatctgcatgatactgtcatatggtcttaagcattttcggttgctcatgtcgctgtgttctgttctgaataaagaaagctaagaaatgaataggttgtccactggcagacaatcactgtgacccggcaacaccgaaaataaaaatcaatacttaaatctgtggatggcatgtggtttcactttatagactggacgacactaacgtcccatggatctgctaaaaatatcttttcacagcttttcaacagaaaataaaataaatacagctaccctcactaaattactggaaacatcattctcttcctctgttcatatcattactagcagcagatgaacaatttactgaccgaacagtgaaaccaaataatatgtgcagtgaacaagttatagcataacccagcaatcgtaatgaccaattaactaaaccttttggcaattgtaccaagatgccagggccccagcccaccatcacctctgctttccctccccatgtttctgtcaccacccactgctttccgttccaccactatgatttgcattgatctttttttttctctccgtctctcagaaaactcaccgcatctccatctataaatgagcccctcttccaagcctcaattcccttttcccctcctccctcgctaaggttcctgtgcagcagccctgttgcatgccatcttcctagcttagctagcaagaatctcttgccctccttgcttcctgatcctgcgcccttggatcaccttccatgtgttcttggccttgttctctcgtgcatctgaccatcagttcttaagagtatatttccattggaagcaaattttagggtttcctggaagagactctgccaacccttttgtttgccctggtgcatctgcatcaacttgttcgtttctctctcgtaaaaaaaaaaagctcactatcgtgaacgttttcgtcaattgatccatgatagactaacgtggtgtagatgtcacaaatcctctccgaggtgagtcaccgctgcagatttatgatcaactcgacgctccggcgaggcacccatcttgttctctctttctccgttgtgttcctctattggttctatgtgttctcagtaagatcctaaccaccaatacaacatactagtatcatatccttggaaattataagcctctacatacaacacaacttaattagtcagaggaaagctttcaagtctagatataactccaagtatcttttgagg

SEQ ID NO: 3512 - DNA, 1171 bp, Zea mays
tttgttttggtatgctttatgttattgtttcgagtttcttaagagaaacaagtcctaagttcatgaaattcttctttatcatagcctatttgtgtagtctttaaactcagagagaaatattattggctagtggcattagtaacagaacgaactatggttatgtattgcttattctttggttcaacggtgtgcaagaccaacttcttttgcagttcttatttatgcagtgctttctgttgtttaaaataataattggcaataccatgtcctcatgaccgtagctggtggacaggtaacacatgtttaggaatcaggggatttcatcacctcgctagaggtgagccaaatgtttggagaggtaaaactggttctcactgatcaattatgttgtcaacactattttgaagaacattgcactgtgctttaatcacgatccaataatgaactttatgtttcaagtatagcattggatccataagatgtgctctctctttttccaaaccaacaagacattaatgagattcatgaactgatggtgctgctattgcatttctttggcacaaatgataggtgtatgggcaatgtgcctctaggagcaaatgggaaagccaacaaagctgaatctaattgagcttggtctaggacggggaacactcttgatctgatatcggttcaacacgactacaatgctctacaacgtccaaaccattactataactatccataagtagcaaatgatccatctgtttaatgaggagttgatcaaggtctaggtattacttaccaacctcttattttgtttctggatccaggatcttatgctggtcctacaagtaacatgaaagcactccactccccattggcattaaagcccccaacgtggttgttgtgttgtattgtattgttgtttgtactaggcgagcatcacttctagtttgttgtagttgcttttgcttgttgcttcatgggtcttggatctttggttgttcagttatttgcttcagcaattgggcttctggatttgtaggcattgctggttgtcttgaagaaagtaatgagctcttctcaccactagctatagaggaaggggaagtttgtggttgacaagggccccaccgccgtgactgtggtggcagagaaaggtggtggtcacggtgagggcagccacaag

SEQ ID NO: 3513 - DNA, 680 bp, Zea mays
aatggcagatcatctttattgcttgcttgctataggaggggagggtttctatgtctaagcggaacggagtgtagcaagatggaatcagatcctctacagtcggcctgtgtctgtgtgagctggcatcggccggcccctaaaccctaaccctgattaaggtagagactatatacacacatatatagaaacagtacacccattacattagaaaaacacagtaatgtgacacggtaatctctcactgattcttctgacgaatatcatcacctctacgagattatgcactgcacatcttacggatctagctggactgaagatcggtccagtgacatctcaaaatgaacacctcacagaattaactctctctctcactgatacaacagcaaactacaagtctacgacaatgccgacgatgtgcatgccaatgggcagcactgccaccggagaagcaaaattagggaggggggcatatatagacaagacaggcaatgaacatgaaccgactccttttctcaagtatcagcctcgggggccagcaaaatccggctcaaggtaaaaaggaccccgacaacacgtataaccaaaaacaaatggaatcaactcctgtcgcctagagacgaggcgaggaaggggaatcgccaccgccactgcgcggcttgtcatgctggaacttcaccacg

SEQ ID NO: 3514 - DNA, 1236 bp, Zea mays
agattttggtgattaagtgcccaacacacattaagggaatgagtatatgccaaagggtggacaaagtgcaaatcaatacaaaggtatgattctagacttagtacattggtttttgtgtactaacatatctgtctaagtgctagaatcacataaaagacaattggaaaagacttggcttgagcagccaagactctgctcagtctgggtgcaccgaactgtccggtggtgcaccggacagtgtccggtgcgccaggctggctctggagaaaaggccgctctcgggaattcgtcggcggcatacggctaaaattcaccggactgtccggtgagccaacggtcggccgcgcgatccgcgcgtgacgcgtggccgggccaacggtctgaaggggcaccggactgtccggtgtgcaccggacagtgtccggtgcgccaacggctccaaatcttcaacggtcggctacgccagaataggaaagaaatccgcaccggacagtgtccggtggtgcaccggactgtccggtgcgccagtcgacagaaggcaagaattgccttcctacaatgctctcgacggctcctagctgccttggggctataaaagggaccccttggcgcatggagaagatatccaagcattctttgagcatagttgatcactcacacttcgttcttgcgcacttgttcgacattcttagtgatttgagcttcgttctagtgagaaactcatgatagtctcttgagctcaagtctggatcttgtgtgtgcgtatttgctgtgatctttgtgtcttgtgtgagttgctcatccctcccttactccgcggttctttgtgaacatctttgtaagggcgagagactccaagttgtggagattcctcgcaagcgggataaagaaaagcaaagcaaaacactatggtattcaagtgggtctttggaccgcttgagaggggttgattgcaaccctcgtccgttgggacgccacaacgtggagtaggcaagcattggtcttggccgaaccacgggataaaccactgtgccatctctgtgttgatatgtttgtggttattgtgttttgttgagactcctctctagccacttggcatgattgtgctaacgcttaaccaagtttttgtggcattaagctttcaagttttacaggatcacctattcacccccctctaggtgctctcaattggtatcagagccgttctcttcacgaagggactaatcgcccgaagag

SEQ ID NO: 3515 - DNA, 1500 bp, Zea mays
atttttaatagaacaaacaactcacctacaagtttgtttcaaaaaaaaagatattgcatggttttatgaaatgaaatgctctagatggagtttcacttagtttccaacacatgagaggatgaaataaaatattgtaagtggartgtgtcataaccatgagcattgtgtgttcatctagatgaaattgatctcctatatcttctcataattgatgtgtcatgtcatctttgttgatgtattgcctgattcaaaatgaacgaaactcccttttttgttgatgtgttacctyattaaaatgaataaaactctagctatgattagccttaaggctaaagaagtagatcaaatggacttaataaatttcagttataatgcaataaacatgaatgaaactcccactataatcaaccttaagctaaagaagtacatgaatgaacttaaaatacttttcatttataacgctgggaggaaaacgaatcgtctattatataarataggtagattaagtagagtcaaggaagaaatagcaagggtagagtttataagaacaatacccaatgttaaaaaccacatataatttctatgtgtgttagattatgtagatattgcacataaaaccaaatttttaattaatattttaagtttgttattcaataacacattttttctctattatccacctatcgcatcactttatgttatttttggaatattggtatttttgcagttttgaagcaatagtatggcatttaataatactgtagtattggaagccaaaaaagtgtttagttgctacagttaaaacaaaaaattaataccatgatctactccaaaaccatgatattttttgaagtttttaaaactccacttaggatctcgttttttcttctattctctctatgcatactttggttttccaataaaaccaaacatatatcagttttaagcaataatgtaataatattgatgtttgcattggagaggtagtgtcgagtagtgtcttgggttggcactgttcttaagtatgtacaaccctatttaatacactgtctctaaatctctaagatattaaataaaaaatacgccaagtagcttttaagacactgtaggagctgtttttaaatcaggcaaatactccaagtcagactgagcagtgctcggtggtcgcctgctcgatcggctcacattcacggtaggctgagctgaacaactcacaactaccaccacccgggagtaattcaatgctccctggatcctaggggtcaaggcaggcggcagcattccgtgatcatgtcgaacgacgcaggcactcagcaggtagcctatataacaccgccaccgccacatacaccaccacacagcgcaacattttgccaagatccaagagatttctctgtgttttcacgcacaaggatcgtgccccggccagccccagctggtagcgttgcttctcgatcttgcgattgttagctagcttgcaaggtcaaggacgggccggcg

SEQ ID NO: 3516 - DNA, 377 bp, Zea mays
agtgtgagcgtaacccgtcgataatccctcgatacgataaaagagacaatactaatataaagtacgcgcgtgaatgttgcaggagccaattttttatcgactagtgataacaatcagttatcatcaattataatgatttttttaaaatactcgattttataatgaaatacatctaaaacctttttttaaaaatcccgagaggcaagagcccctaaaaatcaattgtctcgctgactcgctgcatcctccggctcctgccagacctaggctatttcccgatcagacctgttatttcccgatcagacctattcctctctcggcctcccaccgccaccggcggcgacgagtaactcgcccgctgaccccagcaggcagcc

SEQ ID NO: 3517 - DNA, 254 bp, Zea mays
ctgcaggccctgctccactgttgctttgcagacaagcttcgcctcgggcaccgcgtgctttatcgcctggccacaaagcaaggaatccaaagcaaaggcaacggccaagttcgcagccagggttacagccaaaccacacggcgatccgccgatcctattatcccaaaaccacaacacaagaacgggaagcgtgcatgcacacgcacgagcacgaacctgagctgtagcgccctctcgctcgctccccgcgcgca

SEQ ID NO: 3518 - DNA, 148 bp, Zea mays
gctgggcggccatgcatggcgtggcgtgtgcatgctctgctgagtcctgagctgagcatgcacccaccacaaataccactgctggtgctggtccagcacgaagggagaacgcagcagtagtttgttcatctacgtctatgacaccagc

SEQ ID NO: 3519 - DNA, 87 bp, Zea mays
tcttttttttctgcccatgggatccaacgtgttgggcccagcccagtatataggagtgcatgcagtggcgggcgatgatgtaaaaag

SEQ ID NO: 3520 - DNA, 602 bp, Zea mays
ggcttcgccgagtgcttccggcactcggcgaagctattgattccggtagtgatgtagtatccttattaaataaaatagaataactagtttgttttgaggatgttcaaaagaaggagacctacaatatagtacgtagatatgttggtgtttagtatacatattttccaacgggaacggctttactctctccacaaatgtttttcggttatgccataagttttgttttgttggattgctttatttttgccgaccggccattatcaactgagaatataactttgtacgttgagtgcatggaccattattacatcggctagtcggtatgcggtgtgggttggccaagaatcagttcttccaccgaaatgctaggcggatgcctatgaatcaccagctagctagctagccaggagttttggtattccggcatggcatccaggaggagagcagacagaggccggggcggcgagatccgccgcttccgcccaacgggaagcccagccaccaacgcaacgcatgccactcgtcgtctggtataaattctcccacctctcgatcaagcaatcccaagtcccaagaagcagaggagaggcccaagcagagta

SEQ ID NO: 3521 - DNA, 797 bp, Zea mays
ttggcatgccctggcagaatgagcccgcagcattgcgtttggattttttttccgcccctggtgtgccaggcctgaataaatggtagaaatttatattgcagatttatagaaaaaaatcaaatttgtggcaactacccaatacgacaacatgtttgcagaagggtatacttaaaaaataccgtatcacttgtctctgtgacttgagaaagtcgcctataaagattacagtggacacgtttcgagtggagggattctgtggtctgtacacaacgaatcgaaataaaagcattctagggtccacggactatgagggcagttgtgtaatttgtccctacacaggatcactttgatgtgccgtactggacctctcatcgagccatggatacaaaatgacgacactgccccgatcctttattccctcccatttctcgcgcctccttttcggaaagctctcgaacccaaccacccaccccacccacgattaaccctggttagcgctctgccacgacctgacgagcccattccaccatagcatgcatagacccactccactgtacgccacgcacgattacgtgggcccgacatttgctccgtcccctctggtgcacaaagaccaggcgcacctgatcgtgcttcacctcgaaagaatcgaccccattaccatcctcctcgttatctcgcagctaccgccgccgccgcaaaccctaacctgagttccgatccggttaatcgacgacgaggaagacgacggtgcgttgcagatctgaggggatctgacgacggcggcggagggggag

SEQ ID NO: 3522 - DNA, 115 bp, Zea mays
actgtacataatgtagtgaaacgtaaatagtgagatggagagtagtaagctgcacctaaaggcttttgtggaccttgcgtggtgttaatggatcttgttgctgaccactgatgtg

SEQ ID NO: 3523 - DNA, 1324 bp, Zea mays
ggagcgtaattgaccgatgtggaattttgctgctgtccacgtggtttgaacatttccacattcagcttgttgtctgtaacgatgtgattctgactggagcttgaatggtggcaatggtattgacattgtcgttgatttgcaacaaggattctgttcgtgaactaatcaagtaaagagattttgagctgtgtttgtcctaaggcatgtcttgtagtggactagtggtagataagcacagccacaccctagtgtaactgaagtgggcactaggcagaacgccagggatgggagttgaagagtgctggcctcctgatcatcatggatgataacatcttcaggaaagtatcagcatgaagagatgttttcagactgaaactgcaggcatgggcaggtggaacgacttgtgatcacaagttcttgaacgcagacatgtttgtttcggtttatttccagcttctggccgctagaagctgttgcggactgacaaatgtctagttttttcagtttgttttgtgagaatcgcttttataaaaactgtccaaaatcaacgtgaacatagaattgataaatctgtcactttctaaatcctaaagcccattgacatcatcttttcttgcacgtaatccacacggtacttattatctgtacaaccagattatcaaaaaggttcggttcgaaaaaagttgaaacaaatatgccaataagagagctttccagggtgttagcctggccaataggcttattcgacaagtgttcagcatcaacaaagttcaagttcccctcagacttgaagctgggcgtcattggtctggtcattggtctgtctattcgtttggttttaatctatatcgattttattttacagtatttttatctttataaattgtatctgcagtagtataaacaaccacaacccgctttaatttgaagcaaacacctccggaacttgtgaatgtgcgggctcacgattcatcaaccagtaggctgcagttgtagtggcactgagggaaatgaccgtggaatggatgcaaccgctcccttgaggatcattatgttaataatctgttttttcaaaaagaaaaatatccagataaaagatggtggactataaattttgtctaatcagccgtggaattctacctagcgtcgtttgaatcggcgaaatttatgtaaatatgtttttcggttagcattcacgtttgtctgctggagcctagaatcctgaattcctgacccggtctggtatccgagcccgccggccgccgggccatcgcaccacggataaaacccaaaccccttcgccgattcaggaagagggaattcc

SEQ ID NO: 3524 - DNA, 1246 bp, Zea mays
acggtcagtcgccgttaagccttggtgtggttcttgatgttgctttgtggatcgatggaggttgcctctggtcatggtgatcccatgtttaaccttgatgacgaacattggaaaaagcattttgttttatggactggaatagtctgcaaacatcacgatagcaatattgttctgctgctcatcagctgaggatgctgccctgtcctgaactcctgattttgcttttgatctactatgtgatgatttgctcttccttttgtttggatttgattctcacttttttcccctctggaatgtgggaacgctgcatcgcattaagcaatggagtgagttgtggtcgtgccttgctactgcttaattcatctatcagagaaatgtctctgtctgtcagatgcacttgacagaaatcttcaagctggaaattcatacggcacctgcagccgccgtaattagatatgtcggttctgtttgtaaaatttacttgtgaactttgaaagatgaaacgggaaattctgatctttttccgtacaagcagccatcaggcgtgcaaccgtacaagcaggagctactgccatcatctatgactgtcatttagtctgtaataaagataaagataatctaatttctgtttggaattgaaacagatcatagtccattctctagacatctgaatcatattaacagagtttttgcataaaaccacacacctggcaacagcaaatctaccagaccagtacgacttgagacaccggccacggccactaaaagagaggagaggggcagcaccaaaagagcaccggtgacggcgactgcgacgaaaaaaagacgtcgggcggcggcgcatactcgcacatggccgctggattagatgattttgcaagcttggccgttggattcaccatggatagccgcggtcatcctatgtcaacttcgatccgacgtgtcgtccttctattggtggcacatacgtcatagcgaccggcgtgcacatctgccaggcccacaggttcctcccatgggcgcccacaggtcagtgacacgcgcggtcattgcgaaaggcacgtcgccttctacccttctccgtcctccccgaacactccacccaacccaaccggggcattcaaccaccccgtgtgctccaaccgctcctcgatttgatcaccgattgcgggaggccgactagggtttaccggtgagcgcgcgcgcgagagagagagagagagagtgagggcggaggaaaggggag

SEQ ID NO: 3525 - DNA, 583 bp, Zea mays
cgtaaattttgatgtttttttcaagtattttgatcaaaactttagaaaatgacttaagataactcttaataaaatctctttatctagaaatagaggttgtactatatagaacctgcgagtcataactcataactatcttttattacataagaagtcataattattaatgattttctctaactattttaatacgcccggtcttgtctcctgtgtcctgtactcctgtgtcttgtcccactcctcccgtctctattccccaattggccctcgcctccattaccttccccgtccccctcgtacatttcgacatcccctcccccccgactctcccgtcccgctcccgccgctaccagcgattccaatccgccctcccttccgccgcttaccgccgcggccacgccgcaagcgtttcgtctcgggatccccacttcgtctcgctcgagcggtagagccacgctcccaccgtccaggcgtccgctgcggaggtgtcggtggcccatctgaacaggctctcctcgtcggggcttttttgctttagagggagagacttcctggtcggcgcgccgcgagaagagcaccagcc

SEQ ID NO: 3526 - DNA, 761 bp, Zea mays
agctgtctgacgaggaattggaaaactagggaaggagttacagagccatagcttcctcttggtcagataattgcaggacagcaacgtggctcatatatagttatatacaatggacgggcggcgagtagctagccggcacaagttgcagcagacgaggcttggccgcttggggacctccagctgcctgtgtgagagtgagagaggtgacaaataaaacgggaccaacacggcaacaccaacctccaccgctagacctcttctcccgctttaccccgacatgaaagttagatttggtagaatcgaagttggcaaagagaatgtagatccacggggctacactgcattacggttgatgagttcatctggtctatcactacaactacagttacaggcaacgcaacgagccagaatcacgtggcacgccgaggcgggtggccctacgaaaattcctctacgccgtcgcgtcacggaaacaggcccccccaccccaacatccaccagaccaccgctggtccaaccaatcgcgccaagaggccgagaccaaacgacgcgccggcgcacacgcaaaccaacaactattgccgatgtttccgcgttactccccgcactcctgctccgctcgccgctttttatatcgacctgccccccggctcagtcggacagtcctccacgcacgcacgaggccaccaccacgaccacgagcgcgcgcttgccacggcagaccaccccgcccagcggccagcttgctcgccacgaccacg

SEQ ID NO: 3527 - DNA, 1500 bp, Zea mays
cggaataccttgggctgggtgggaggtgatctggcccaagcgcaggattgctcttctcttttctttttctttttttctattttcaatttcttagtttccttcacattttcagattcctatttcaaatttattaatagttatgttagataatatctctaaatattttatctaaagagaataacttaatttatagaggattcttaaatcctttattattagctatatttatttaagatgtgacttaaaaggtgagataatttgtataaaaaaatatcacggttcaattcttcgttttattctgtcaaaaacccataataatatttttttggtgttacatagattctcttctggtgctggtcacttgcttatacacaattgtgaatactattttggaacagaatgagtaatatttacagtccaatttatcccctaaagcaccaacaaagttcaatttaccctttacacgacgatatgtcaaataaaagcgttgtccaaactaggattggatatctagccaactcgactcattcgggttggagctggctcgttaagctactgagctggctcaactcgttaagctaacgagctggctcgacttgttaagctaacgagccacgaagtcaactcgattcgactcgtttatgatctcgagatggctcgtttagctcgcgagctaaagcagaaaagaactaatatatactaatcatttctagttaatagtacaaaaaataaaatattgccaaaataaatattttagattaatcataaaatatttttacaataaattttaataaaaaatcaatactgtttgttataaacttgaaaaacttaaactaccttgataggtacaaacattctagttgcgttatatatagaatatgaaaaacttaaactagtttgataggaacaacatgtacatattggatattgctcggtgggtgcgggtcacataaattggacgtgcatctatactgccggcttcttgcttaatagaatatgatttttataagatacgataggaacttaggaagtttggagaccatttttttgtttagtacttcgttatgtgttgtttaatggggcttgggcctgggccctgggccaaccgggttgagtgttatcacctctatatctatacttttaattaaagaatataaatatccttcaaaaaaattctatgcagattagttttaaaaaatttataaaagatttaaaatagaaaaatatccaaagcgacagcaacaccatttatgtagagcatgctattaattagcaccttccttttttctctgccgtcaaccacgcccacgtccccgcggagcactgacatgcgcgcgtcgtggtaccctggtctgtggcctctgcgctccccttcctccgcggccctcgcctcgccagaacagcgggagatytcgggatcgggcggccctcctccggcgtccggatcgagaggattggacccgaatccgatcgcctagcagggggcgcggcgcgcgcgcg

SEQ ID NO: 3528 - DNA, 1500 bp, Zea mays
atatattgcatttggtatacgtgagacttttggatcttctggtatcattgtggcttgcatgtcagtactttgtataatagagattatgcgagtaatcttaccagtgatgtcgttgtcgatcttacgcttggtgtccctaataacaatcttattaggtccatcagcctttcctgatgaactgtgctgcctgctgtaacattgctgctccgtttgggagcataggtgggtgcaaagctattggggtaggagtaggacagtggttatggctacagctgaaacatctgaagccaaaagcaaactgatttgggtgactaaaatttggacctgaaagaacctaatgaattgtgtcatgtggtgattcaagttcaagatgcatgcgcaacacagacatgcagcagcgcaagggatgaaacgaggcctatttgcagatttagttggtttgaatgtttagcctgttggtttggttttaggatatactagggattgattagtttattaggaacttcaggagatgtcatcagtgccgtatataaacctatggatggtgtaggaaaatatttacctccaatttacctaacacccactctgttcttgcctcgaggttgtgatgagctgatcatggccctgccgtcgtgccattgatgtccacggtcacacccaccccacaactatgccatcgccatccacctccctccaatgtcccccctacatcacaaattgttcagtattttttattccatatagacaacacaatggtaaaatcttctgattttcagtcatacatgggatagaacacaatacatatgctgttgcacatgaatctatactgcattttttattctccagaagttagcataaattaataaatttatgaacaagcagtacaaaccttttctactgatagcctgaatcaaaatgttcttcccttagatgttataacctgctataagtaatgaaaagtgggaaaatacaaaatagtgatcttctttaattagtgacaagtaaacactaaatagttgatgttctttaagcaaaagtattgaaagagaaatgtgaaaggtctattttactaccatgaataattcactttgccagcttgatgttcaaaattttagctcactttactcccctaaactttttgaaattgtccaatctacaccctaattagaattttcttgtatgtctctcataagtagagatgtcaatggggacccgatacccgataacccgtggggaattcccctattagggtacgggtatgggacaaaaattgtccccatgggtatggatatgagacaaaatctccacccattgggtaaacgggtatgggtttgggaagcaataatccgaacccgattacccatgggtatttcatacgcgtacacctgtcctgtttgtatgaatgagttgaggccgagtcggccatcaaacccgrcagactccatttcttatattggtcccaagtactgatttcttttctgatggatagatgaatagata

SEQ ID NO: 3529 - DNA, 640 bp, Zea mays
cggtacccttgaaggtgcaggcaggctctacgggagcagtggactgaacacgtccagcctgccgaggccgtccgtcttccttttttttttctccctcgcctcgaaggaagccggcaagccgcacgcttgcggcggaatacttcggcagccacaacgtcatgctacagctcctgctcacgggcttccgtcccatccgtcacctctggatccttgcttccctcctcgctcctcggggagacgaggtccctccctgtcgctcacggctcacctctggattcggtgagctgggcgtctcggtgcgggtacgtccgtcacacacgcgagtcctagtacagtactactagtacttggaaaaggggttcgttgggcagctctggtcgtcttcccggtggacaacaaacccgcgtttttccacggccaccgtcccaaaaattcgtcgattccaaccccgcatcgcctcccccttccgcgttcaaagggaaacccacgcatctcgccccccgcagtcgtcttccccgacccgcgtttctttattatattttcccccaaattccacctccaccaacctcctctcccaccaccgcccccgccgtcgcctgctgttccatgaaggactaatccgtcggtccacttctcagct

SEQ ID NO: 3530 - DNA, 219 bp, Zea mays
tttcctttacaaatggtttaaagtgctagcttgtgctaattgaattcagctaacaattaattaaattgctcacgtgcctgcttgtttgcattcatttcctcttcaagtctctctcccatttcttcctctccctgctcgaccgctatctgattatgatgtgaacgaatcccatcatgcagcgaatcctacaacaaggatgtccccatcgtccacgtcgac

SEQ ID NO: 3531 - DNA, 1150 bp, Zea mays
ggtactaaataaatacgagggagaggaggttgtggatgcgagacgcaaatttttttgggtaaaaataagagagctattagagtaagataaaccactattctttactaatatctgtttggagttagtttacacattcttttaaagttgctctaagagcgtctccaatagctccccataaattgactcataaaaataaattttaagggacatctaaaaattagtggagataaattttaatcctttctccaacacatcctttaaagcaacatattgtttctggggagcccaagaaacctctcatttgtagctacaaatgagggagttttaagggctacgaaaaatttaggagcactttaggggaactgttgaagacacgtttttgtgtttttcccaaaaaacttgatttagggggagacttctcgggagctcttggagatgctctagtaagggttttgtggaggaatgcggtagcgacggtacccattcgtgcaacgatggtgagagtcgcatagtcaaattcacatatttgtaatataatgagaactgataacgttaaactatatttgtttaagtccagtcataatcaattattacactagagtgttgtttggtctgcagtttttaggctagtaaccattcacactactatctaatgtcgttgctttccgtttggttgagacaacccgtaatatgtcacaatgggagtggatatgactctataggatctcgttacccctctttcagaaaccctattctgttccgtactacacgctcaatgaatcaaacaaagtttactttctgtcaacacgtctcatcgtctaccagtttctttaacattatcgttaccaccgccgaactaaacaacacctaaaaattgatacctcctattcaattctattatttatatttaaatataaattattatcgttgttatttacgttatatatttgataaacgcaccaaagtgtcaaaccatgctcgagtcaccctcgcgagccgtttgccgttcaggctcggtcgccccatgttggcccgatcggtttcattttgtagctcaaaggtgaggttagggtttttttcaccaaaccagcgaggcagctaccgttttgtcgccatagcactcccgccgaccccctcgccgccgccggga

SEQ ID NO: 3532 - DNA, 577 bp, Zea mays
tgtgtatgtgataaattgtgaaacatgacatagttgtcagtttgtacaatataaggacatgtatagtggagagacgctaaaacggttcttcaagcataagagacaaccaagagactttattatataattgagtgtctataaatgtagtctattaataaatacagaagcaaatgtgcttctacagcatctgatcgatggaatagacgacgaatccgtacggtgggaggtaaggtgtctgttgctactttggctacgagccagagccgtctcttcacggagagacgactccacgatttttttggcaaatagtcccttttagactattgaatgaatctgtttgcatgtatccagaaggttctttactatagatagaatatgctataaatcttctgtaatcaggaaagtcaagaaccttccctgcacatgatttgtctcctttattgtaagccacgccaggggctcttcctggctatatataacacgtagacggcacgaggtcaagtgcacgtttccagccctctgattgttttccacatggtaccagagccatcaaaatagattaaatctatcttccacc

SEQ ID NO: 3533 - DNA, 1500 bp, Zea mays
tcgacacgacggaacgccactgtgtacggtctcaagcgtatccccactgccttgtggggtcagtcaatcccattcttggggaacctcagcgacggagtctccacaatgacctgcacacctagaaatgatgggacgatacactatatcgggtgtatgtctacgcacacaggatggtgacacaagtctcatgacaaaagacaaatccacaccacgcacgactttgaagcatactgtaaatccaccctgcgagacatgccatgcgctactatgtcaacatcggacttgctacatggacccgcatatcggacggatgaagcagtatgccataccgggagtacggctacgcatgaccctactagagatgtcagaaagactaacgtcactcgaggtcgagggcaacatgccacaccctcatcagtagagtacgagtccccactgtaaggtcctacccttgaactataaaagggcaggacccctccttcacacacacgcagctgtaacgcatccctcaagcaatactacgatccgcattgcattggactagggcgtaagcctgaatcagtataacctctgtgtcaaatcccctcctcgagtcccaacgattgaccattcgaaatgagtccacgttagcatcccaaccgaacataaattctattgtccccgatttatggaaccacgacaggtatatcgaaccgatggggagaggtatattgaactaaaaatagtttaaagaattatgatactatttcttttagcttatttccgccgtgataagttgatgcagactgtcaattcttagcttttcaacccgtttttttgtaagaatcgtttcagtgaaaatcgtccaaaatcaatctggacacaaaatcggtcgagtcgttacgataataggaatttgtcactctctatatcataaaccttatgaacatttttatctctctccgtacgtactacaactagattttcagaaaagcttctcgaataaaccccaaaacaaatagccctagtatcgtctattagagtaggcaaccactaatatgcaatcagtcattaagtgcaagcgtgcaagcaactcacttgatctgttggatctagattcaaccgtatgtgtaatcatggtttgttaggggcttttttataaagttacacgaggcgctggtaggaggatttaaatgttaaatacatcatacggttagatctagatctaacggactaaaaaatttgcttgcacgtttgcaaataatgacgacttacctattagtcgttgttattagagtaatctggactttttcagaaaacaattgcatcttttagaactagtttgataactgcattttcgcaagggactctcctgtctccaaagaaaaattaactaatttactatagaaaataaaattctgttaaaaaatggggcaatgttaccgggataaaagatctcacccctccagagtcccgggataattcgcttcgatccccagaggcacagacgagacgacagag

SEQ ID NO: 3534 - DNA, 419 bp, Zea mays
ttaacagtcgcataagttatttacctatccattccaaaataagtacatatgctagcgtcaatcatgtggtaaataaccagaataatccaacttgcttgttttcattctttcatcgacaccatgttacaattgttactacaatagtagtgatacgataagtggtatctatatggatgtacatctagttaggcaatttcaaatatatgttggccctgtttgtttcggcttctggcagcttctggccaccaaaagctgtaaaaagccgaaacaaacaggtgcatagaaagccctcgaggccccagtccattccctaataatcggctatcctgtcagtttccctctcccctcccgaaaccggattccgtaccgaatctggtctcgccttggagccgaggttgcacgcggttcgtcctgcggcc

SEQ ID NO: 3535 - DNA, 598 bp, Zea mays
tgggcttcaatcatctatctattttgactatataagaaactttttggtgataatgtcatggaatgtttaataactatttgatgaccatataatggaacatgtaatgtaatatgttatgtagtattatcctagtgttgctactttatttaattatttatagtgttgttgaatgaatgattcaatgatgctcaaaattttataatggtatttagaattgatatactcgatgttgtataatgtattattttgataggtgtttaatctttggtactaatgatcaaacagaacgcgtataggcggtgggtatttacccgttgccaatctctatcattactccactccactgccgtctcttctgcttcttctaatcctcttgtcccgcgaaccccagtcgctaccgagagcacaccaatcctcatcacctccgagattttcatcgcctgccgcgcaatctcgggatcctagccgtccgcacatcgccgcggccttcctccgcgccacgaatggtgttctctggccgctgtcttttcccgaggacctaacccaaggcggtaggtaccagctaaaagtctaaaggcgaccaccggaccgggcggca

SEQ ID NO: 3536 - DNA, 95 bp, Zea mays
gggccatatacttttttcaaggctctcatagttcagtattgttgcaggttgtgacagacacgctaaatccaatatggaaccagacatttgatttc

SEQ ID NO: 3537 - DNA, 70 bp, Zea mays
gtcgcggtagggcagagccaaaccctaaccctagcttcctccagtgcgccttcctcgtgaggccgtatac

SEQ ID NO: 3538 - DNA, 1500 bp, Zea mays
gagcaaacgaacatgcatcaacctagaggggattatagctcgggatcacccgatagtgttgaagcaccacgtcctattggtcgtgatagagtgagagtgcaacacaagggtaaagggttagcaacgagcaggagtgaggaccctagacgaaaaaagaccatagcaaagaggctctataaggctagcaagaagttaaattatgtaaagttatatgattcatgcaccaaattgatagatcaaaacaccgataatgtgcccgaagacatgagaatgatccatattgcgaccattaaacggttggccaaacaattataactagatgacaaaataaacaagaaggctaggtggacgagggggtgagtaattttttatgctctttgtattttatttggtttatgggtttgttaaatttatgtagttttttaacaaacatttgtaatatgttttcatattttatttggattaaaatgagtatgtagaagaaaagctgatgtggtgctgatgtggttgtagtctaacggtaaaagttatgtaccagaaaatttcgataaataaaggctaacattggtagatacagatggattaatagtgattcagtggtagatacatatcagagccattggaaccgaatccacaagaaaacccaggaatccaagccccagtaatccaagcccgatgacacccgaaacgatcattagtgtccatgtaaccatgggtctatttgtttcggtttctggccagatttcagctatcggaatcggaatcggcttctagcagcttttataaaaattgctcaaatctacgtaaatgcagaatttatcatgtggtcacgacgggaggaatccaccactttctaaaccctaaaccgttagacccctccatattcttcggtacgggagtcctgtcatatacatctagattatctatattatattaaaacatcagttttactrattccacggtttccaccttatcatgctcccctagctttaattagtaaaaatactaaagtttatatataaatgtagatttgaatcatggttgttagttctaaactcacattcacaaccacctaatcaacagaatacatatgcttttatgttgtatattctatattttatattatatatttaaacacaaatagaaagcgtacttacactttgctagttcttcgtagaaaagcactttaaaaaaaactgtcccaacaacccggcaacggatcgcatcgcagcatctggctacgccacggcgccacgctatggacccgccaggccgccacacgacacgcctaggccagcctgagccagccccgcagtcgcctgtcctgtgtcctccggtcccggacctctgtgccgcactgcccacagcgacagcatcgacatcgccccggtcccgtgtcgcttcgcttcgtagctcgccgccttccccgcgccccagcagcaacggattcccctcccctcgagagatccgacccttggcccggtcgctggggagagcggc

SEQ ID NO: 3539 - DNA, 879 bp, Zea mays
atccaaggtgaaaaattgttaatgttttgttcaccatacgaattctacaagccggattcagagaccgtgtaaagtagaggatacggcaatgtagatgataaatatttagtaaattttaaaaatgtcagatgagataaagaaatggtagggcgccaccttatcttatccgctcgtttcacaccggtgaaaagcgttaacgaaaactctcgcaccaccaaactgagcgaatgacacatgaggctgaacgtcccgttccgttgcacgggcccgcatagcagtggaacagctagatatcgcctcccgctcccattacggcagtacgctcctacgcacccgctcacctgcctatcgccctgtgggcgggaactctgaaattcgaaatctgcgcctccttccgctgcaagcctccgcaccgcggtcaccgccacggcggctccaccgcgctcacgcttgctggccccaccgctcagtgtacgaattaccgcttggctatcttcgaagaactagcagcagtgcagcacgcggcctcggtcccccacccgaggagccgccacgcaccccctgggtcccctccaccgcccgccggcgttcccacttcaattcgcccagcgcccctttctcctcccgaaaggcagggcaaccctacaaaacgctgtctcggcttcgccgtccagcggaacagtgtacgggagcagttcgtcgcgtgtgtcgcgtcgcgttgcgttgcgccacccactaattcgaacggacgggactgggattcgaaatttcgaacacgcgccgcctgagagagagagagagagtgagagaaagagagagagagagcaggagagatggtcaggcctttgtgatctcccgcggggctggaggtgtgcgggg

SEQ ID NO: 3540 - DNA, 1159 bp, Zea mays
catcataaatagcacactatcaattgttctatggctgttcaaatagggacaatcttgaaacaacatttctcacatgtaaaacgttgtgaagtatgccaactgaaacggatgacacatacacttcgtgaaccaatcgatattttacttgcttctatgttaaataatgttataatacaatattttattcaaatgctaaaacttattactagataaaaataaaatttaattatcttcaaaaactaaccaatagatattccatcataactacatttaccaaactaatatactaaaaaatataggataattactaaattaatcgtgcaataatcagtatttatgagattgataattttaaattttgtgggctacaaacaaaaattaaaacttacttttcaagttggagataagaacaatggtagacgtagctcgggatggtatggcgtcggtgcagacggttaccctttgtgcgaagtggcgcgggcacgagggtggggacttggtacatgcatgagagagaggaagaacgaaacaacttctcaaattaaagcatatgaaaatcacctaatttttgtctgtcggtggaaactaataactagtttttattatcttttttaataaggatccacgaaaattatttttgaccgatgaaaatcctggatcttcgtattatgtttcgccttttcccgactctttgcatgctagatttccatgcttggactaaaacgaagataataaaaccaatctatcattttcacacgatgtattcatacttgcaatagataaaccactactccgacgggatttgctttctgacctctgaaatcttggaaggattatgtgtctacacttctcgatcgaggggaaaaagtcgtagtaccaagttgtagttaaatttgtttcttcgatgacaaaacaaaggagaggggcccgcgcggcgcagcgcagcgcagttggctggttccggaacacgaaaaccaagcacactccaccagctgccatccaccgggttggatggagattacaatactcgaatagtcagccagccagccggcttgaacgtgcagttttcccctataaaacggccccgacccggccgatgccccgtccatccaatccaatccaaaccgtcccttgtccctctcttcctcgaaacgcagct

SEQ ID NO: 3541 - DNA, 288 bp, Zea mays
atcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaa

SEQ ID NO: 3542 - DNA, 869 bp, Zea mays
catttcccatacaaatgcaacaggttgttttttttattcatgccagcttaactcgcatcaaataagtgattgaagtgacattttcaagtatatgttaagtaaaaatagtactcactcctccgttcataaatattatgaacgtatgacacaattgattattttaaaaaactttgatcactcgtcttattaaaaaataataagttattatttatttttttaaaatttattttattacttaaggtagtttgtatttaagttaaaattttacatttttaaataaatattttgaataagacgaatggtcacaattttcgaaaaaaatcaacggtgttatatatttgtgaactggttcaaaacatgttgtgataagacgagtgaggatcataataaaatacaaagtgaatgattcaaaacatgctgtaatttgtggtttcgtcttgattattctcggaccaggctgtacttgaactctatttcgtgcttgtctcttgtaataaataaataataagttaaaagtggttttagccgtgtgttccacttccatggcaggaaattataaagcaagttatgcccatgctgccatgcatgcgatgcgatgatggggtagccatggcccatgtgcgtggatgcatgcatggcaggcaagcgtagcaatgagcatatgcatgcacgagacgagatctctatctctctctctctcggtcactctcagctgcgggcaaaaacaaacactgccgccgcatagtataggaaaaaagacaggcatatatatataccgtccttgcgttccttccttcggtagaaagagccggccgggtagctagtacattgttggagcagagcagcggcggcggcggtggccatcatca

SEQ ID NO: 3543 - DNA, 115 bp, Zea mays
ttgcatttttttttgaagtttgttgaagtaactggtggtttttggctactatgaccattcaatggctgcaagtgtatcatagtatcagaaagattgataatttctttagaagcta

SEQ ID NO: 3544 - DNA, 757 bp, Zea mays
agctgctttccagtctacagctgctcgctgtttggtgtttgctaaggtgtcacaatgtcaactattgattgaatgctgcattgctgcatatgctacaattgttggatggttgtacaactccaactttgactgtgttattgtcagtcttattgactatgtctgtgttattttttacaaatccactatttgctatagctacgctatacctgcgctatagcctcgtagcctaaaaaaatgttgccgctagtttgcatagcccgctattttaaaccttgctttgagctatgagaaaactgccgcgagctggtcgttttggaaaagctaaaatataattctataagagcatgatagcttgtaatacgaataatagaaatatggaaagtctaaggtaaggggtgattctaaattagactagaggaatttatagatttttaagaatctattctgctgttgtacctattttgttgagattccagttttttgacagtgaatctaatcctttgaatattttttttcataaatctacaattcggacagtgttataatgaatttgacgagaagctggtctatcccaaccacctaccatgggcctggcctggcctggcccatttctatgagaagagaggaggagaactgaagggatcaaagggaaaggaaacctagacaagcgaggcggcggccccgcgttctccgtctccgtctccgtctccgtccgcccggcgtaaagaaaagcctctctcaccacagccgccacgcc

SEQ ID NO: 3545 - DNA, 367 bp, Zea mays
gtttggttggaggccaaatttttggtcatgcccaaatttttttggccacaccaatttaaaattttgccaatccttggccaaaatctgggccaacaaatccgcagctaaaatttggttgaccatattgcattttgatcacaaagcaaacataatctaattttgatgtagcctagctttggcaaactgcctaattttagttaggtttctttggtccacaatcaaaacaggctccaaaatttgcctcgccaaccgagtcacagttgtcttttcacaagccccacgtcagacaagatgaggacagctcggacaggtcacaccgtcacgtatccggcatcaacgatcctccgttcccatcttccttatccag

SEQ ID NO: 3546 - DNA, 214 bp, Zea mays
gtcatgcatgtgttcttgatgccacgggcggcagcaaacacgggtgaactcagttcttgttacttcttgttagtaggtgacctgtcttagactctgtctgcattgcattggtggttactggtagctgtagtttcggctctggcgtgctcaggtctgctgggtcgatgagctagctagtcatcaagtcatgcagttttaatgttttataataata

SEQ ID NO: 3547 - DNA, 1316 bp, Zea mays
agcaacagagctcagccagatccttcctgtgtatgtatgcatccatgcatgcaggcaggcagatgcagagaccgacgtcgttgtaaaacgcgtggccttacttgagatgaataaaacgcaacatgtagcgtcttgcaactgtcgcaagcacagctactactgctactgattaaataaacaggactgcaatgatagtaataaactatttaggcctcgttcgttttgaaaacaggcatgtttttagttctgggccggatggagtgaatcctgctggttcactaaaacatgaaaacttttggtttggtttggtttggttccagttgtttataggtgtagcttcgactcaagccgagaaaaggatgaaaaggtctacaatggcttggttttattcttgattgagcttatcagaacaacactttcgggttggttccggttctaatccggaccaaataattctagatggaatgggctatgttccatgccgttccgggacaaacaaacaatgcctagaattattattccaaaccatggatgttatgtggtatatacacacacaatgacacaagtcacacaatagagcatatatccaacagatttattttttcggacggatcaaatcaggtcaggtcaggtcaggtggctcatgattagatctatgtgagagagaagagatgaggaatgagggagaatgagttatctagctgtctaaatcgttggttttgatgatgtgtgggtgtaatttatttggtggatttagtggcggttatgggtgtgtgggagtgatttggttgggtgggttttgcaaagtttaaactggtggattatatagtggtatatatatatagatatagatagaagttgtacattaagtcccctttttaagttggttttctactagcaatgtgatattaaactctcttaactccctaatatgtattatagaccttgaaatattaattgaactaaatgagtcaatcaatttaagtccaacacccaacacgtgtagtgagcggtactgcgatgtgactgcttttagttattgattatcaaaagatagattggtcgtcaaaagatagaaaacatatcgtcaatatgatctcaccagtagcaggccatgatattatgcttttgcagtatattcactaatcgccattaggttgatccttagtgaacgcctggcagggcccactcccccaccatctactcccctatttattagacgaccatctagtcatctacccatagcgtagcctttcaccaccgccgtacgcccgtacccccatgatccaaacctaattgccactgtaatccccaca

SEQ ID NO: 3548 - DNA, 1500 bp, Zea mays
attgtcgctgggaacaaaaactaacggtaattgctggtggatttttggcagacagaatataccgatagaagttttgcttgtctaattgttgatggtggctagtaggagcatatactattcctgtacatcctgtttaacttgtcgctgctagacgatttcgcaaatgtagtatgtagtggtagatggatccgataaattttctgtaattttgacgaggtaatcaggcaatcgtctcgagattgttgttgtatgggcgacagtattttttcattgtttgtacaatccttttaaaaatcatcgtctggccttgagcctttatgccatatgggtatatgttgattccccttttcagttcctcgtatcgacgtccagctgtccacatcaggtgcaagtgtctgaggggtgctgttatttttgatattttcttttctttctgatcgtgatgtcgtcttttgttagatcgtaatcactacggaattgctatgatattttgtgtgatgacgttgtttttgggagatcataatcaatacggaattgctgtggtgacttcgaagagctagtgtatcatgtcgccccttttgcctctgatacgaacacatttgcacttctgtagggtgcagttgttttcggatatcataaccactatgtgactgctatgatactctgtgtgatgactctgaataacataccatgtgggttcttttgatactagccagatgcacgacgggctgacgagcacggcgccttctgctcgatccagtgcatgcgccggcccggccatttggccagtaccttcgccgagaactccttgatccttgtgtgacgctgacgcagcatgtcagcatgtggtgtagtacttgtacttttaacttctaaaaaatactcaagcgacagtacgacactatgctacagggtaccgtatcgcccttttctctcttgtctcggtgttacgagacagacaagtggatctgtagctgtgcagttgggttgatcgggtcagatcagccggtcagcatggatcggatagtgccgggtggttggtagttacggctcgttggatttccagcgaggcgacccggcgaaagacctggacccgcgcgccgaatcccaccacccatcgcgtccccaagaaccctcgctcgtacgtgtccgtgcccccctctgccctctccttcgtcccaccttcctcccgcgttgccatttcagagcaaggtggcgcgcgccgcctcctcatcacacggtctcctcgcccgccacggcgtcacatcacatggatgcctcggcacggccgactccttcaactccgcgtccgtcgtcttgttccatctcgcatgattgattgaatctccacgccccccttgtccaactacccctcccactatttcatttcatttcatccccccgatccaagaaaccggccaccgggccggagcgaacccttagaagcgaccttggcccgtgaggaagccaatcagccagagacagaacaatccatccacc

SEQ ID NO: 3549 - DNA, 639 bp, Zea mays
cgcccgtgaactcgagtttctgctctccttgagtttactcaagccgatgatgttttaatatattttttatagtacgttctttgatatagggtgacagtgactaatatgcaagcaatcattaggtacaagtgtgcaattatttttttggtccgtgagatctagattcaaccgtatgtgtaattgtggtttgttaggggctttttttgtaaagctacacgatatggtagtaggaggatttaaatgctaaatatgacatactgttagatctagatctaacgaaccaagagatatgcttgcacgattgcacctaatgtctgtttgtatattagtcgttgctgatacagaatggagtaatagaatggttagagagagaataaaataggggaggaataaaagaggggatatatttaaaaaataatagaaaatataaacagagggagatgagagggagaatgtatggaattagcttcaatccccctgaaccgggccctgaccgttcgcctcctcggttgcttgttttttctcccccttcccacctccgcgagatctgacggctcggcctccaatggcgcccttctccctgtaaacctagctgctctacctacccgcacccccaccccgtggagagcaagtgcagcc

SEQ ID NO: 3550 - DNA, 577 bp, Zea mays
atgacgcccattgatcttttcattattcctgcatgtatttttcagtctggtctattttttctgccatatgatcaccatacatgtgtagctagtctctggaattgtttttttcccctgtagaagggttaaagttgaatgaacaattctgctgcatatacttgctctagtcacttatgaagcatgtaaacttaaaagtgcactgtaaaggcatatattccttatagaatgaagcagcatacaatctactaacaatctcaatgcaatgtggcgttattgacagcttgacacaaacaatcatatattgtgcatgggttgccgaggccactattgcgcgttatgccggaggagggtaatgaagagctccgaacactatggaccaagaggttgccaacaacacacggatccgtagtgattcccaatcttgtacagtacagaatctcctttatacatagcattttgccacttccagtgttggcatcgacttgttgagttgtttcccaaaacgagaggcttctcgtggtagggccaatgtgaatttgcaattggaagggtccattgcatttatctaggatcgttg

SEQ ID NO: 3551 - DNA, 133 bp, Zea mays
atccggcaaggcgccggccaccgcccagctaccggccgcggttcttctgtgaaatgacggcttgaggttcaggaggaactgtgtttgtattttgtatctgtatttctcttgaagttgttgtagaatatgcttt

SEQ ID NO: 3552 - DNA, 1390 bp, Zea mays
gtgaaactgaagccgaaacatcgtcgtagttacatgttgcatacttgtagatgaggaggagctcgcgcgaccagactgtactttgatttctaactagtttcgattttcaccggtatatagttgtctgtcagctgcctaatccctcgacttcgtgccgccttctgaatagcgaacggttcctcgaaacgagcagttcgatctgcgtcttctgaaaaaaaaaacgagcaggcagtgatcattttctgaatcctttcagccagatgcgaaatccgttctgagtgcaagctcagacagtatttgttattcagggaaagaaagaaaaatatatgggagaaaataaaggaaaactggattagaaaaaagaaactttgcaaggcggatggawcggtacaaagaacgcgttggcagcaataaagcttgcttcagaaaaatgttcctttgacatctgaatttgtccggacgcagccccgacatggaaactgcagtcgtcagctattccctcctgttcctattcagcaagttgcggttccaggtgccgatgtgacattccactcagcacaaatgatagagaaaagcaacctagttccctattagagcatataaaaaactagctaaatagtttgtaaagctaaattttagctaattaatctctactacttattaagtaagcaatagtagtctgccgttctgccgttctgccatcctgcaatctcaaccgtccgttcaccgttctgcgatctaagccgtccgatcctgcccactaattccacacggcctctcccaccctgccttccgccgccagcccgcatctcgcaaccgtcccgcacgagcaaagagccctcgttcccctccccttccgctcgagttcgtcgccgtcgccctgccctcgtatctcctcccacgacaccggtgacaaccacaggccaccgtcytgatcctcatccggggtcatccccaggcaggcaggtcggcgaggagggcagcaagaccgagccgtgcgggggctcgggacgggaacgggacaggaccccaaaatctcagatccttcctgctcgcccgcccgtgcccgtcggcgcgtcgttcttgccgtccgcgccccacctccgccctctcctcctccaggtaggtgaatggtgattgctgcaaccgaccgtctttgatgggcggggattcttcggtggggttggtacgcggtgtggcggccggattcggagagtgctctgcatactcccgcgcgcgcattgggttttggtgtttgggatttcattttcccgagggttctcgtcttcgcggtggcgaccatggttcgttcggattgggacggtggatttttgactctcgtctctgcatctgtttccgcaggggaatcagatatgccacaggctgcgcg

SEQ ID NO: 3553 - DNA, 123 bp, Zea mays
gaaaagaaaaataatcttccttcttccacgatagtcgatacggagcacccataacgttacttttattttgcagttcagcggttcagccccctcaagtcgaggtcgaggtactccgcctccgca

SEQ ID NO: 3554 - DNA, 307 bp, Zea mays
ggttccgggctcgaccccaaataggaagcagtgctcgttgactttctccacgcaaacgccgacgtttttgcgtggagtccctcggacatgcccggcttaccgagagaagtcactgagcactcgctggatattcgggccggggcccgacccgtcaggcagcctctgcgccgattcgacgaggagaagcgtagagtgataggcgaggagattcacaagctaatggcggcagggtttatcaaagaggtattccatcacgaatggcttgccaaccctgtgcttgtgagaaagaaagggggggaaatggcgg

SEQ ID NO: 3555 - DNA, 1500 bp, Zea mays
tgatgggggttaccagctgagaattaggcgtcttgagggtacccctaattatggtccccgacagtagcccccgagcctcgaagggagtgttagcactcgcttggaggctttcgtcgcacttttttgcaaggggaccagcctttctcggttgcattttgttccggtgggtgcgcgcgagcgcacccgccgggtgtagcccccgaggcctcggaggagtggtttcactccttcgaggtcttaatgccttgcgtaatgcttcggctggtctggttgttccctcatgcgagcaggccgtagcccgggtgcacggtcggggcccaagttctcgggctggtatgttgacgctgtcaacggtttggccggagccgggtttgcgagagcagcccccgagcctctgcacagggcgagagggcgatcagggacagactcggcttttttacatacgcccctacgtcgcctttccgcaaggaggaggggggagtgcgccatgttaccctcgatgggcaccgaacatggtgtctccggtgagctgcaagcgggtaatccgagtggacgtccgtgccccgttcgttgggggtcggctaggggcccagaggcacgcccaaaagtacctgcgggtgatctgccggacccggtcccctggcgacggggtccgagggctcgatgcctccctccgatgggattccgttacaagatcgctcccgctggtctcggaaatgtcctagggtacctcgggagcgcagcccgagcctcggttatgtatcgaacgtacccctggtcatccctcgctcggtgtctgaggcgactgtgaacccttcgggggccagccttcgaacccctgatcagtaatgggcgcggagcccgagtagcctgaggcggccgtggagcccttcggggggccggccttcgaacctctgaccagtagtgggtgtagggcccacgcgatctgaggcgactgttgaacccctcggagggccagccttcgaacctctgatcagtagggggggctcggagcccggttccttcacagggaaggatccttttcggggtatccccctttcccggtccctgttgcaagagatagagaaagaggaaaaaaggaaaaggatacgaaatcgaacgacgtggcgtaccttttttggcgcggttattacggcgaaggcgaagcgtcgcccgcttctcctgccagaagcgccgcctgtcccgccgcggagttaatgcgacggggcgagtggttggcggggtggccgttacgcgtgcgcgatccgttcgagggacggctattttgcatcgcgctttttgaatcccgcgtccggttcgggcggagcgctggaaacggtttcgccctggtctttatatactcgggagagaacctggtgacggttcttcgctccacttcctgcctctttcttttaggttttcgcaacccgagaggcttcgaccagaggagaggaaaccgcccttcccgtcccttgcgccgccattccttctgccttgctg

SEQ ID NO: 3556 - DNA, 253 bp, Zea mays
gcagcgaagccaacacaaccgcgatggacaagcgtccccatagacgagatccatggcggagcgccgaaagagcatctcctccgtgtcgtttgcttcggcgagcgccgagaggggataatggcagcagtgagctcggtctcttccgttgaggcgtgctgctaggaatgtgttggagggaggagcgagaagggcttcgagtcccctaatcctcgcgaggtatgggctgcggcgcggacgcccggctgctgttgct

SEQ ID NO: 3557 - DNA, 422 bp, Zea mays
aaaatatatatatggatatatcaacccctaatagctggctatttaaaaccttgataaagactcaaacaatatcaacagctggatatatcgacagctgtagtgcattctgtcagtgtcacctcatgtcatggctcatgttgggagccggcaactcgaagactcaggattgctgggctgtatctcgccgaagaagaccggtttgggccctcagcccattgaaaataacctctgctccaagcctccaatacccagcaagaatatgcatataaaataacttcgtcaatcttaaaaaagatggtttgtagtaaatatctggagtctgtcgttccctccttaatccttatcccctccccacgtttccctcttcacttcccggttcccgcctgcatacggtacagtggtacacccaccgccggtgagcc

SEQ ID NO: 3558 - DNA, 304 bp, Zea mays
gtgtagttagcatgcttttgtataacttatacctatgttaacactaagcaagttatgatgtataagttagccgtagcagttatatctgactggattaatgcttgtgctgttactaaatgggctctatcttctccttgcctgggttaatggtgttattgtagtgctgctgatcgtggataattgttaactggttatgttatgtaagggcaacctgatcaacaattaatcatcgtctggtcgaccactaggtgacaaggtctgaccaagcgctcaagggatatatatattgaaaaaaaatcaagag

SEQ ID NO: 3559 - DNA, 1500 bp, Zea mays
agtgcgtaacaccctacgtcctggtgagtatatgagcgtggttacaagaggattctctggatagaaggcacagagaatgtttgtgggtggctaagtagaatcgggtcgatcgatctgaaggggtgccccctaggccttatatactcggccgtggagcattacatgtgatatgataacaacaagtagctgaaagatagtaaacctcttgagtttatccttacgtaacctccgccgacttatcctcgcatggctccgttgcatgggggcttcagcgcgggaaagtcgggtctctgtttgtgattcattcgtttgacgttgtgggccgcctgtgtttgcactaatcagtcccacgtcttctttattggttgtctttccctaggcccacgaaagaatgaccttacgaattatttgggcccttgggcttttcgtgaggccttttacttctttagtggacccaggggatatctatcccccacaagcccccgatctttgagttaatttagaggtaatcaactcaaagatccaaggtccggaaaatgacttcctgctgtcttctctggctctgatcactcgttcgaccaaagtttggttttgtgcttgtgccttagaggtcggcattttggattgtagggttctgaacttcattgggtgcaccggaggtgcacccaatgggtgtagcccccgaccttcaaatggattttttaaggataatccattcgaaggtcttcctttcgtttgtagaaactggcatgaagctattttgcattatgctttggaggccagcattatgtcatcaatattttgctgtaaaggtcagcgtatattttgtctttagcagccgagtttgcaatccatccatatcttgctaggtagtgcaatttatttgcttctgcgactgattggacgtttgatggacgttctctgtctagtgttcacgtcgcttctgtcagccatatattgtacttcgctggctacatttggctttcctctgatccttactgatatctcatttttgtcttgaggtattcactgcgtgccctgcacagatgtgaccgttttgaaaaatatactgataattcctgggtgtccccgcccaatgggtgtgggcaagggacggcttggtacactgagtgttttagccgactgcttctgagtagtaatgtgatgggacgacgagtgtaatcatatcctttgcgctgttgactggagtcccaatgggtgtagtgttgcatgaaacggcgtcagccgtctgacgtgtcttcagatgggtggaagtgcttattgaatgctttgcgactgttcagtgaccacggttggaggtgagcggttgcctttctcttctataaataacgccgttgcccctctggttttttcacatctcttcgctgttctttactgcatccttctcttctataaataacgccgttgcccctctggttttttcacatctcttcgttgttctttactgcatccttctcttctctcccgtctgcttccgcc

SEQ ID NO: 3560 - DNA, 976 bp, Zea mays
ctgcagtctctcttataggagctctaatcctatcagcatgactgccaaatcttctgcataagatgtgtagcagaaatgcagaatacataggtaatgtcaaatgctagtttatgttacagttaaaaaaggatagttattgttgaagtggatttggttgggataacagaaagaactggtcgctctccatccctcttgaaggctctggctactttttagggttctgattgcatgatctatcttagtgtgcgctatattaggatggtgcggctgcacaggcatgttgccttgtgcgcctcgagccattggcaattttgccattatcatttatgggcttcgccagtatgccatcggacccacaaatcatagacacagacggtcccaccagtcatagacaagggatggcataataacagacagccaaaattgagagtggcaaaatgacaaatttctccttggagagccatggctagtgaaccatctcgtattccgttctctctccctctctatactgtgatccgacagaggagacagtcagcttcacgtgcttgcgagagcgcgcgacatgggggcgagacgagtgatggatgatgaatccgaatccgtgcaacgtttggtggcgcgacgagtgaatgcgtgcaacgtttggtggcgcgacaggatctacaggaccactactgggacagccccaccaggccaccatgtctccgatcagatcagcgagtgccagggctagctagtttcctgctgcgtgttccaatattgcaggggtgcgccatgccatgccatgccaaaagattccgattccccgagccccgcccccgcccccgcccccgcccccgccccgtatatatcccctgtccggagagcttgtcatgcagcaggctcccctcctcgcccgcccccgtacgtgtccatctctccactcctttcctttccttgttggtaagagcaaggcgagacgtaacgtaatccggcc

SEQ ID NO: 3561 - DNA, 547 bp, Zea mays
cataccctaataaagtaaatatctatggagtatcgagtcacgtgtacccattgccatctctacaccatatgctgatatgcattctggcaagaacagccagccaacgtggctggcaccaccataattgcgagatccgcggtccccgcgcgcgcgtacacgagtccggagtccggacccgcggcctagcctggctggctcgtccgcggcccgccctctgcgcacctagcaccgtccactcacccgcgtcgcgttgcgtcgccgagacaaactctcaaaccggccggcaaaaacccacacgacccacgcatcggcatcgcattcacgtccaaccgttcgcttgcgccctccgcaacaacgcaacgcatcgtgacgccgccgctttttgcttttccgactgctgtttccgccttttgagtaggcgttgggcgagcttcggtttcgacggacgcagccgtcaccgcctcaccggcccggccatgggcgccgccgccgcctgctctcttcgcctctgccacacgtcaccatccgctgcgacggtagggccgcg

SEQ ID NO: 3562 - DNA, 1500 bp, Zea mays
tattactatatgacataaaaagcttaacattatgctatctctagcatccttacctatctcaactcatatttcaaactccgctctttaaatactgcaagaaacattaaaaatgcaaaataatattttgtacaaccatatgcacaatctgctgaccaaaaccttacgccccgtttggatcattggaattgaattccattctaataatagtaatttaggtatatatcaattaagctaattcagttttatgcaaaatatattgtatactattattaacaagatgtttgagatatttatgtgctacatttttactatagaggagtcagacgaagactgtcatgtaagttacagagtagaaacaaattctactaatgcataaaatcatttcccaccctttaccccatgaatttgagatagacttatatctgaactttagaaagcggtggaatgtcaaattccaaaytaaataagttattttattgagtgaattccaattcctctgaaatgaagggatccaaacgccccgttatagatttttagagtccccgttatagattcaaaaccatatggcatgggtcttattataggccaaccttgtgtactagtactaaaatatcacaaaaatgagaaaataaaataaacttagatcttattatcaacaaaaaaattgttgtccaattaagcttcacgtgtaatcatcatgcagtcaaacaatcaaaagtcatgaaaacatctttaaaaattatatatactttattatttactctcccaatacatcaaaatttaaaatctagttcatccaatattaagatatgtaaatagagaaaattctatcattttttaatccttcgtattggataaagttttctattttttatcgcttaacatacgataaactagaacttcaattttgatatattttgaaatattgatagagtaaataataaagtatatctataatcttttttaaaaaattgggtacttttagtagtttcattttattgcgattgcacaagaagctcgattgcagggccgggcctatgggtgtgcgacccgtgtgaccgtacagggcctcaaaaaattgtctaatgggagaagggtcatgtgtaaggggatcgtatccagtgcacaagggccacaccgtgcacaaatgcacaaaacgaaatctggccgtccattttccatccaacggccgtcgtaaatatgcagatgaaccctycsgcagcctccgtagcttgccgagtctgttttgtgaaaaaccccccgcgccgtcatgtcgttggatgagagacggacggccagatttcgttttgtgcatttgtgcacggcgtggcccttgtgcactggatacgatcccataaatgtaagcaagaccaacggagcaaggcccccccaggggggcggggcaccacaggtactcttctcctgcttggcctcttgtgccgcaaccgcgagtgcggcctacggtagcctccaaagcagcacatccaaagcagggaccga

SEQ ID NO: 3563 - DNA, 227 bp, Zea mays
ggttcggggattttctcggccgggaccattgtttcggtctcttcttatatggaataccgggagggcggtctttccctccccggccgagttttttttaaatacatcagctacagaacttgtcagttgtcactgatgccatcgcatgtgtacatgttttaggtgatgttttcgtttcaaagaaaactgacaagcaaaagaagaggaagataaagaaggttgaggacaaa

SEQ ID NO: 3564 - DNA, 433 bp, Zea mays
attcttgagagcgtcttaatgctagttaggagcagtggcggagaagccattatggtttagtgtagctttagccatatcatacattttaaaagatctatattgataggtggctgctttttaaacagtaggtttgggttcaagtcactttgcttgtatttttactttttccttagccatatctttttttttatttgtcctccgctactggttaggagagtgtattttctcagacacagtatatcttaatattctcatcccaatttagattttagtgacaaatagaaaaacaacccccaactgtactgtatccatcttccacatcttctcgcgggcgaaaaagccccacccgctgcacaaagttcgcagcttctgaagctcccaatccccctccgaaggacgcggccccgtcctcgtgcttatcggaggcggaggc

SEQ ID NO: 3565 - DNA, 1292 bp, Zea mays
tctggtaagcagaaaaaacaatcagccagtgcataggacagacccagtgttggcggctcccacatgattggggtctgcggaagggataaaccaaggtaagcctccccttcgctaatgcggagaggctacatcaaaaccgcaagacctaatgattcagtgagacagctctcaccactgcaccagcctaccaggtctacccttctacctacgattatgtaagttttaaatattgattgatggattagagcttcaagaattttggcaaccagtgtgagtggagacaataagatgaatggtagagggaaaattcttgaccaattcatactttttcttgataatagacagctggcgacacataggtatactatgtttagttgaaaaaattaagaaaggcacagaaaaaaagatatgctatgttttatctttttctaactggtacaatatctttcacaattctaaatcttgctttcagtttccttcttcctcataatgtgttaacgaatatgaagttagtaaccgattgcaggaccttacatatttactatttttatgctgctttgttttattatttagctgaggttctagaaaacaaagcaaaaaaaaaatatgcatatggatgttgtttacattggaattgatttctaaatatcatgttcttttgattagttatttcctctttctgcatatttacagaacatttttattgccatttttcataattatttcagctaaacacatcaatagcccctttcctaagtgttatctctatggtaatcatattcgtgcagtgcaatatgtcatatttgttaactagaaactgactattatgcttactcatttttctaaacattgtctagtttttccgagcaatcattttctttccgtatttgatccaagagatcttacccttagacattgacttctaattattaatctcattcttcaggattagctatcattatagttgtaaatgtacgcccatgttgtttatcaatttatagttggaccctttgccatagccctgtttacacttatttaaataaacaattgtcattatgtttactcatttttggagaactcaagtacatactgttgctgtatgaccatttcaaatgaatatatttatgtttactttgatgaaaaaagctacaatgttgtaataagatgacctcaaaataactgtatatgtgctcatcagcaagcaatggtgcaaatggggtcgcatctatcacaacgaccactcatggataagcaccaatcaacaaacaaaggcactttgagagtttcagcat

SEQ ID NO: 3566 - DNA, 559 bp, Zea mays
tgtaaggctttcatcattattctctctttttatttttccaatcctagcaatatcttcagcattttgtatagattataggatacaattaaacagaactaaaagtatgcagtacgtcaggtagtgaagctggaatttctgttagatgtgaaagggcaaataactaagtatctagagacacttcagaatattcagcaagttctttgttgtgataaggcttttatggccaatctctctttttcgctctgtctcagttatatcaaattaatctgtaattattgtatagaaaaaaatggttaacaatttgaagtaggggatatctttagaattgcagctaaaatttctgttagacgagaaagggaaagtaactcagtatctagagcacagaaaactcagtaatgatataactttttcagcaaatttcctgcctgaatttaggatcctgtttttggttgttacaatgtccaatattgtaagttttataaaccatatgctagtaaagatattattcttgtttagcttcaatactgatgttgttatatgcagttagaagattttgagg

SEQ ID NO: 3567 - DNA, 1351 bp, Zea mays
tagaggaatgaagataataagttgttatatatcaataattcatttattatcatcttcattaaatatgaataagcattaacgatattcatattataatggtaccttcagcttgccaaaaggtgggagagcgagaatggcgcgagtgcgattacaatccagcgtgcacagtacgatgttactgtttatctatttataggcacgggacgcagtccggataaaagtacatttatatccctgtgcctataatcctaacatgaattattgaggactataaggtctttagcccctttcagtcatcttcgtgtttaagcttcgtcaatatgttaagtcgaaggtccttagcctatagcttcgtcgcccattcttttagctcactttattccgtcataagagaagttcttcatcctaaagtcgaagcttcctgtaactattcataatcatgcagaaaacatatggttagtcacattttttaggaccttcggaagagaaaggcccccaacaaataccaactggtatcacacacatttctgtcctyccagagactacttgacaaagccattgctgtgaaaaacaagtcgtttgagtttggagagaagagaagggctgctaaccagggacaggatggaagtagttcccgtccccgatataatactactcaaagtacacctgttcgtggcagtttcgggtagcaaactcaacaaacaccaactgctcctcctcaagcaagcaccccagtgggacctgttgtacctaatacatctacaaataggtcatgcttcaagtgtggtcagtcgggacactatgccaactactgtcccaacagggctgcttatactatcccgactctgtgatatcctggctcctgggatgggatatccttgtaatatcccaaaaaacatacataaaaaatattatgttttactcgagatcttacagttgaccaacaattgactttttgagtcgttcttcagatggacgatccgaggtcgcagatatgtagaacttgtcgatatgaatccgtttgattagtcatacacacgatttggggtccaaacgagtcaggaatgagtatttcttattgggccgttagatttgcattagggtataggaggcaaccatcgtttcttgttatcttgggtatcacatgagccttccctacccagccgtcatgtccctccattccctgatctatcaaaacaaatrtagaagaagagaaggggcctgctcctgccgccggatctggtctgcccaacaacaaccgaagtctggaggagtggccaaccctcctattgctgctccttgttcttataccgattcgatctgtgctgcagcttggctttggaaaagctag

SEQ ID NO: 3568 - DNA, 767 bp, Zea mays
ttataatttataatttacaatggagaaaagtagatggctaccatccctaacgtcagatactagaagcacaaaatagctcatttgattttagaatatgttttcgtacaacccctgctttactagtagacaacttctcttggcctaattcgttttcttcgagaagctccgctgttcaagctaaagctattttgataaaaataaatcatcaaattatcatgatattaagataataaaatattcataatacttttttcycaaggcaaccggacccagacctgtatagctccacttttttttttgttggtgttgagaaatgtatagctccaccagtgtgatagcgtgattaaaaaaaactttagctttataccgtacactcggtccaatgggctagatgcattacctggcctagtatggtccgtgtctgggccagagaatccgggctgaaagctcaagtgcatgcaacagaatgatgggctttattggctgctgggccagcgatccgcttcagctttgtcagcttatcttcctctctaggtcgaaattcccaatggctttgccactgccatgtgccagcgcatgagtggagactggagaaagagccctactaccctagctaagccggcacagcggcggccggcgatacacgtgcgagcggcggcgtgaggaaaggcgggcggggtgagagatacctaaccactaagcggctgcggcagcgccgcagcataaccggcaccaggtcaaaaaacgacgactgggcaggtttctcc

SEQ ID NO: 3569 - DNA, 184 bp, Zea mays
aagtaatgttcagaagtaactaattatttgcctcttttgcaggattgattatcaatctagaccttacgtaaggggtgtttcatcttttagacatcttattgcaaaactgcctccaagggcacactctatttattaccgagatgagattggtaatatttccacatcacatttgtggagtgattct

SEQ ID NO: 3570 - DNA, 567 bp, Zea mays
ataacacgacagaccttgttgcttgaacactgcaagctgaagcatagctcactactcagcggaagtaaacaaaacgtgagacgaaaccagtggaggacagggtgtccgctcatcctcgcgtgaggtaggactaggatgtgtgcgatttgtttttttaattatgcaatccatgttgggataaaaaatgtagcagggattagttttataaagaaaaaaaattaaattactccccttgcatatgtatgatgtccatatgcccttctaaagtataagtgttgtttagttcattttatccctctatctatttgaattggtttttagtttaagttttctggttagtagttgatgccacaacttaacctaggaaatatattatgattttatattattttaatatattaggaattagataagatataactttaagttcaacttatatgtgaagaaaccaaaaaaacaaatcttattaaaaaaagacttatctttttcattttagttttacaagttgaatttaatgttcatattttgtaaggtgtttaaagacatcataacttatgtttaaaaaat

SEQ ID NO: 3571 - DNA, 499 bp, Zea mays
tcatgtctaaattcgaaattggactcggattcttcttgaaaaaggaagaaacctagtacatactctctatttcaaaacttcaaaatataatttgtttgacttttgcaaccttaattttgaccacgcgtattattcaaaaaattcatgaaaagtaaaaaggttaagtcatatgtaaattatatttgataataaataaagtcacagtaaaaccttttattttgttttataatttttttaaataagatgattgattaaatttagaattaaacttattataaattaggaaagggctgtagagagcgagagagggaggaagagagagaaggtgcagtcagtcagtcaggcagagaaacgtgcggaggtggaagccacaacgggagcgcctaccctcgcagtccgcccctcgacctcggagccgcagcccgcgaggagcgttcacaatcacaccggccaccgcggaccctagcgctttagccttatccgtccgagcgcgcgcccg

SEQ ID NO: 3572 - DNA, 114 bp, Zea mays
agtacactatatacacacacgcccacctatattctcagagatcacactccattctcagcttcttccctaagctagctaacgacagtgttctgttcaactttttcagcgcattcg

SEQ ID NO: 3573 - DNA, 594 bp, Zea mays
acaccataatcatttatattattatgtgtagatctagtcgtataaaaaaaaaatacttttggctatgatcatatgtaaaagtgcgtattggttttacaagtacaggagggtgatgtaaatattggttacccggcggcaagtcgtatcggcccaacttttatgcggaccccagtatgccgggccgacttcagctggcgtaggcatatgcccccgagcagaaaaggctggcggacgggtaggccgacacgccgacgccgacgccgacggcgaccccgacctgccggggaacgctagcgcgccaaccaaaccgtggcggggggcaacgtctccagccagagaaaccggagcgacccaaccaaccacccacccgcggccatccccaaccaagcgagcacggtgcacggctacaccggggcagacggacgggaccggaggagaaaccgaagcacaaaagaaaaagaccaaaaaaccaagcagaaactagggtgggggagccctgagcaggggaggaaaaataaactagtggccaaaccctagcccgccgagctcccgcgtgcgctctccgccgagcgccccaccccctctccgtccgcg

SEQ ID NO: 3574 - DNA, 1500 bp, Zea mays
aaagcataagctttttttagacaagcgaatcacatggattcaaagtattcttggttgaggatcatatctttagtactactcaatggcatcccacacaaaaatctttaacaattgtagaagaggagtgagacaaggggacccccccccctctatctccttctctttgagatggcaacatatatacctcctctaatctaggacaaataaagcttggtgggggtgagtgttttaaagaatcctttgagtgatacatttggaggtgactttccaactatacaagtaggacgacgataccctactcatccatacaggtgatgctagagttctttttttaacctaaaagggttcctaagatcctttttcaaactcaactgagcttcatgtgaagtttgaggagtcatttttggttctcatcaacctaacgaatcagatagatctccactctccacttagctaacacctttggatgcaaagttggtggtggtacgcgcttttacgtacgtggggatccctcgtggtaccacaaagcccaccatgcaagacttcactcctttattgttcatgatgggaggcaggttggttgacataagtttccacctcttctttgaacgttcttttactcaatcatattagaataaaatcgccataagttggaacctgagtctacaacctttagacatcaacattaaggctagaacaaattttggcaatcctattttagagagattttcgtctacttgttagatcatccagactacaaaaaatggagtgatttttttatataaatggcaaactttccaatgtatcaaatccaaggaaagttaacaaggacccctcattctttagagagatagctatagttatgccttttttttttcttcctttcttttgggtctagaaaccttattttcttagatgatgtacatttgttaaaacttcttttattaatgaaaatagaaatgtatttttaaaactcacaaaactaagtaacacacacttacaagtccgaggatcgttggtgcgtcattgaactctagagtaatatgcagtaggtagtccatgtcttggatcacaagctagatttcattaaatgcttggtactagtagtattattgacaacacaagagtacataccgctgatttaaataaactttagttgctccactaaaaactgtataccatggcccatggggattaggccgaggagaggagatccttctccggtggtccctacaaaccaggaccagcccgcacgaccacaagtgccagcgaggagtggcacctgggcatgccacgtgtgcagtgggcatcaccatagccccgattcaccaatgggaagagaccccttatccgctgctcttatcctccgcctgtggcctgtgctcagctgcgcgtagataacgaactctcccgccctcacaaaaccgcccttcacgatacgcacccaccagaggaaaagggcaaaagccaaaaggcatcaccgccgcgacgacgacgacg

SEQ ID NO: 3575 - DNA, 175 bp, Zea mays
gatccgtccgaagctgttgagtccttgctgacgtccccttgcttccgtaagggggctaagagccgccgtcgtcaaagagtatgcgaggcgccatcattgcctatctggcggggcgagccagatgggacgccggtcttgttccccgtggcccgagtcagctcggggtagggtgatg

SEQ ID NO: 3576 - DNA, 1167 bp, Zea mays
ctagtaatatagggagcatggacactgtggaaacatcggaatagttgtgtcttcgacaaaaacatgctttatatggatgttgctgttaggatagctgatcaagaccgagagaagtgggagctggctggagcaagaaagctatcctggctaactagtcacataccgggtctgtaggctttgtgttagatttttgtagtttttgctgttttatttattaatggatgagtatcagtatgcctgtacttccccgtgaactggttgttttgtattgtctctgtttttcttctcaatggaatggaacaatgaaacacaactctcatgtgtttttcgagagaaaaatatatgatgtaaattgcaaatgtttgaggctttgagatacttctttatgtgaatgtgctttgttttcatggttgtttgagctgctttctatgtcaatggggttaggctggcatgaccccattttcgtgtcgtgcagtcgtgcttgctaggccaccacgatacggttggacctatcccgtaccatgctcatacaaggttttggactcgatggaaaacacatatagctaatcatgtgatgtttaattaggtcgtgcctagctagatcaagtcatgtcatccatttaaacatctattgttgttatgttgtgacctctgggagatagggcatgggatctgttgagcaaaaggagaattttactataattatggctagtttatcaactccattttcttaagagatttataattttacaagaaaaaataaattaatttctcttagaaaaataaaaatctcttaagaaaatggaattaccaactagcccttagatgtctttacaggcagatgagagattatccatattgttgtactagcaccacatcaacgaatccatacaggcctttagcagcacacttgaaaaaacaaccatgttttaattctgaactctgaagtcgcctttacaaacagcactgcaacgcagaaagctacacaagctacaccagacaaggggcaacacaatctcgtcatctggtgcagtacatagtagttatgatttatgaacaactctaactcctatcgtcccaccatgcacaatgcacttattatcactcaataactataaaaacactgctatctgaactttcagtatctcaaacacaaacagagaagcc

SEQ ID NO: 3577 - DNA, 1500 bp, Zea mays
caagtaccaatgtgccatactgccaaccaaactgtaccatacatacaatttgttcccttcgatcatccagctagctagctatagccgatgcataattgatggcgatgtatcttagctcgtatccggcggatcggatcgatgggtcgaccgtgcgacgtgacgtacaggtaagcgcgcgggaattttgcgcaacgaacaaagcatcggtgtaccaaacgaacgaaaggtaaccaaaaaaaacacggaagcagcatccggacacggggaacagaaggcaggaaagggaaaaggcagcagaacccacgtactccaatcctacgactacgagagaggcatctcgtttccaaaagccgccggcattcggcggacaaaagcgtcgtccggccagctagcacactgctaggctgcactgggccggccgccgccggaacgccgcgctttggccggacggcgaactaataacacactacwtacgccaccacctcttctccggggtcagaaaatctttttttactcatctaagcctttgtttagaacccctaaagtaatagttagccagctaacaaaattgttagctagatttgaaccagctaatgaactaattgctactgatgaattagctaacaattaactgaggtcttacctctagtggtgtttggaacctttaccggccgctagggtccaaactccaaacgagaactaattaagctagctaggccggtatatatactctaccatgcatggacacatctatattgttgtaaatttttccctagttctcgacaatgagagattatctaattatgtgagccgacgactacagatgcaatgcctgaggccgcgtgggctagatgacaagtttggggggcattgacattttaattggcagcttgacggtgacagccgcgacgacgtggaagttgagacattcaggccaacatgtcagtagctgtgtcggtcgtgctacttactagctagacgtagctagttcaattcatcgacccgctccgctagtttcatccgcatgaattacgagcactgcacgcccatccctactgcttctagctagcctctcgtgaaatgcatgcaacagccaacagggcctggccataacttgtgcgaatcagcgatgttggagcggttgatacgcaagaagacgatgcgcctcgtcttccctgaaacaagtattgttgtgtccgggaatgggcgttcacaggtcacttgcactcctctacatcgcgcgcgtttctctccggccttgtcccctggggaccttacatcccttgtcgtgttcctcctctataaaactcgagcccgaccttagcctcccccgcgtgtggctcgcaacttgcagtaggtgacaggtgttaacaggagctggctgagcttctcttgcttctgcaagtagtagctgtagccgccctgtaggcagagagaggagagacgacgtacgtgagggagcgagcgagcgacgacagcatcaggcaggcgttgacggcc

SEQ ID NO: 3578 - DNA, 1500 bp, Zea mays
tatgcggtggactgggcatatgatatgatgactgcttgacatgacctagccctggccctagctgtgtttgtgcatggtcgggccggcgcttgatcctgcttatgggcctgtctgcaggcttcagtcatgtcgtgtttaaagccctatgtataaaggcgtgttttcgagttccaactcacgggtttattttaccgtggcatctagtcttcggttgttttttaattgtcgtgttttagttaaaaaaactagcgaacaataaatattcgaaagcaaaggtagtatatacaaaaggctcacctacttgttaccaaaaaatgaggtttgaaaagaaactacttcagactttacccagcccgccctagctgtccttaataaacttcagaacactaaccgtttgtttggatacaaccattccctataggattggaggggattgtgagtgaaatgaactaatttctccttcaatcttttattcacatgtaaaaccatggatccaaactagttataagggrttgtttgtttgaagaatcaatctatttttagatagtctatcaaatttagtcgaatgaactcattcatcatattattactaattattagttcatgtagaatgatatgatgatagatcaattcaatctatttcacaaaccaaacaagaaactgaggagtgagaagattatgaattatctcattcctcaaccaaacacgatataatcctctcataagcattcttacgggctcatttggtgaccaatgatcacgaggattgaagaggattgaaggagaaattagtttatttcccactcaatcatctccaattatcccgtcgtctccttgtgaccaaatcattccgtaagaatttcatagccgagattatgtttgagttaaaaaagtcactccttaaaataaaatgacacctcttgataaaatacgacaaaatctaagggtgaaaacgcgagtgccaggccagcacacacaaaaaaaaaagatcttatgaaaattcttgacgctatagacaccacgagtccacgacacggcgccctttccctgtccgtcctccgtcgtctccgccggctcttcttcactcctcttttccgctggagtccccgatctcccccgcatttcccactcccacttctagcctcccccacaacccccatcctcagttcctcaccaccacttgccccgccaattcccaaatctcccaggggcttctccgcttacctcccgcccgactcctcgcgaccccatcgcctcgcctcgacccgtcccgagccttgctcgtcgcggagcgccacaaccacgcctcgccgccgccggcgagcggtcaagcctaggggctatctccgtgtgatggctaccgcgccggcctccgaaagctcgaccgcctcctagggcggcagttacccgaggctgagctcgtgcgcgcgcgtggggggatccttgtgctcagctcgcgaaaccctaggggcagcaggaggcgaagcttgcagggcggcg

SEQ ID NO: 3579 - DNA, 728 bp, Zea mays
gctctgagggttggtttttgtgacaattcgtccattgatcctctccaattaccttgtcaccaagccagccctaactcactagccaatgcgcgtagcaggatcacagggaacacacagggagcttctattccagaaattaaggcccggtcaagacttcaatgaatgtcagcaactcatcagctgttacctgtctaccagctccattgctagcagcaataacggccccatcagtcatgaagctgctcagttccacagtaccagctctgcaaaagatcgatagatgcggtagtagtaaaatcccaggatgcgaatgcagtgacacttgatgttcatgtgcccctcgtcagatcccatccccctcgttcgcgccaaattaacgtgtacaaacgcagaggcagcagcttaaatttccgctgtacgtgcgcagtaactgcactctcactctctctcgatctctccctgtaacgtactgcgcaaacctaccagcattgaagcatcaccagttagttgatcaccatcctggattcctggtggtggtaccaagcatgcatcgggccgacgacgaagctactaggaccgcttcacaccggcctgctctcctataagtagcagtgcctcaatgcgacgccttttggcaagttcgatccagattatagcagctagctcaccgtcaccgacatacagtacaatagcagcttattagcttgtgtcagtccatccatccatcc

SEQ ID NO: 3580 - DNA, 91 bp, Zea mays
agttcgaagctagagattcttgttttcttctaaaaaacctaaaaaaaacaagtagaggctagatcatcggtagattgtttcatcgcggata

SEQ ID NO: 3581 - DNA, 277 bp, Zea mays
ctagtacaaacagtcaaacggttaaccttcaccaagtatggtgatttcaggcatttcccttatgagcatgaacttgtttgaagtaatgaagttgccatttacagttcaattcactcttcttcaactaccaggaggattgctaacagaattgtttggccgaaggtttgtttagggtaacaaatcatcttgaatatgcacaaagtcagagtgtttatgcttatgaaaatactgatataatatgtcatctgcttatgaagtaggaactgccaactggtat

SEQ ID NO: 3582 - DNA, 778 bp, Zea mays
agtactcaagttgtaggcgtgcagccggggcgccggccgctagctgctgtcagcacgcgcacacagcagcagggtggtcgcccgcggccggtagccggcacgcggtcgcgacaagccgatagcaacagcaagccaggcccaagttcagtccccagagagcggcaaggtaaattcccgaaccctaatctttatttcaatgttaaattccccaatcgagaaatctcatgtcacttgcagagtgaagaggaccaagacataaattctatttttgatgaatatatgagaggcgatggcgaagtggcgaaccgaaaccttcattaattaggcattgttttaccacttccatgttttcatcaagcatgctgtggatttaagcatggaattgagatatcttctaaacttatgcatttatgagctagttttgttatctatctgtattagacccggtgtggccgtgtgggagtggtatttgacaaggtgttggtgtactttgatggtagcccgaggtgtgaaaattaaccagctcagccattgaccctaggggaaacgtccaaagagtgggtgtggtgggggttgggggttgggggcacgatgagctcttaatcactgcaccgagagcctaccacaatgctactcattattttgaacatcaatctgcatcttatgggtcctattgctgaattgcgctttctacattttgttgacagctaggtctgtcatcttctctggagggttcagaaccaccgagaattagctgtctttgaggagtacaatagga

SEQ ID NO: 3583 - DNA, 1392 bp, Zea mays
ttggcatcacacttgtaaggtttactgataccgtataccttttaatgcgtaaccatttccaaagagtttaacctgcttctgtaggggccagattggtctgtctcatatgtacataatttcgtctgtttatttaatgatatatcgacaaataagactgacaccctagattaaggatgacgtggaacacaattactagctctgttgtccatgggatgaaaatcacacaaattggcaaatacttcctatatgtctcttgtgctaaagaagaatcgataactaagcccttctatgatagaaactaaaggctaaggttcagacaccaatgaatctactgaacaggaggtgttgaagaggaagctttaagcttacatgtggaatacaggtccaacttgtaggtccaggctatatggaaagctactcttggtttgttcataactaatcccagtctcaaatagatatccgattgctggacatccaacagttactattggattttctaaggttcagacaccaatgaatctactgaacaggaggtgttgaagaggaagctttaagcttacatgtggaaaacaggtccaacttgtaggtccaggctatatggaaagctactcttggtttgttcataactaatcccagtctcaaatagatatccgattgctggacatccaacagttactattggattttcttaccaagtagagaactgaaactccgtagttttcattttaaaaaaaacaactatggcatagaagaacatcaggagctgtttcatttttaaaatcagaagagctgaccaacacaaaaaatactttccgttgccgggactcgaacccgggtctttcgggtgagagccgaatatcctaaccagctagactacaacggatcgtgttatttttgcattaaatttagatttataacttgtatccattgtatcctaagggggtgtttgggagtgaagtttttttttacagttttggaagaatactacagtattctcaaatactgcagtattatatacataatggtgtttggcaagctgggtaaaatctctgttttcaaaactgaagtattgcaaatactatagttgttttaaggcattctaaacttagctctggacctcagttttcaaaactgcggtattataaactacggtattgtcataactaaagtatagtatagtatttcaaaaactgtagttttcaaaaactttgttcccaaacagggcctcagctccgagcctccaatatattcaattcaattcgtcccgcaaccgtgaaccctgtgcgcttgtgctccgaccttgctgcaatggcggactggtcgttgctcccgtcttacctcgtcaaccgcatcgccgaccgcatcctggccaccgacgacctcgactactac

SEQ ID NO: 3584 - DNA, 1308 bp, Zea mays
ttggcatcacacttgtaaggtttactgataccgtataccttttaatgcgtaaccatttccaaagagtttaacctgcttctgtaggggccagattggtctgtctcatatgtacataatttcgtctgtttatttaatgatatatcgacaaataagactgacaccctagattaaggatgacgtggaacacaattactagctctgttgtccatgggatgaaaatcacacaaattggcaaatacttcctatatgtctcttgtgctaaagaagaatcgataactaagcccttctatgatagaaactaaaggctaaggttcagacaccaatgaatctactgaacaggaggtgttgaagaggaagctttaagcttacatgtggaatacaggtccaacttgtaggtccaggctatatggaaagctactcttggtttgttcataactaatcccagtctcaaatagatatccgattgctggacatccaacagttactattggattttctaaggttcagacaccaatgaatctactgaacaggaggtgttgaagaggaagctttaagcttacatgtggaaaacaggtccaacttgtaggtccaggctatatggaaagctactcttggtttgttcataactaatcccagtctcaaatagatatccgattgctggacatccaacagttactattggattttcttaccaagtagagaactgaaactccgtagttttcattttaaaaaaaacaactatggcatagaagaacatcaggagctgtttcatttttaaaatcagaagagctgaccaacacaaaaaatactttccgttgccgggactcgaacccgggtctttcgggtgagagccgaatatcctaaccagctagactacaacggatcgtgttatttttgcattaaatttagatttataacttgtatccattgtatcctaagggggtgtttgggagtgaagtttttttttacagttttggaagaatactacagtattctcaaatactgcagtattatatacataatggtgtttggcaagctgggtaaaatctctgttttcaaaactgaagtattgcaaatactatagttgttttaaggcattctaaacttagctctggacctcagttttcaaaactgcggtattataaactacggtattgtcataactaaagtatagtatagtatttcaaaaactgtagttttcaaaaactttgttcccaaacagggcctcagctccgagcctccaatatattcaattcaattcgtcccgcaaccgtgaaccctgtgcgcttgtgctccgaccttgctgca

SEQ ID NO: 3585 - DNA, 1500 bp, Zea mays
aatattgttcatgtttattcatgatgatataataatgatttatgctgatgtcatatgattattcatgttatttctcatgttttcatatgcttcttctttcactgatataaactgcgatgatgaaggtacgtccttcatgaccttcatctgaagatcattatatcctaagggaaataatgcttcgaaggacgaagggatttaaccattaacatttttgtgttgccttgttcttgaaagggaaatgtgcccttgggccatttctaagtattttggtgattgagtgccaacgcaagtacttttgtgttgatctatgcaatggggtggacaaagtgcaaatcatgtcaaaaggtatgtttctcagacttagtacattgttttagagactaatgtattgtgtctaagtgctggaaacaggaaaagaacaattggaaatgtcttggctcgagcagccaagactctgcttagtctgggagcaccggactatccggtggtgcaccagacagtgtccggtggtgcgccaggctggctcgtgcgaactggccgctctcaggaattcatcggcgaagtacgactataattcaccggactgtccggtgtgcaccggactgtccggtgagccaacggtcagtcgagccaacggtcggctgcgcgatctgcgcaagacacgtggctgagccaacggtcgagagggggcaccggactgtccggtgctccaacggctcccaggcgccaacggtcgactacgccacagaaggaaagaaatccgcaccggacagtgtccggtgcgccaggcggcagaaggcaagatttgccttcctggaatgctctcaacggctcctagctgccttggggctataaaagggacccctaggcgcatggaggagaacatcaagcatcctctaagcattcctaagcactaagacatcgattccgcgcctttgattctttgcgatagcaattagagctctagttgagttgtgaactcattgagttgtgttgtgagctcttgttgcgacttgtgtgcgtggtgttgctgtgatttcttgtcttgagtgtgttgcttatccctcccttactccgtgcttctttgtgaacttcaagtgtaagggcgagaggctccaagttgtggagattcctcgcaaacgggattaagaaaagcaaagcaaaacaccgtggtattcaagtgggtctttggaccgcttgagaggggttgattgcaaccctcgtccgttgggacaccacaacgtggagtaggcaagcgttggtcttggccgaaccacgggataaaccactgtgtcatctctgtgattgttttcttgtggttattgtgttttgataaagacttctctctagccacttggtgattattgtgctaacacttaaccaagttttgtggcttaagttttaagtttcacaggatcacctattcaccccccctctaggtgctctcaattggtatcagagccgtcctcttcaagaagggactaatcgcccgaagag

SEQ ID NO: 3586 - DNA, 1500 bp, Zea mays
tcctgcaaaaattctggagaaacttttgtaatatagttacggaacaacttatgtaaatttgtacataccttgtaatatattttgtttctgctatctgtgtacaatctgctttgctgtggacgaaacttctcttttgagccgaaggcgaaaaacaccttcccttcttttcgtacacaacgaagcataaaaattttccttcgagtttctcctcattgccgaagcatctgcgtttttgtgcggtataatgatgattctatatatgtctaaatgcatgtttatgaatgcaaatgacatgatgagatgtattgcgtaaatgaatatcaaaatacataatcaaaaaaaccataatcatagtccttcagcgttgacttttcgctgtaagcctcccttaggagcttcttcgccttttactttcagcggaatcagcgcttatttttcgctgtaagcctcccttaggagcttcttcgccttttactttcagcggaatcagcgtttatttttcgctgtaagcctcccttaggagcttcttcgccttttactttcggcggaatcagcgctgacttttcgctgtaagctcagaaaacttacactgcgctcccttaggaacgactttttactgcttcgaataaattgcaatgtgtcccttagaacaaatttttgataatacaaaggtccttcatgccaccataaattcgtatgcttcggcaactcaagcctatggagaagacatatttttattatggtaaaagacaaaactgttacaagaaattgaagaacgataaaagacacttagacttcccataattgttccttattaacaaaaaaaagtaatactgaatgtaaaaatgcgaaaaaacttgtcggcgtttcgagaccggggggtccctaggccgacgagtgaatgtcgccgcgtgccccagcccagatgggtcgagcgcgaggccgagcgcgaaggggggaagcgaggtggccggagaccggcgtgagagaggtgggaatcccgcggccttcgtgttcgtcccgcgcccaggtcgggtgcgcttgcagtagggggttacaagcgtccacgcgggagagggagcgagcggccccaagcgagcgcctgtctcgtcctcgtccccgcgcggccaaccttctctaagagggccctggtccttccttttataggcgcaaggagaggatccaggtgtacaatggggggtgtagcagagtgctacgtgtctagcggaggagagctagcgccctaagtacatgccgaagagattttggcacccagctggtgtgatgtcgtggccgtcggaggagcgatggagcctggcggagggacagctgtcggagcggttgagtccttgctgacgtcctcttgcttctgtaagggggctgagagccgccgccgtcacagggtacgcggggcgccatcattgcctatccggcggagctagccagatgggacgccggtctcgttccctgcggctcgagtcagctcggggtagggtgatg

SEQ ID NO: 3587 - DNA, 64 bp, Zea mays
tcaagtctacagtctacaccgaatccatcccccatcgccgccgccgccgccgccgacgacgacg

SEQ ID NO: 3588 - DNA, 735 bp, Zea mays
agacttctattttttataaactagttaaacttaacaaaattatgctttaaaaacatacggtagttattttctctaggatgaaggtggcaaattgaaataatggaatgccaattttatacccggaatcctagattctagacaaacataaacaaggggtgtttgatttttccgactaatttttagtctttatattttattccattttagtttgacaatcctatttttccgagagattttcactttactaactgaaaataaactagtttttaggaaaatgaaaatttcttgaaaaaaatagagttaccaaactagctcatatggaataaaatagagtgactcaaaattagtccttataaaacaaacatcccataatttgcattttttttaagttatatacacatccgctgatacatgttcagatctaacggttgatactaatccattcgaggaaacaacggtcttgatcgctcatagtgacgcggccgaaggcttcctgttccaaaccatgcgtgcctgccagcacgctggcacgcagcactgcagcagcgcaaactcccgatcagatccacagcgattcggccaagtccccagcccttctcccgccgcatcaccaccaccacctcttctctgccccctcgatctccagatcgccttcgcaattcctccgtgtagcgcccctgtcctgggcgagcacgagcgcgcgtgcgcgcccagatctgcgcggtctcgccggcg

SEQ ID NO: 3589 - DNA, 1500 bp, Zea mays
taatctagtaactatataccattcgaggtagtggacaaaaataattatgtaaatattgaacttatcaagatgtaaagcgagtgtgtgatattcagtgatcgagcattctctggtgagttaattgctagaggtaggtaggagttacattttaacgaaaatgtggatgatatcttagttgatagggctgcttcacttgggtttgaaatatcaattgtaaggcacatgccctcaattttgtgttgcrgtttctctcctcaccagaaatacattacttccctacaacaattagatttgggatctgcatcacggaagttagatttttatttgtatgagttattcaattttaattatttaagtgatgcaatttttatttgttttatgaattgtgtaatttttaagtaattcaatttttatttttctcatatagcatgaattatttattttcaagtatcgtatttttaaatctttttatgaactatgtaatttttatttgcttatttatatattcaacaatgtttcatttgcaatataaatctgtaaaaaagcgatgtgatgttgaggtgagcttacgatgttcgatagtgcgatcggtaatgtgattgatggttggagtgggtgttaagggccattgcctataggatgtttggtatagcttttctccactctatagcagttctgcttcaaaactttagatgtagtagctctaaatgaatgtaatgaagatcaatctgaccttgctttatacataataacttgaacttgctttatatataataagattatgcacatgaagaatttagaatgtacccgccattggtattggctatgagaaaacaatatatgtcgtttttaagaattttatagcagtaaaggagctactccaaatcattgttacttttatctctcaaaactttatggtgtttgtaatgttggagttagattgtttagctgactgtggttagattttttctcttaatttttgctccaaacacaactattttaccacgtctattaaattttctagagctagcgagagaatacccgaaacaaggcgtgaggaacagaggagtacccgaacgggtagagacggtgaccacgagacatatgacgtgggcactgatgcacgtcatgtcataggcaataccgtagattccgcccatatcaacatctgaaccatacagccacacctgacgatcccaatcttccttctcactgccgatggggtccaccccgccgattcctgaaacaaaactggttgcgatgatctgtcatcaaaccgaaggagatccgcacatacgtacaattgtacagtacagtagagaaactggtcccactagtacactacccctgctgtcaagagcagcctgacagtgacagatcacgcctctccagctccccgttttataaaaacaaaacaaacaaaaacaaatcttacctgtcgttgctctccgccgccaccagtgcccgtagcgctcgccgccgccgccgccgccgccacca

SEQ ID NO: 3590 - DNA, 730 bp, Zea mays
cctctatatctcctcagataaccagtgggaaaaccacctgtttgcgacgagcatgtacctgatttgcgttctttactagtgccacccgtttagccacgctgttatgtgaggggctgtgcagtagcctgtgtttgcagctgggctgcaaatatttttccctagaatgtatcttataaaaaaagcgagaaagggtagaggagcactctgccactgtgaccttctaggcacatgtgagaaagggtagaggacttgtttggtttgcacagtgagacagctgcccgaggcaggcagcacccctagacattggattttgattgtccggggttgagattccatgccgggtagtcaagtgtctggcaggctcaagttggcttcttgtctggttcattggttggaaataaaactaataaactggtgagagaattgctttatttgataaggagaggactaatcaagaccaataatatatgagtagttcgagttgaactagagttgactaaaaaggcaacctagcttgccctctttcaccttcagaacacagactaataaattccctcacatgctttactctctcctcgcatcttagcctataaaaggactgaggaattgcgatacctctcctactaactgatcatcttctctagatcttctcatcataccgataccggcctcaacgccctctctttcccagcctcacaaccaattcctgtttcagtcgatcgcagttagc

SEQ ID NO: 3591 - DNA, 238 bp, Zea mays
acaacttcaagttttgagttgcactactaattcatttgtgcattgataatgtgattctaccttgtagtcttcctgatgacaattcagttagtttctttaaggatacttcaagtaccctcattcacaattgcttgatctctcgcctacagatgatttccgtttgttctgcggtgatcttggaaatgaagtgaatgatgatgttcttgcaaaggcattctcaaaatatccatccttcaat

SEQ ID NO: 3592 - DNA, 439 bp, Zea mays
tgtttagtaatgctacctctgatatggtgggctgcagatcctccatgtttgcacacatctaaacaggcttgcttctagtagttttgtgccattcagccctgttattgcttgactcgtgcttgttattatgcacctcgataaaacgaatcttcatgttctattgaattatggacatacttgtaatatctggcacctatgtcatcaagatgatggtactgtgtgttttacagtttgagtatctaactcgattaatttgtggtaactaggagtcatttgagtgggttgtctgatcatttaacttctatattgtgctttagttcttatgccattggaactttgataattgatagtgattggctaatctttgcaggcgtttgatgaagctatctcccagttagacacccttggggaggagtcatacaaagatagcactctgatc

SEQ ID NO: 3593 - DNA, 691 bp, Zea mays
tgcagtttatggtcaaaaagggaattgtattgacacctcatgctgactattgccttccaggcattacgcgagcaactgtgagtataatcagattccagttggaacaactggggccaatctacacaagtgcctcctaaactctatttgtgcactagtactctttctgaggctgaagttgtttcacaatatttgaattatgttgcacatttatatatactactaagataagatatttagtggataaatttaggttctaaaatagtagaaatgattctacctgtttttattttgatagagggacttgggtacatagtaggaagtaggttcggttccttttatttattatttttttgtatacgttcaaattattggataaggtcatgttttgaactatcttcgtcagaagaaagtgtaaaatatttgaactacagaagcagcaattctccacatttctagtagccttactatcttttcgccagtgttctgctcagttgaataagtttgtccattcgatacttctagaactctgctatattactgtatgcttaatgtagtgtttctggttgtgtatgcttactataaagtgctacatttatgcatgaatgtggaaatgcgcagaattggtgcaaataatggaaagttgtggtttactgagactttctaacatttctcaaatgaaaaataacaggtc

SEQ ID NO: 3594 - DNA, 157 bp, Zea mays
ggtaagtaatatttacccttccgtcacctgtttgattctcattgactgggtctctctccctaaaacattgtatgcaaacaacatattggatccttttgaacacgcaaaaagaattatgttcgagtattaacaagcgcataataatacctaggttttt

SEQ ID NO: 3595 - DNA, 921 bp, Zea mays
caggtgactgtcttaattgaggaaaacgcttgtaccttcccgtggctagaaggaaccaccttgtgaaccgaagttaccgattatttttctttgggcgaggatcattctagtggtttcgcttaacttacataatggagtactatttgttgaggaagtaaccttaaggcttcttttgaccttaaaaaaaggaacaacttaaatctgtctcatctttggtcttcgtaaaagctatctatgatacttcctcttcgaacacaaagcgaacgtgatcaaatggttacgatcttcactctagtctttgtgctcaagtgaattaagacgtttatcttatacctttttctttgtttcagtatgaacttgatcccaaaaataaaacattgattaaaagaaagattaatcgttaattacgttcgaaacatcaggagtttgtttgttcaagattaaattcccgataatagttgaaaaggaaaaaagaaaatgctgttctccttttttttagcatgcaaatagcagcaaaacaagaccagaccagaccagaccagactttgcgagcagtggagcaaaggctgttttccgtgggtgcttgaggcttaagcaagaggctcattgagatttgagaccaggagagatgtctggtctccgcggatccgacggtagcaaatgaacctcactcagatcggaggggagaaactaggctagttggtctggtgcccctggcactcgctgcacctgcagtttccttctccgggatctcaattctcatctgggagagggcgggcgagatccattccagtcgcccccattcactccccttcctcgtccgtcctcttcctccctccgatccaccgctccccctacccgccgggccgccgctacctcgagcgagcggagatctctctcctcgaacggggggggaggaag

SEQ ID NO: 3596 - DNA, 1039 bp, Zea mays
ttgaattgtatgtttctaaactgagctccaacattgtggttacgattgctttaagatgtccaatgcataatacttctctcttctatgtatgaagttcttcctgccaaaagagaacattcctgtgtttgctctgtaacgcatccaaataaatgcctctcttgtattttctctaaaagtacctttatttttatacaattcatacatttggaactttatagttctaggttgttccgcaagaggcataaacaatttctctagtagaacctatttttatactttttttaataaaagatgcttaactattgcatttgcatcagcctagcttacagagagaaaaaaagttaccatagaaattggaggcgtctttagaccttgtccgtttacatctagattggagagaattaaaacagattaaatattttttatttaattttgagtaggaaggaatttaatcaccaactgctcaccctttatcctccgtcagccaccaacggcaagtgcccccacaaggccacaagatgcctctcctaccgaaaaaggaaacaaatttggccagcgctactgcgctacagcaaagtcgtgtataaaagtcgcccatctgcacagctatccattgggagtagatcgaggaccatcctcgctaccctgcaggccggcactgcactgcagtcttcagaactcgtcagtcacagatcggtgcaggcggtctgcacctgcatcacctaaccaattcctcgattagtctgctgttgcgatttgcgaggcaggtcaggtactgacgtattgcatttgcatgcctagctagctgatagatgatcttgtttcttctctgctttgctctgtgtatgtgttcactgcaggagaatttgtaattgcaaaccgcctcacaaattggtactgactgaaagatgatcttgtgtttcttcattctgtttgcacgaagctgcaatctttttgcagcagccactaaacctgtaccaagtcttcttgcctgagggcagaggcaggctccgtcagtcacgccggcggcgtacagatc

SEQ ID NO: 3597 - DNA, 1500 bp, Zea mays
cggtaaaccgagcgatttaccactaaaacctattgggttttcaatcattggcggtgaccggagttggcggggccgctggagtcggatgaagggcagtgggggctagctaggggcagccggggttggttgggtgtgtgggtccggctaggggcgaccggakccagtggggagccggccagggccgatagagggtggccaggtggggtcagtcaggactgatggcgcggtggtcgagaatggttgcagcatggcatggcagctaggggtgggcatggaagccgactaattaggtggccgaaggggagtagggagcggcaggtgtggaggccagcgagcgctaaggcatcaatagtagcgrttgggcggtgcaaggaggagagctacaagaagaggtcaagaacagacacacctcctatctctgtggccatacatgaccgtcaaaaacaaaccctttattttcagcggtagacatattgccgctgaaaataaagtattttttcggtggtttgctatcgaccgttgaaaataaacttatttctcgattccatgtaatgtcagttaagcattgttgctaatttgaatgttgaacgtgataatatctgcctgacttctatccacttcaatccaagtactgcaagtggacgtcgtcgacgcttagggctcaagccttcaaggaccgtttcgctactaattaattaagctagtgagttgtctcgcttatcgagttcgccagcttcacgtagtagtccatgcctgaatttgtcaaagtcgtcgtttgtggaaacctcgaggtcacctctctgcaatgccaaccagtgcaagaggaacagaattgtttgggtcgatcctcaaacgtgcactctgataagacctcacgcatgagatttaaattagtataaaccagtgcttttagtatataaattataaatggagagtggactactaagagcatctctaacaacgtgacctaaaaaatgtcctataatttaaatatgagtatattttatagaatttactacaaacaggtttcacctatgagacaaaacagtccagtctgaaaatcggcaacaactttgataacttcactgtatatcgagacgaacataaaataaactgatgtactttacacgggagcaagcagctagtttagtttcaatggtcgtcctcgcaaacaccaatgagtgctaaaacgttgtgccgtccatagtctatagagataagacttaacttggcagatcatctagagagagcgtaacaagtactgctgctaagacgattcgtaaaatgcatgttcccacatggctatttggatgtatttaatgatcaagtcaagatgctcctccattgattgtagtagtggactggacgcatccacttggtctccattggcgtgcaagctacgaaggtaaagaaccacggcatggcatcaagcactataaattaggcatgcggcattcggtggaactcatctcaactcaaacactctacttgtatctcaca

SEQ ID NO: 3598 - DNA, 290 bp, Zea mays
atattttcaaactctactctacgaatagtatatactacaatacaaaataatattttagttgaccatatacctacttgttacagtcaagactaataactagttcatacatctctccttatacatacttatcactcataccccctgcccttctctctagtttgtgcaagtctaaagccgacccttctttacatcctataactaagatctcgtacgtccaccctctatttccatactcgaagaagctcaactttgtcaaacatcgtcattctctcgacaagatccggacgaca

SEQ ID NO: 3599 - DNA, 705 bp, Zea mays
gggggtggagtgctttggttgggtgggttttgtaaagtttaaactgatatgttatatatgatgagtataaaattattattttacatacataatcgtgtatccttgcttgcacattgtgatgctttatatatatatatatatatatgtttttttttaaatacagtctaactaactctatccggaagttgtgcgtttactacaacaacagaaaatgatacgcgggcctgcagtggagcggtcagagagaataagcagccgaaacaaagcatggaaggtggcaggtgccactctgccggaagtgccaaaagtgtggtggtactgtatgagccaatgactcccggcccgggcccgggcccgggccctccttcattcggctggtctggttcgtctgcttcctcgcagtctcgcgagtcgcgactgccggtgccagacagtgagagccacaaatcttagcgagagactatttatatgcatactctctctgacattgcaggcttgcgttgcagcatccactgcgtatatagccaacagagccattctctaccgatcgactaaacgcaaggcaagcaccccagcttgtggctctgtgcgtctgattgggaaattgcttggtcgctccaccgatcctctgcggcggccctgcgcgtgctcgtctcgtccctctgtctcgggagcgcctggatttcggaggtgcgtggaaattgg

SEQ ID NO: 3600 - DNA, 415 bp, Zea mays
ttttcggaaaaatattgacgtaggacaactcttgctttaatatagtaaagatctattaaagttgctctaactattattagatgtgtcctcggatagagtcctaaacccaacgaaacacgcataagcaaaaaaatgttttcattacaacatgtacccctgcactaggaaaataaggcactcggcactcgtgagccgtcgcatttccccccgtgtgaccaattcctctccgggccgagcagccgttccaatccgctcacgccgcctctctcgctgccccgcttgaccgcctgctagcgctgcagtttgatgctgatgacctgatccctccgttgggtaggttcttgggcgcggaaagaacaaagaactcgtggtgggtccgggtccgcaagaccctaggtgttcgtcagcagcgagg

SEQ ID NO: 3601 - DNA, 887 bp, Zea mays
ggcacggaggcaaggcaccgacggccccgcaggcgccgcgcgcggcacgctcgctgggggccgaggaccacgccggccggacgaaagcgacgccgcaccagcagcgcacctgcgcggcgcccacccccacaggcagttgggggcgggggcttccaggcacgcacgttcgacgcgcggcgggagcggtggactggtggaaccgcgtgcgtgcgatcgcagacgcagagccaggccggcaggccgcccatgtgaggcgcgcagggacgggcggggaaacggacgacccgaaggtattaaaaagaaaaaaaacagcggcggagctgcagctgctgctgttcactgtttactgttcagcgcgtgtgcgggtctggaatctggatagagtagagtgtggaactccgagccgccgctcccccgaccccgatctaccagcttcgtgtgtgagcaccgtgccgcggtgattcgattgcccgcgctcgcggtttccgtcgtcgtcgtcgttctctcatcgtacggcggccatcgctagctactgccgctggatggcggtaataaccaggcccgaggggtaggagcggtagttgtttaactgcggcgggcggaggcaagtggcgtgttccggtggactggcactctgacacggtcggttgctgtgcttcgcgtcgcatctaccgacccctcacccacatggaaagcgaggaggtgagctgcagctgcgacggagactgagcgagaagccccccctccctccctccttccttcgacgtcaagctccgccccactccatggattcgatctgggaggcgaggagctgaggccaggacagggggaggagctgctggggggcagggacaggatagcgcggctaagcggcaacggcggcagcc

SEQ ID NO: 3602 - DNA, 1500 bp, Zea mays
tgaacaactctctttatgtctcaacaagtgtgtttgacttagagataggacattgagcttgatttgcaaaaacaaaaccaagtggtggcaaagaatgatccaaatatgccaaatttaaatcaaaacaaatttgtgttcttatttgcattgatgttgcacttcctttagttgctttttgttgtgttggcattaatcaccaaaaagggggagattgaaagggaaatgtacccttgggacatttctataagattttggtgattaagggctccacacaaatgctttgagtaatatttgtgccaaagacttaagaagtgcaaatcaagagtaaaggtatgtttccaagacttagtacgttgttttggagactaatgtattgtgtctaagtgctagaaacaggaaaagaccaattgggaaatacttggctgagcaaccaagactctgcgtagtctgggtgcaccggactgtccggtggtgcaccggacagtgtccggtgcgccaggctggcgtctgtcaactggctgctctcgggacatcgacggcggtgtacggctataattcaccggactgtccggtggtgcaccggactgtccggtgagccaacagtcggccgggccaacggtcggccgcgtaatccgcgcgcgacgcgtggcagagccaacggtcagaagggggcaccggactgtccggtgtgcaccggatagtgtccagtgcgccaatggctctgaatctccaacggtcggcttcgccaaagaaggaaagaaatccgcaccggatagtgtccggtgcgccaggcgacagaaggcaaggattgccttcatggaatgctctcaacggctcctagctgccttggggctataaaagggacccctaggcgcatggaggagcacaccaagcattctataagcattcctaagcaccaagactccatttccgcgcatttgattctttgtgatagcaactagagctccatttgagtagagaactcttcgagttgtgttgcgagctcaagttgtgactagtgtgcatgtttgtgctctgattttgtgtcttgtgtgcgttgcttttcccacccttacttccgtgcttctttgtgatcatcaaattgtaagggcgagaggctccaagttgtggagattcctcgcaagcgggatatagtgaaacaaagagaaacaccttggtattcaagtgggtctttggaccgcttgaaaggggttgagtgcaaccctcgtccgttgggacgccacaacgtggagtaggcaagtgttggacttggccgaaccacggggtaaaccactgtgcctctttgtgttgatttctttgtggttatcgtgtttagcaagaactcctctctagccacttggctttattgttctaacacttaatcaattttgtggccttgagttttaagtttttacaggatcacctattcacccccctctaggtgctctcaattggtatcagagccgttctcttcaagaaagggactaatcgcccgaaggg

SEQ ID NO: 3603 - DNA, 145 bp, Zea mays
ccagcagccgcaccagctcgcagtctcccacttttcgaagtagcagcccggaactccggatccaccgctaccgccgccgcgtctaaaccctccaccgtcgcggtgcgtcagaggcagaggcagagaggcagaggcagaggcagcc

SEQ ID NO: 3604 - DNA, 334 bp, Zea mays
ttttctgaataagatgagcggtcaaagttttctaaaaaattcaacgatgtcatatatttaagaatggagttagtatttagaagtcatgatacaatattgcaattttgattattttaaatataaaagaaaatttgttatcgttggaaggcctctttattggtgggccgcagacctactagtactactttaggtgcgtgctagccgtctggatggcccaggaacggcgcaccgtggagtccctctctgatttttggcgagcagaacatacctgagacgacaggtagaagacgactgactgcctcgagcagcagagatcagggaggccgagggcggg

SEQ ID NO: 3605 - DNA, 350 bp, Zea mays
gcagagcgccggtatcaatcagatcgccctgtgccgtgaatgagatggattcggtgacccaccagaacgccacgctggtagaagaggcggcggcagcggccagcaatctggagagccagtcggaaacgctggagaatatcgtcagccagtttgcgctggataatcagccagcggcgtttagcgccagcaaaccactgccggcgctgcgtccggtaaaacatcaggaagccgagtgggaaacattttaatttattcccgctaactatgttattcccaccccgataaagcagcggaatgcgcaatattataacgccttatcacgctttgtaatattgcgcctctccgcaata

SEQ ID NO: 3606 - DNA, 470 bp, Zea mays
ccccggctccccctcctctctctgcccccgctctcccgtttctctctctctctcaaccccacgtcacgccgtccccccctctctgccattattgcccgcgcagccatcctctctctccctctcgtcgcccccgctcacagtgtgatttatggggacgtccggctcctcgcttcctcatccagacctcccaccacctcctccgcatcctctcgccctgcttccgtcgggcgcgcgaacgcgagcttgtccgccacacccgcctcgtacgtgcgataccctccaccgcctcagcccgctgtgccccctgctcgtcaccgcgatttataccgtaccaccatcagccagccaccactcgctcctcgacattccgcttctctagtcccgaacaccggccgggactcgttagccgggtgtgcgccggtacggtgtgggaggtactctgctagcctccgctagtacatgtgaggtcc

SEQ ID NO: 3607 - DNA, 710 bp, Zea mays
aaaatttaattagattaattaatatatacctaaattactattattagaatggaattcaattccaataatctaaacgaagcgttagaaaaaatgtacgacaattagataattattgccttgaatatgaatcctcgccccactatatgattacagagttatttttatttaacgtatactacgttgataactgcaagattttttttctcaacaatcatacatgccttcgtacttcttggcaaaaggtggcataatattttcaggtgccagctgcacagtgcggtgcccagctcaaatccttttggggccaaattagatttacagaactttacggaggggctagatgaactttcctcttcaacggcccccttgtcttctccatttgttcatttcgcgtggcttcccttgccccctattaaaccaccgagctgggcgcctccccgtggcgctcgcggccgcattagcgcggagatcgagagacaagagagggaaggcggcggcttgccggcttaagccttctctccctccgtcgtcgcctcctccttacgtccgcttcttcctcctggtacgcctgaaaaccttgatgactcgcccgcgttagatttggattttctgcggtttccaatctgaaccacgattttagagatccagaagttcttggctgagatcctggcatttgggactttctgacagcagtctctattgttttcaga

SEQ ID NO: 3608 - DNA, 236 bp, Zea mays
aaaacacgactaagggtataggtgagtacaccacaactaagattccgcgggtgcaaggacgtctcagcacacgtagtaaaccaaacatatggaaaggggactaggggagcaccctgaccgcgctgatctgtatctataactctatatatcatgcaactcagaagccttccttcttcaaaagttcactacctagagagacccatcaagacccccaatagttaaggtggatagagaaa

SEQ ID NO: 3609 - DNA, 1292 bp, Zea mays
tgcagatatttcttaagctgtcatagctttacatcccactacaaaacctaactaaaaattcaattagagaccttttgtaaccatatttttcaagacgaactgaaggagtaagcagtaaaagaattatatcatgatagaatcatagtggtaaacccacttcaaatatggaacatggatcctggcaatgtaatacagttgagtaatatcaaaggttatcgcttcacaggtagactagaagatacattgcaagcaaatgtatcacaaccttcagaaaatttagaaatagattaaggggctgtttgtttaccccccagattatataatctggattaaataatcctcagaggcaaacaaacaatctagcttatttgcccagattatataatctaaccccttggattatgataatccataagcaagtgaggaggtgcttatttcagattatttttttcccacttccccactaccctttcaagtttcctagaaattacccaccattgccattataatctaccaaatcgtttttgcgcctatcggatcggagaagcccgccgcccaacagaaacacgccagataatctgggtaaacaaacatgactactcagattatataattcaaattatataatctagattatataatcctccaaaaataatccagattatataatccatagattgagacaaaacgacactctaacgacaggcacgcgagttgaggtgggtgacaactgacaggcaaccaggagcctgccgaaccggccgggcaagggcaacggatccgtcgacggcgagagcgaatgtcgcggccgccgtcggtttcgcttcgtttgcaacgaaaacacagagaccttgttgttgaaagacaaaaaaagaaagcaatcgaacgcgacccgtacagagtagagggcgcagagcagagcagagcagagctaaccgcaagtccgcaacgctagccaggccaaacatagggcttaacgcttggagaccggccactagtccacccgtttgtcccgcacctgatctgctgctatacctccgcgttcgtgagcctgtcacgttgcgctggcggctggcctctttcgccacggcaccgcacggcacgcgcaccaatacagcactggaccactatatatccccccgccccgcgctggggccggtccccagctagcgagcgccgccggtgccagtgcaacagaacacgcaccacacgggcgcagactgcagagacaacagatcgatcgtccaatggcgatcggcgggtcggaggccggcgggggaggcgcggggagc

SEQ ID NO: 3610 - DNA, 124 bp, Zea mays
gcttaataaaaagccgcaggaaatatgcttgctactacgtactatttactgtatcctaatagtgttgcggattcgtgagggttgtacggcgtggagggtgcctacattggacccgccctgggag

SEQ ID NO: 3611 - DNA, 1500 bp, Zea mays
tgttcttctgttgtgaaataataataggcctgctaaattagtaaattgaacatcaagattagtgattagaggtagcaaggcttagaacctagcaggaaatgagaaaaaaggttatggcttaatgcctgatactcataatcataattgttatggtccaggtcaatttttatggtccagaacaatttttgctaatagtttttttactatggatttctatttagttgtgtacttattgtctcatctgtttgactgttaggagtaggacatgtttgtttttggcttcttgtttaatttttagaagacacgtacctacctcttcctgaagtgcccttacattacatcattatgtgtatatgctgctgcactcattttttttctatcctcataaataggttcctgagataaatgaattgaatgagctagcagaattagctctacaaacgagcatatagtcatcttattattaataggtagggtgcctggtctgaccttgagatagaaatagaactggtgagtatattacagcgcatgtgttattctttagtttgattttagatctaagttacatttcagattgtatgttattgttaataagagtttgtatggtgtgctatcctgatggggggcctccgaggacctaatctctgtcgaaattccctaggcggtcatagatggagggccacttaagcgggccacgcgtcacaattctaagcagtgcagtttgctgacaagtttatctgatttcacctaaatcatgtcccgcaaggatttcatcttcagtatgacagattgttggtataccaacctgagtgcttgggtgataattgtgaagtttgcaacctaggtgtgacaaacggtagcatctctagttactgatggaatgcgtatttcggtttgtgtgttatcttcgtaggcagttggatacttgactgctcattttcgcaaaatatgttacttgaaatatgcacataactacacatacttgagtctgcagtgtaaagtcctgtcatgaacctagaatagcacataagagaatattatgggcatggttaatcattgcacctgttttttgctaataatctccccacgtgttactttaggacaaagttggatgataagtttctaactacacttcctttttatttttattttgcggtttcttatttgcagaagctgctgaaggctgctggtctgtttgcgggatccatcttyctgatgcggaacttcggtgatctgatggccatttagtaggcttatcagcgttgtttacttggatcctatgagtgttgttttgatgttccaataattcctgctatgaatatgaaaggctattttgctccgaagaggactagatctgtgccgatagtgcttgatcttagactttgtagccatagagattagaccctttaatattcggcatgtaccgtggatattttggaacgatggtatcagtctgcacccataataatttttgatgggtcattaatattttaagagaag

SEQ ID NO: 3612 - DNA, 1292 bp, Zea mays; identical to SEQ ID NO: 3609

SEQ ID NO: 3613 - DNA, 1035 bp, Zea mays
tctgacctattaccatatctatacccacccttagaaagtatgtacatctcgtgagagtacataacacatcacattgcaacaaacacaagataataaataccatgttacggtccaattccaatcaaccacgccgtctaaaaccacgagatccccggtgtcccactaatccatcagcagccgcacatagtaagggtgtacccagcaattcggccgcacgatgcacgagcaggaacaacccacggagtcccacaagggtcactgacagacacgcaagacagattcccttcaccttgctcccatcagcatttcatgggagccattctgccatgacaagagaattacaaagatgccctcgtcccggcattaaatacacctccccgctcggcctgatcccctcccccttccctcttctccgcctccgattggagtggctcgccttcttccccgcagccagcacgagcttgtcgagatttcagctcgtttctccgccagaggtcgagcaggccagcctcccaggaccgaagctctgcccggttcgccagtccaggaactgctgctctcccggagccagagatccaaacaaacctctgcgttggggttctccggggttccttgcgctggagggaggtttcgttctcgccggccatggtttggctgagaagaagcagcagcatattgatgcgaaatctctgagctttatgaagatcgccactcacctgcgccgctcctgcttcctccactccttctcggtcgtcttcctctactggttttatgtgatctcgtaacttgccctcccccggatccgccattccccgtgccctctctctctctctctctctctctctctctctctctctctctctctctctctctctctctctctctctctctctctctccgtcccctcttgcttctcccttctttcttgccttcccgaacaaccgccgaataataatagcactagcgttagcgatagaggaattttgttggaggtaaagtagccagaccgaccgggggaaaaaagaccgtgtcttg

SEQ ID NO: 3614 - DNA, 128 bp, Zea mays
ggtcggtgtggtttcttctaccggcgcacctccgatcagaatgcatttctgtttttgcaccctgcatcacaaaagattcggggccctcttaatttgcaggtggctggagtcaatgatcctcagaccgg

SEQ ID NO: 3615 - DNA, 1500 bp, Zea mays
atatatgtatgagatattattgtgagtattaaaaacaagcataaaaacgtctagattcattacgatattttttttgatactgctgttcatgaatctagttaaatttaaaacattttattttaaaatagttttttgatactactgtttatgagtctagttaaatttaatttttgctaggttaatttctgtttttgcatggtcggaataccattaccaggctagtgccctccctaaatcactgaccaggcgtgctccacgtagctgctcatgaacctccggttaccgctcagtgccagagccatgtgacatttgatcgaccgccgtcctagaaagtgagccaggccgtgacaatactagcgtcgtaccatatcgatttggaccagtctggctgttgtctcgtagctgatgtatgtgtgtgacttgactgttgtatatggtctgcctgtctgccgctctcccgctagctccaagcaaatggcgagcctttcatcacacgagccacggcacatggtccgccggtgccaagtgcccacgttgccacgtcgcgtccttctcgtccagtaaaatatgcacgccaggcactcgccattcgtaagagtttgggcgactggtaatctagagcatttcgtcattgtcgaaaccgtgaaaaatataaagaaatctttttttctctaccgtcggtattggagcaacaggttccacctccacgaaaactgggaatccggacttttctttccgtgcagtgacttttctttgaagagattcagaaacaaaagcttgaattcagcgaaaaaagctgtcacgcgattttttcctttttctttaaataccaacgtgctggtgcttggtagtttacagcggcaaactcgtggcaacgaaagcacgggaacggtctcagagaactgcgcaggcgcgggcaggtggaaatggaatccccggttgacgccacggaagatctcagcgggagagcgacgcccagcgccgcaagaatgtggccgcaaagacgtcacccaacacgtcttccagtttgtcctggtccaaacccacgccgaccccagctgcccgtcaagctgaggctccttgcgtcgcaagctcaccacggatctcaagccagccaaccaattcaaaagtatctcctgcccgcgttgacatgtcaccgtctcccagtcacacaggtcccccctaaaacacctcgtccaccactcatcgctgcaccggactcatcggtcccaccacaaaagcacccgatcccaccgcgtcacacgcaccatttcctgcaccgtgtccacggcaaacgtcctcgatgacgggagagttcgcctcccgctcctataaatgtcagcctcccgtgcgatgccaacagcacaagccgcaccgcaattagccgcgaccctccgcagaatcggctcacgtttccgatccagaggtccagactgttccccgagttttcccactgtgtcctctcctcgcgagtcccggcgaagcaggcgaaccgcgaac

SEQ ID NO: 3616 - DNA, 72 bp, Zea mays
cccaaatccgcggcggagaggagagagccggagagaggggcgcagccagagagatcggagaaggggaagaag

SEQ ID NO: 3617 - DNA, 173 bp, Zea mays
gttcaggcattgttattgttctccacaagcgggtggtttcaggtgctgtgtgaaacccacgatagagaacgcctaaatcaccctcaaggccttgaatccattccctatcaagctatcatccaggcccagcggggcttgatagttttctatcaagacgctcaaaggggcctgtc

SEQ ID NO: 3618 - DNA, 853 bp, Zea mays
ttatcacctaattagagtcttgatccttaagtttttttttgtaatttttgccctaagtgatccacatgtgagttgttaaatagtgtgggttgagttaatctcctctgatcaacacctgagacgttatattcaacatctaaataatacagtaaagtctttgttttgctcacaaatgctaactcattcaagctaacgtggtggctcgagcggtcgagctcaactcaggtgagatactaacttagttcgtaacaaaactaaaataaatcgaatctagccgagccaagatgacaaccaacgattgttttgtctagctctaaacacgtatgcggcggctgtgactcgtgcaagcacggaacggtcaattgcgtccgtccagacgccgctgtccttgccgggccatccactcttcttgtgcagcaggcggaatcactcgcggcgaggaaccggactaccggagcagggcagaagccacaagcggtgggcaggcgcaggaagcgtaaagggagctgcggccatcgacgcgcgcacgtgccggtgacaggcggttgtgacgtcgacgccccgggccgccgggcctgaccgcctgagacgagcagacgaggaagggacaagggagggaggaaaatatatatttttttcatcctcccctttcctgcacgttaaaacgcatttactgaaggcctgctaacggagatggcgccgtcactgggatggattggagtataaaaccgaggagccgtgggcgtgacggccaccggtcccgaagggctatcgaacgtaactaccggtcttctgtctcggcgtcggcgagcaccagaacagacagagggaggggaggcgaggcgaggcgaaa

SEQ ID NO: 3619 - DNA, 540 bp, Zea mays
gctcgggtccccctgatgctagtaaaatcctgtagatggccaggaagttaattcagcagcggcgacagatccccgaccgagcgcctcgaagagaacaaaaccgcaatgatcgttgatcgagcgagccccccgctgaacaaaatgacaaaagcgacccccaggacccagggacgtggaggaggcccagcgctgacgtggatctgacggaccactgggacgcatccgacggccgggatcgtcccgccccttcttttatccccggcccggccctctccatctcgcacagcacagagccacaccaaacccggcctctccatcacttcccgtctcctctctcctgtcctgtcctccacacaccacaccacacgcgggcacgagagagagccagagagagaagagagctcgtgcttgcatttccattgccggcgcctcttccagtgatcgtcgcagcatcacgaccgcaccgcacccttgcgttagctctgccttcttgtcgtacgtacatttatttctttgcttggagctagcggtaaaggagat

SEQ ID NO: 3620 - DNA, 798 bp, Zea mays
tttccagtcgacttttgatttttattttctagcatatattattctaccccaagagaatggtcatgtatgttttcctagatataaattttatatcaacaacgaatatttcgtaagcaacagatataggattcttgcatcgccgttatgctcggttgtcaccatatcttggcgttatcactgactaccattttgtcgggcattcatcatcgcagcagctgaataatatgcctctagatatatatattttttcaatgcggatctatgagattttgttagtagttacattattaatcaaacatccccgtattaatttttgaaagacggatttcgtaagtgagatggttgaaatcgtcgcatgggcatccataaaacacctgtgattctgaacgcggcaaacttttgtactagcgcttttttatcccaaaattacctcccatttccatctgttcaactctagtagttggcgcggccctttccttggccgcccttctcccttttttttctctctctctcttttcgctgtgcctaccgacactcctctccttctccctgaatttctctttaaaaccccccgctcgctgatcccctccccctcccactcccacccccaccgacgctgccgccgctggcacgcattcctgctctcctctcctcttctccctcgtcggtgcggcgtggcgcggctcggcgttcggtgagaaaccactcggggatgaggatctgctgctagagtgagaggagctaccggacagtatcctgcgcgccttcgtcggcggcggaagtggaggggaggaagcg

SEQ ID NO: 3621 - DNA, 879 bp, Zea mays
ggcatgcagcgcacgctgcactttgcgttaggaataatagacgatatggcttcatggaatcatgttatgtgtaagaagtaagaacaggctacgaactgggaataatgaaacaaatttcaaacctgcaactagtaaaatcaaaatcaggaacatatactgtaccatcagttatattggtgcaacccttcagttatattggtgcagccgtgcaatgtgatgcattcaattccaacagtaactcatattccctctatcctaaaataatattagttttaaaagaattaatttattcatacaatacttaacttatgtgttttatatattccctccgttgtactattagttatcgttttgaacaagatttgagttaaacttataaattttttactacaaataattgttttattatttagtattaaaacctaatgttgatatatattgatttgtcttaaaagtacttttataaaagtataaatgtattaagagtatatttgtgttttaacaagaaaatattggtcaaagttatattttggagaccgtgtcgttgtcctaaacgacaactaataggaaaccggagggagtactgattttctcctgcagcgggcacagaagatcatgctggaaaggtagtaggtacaggtagcctggagcggaggagttgccactttgcacagtgccgatcgagctcgcagccactatatagcacgcaccctgctcaagcatcttttccttacccagaaagatcgcactacccggcgctcgcgcggctttctttcccaactccgacgaaggctagctacaccacctggtgcgggctcgtctccatcgcccgccacccgctccgtcgtcgtcgtccccgccgcgccgatcccgaatcga

SEQ ID NO: 3622 - DNA, 239 bp, Zea mays
agagcaggtcgaaagcagcggccactgcaagatcagtccaagagagacggtcgcagtcagagttgggcggcagggaagggttaacgaagttgcgtgtcatcttcggcaacgacatggggagccaaagccaactcggagaacaggtggagagtgcgtgggatcctctagcgaacctacaagatatatggagaaaggagaagtggtagaattcactctgcctttccattcccccatccgcc

SEQ ID NO: 3623 - DNA, 791 bp, Zea mays
tgttgtttattatttttaagaattattgatagtttgtagcaatttaagtgtattatttatgagaattattgacggtttctagcaatttcaagatgcaaattctgcttgcgaagctgactcgtgtgctctgtatttgtggatcttctgcactgtacacacatttgtcaccatgctagatggcactgatgatagtacggaaatcagttcataaagtgttgtcgttgtctcaaaggggaaaatagaacccaagagaagatggcagatgaacacattttgggacatgtctgtgacagaaaatctgtcaaccagcctagctcyaatggccgacagcgtcccattaggtactgaggctaaaaatggaaaacaaatgccaaggaggggggagggcagcggctctcgtcctggaaatgtggcatggcggtgcggtggagcactggaggttgggcaatgtgacgctttgaagcctacttccctttcctccgtctctgtggtttggtttcaaccccttcgcttcttccgcagaagaacaaggagaaaagggaggtacgccatgagcgcatgaacgaaccaaggatcttcgcgttttaacgcctttttacatcgacttggttcctcgcgcctctgatctcggctctggcggcatttgcattgcaggggttcgtcacgaggaggaggaggaggaggaggtgcgtcgttccaatcgaaccccggcgcacaatctagaggccggggtggatcatcatcctcaccaagacagaactccatccccgttaaggtgttaaacattaatc

SEQ ID NO: 3624 - DNA, 1246 bp, Zea mays
tggcaacagattatttctaaaaaaaagtgtagcgtactagtaggagtaatcacttactcaagtctattgtatcatcgtctattgtaggcaccacgttcgagtctattgaaaaaatattagaaatgagagtatgtatggtagtctcttcgagagtaaagtccgatacatcaccgtcttctctaggcgccatgttcaagtctattgatttttttttaaaagtgaacaataagtaaaaaatcaaatggcaagtaaccagaccatgtacgtaccaaaatcattctcaataggtggctccatattcaagtcaaatgtagcattttcaacatgcaccaaaatcattctcaataggtggctccatattcaagtcaaatgtagcattttcaacatgcaacgccattgctttgttttggagttttgctgcttctgtttgttggtaccaggagcccaacgtaaggctttaataactgacgaacgctaagagcaggtgcaagtcacgaaacgacgtcctggatgcgcggtgcaatttgtagcaaaaatattctgggcgcgcagtgcaatttctagcgaaaatattctaggcgcggagcgcagtgcaaaaataaaaaggtgcaacatccatgcaaaaaagggaggccacaagaatcaaacttagaaatgcatgatagaaagcagcgttgctgaccaattgaaaccccaaatagaattcaatggatgagacaacgagaaatatttaatatgggtacaatcgaaaatatgacttcaacttaaacatttcttggtatgcgtattcwtgtccaaaatgactagtatttcaataccgtaggggtagtccatactgtcagttggattgatctggttggatcgaaccagtttttttcggaccgtatcagattggattggcctgctaggacggctcatgatcaggatcaggtgcacggtaaccgtgtacgtaggaagctttacgtgcccaatcgaagacaataaaaaagcgaagaaagaagtatgaataaaacaaaatttgaagacgcctaacagcccgactgcttcgtttccacgcgcacgaaaccctagactagataaaaagttcccatttccctcaattccccaacttccctcgccgcaatctctcgccgcctccagtccagagccaccgtgagatctgcccgattccgccgcccggacccggggactccctcccctcctcgatccgttcgggcggccggccggcctagcttcaagtgcgggg

SEQ ID NO: 3625 - DNA, 1463 bp, Zea mays
cactatctcgaagatacatctcgttgcggaagcataaggtagctttggaggtaaagcttagagcgacatgtgggtgcaacaaacaaacatgggggcacaacacacctcacctcatataactaatttggcttgcaaatcgagagtcccgtacgaaaagtactcgttgtctcttgacccaataaatcaaatacaccttcttacacaatttgtccattttatatttttcgtttccaataacaaactcaaagtgacttgtttttttggacctttgacacatagcctttaaagtagatttcacaatttaagcttgttatgtaaaacaaactaatttcgagagaggctgattgaggagaaagtctgcggtcgatgattcaattggacgaaatcgatgtttaaactgtcttgttgattaaatttctagcttcacacgtgcttgaacggcgtaggaagtgttggaatttcccttcttatgatttattagagtagagttttgttacagtttatttacggattcattacggtatttattagggatacgttgacatataacttcagtctttcttttttaatagtcacaagaaactttcacacacctactaggagtaacagaaaaacatggacatattgatttttgaaaaaagaaatattgacagataaggtgttggggaccgtagagactagagaggatgaggacgacgccaggcagacgagccttgccgattgccgtcgacgtcaccctggtcaggcgtcacttgacgacgtatacaggggcacagggctcaggttttccttcaaattgcgccgaaatactcgagatttcttggatttttttacttgtttattctattctccttccggcgcctctctagtctattctccttcctcgtcgagtcgtcgtcttcttcgatccactctttcccccatccctatctccctactttccacgcaactgcgtttcccccggactcttcttccacgattccgttggacccctaccgctcctcagtcagtcctcgcccctcccagcaccggccaacaatccctcacgttattccctgtagctactatgctgccctcttggatccctttttcacttgtctgagatttagccaccgcccggtaggaagaagaaggggaagcaccatattttctgttcctggcctgacgcagcgccggtgagatttcagtccgggatcggcaacgctgggaggactcgcgtgtgatttacgccgacttccgtgccgctctaggaagggtcacgtcgaggaggcttttgccgacgcggatttgcctggagccagccaagcagagcgcagaattgggggtgtttggccgtgcaaagccagaaagttctcggtttggctgccgaaaccgcttgaggcgaccaccatctcatggtcgtagtggtccgggtccggcacaagtaggggctcgcgtcttgcgcttggcagttgtgggaagcc

SEQ ID NO: 3626 - DNA, 97 bp, Zea mays
ggtggatactccgtagtgtagtatattggtgctgctgtggcagtcgtgccgagatgtggacgcactgcacttctcccgtagaaactgcaaagggggc

SEQ ID NO: 3627 - DNA, 594 bp, Zea mays
ggtgctgtatgttgttgaactccctggtgaccatacttagcacccaccaaaaccgaatgtggtggtgtctagcagtgtgtgcaaacttctagaatatccagtctgcttgaatgccatgtatcctattcatcagctgcacattcatactgatccatttggcatgtttatatctaaaaccctgttcaaatgtagtcgattggatgaaaattatggctttactggtttcagcgttcctttcaatatcatgtactgttatcaccattttattctgatccgtttcaatttctatggacgtttagtacataatgtttataaaccttaacttttttactcttttttcttttttgattagctacgatacagtgcagaataatatgttctgcttttttattcaactattcaaatcttattttttattcaactattcaaatcatattttttgattagctgattgcaggagagattaaaatcaaagggattgagctacaggagagttgcagtctgtcgttcttttccatggtagtaggcattttcattgggttcatacatttattctctgtcgatgtttacaagaaaatagtatctaaaaacaag

SEQ ID NO: 3628 - DNA, 55 bp, Zea mays
aaagctgtattggcacttcttctatggttagtggtggaatagcccgaacagtcct

SEQ ID NO: 3629 - DNA, 968 bp, Zea mays
cccctggaaactggcccaggagcaggaaaaaaaaggcccggacactttgccaggcgttgtcggaacgtcccgtcgatgttcggaaacgagcacgacccgtcgactcctgcttcttggcggagaagaaaggggacgacgagcgagcgttttgactttgatttcctcgctaaaaccggccgctgtttttgctttccgcgcgagccgcccacgttattgactgacgctggtgcgagagcgctgctgcctctgcggttgccgtctgcgctccagtggtagccgagaatattgttaggtccgtaggatcagatttgctacgtactaaaaaaattccttaaactttaattgtgtattttttttaaaaaaaattatagcatttatcagcaacaaaactctaaaaacatgtttagttcgctgcttaatttatcacatattgtctaaattttatatataaattatttaattcgaacgactaaccagaacccagacctacaataaatttgcccccgctgctgcgctccccagctccccaagtccctaacccgccctcgctttgtcgccgcggcacacggttttggccgtggacaggacagttgcaccctagccccattggccgattccgagctaggaaggagtatatgcgtatcggtagtaaccgaggagcaacgcaacatgtccacagcccgcgcgctggtaacgggtccatgcgtcttggctcatcaggtgccccaagggacgccctcgcccggtctgacccacctatataaacttaaaacttgtgccccaacatcatcagttcgtatcacacccaacctcccactgtaaaaaagagcagcggaacgtgcgtgcatccatccatccatccatttccaatcccaatcccaatcccaccagtgtccagtgctcggggaaccgacacagctcctcagcagagtagccagcacgacaagcccgatcagcagacagcaggc

SEQ ID NO: 3630 - DNA, 110 bp, Zea mays
ggtgctgtatgttgttgaactccctggtgaccatacttagcacccaccaaaaccgaatgtggtggtgtctagcagtgtgtgcaaacttctagaatatccagtctgcttga

SEQ ID NO: 3631 - DNA, 594 bp, Zea mays; identical to SEQ ID NO: 3627

SEQ ID NO: 3632 - DNA, 438 bp, Zea mays
gtcgctgcggggccgggccaaccagggacccagtcccgcgtgtcagacacgtaccaggtgggggcgtaccgagcgtcgtacgccggaccgggacaaggggaaagtatctgctgctccggcaggtctcggtctctctacgagaactcataaataaacgccgccccgtttcacctcccctctgctctgaccttccctccctccctccctccctcttggaccgagcgttcttctcttgcttttgccaaccagaagcctcgagccgacgcatccaagcatctcctccccctctaacctcccctcctcccaacaccatcagcgagcggtgccgactgcctcgcaaggccagcagcgcctcgcaagcgagcccaccgccgctgatcaccaggcctggttgttgaggcgaccctcgcgtgggactgcgacagcgccacagcggcg

SEQ ID NO: 3633 - DNA, 627 bp, Zea mays
gttcggttcatccaatccatatggaaggatattaagtcggtttcaatcctaagtctgtattcgattagtcaggattggaggtaagaactgttccagcttattaaagttacacaaattagtgaatcatttcacctcaaaattattccagccgctgagccgccrgttccagatgaaacgaatgcgtcctaaatcaaaatccctcaaaatccatatcaatttcctctaatctgtatagaacggaagtaatcgaacaagccaaataatagcagaaaccgcccgttttcgttcgaaaagtttaaccgtgctaccccacacacagcgcccacgtccgtgcacgcgtggggatgcaggatggcagctggggcccactggccgcgtcagggccacgtcactaaacgacggcggagccaaagcggcgtgggccaggctgatgagggctagcgggctaccagctcgggccccggcgccgctggacgcacgcggggctccggctatatgaagccacctcggctcgggccttctcctcccagcatccgtatccctccatcagtccctcgggccatccctagcttcatcccaattcttgttcgtgcagctgctcgtggcagcctgagaccaggcgcgagg

SEQ ID NO: 3634 - DNA, 1111 bp, Zea mays
ccccgtggggggcaagagcgctggcgctgcctaagctcagttggggagatcgggagatggagtggtagccgtttgatctaaattggatgtctaggaatagatgtactgcataccggttcaggatatgatttggaccctagatccagagatggatggcctagggtggtccatgtaaagtcgcatggtgtttttataaagaggccaccggaaatatgcaaatcgacctgcagtccggtacagttcgaaagaaattactaacagatccaaactctttcacgtaaaaccctgagttttttcaaaatgggaccagttttttctggtttctttataaattaattcaaaaaggtgattttcaatataaatataattctaaaagcttagaaaatcaataacttttgcattttaattctgaatttcgtggttctcgaacctacagactcgtgtcgacgtgtagtatcggtgtttcgagaccggggggtccctaagccgacgagtgaaatgtcgtcgcgtgccccagcccagatgggtcggcgcgaggccgagcgcgaagggggggggaagcgaggtggccggagacaggcgtgagagaggtggaaatctcgcggccttcgtgttcgtcccgcgcccaggtcgggtgcgcttgcagtagggggttacaagcgtccacgcggaagagggagcgagcggcttcaagcgagcgcctgtctcgtcctcgtccccgcgcggccaaccctctctaagagggctctggtccttccttttataggcgtaaggagaggatccaggtgtacaatgggggtgtagcagagtgctacgtgtctagcggaggagagctagcgccctaagtacatgtcgtcgtggcagccggagaggttttggcacccggttcgtgtggtgtcgtggccgtcgaaggagcgctggagcctggcgaaaggacagctgtcggggctatcgagtccttgctgacgtcctcttgcttccgtaagggggcggagagctgccgtcgtcagggagcgtgcggggcgccatcattgcctatctggggggatcgagccagacgggacgccggtcttgttccccgtagcctgagtcagcttggggtagggtaatg

SEQ ID NO: 3635 - DNA, 230 bp, Zea mays
gcccctcagcccctgctgttgatttttattttattgattattgattcactgccattatttttgtagtgactaaaatatgaagaagcagggagatattgcctctctttttcgcaatcatgttgcaaagaaacataagtttattgtgtcgacaccgcaagaacaagaggaagataggataaatgaagaaattgtgaatccaatgccatctacactgcctctgccaacacttt

SEQ ID NO: 3636 - DNA, 1287 bp, Zea mays
atagccgacaaggtgcttgctggactcggcggaagtggagtttatttatgacgccaacatcagcctcgtatctgtcgatctactcgtgccggagcacgaactgtaccggtggacgctggagattgtggtgtaggccgtgatgcgtgggcgctggcgtttgtcttcgcgtctgagccattctgagctagacgaccattgctattttgtgatgtgcacgagagatgtattgtggtgtcttgctatataattggtatggatagagtatgttttgctatgtctgtatttgtataccatgtgtgctctggatgttatataatactagataatgaaggttgttgctcctttaataggaatatcttctctaaacaataaatgttttcaatagaaatatctttatttcgttcttgtattatcaacttagaatttacctatttcaattaatagtgacattgagccaaattttggttgttcggaatgtcaaatttcaatattatttgttatgattgttgagttgattcttgatagcatcacaaaacaatgacctatgtgtgtataaacgtcctccgttgcaacacacgggcttatacctagtattatatagaggattaataaaacaatctatgatactatgcattgagatagttgtatcttatataatttcatataacatgttaactttagatattgtgagaagattagattgagaatagcctaagagccattgttcgtgatcggaattcggagcaaaatttatagcattcaaaggagcaagaaagtcattttccccctttatttatttttagttaagtggaatatggccacttccgcaattctttttatttagaactaatttgaaaacttaaatctccttctagatttccagaaattgagaagaaaattaagattttctctaaatctttagaaatatcagagacgatttaagtttataagggctagtttgataaccttatttttcaagggatttttattttctaaagaaaattagttaatttttcctggcccgtgtcgaaccgaacaggccctttttggcaaagcccacccaggcccatccgtcccaacccccaagaatagctggtggattcaggtccaactgtcatgtttacctggaacggcggcgcggcaagcggctacggccatatgccagccacccgcccgcggtaaccccctccgcctccccttcctctcctggcgtgcccccggcctctccctgaggccgaaagagccagcacgttctgctgctcgatcggacgtggggaagaggacgac

SEQ ID NO: 3637 - DNA, 388 bp, Zea mays
tggtttttaaaaactttgttcccaaacagggcctaagtgtttgacacagcagtttttgatggctataagctacgaaaagccgaaacaatcatgggcaatgtaagcccagaccgcgttcttggtggccctcggattcctttctgggagcccctcacacgggtttcggcgtccaacggtcacttgccagctgggtgaacctgaccgttacccgtcgtggcgcttctccttttccccccacaacggcttcatcttcatccgccgttcccccaccaattgtgttttcctttccttcccgctcccccaaatgccgcctcctcatcactagtcaccacttccccgcgctgccctcccactcccacacactttctgctgcctctcgccgcggccg

SEQ ID NO: 3638 - DNA, 624 bp, Zea mays
ccgtgagataaagctccggctagaaaaaacttaaaacacccgcctattcccatccacacccattttttgtttttgggggccttcactgccagtcccgcggagaactcggctccgtccctacaccgagggctgatttggtagatcggtaaatagatgggatccatgggagtgaaatcatctagctattcaaaattgaatagcaactctttgtccacccaaccagcactcgggatggatcgggggcattttgccacccctagcggcaacgaacatatttcagtgcgaatgtatgctgcaccttgtgtttcatttcagggcaactgaacgtgcattattgatggcatggcacgattggacggctgcaaagcatgccacctccgcccgagtgtgttagcagcgagccagcaacggtctccgagatgccagtccgctctatataaagtgccgacacttccggctcacatcctggcagtctggcactcgcaccgcacccaagaaaaccgccggctgccttgcaaaacagccaacctcacagctcacagtcacactagcgttgtcctctcgcggaagcaaaggcctgctggggtgcgcgtgtccgtccgtgtgcgcgggcgcgccacagcc

SEQ ID NO: 3639 - DNA, 432 bp, Zea mays
ggtctggttgtttggtcgatggagtgagagagagagagaaagggatcggcggccgcaccaggtgacagaggaggacactcgaacgtgagacagcaataaagaaagcaagaggtggcctcggagtggccccgtcccatgagccgagccgagcgacacagatgcacgcagcaggcttccccacagctgcttccttgcaggccggagggagggatcgaatcgaatagagccgcgctcagcctgccggtcgttttcccttcaaccaccgcgcgatctgctgcaaatcctccatgctttccccagcggaaaaaggagagatacagatactagctagatatattatcctcctgctgctgctgctgcacaccacaacaacccacccgccggtgcaagttcgtagtgattccatttcttttgtgaccagcgcaattgata

SEQ ID NO: 3640 - DNA, 1494 bp, Zea mays
ggcaacttttttttaaaatacatatgcaatttcgatcttatcatgaacatagaacacctaaatttgtaatagtgatctacaacaataagacattaaagattgcctcccacacttgcataagctcttggtccgaataaattcatttgtacaagctctagtgatattgagcattggataccttttctgtttataataatcctaaattctgtttaaaatgtgccttctttacgttggcataaaatttacacctggagacatggtgattaataaccgtgatttagatcttacctatcaccgccggggagagcatgcaacacgaggcactcgccggcaactgagcacaggctgataggcaagtcatcggtgtacggtatacgtaggctgcgacgaacgagagatggggcctagtagagtgggggaggcccatgttagatgggctgaaagcaggggacgggaacgtgggggggggggggcaacgtcttcgggttagatgcattcttttgtgatggaatatcaccaagtcccatcggcgctacaactttaattgagcatgctgcgtagccctaattaagaggcgcagtgttgttgctcctttttctctaaaaaataacttctcaggagaagaagaaaatggagcagagttgcaaagtcccagttgggactcgacatactcgtacttcaaaatgtttgaccaataatcagactaataactttcatagcaaatataatgtaaacttgatatggttgatcaaatataatatcaaataatcataaagtaaaacttaggagaccttacgatgttacactatgtgtatctctgtgccgtataaacgagattgaagcctaagggagtatgacttacaatctgttcccaaagtataggttcgacatcaatttagcttgattaaattctccaggagcacgtcttgattaaaactaaccaaactagagaacttaaaagggtggcatatattagtctaaacaccaatcgttcaacagcacaaatggtagcacttgttcgatgatgagaacaccgaacgcttcagtatttgcatccgagaaccaaagccgtgattcgcgtctgaaattctgaatctgttttttgctcgattggcaagacacaggtgcgttccgcctcgcgtcagtctcgctgcaacaaaccaaggtgggagtgcgacggtgcgaggccccatggaatgcaatggaaagcaccgggtgcccgtcccgtcccgtccggggtgctctcctctccctcttgctccctgccgcgtgccgctcctttcactttctgccgctggtattcttctacggagaaaaggagtggcaaaggatctcacagccgccaaggaaagcaaagcaaaaccgagtccacatcggtccaggtccacttgaccactaccgcggcgaccgcactccgcaccaccaatcaatcaggcgctggagtgacagcggcggcaacaccacgcccacgcggctgccggagccgaccccccg

SEQ ID NO: 3641 - DNA, 1087 bp, Zea mays
ggtgactcttccttacttttcttgctttcatgtattaccaacttcatggtgttgctatgtatctgcactgtcttatggtataacactgatgactcccactgaataaagctcagtatctgctaagaagtactctcattgtgcttacactgaaatgcttctgatataattaatagcatcaatcccctgcagtatctggtaccgcattacaagacttgttatggttacaaattatgactgcaagtcccttataacctagggcgaaagtggaatatagaaaaagctaatctctcaatataaccagtagctggtgtttacatcagcaacatgttctcagttgacatggatttggaattttggatagtgtataattatgtgattttggtttgcatatattcaagactgcaactagcacagtgcatataacttactcggtcctaatggtaatttcaaaagcttggtatatttataaggaaaaattcagaatttcatctcgaccttgaaaaatgtgcaaaatatcatagcttgtagactgttatttagagctcaattagtacaatgcatgtgctttgcgacggcacacaatcatatttgatacccataaaaaataaatttaatatcaaagtgaacatatggtccatatatcagatattaaacatttaaactgataagaacaaatattacaccttatcttagtcaaaaggccgagaaaggtataggtcactcggtcgctcgtcctcctttagctagcgaggtggtactatgtgggagcgttgcactgcgagtggcggcttcctatcatattgggcttgggtggtttctcaaggcccatctgtactgtaacgactcattgttaggtgagaagtggggaagaataatagacctatgcgcttcgcacgagacgctcgacgcacgaaactgatgctttaatagagtagagattaaaagatttcatgcaaagttttgatttactgattctgttcaataagcttttctatttttccaacagattgtgagtaggattaagaaagagtgccctaatgtaccccttgtgttgtatataaatggaaatggaggtttacttgagcgc

SEQ ID NO: 3642 - DNA, 1500 bp, Zea mays
gacggagggagtacaatctaataagatcctaatagacaactaaacttgaacagtttggttcctagccaaaccacaaaagatgtggctagaaaatttatagccacaatttaccatgtctaagcgaatatccccatacatttttactctttggtacttgatacatggagtcccgaagaatcttgcctaagttaagaccaaatgatgcaagggcaaaagcactaacctggactggaccgctgggcgctggccgtagaactgtagaagtagtgtgctgtgtgcctaggcggcctggcggacggcagcaagccagcaggcagcaactgcctgggccctgggcggacggccggacgcggaccgcggaggcgcggaggcgcggacagcgctcgagggagaggcggggcggggcagggcggcgcgctcaggtcggagatgaggggcggagtggcggaccggcggatccagagtccagacgggccttggtcgccctgtgtttcctcgctgcttccgggtccgggatctgctggagcggtggagcactggagcctggcggctagggttaggaggagtcgaggtctctggatttgctgctcgctggatgccggatagaagaggctggtactgggagcctgggtcctgggacgctggatcacggactcacggcccacggggccggctggcgcatgggagaataggatctgggtgcacatgttatatgtccaacgggtaacagatacgaataatgtcagatacagcaccttcagaaacaaaacatttcataatcctcaagcatccattcaaatttgtaagttcataactgggaccacgattccagattgaaggaaagcacatacagagacagcacaacacatggttggcccaaccctttgtaatttctccacaagcgagcaaaacgaacgagcacggaactgattccttatccgactaaaacacgcatgtccacgcagctaatgccatgactatgagaagaaagcgaggccaggccaaacgagatggcgcgtcggctgtggataagaagtgcggtaaatcccctgacctgggtgaactggatgatggcggcgtcgacgggcagtgacatggcgcctagaatcagtcagctattagggtcgcaacccgcgagcccgtacagcgaacggagggctgatcgtatggcgagcgatgcgtccggagtcgacgtaggttggacagcccggtgacggacgacggcgagtgctccgcgatttgttgcgacggctgagcgtcggggaattgagaattggggaatcgaccagaaaggagacgagagtgtcacacgtacatgggccaggagagtggtgggcctacaatacattctaggaggtccatcgaccaccccaaaaaggcccagaaggcctgaaaagcaaaaccgtagaagatcactacttcactagctagggttttcatccgtgacgaagtggtctatataaaaggtcagaaccgaaaccttaaccttattcggcgact

SEQ ID NO: 3643 - DNA, 217 bp, Zea mays
ggtagttcctgataaattaacaccacatatagatcacagaactttagttatggaactgaaatcgtcttttacatagtcaattttttatcatgcagtagatcacttgaatgtttgttttttttttcttgcatgcagaggcgcaagctcatacaagttgaattagaaaacattcgaacagaaattcccactttgcaaggaggaactagaagccgctgag

SEQ ID NO: 3644 - DNA, 1269 bp, Zea mays
tagggagagaaatctagattcctctaatatatgagtgggaagatgataggccttaagtatggtctagattcagctagaatcgtgttattcaagtttatggaacaccaggtacgacttccatttatattggagttaagagctcactgataggaaactaggatcttgctcttacctctaaccaccacaaacctagagatcttgataagattttccttcgggattggagttcgtagaagcagactaaagacaatagttaagtttgtgatccaaattctgtataggtgatcatgtgacgaacaaaacagaggctcgtcggctggctggtgctcgtggtttttccttttagattgaacggttttccacgtaaattgtttgttgtgctttctggtttattggttgatctacttagtcgattatgctaacaataaaaatctttggctgcttggaaaaaaggtacggtgaacttgggaaaaaacatttgggaatatttagaaaaatgtcttacacgctgtaaaaaaacaatcgaaaaatagctctagggagtatttttagtatttttttactctggcttctattttatagactacactaactctttgacatttgtttaggtactctagtattacatgacaggcgcccatcagcttgactgcttatgacaacttgacacaacagtcctatttttaccccggcagaatgtcagacttgtaatctagacagtggctagaactcatctggttgtaattatgttctcgaatacgcggaagaactgttacgtagggagtttgtaagtttaggtatctgttttatataactgttaaaaaagagtttatttatttattttttctaaatttatatttaggacgtaacgtaactattggacatctctgcgaagtgcgaacggacgctgtagtaactgaaatttagcgggccagaccgacagaacacatgggccgtaggaacaataagccgtttgggccagccttgtcaggtttctgcaaaacatgctctatagtctgtagtacaggggtgtttctgcaaagtttaagctttgtcagatttgagggcacgtagtgtcagatttgagggcacgtagcaggataattcaggggctcttatgcaaagtttgagccaacccatctcgccctgctatataataagattggtccctagggttttcgccgccgcaccccacgacttccgtccgagtctgagctcatctccacgcgcgccgccgccgcctcgcagctcgacgctcaccgcgcagcc

SEQ ID NO: 3645 - DNA, 569 bp, Zea mays
caggcataagttaaatataaaatagaattaaagcaaatcatgtatcattttaaaagtacaggtaataaggactaaagcaaaccatatatacgcacaaagaatttaataccttttggagttggtaccggatcctaagagggagaaggttcaccttccccaactataattggtgttgtatgtaacaactcaaataaggagctgacatacatgatcataaagtatacacttaattctcgaagaaaacacatgaatctaggaacacaaataaattacttactacttactactaattagctagctagatgctggggttatggttaatgaactacttactactaattatgagttggtagttcgcaataggccagtcagaactaactaagcccatttcttgagccttggccagagagatgccgcgtcacatactcacattgcctgctcacaagccacaccgagcggcgcacacggcaccctcttggatcgtgcactctgagagatgacacgacgcgagagccgtgccggggaagagaacgcgccgcaccggacagcgaacgcgaccaaaccaagcc

SEQ ID NO: 3646 - DNA, 77 bp, Zea mays
agtcccattctggcattaatactgatggccccgattaagctctgaatgcattgcacacccaatctaaggaggccagc

SEQ ID NO: 3647 - DNA, 378 bp, Zea mays
ggctgacccctcaaagatcatatagtggtgggaaattgcctcaagtaaggtgtattgtagtgaatgaagatggttgagtggcatggtgatttatatattctggaacctctagaaagagaaacagaagaatcttcaataacgcctatgaaacagtgatgcaggtggccgcaagaattaatagagcagagaagaagagtgatagcggactatttatcttttgtgtgatctttcttgctcctgccccagaggggtgtggtatttttgcttgtacataaacattccttttttcctatcttaattgaagggcagagatcctgccaaactttcaaaataatgtgaactatagtgtggcttcttgattgtttagtgaacagtctt

SEQ ID NO: 3648 - DNA, 410 bp, Zea mays
tgacggctggctgctacaaagccgagggcgcggcgccgggggagggatgctcacctcgagggctggtacaactcaaggaagatcaccctctcccttaagcgatccttttgggccaggcccggccgcaaagattgcctttgagccaaccgagccagcccatggaccttctgcaagttggggcccgctagtttatgagccgcatctactcgttggtgcgatttccactcgactcacacccggccgcacggcactcagcaccaattcgctggaggagaggaggaaccgtacgcgcctcattacgcccatccacgtgctcgcctctccccatcggcccatcgcataattttcctcggcggcgtcgccatctcatcggcggcgggcgtgcggccggtggccggagcccttaggcg

SEQ ID NO: 3649 - DNA, 1500 bp, Zea mays
aacaaatgaaatatacttttcatctagttagcgaatggaatatagcaaagtaatatgcaactccagagaacaaagcatggataacaaattaagcgaaacaattaagggccgtttggaaacaaagagaaatactatggttttaaagtcatgacacaaccatagtaatttttacatcaatccaaccaacacttgtttggagacaaagggtctgtttggttgtgttgtggccgtgaaaaaagttgttgtgggctgtgagcctgtgacctgtgaaaaaagctgatgtggactatgaactgctaaaaagctaaaactgtagtgaaaaccactaaaaagctaaaaattattccacatatttttacggttccatccaaaagccgctaaaagcaggttcagaggtgttttcagttttacactgcgataaagtcagatttttagaaaaaactgctttttagatccagccctttgatttaggttttgccttttagggggcaaaagtcaaagccaaaagccaacccaaacacacccaaagtatctaaaaccatggtatttagtgaacatatgcaagaagttagcattgtcatgaaaacttagggcctgtttggtagcaaagtatttttatagtttcaatgcaatacaatggtatatgagaatactatggtattctagactacagaaaagcttaaagccgagactcatcttgacccattgccattgcaagcagagttagtttactaaacctgacagatcataacgctggaaatatatcctctgctaggatagcacttaaatccgaggaggcactcacatcgacaatggcacccgctgcctcggtgagcaccggcgagatgtccagcagatcgcgcctgcgcagcaccataaaaagcgcacaaagcctcgtaaatctcggtagaaccgaagcatccgccaaactagggtctaggaacggaaaagcaaggattggagacagggccctagggcgattacagatggagattccggggcgcctcctgcgggagcgagtcgggcgggaggtagtcctccaggtttggccggtccagctccatgtccgccgccacagacgaggtcgccatcgcctaagggctccggccaccggccgcacgcccgccgccgatgagatggcgacgccgccgaggaaaattatgcgatgggccgatggggagaggcgagcacgtggatgggcgtaatgaggcgcgtacggttcctcctctcctccagcgaattggtgctgagtgccgtgcggccgggtgtgagtcgagtggaaatcgcaccaacgagtagatgcggctcataaactagcgggccccaacttgcagaaggtccatgggctggctcggttggctcaaaggcaatctttgcggccgggcctggcccaaaaggatcgcttaagggagagggtgatcttccttgagttgtaccagccctcgaggtgagcatccctcccccggcgccgcgccctcggctttgtagcagccagccgtc

SEQ ID NO: 3650 - DNA, 374 bp, Zea mays
atggttgcatcagtagagttgaccacttctcagtattgcgagatgcatcttacatggtcaagaagataattcctattctgagctacttgctcgtgttcgtgtacaagtctccttatcatgtcctcctttcaagccagtctattctttgcttgattcatcacgggtgcacattattgtaattagaatcttcagagtactcgaaggatagttaaagctgtttggctagtccttcagattactaaaaatatagttaagaacatttgtattttgctatttcgatttccaacagtacaactattggggatgattgcttttctttataaaagcaatcaagtaatttcttagctaagttctagctataagttctgcatgac

SEQ ID NO: 3651 - DNA, 1500 bp, Zea mays
tttatgcctaaacaagtgtgtttaacttagagataggaaaatgaggttgatttcaaaaacaaaccaagtggtggcaaagaatgatccaaatatgccaaatttgaatcaaaaacaatttttgttctcaaagtatatggatgtttgcacttctatttgttgctttttgatgtgtgggcataaatcaccaaaaaggggggacattgaaagggaaatgtgcccttgggccatttctagtatattttggtgattaagtgcccaacacatattgaagtaattatatgccaaatgatggatgaagtgcaaatcgacaagaaatgtatggttcgagacttagtacattggtttttgtgtactaatatatttgtctaagtgctagaatcaggaaaagaaaaggattggaaaagagttggctatgtacagccaacagctgctcagtctgggtgcaccggactgttcggtggtacaccagacagtgtccggtgcgccaggctggctctagcgaactagccactctcgggaattcatcggcggcgtacggttataattcaccagactatccggtggtgcaccggactgtccggtgagccaacagctgccagcgcaacggtcgcccacgcaatccgcgcgtgacgcgtggccccagccaacggtcggctgggggcaccggactgtccggtgtgcaccggacagtgtctggtgcgccaacggctacaattctgcaatggtcggttgtgccattttgggaaggagatctgcaccgaacaatgaacagtggatgtccggtggtgcatcggattgtccggtgcgccacccgacagaaggcaagaattgccttccaagaatgcctccaacggctcctagctgccttggggctataaaagggacccctaggcacatggaggagttacccaagcatactttgagcattctaagtcctccacactccgtctccgcacacttgattgactttgttagtgatttgagctccgttctagtggtgaacttgttgcgcttcatttgagctcaagtcttggcttgtatgtgtgtgtattgctgcggatttgtgtgtgttgtgtccctcccttactcttgtgctttcactttgatatttgttgtaagggcgagagactccaacttgtggagattcctcgcaaacgggaaaagagataagcaaagaagaacaccgtggtattcaagttgatcatcggatcacttgaaaggggttgagtgcaaccctcgtccattgggatgccacaatatggaggtaggcaagtattatacttgtcgaaccatgggataaactcgcgtgtcttttgtgattgtttttctgtgatacttgtgttcgcaagagctcgctacttagccgtactaacacttaacaaagttttattggctatttagttgttgaattttataggatcacctattcacccccctctaggtgatctcaattggtatcggagccatgctcttcatgaaagggactaaccgcctgaagag

SEQ ID NO: 3652 - DNA, 652 bp, Zea mays
ctgcagtttggatattgaaatcacacagtattcaaagtgaccatagaacaataattcaaaccgtacaactacattccaaatcatacaactacaatttaaatcatggacgaaattttcttcttcttcggtgtcattttgcgtacagctatcctagtttgccttggaggggactcagctacccttgcagaaggctgcgatgaaccggcgtcttccaatgcatgagacaaggcgagtggtgtctgttaccgttcaaagctgtcgaatcaacactcagatatggtctgcatccttgaagaaacccttttatgcatggtccaaaagcacagaaaaacctactgaaaaacacctttccatcctcttcttgaacatcaatctcaataacactatctggcattttttccaaaaccgcctccttccaactaaataatagtcgaaagctgtcctcccaagcaccatgcaaatcaagaaaggccttttctcttcccttccaaacggtgtcataggaaatggtacatttccatttgtcttgcaactctttttgtaactctttggcacccatgtttggtttcttcatcaagattggaagagctagtccagcaacccacgagctagtgggagtggtggtccttctcctggcacttgaagtacaagt

SEQ ID NO: 3653 - DNA, 1162 bp, Zea mays
aacccagtttataaaaattagattatcaagtttcttaaaaacaagaagttagcctctcatagcaaaaaaaaaacactagtttttaaaaacctaggttgcttccaaataggacctaatttgtgatgagtctggctagcttatagagcagctatgcatgcatgtgcatggggggcaataattttgcaggacggactttattggccaatcatgctagcggctggctagctgtgtgaattccgaaatccgactacgtgcagcgctgtcggctgccgcgcgccgccgcaattttcctcttctttggcgtggatgcagcatctctcacagctgcagcagctgatgcgagctgcttgggctgcagccgagagcagctacagcccgaacagctgggcctgctcgcctgcctgcctactgcctagcttcgtgtgttttcgctgcgcgccggtcgaagcagaaaaaagcctaggcacccaaccctcccggccacccgggctcgcgcgccgtcgtactcgtactcgtaccccagccccatcacctttctgatctgatccgcagtctggctggctgggggcagtaacatgacaaaaacccgcctgccctgcccatgccatgcatcaaggattcaccatgtggccacgtacgacgaatagctagctcgtagtactactagcagcacagcacgcaacatttgcgccggctgcatgcatgcagcgcatgcagagggttttcaccaaaaggatcgagatagagagagagagtgcgtttcactagaagggactgagagagaaagatagatggagaaagggtgcacaacatacgccgcactcctactctctgttacagtaccagtagtatatgccggtagatctcctgccggtggctttaccaaaatgaaataaataaaaaaaattcatcatgcggcgcaccaacaagtgagtaacgcctagggctctctgtctctatctccccttcaatgcagagagtaatgtcgtctctttccctgtctttcccactgccttcaactcagccctttttaaccacccacaaaggccaccactgcttcacactcacacgcacacgtatagctcgatcgctctctgtgtccgctcctcctgcctcctgcacacacatacactcagagagcatagtagcagtagccagtagg

SEQ ID NO: 3654 - DNA, 167 bp, Zea mays
ctagttcgtatctggaggaccggcgttcagtttctgggggaccacgctcgctagatccaggtgctgctcgtccgcccatcaatcagccgctatataactccacgcgagcaagccgagaagaccacaaacaaaccgcaaagcaagcacacgagaaaaaaaaaatcaca

SEQ ID NO: 3655 - DNA, 1500 bp, Zea mays
gtatgttggtctacccttatttctctttctatcgtatctgatagatcgatctcactaccggaaacagttgttttaccgagtgtctaaagcactcggcaaagcctggaaaacactcggcaaagaaagctcggcgaactgtacaacagcaatggcttctttgccaattactttttattggactgtcacccggtactcggcaaagaaaagttgctgtcacggcgccaggtgacagcgacggagcctgtgccgagtgtccacagagtgacactcggcaaaggctcactctttgccgagtgtccactctactacattaagaatcagtttccacgattgtatgatcctcgtgctccatacgtttaaatgtaaaatttttaaaattatgtacaaatgaggatttaaactatagttgttggcttttaaatctagattcacgtagaacacatatatttttatattttatacttcctatttataaatgaaaaccgcaacaatatactctcactagcaggcagatagtaaaacccagagttacgatgggaaataaaatttaggaaaataagtacggagcacgttggacggtgcgcgatagcgagcaatggtacgtgggcgcccgtgcgccaatccgccaaccagaaagaaggcgctactgtggtttggatctggcacgcagttttcctgtggatttatggcggtaatactaatacatacagcgtccgcggcacacctagtcatcaaaacagtcggcactccggcagtggtccggtgcgcgcgctcgcccctgcctgctgcgtgcgcaagcaagatggccaatggcagcggcagccactgctagtaagttacagtacgtgcaatatttcggtgcaaggcggcggcgttcgcgtaccataccaggcgcggaagccaggcccgctgctggaacaccaaactcatcagcaggcaggatcccggctcaccagccgaccggcaccgaggccgacgactgctccaccaccaccaagtcaccaacccattgggcattgggccttggtctgccttcctcgccgcgtcggcgggcagcttcccttccccaccggccaccaccagcaggcagcagcagcagcagctgcaggacacacaccacctttccacaagttccctttggctttcctccctcgccgcggcgtttaccatccgctcgcgtccccgacctttcctcgcttccacacgcggcgggccccagccgtggcaaacctgggctgggagggggagcgactaggactactacttttcagggcccctgccgtatagcccccccacccgcccggccgcccgtggagactactcagcgtctggagcgctataaatccgcgtcaccgtccgttgcttcttcttccacatccgtcttcctcctgtaaccagatctgaacccgcggcgacagaaacaaacgctcgctcgctcgttcgttgtccgttcattgtcttcgccggcgccgagggaccctgagagggcaggcgggcgag

SEQ ID NO: 3656 - DNA, 1500 bp, Zea mays
ctgatgggggtttaccagctgagattaggagtcttgtgggtacccctaattatggtccccgacagtagcccccgagcctcaaagggagtgttggtactcgcttggaggctttgtcgcacttttttgcaaggggaccggcctttctcggttacattttgttccggtgggtgcgcgcgagcgcacccgcagggtgtagcccccaaggcctcggaggagtggtttgactcctctgaggtcttaatgcctttcgcgatgccttggccggtctggttgtttcctcgtgcgatctgatggtagcccgggtgcatggtcgggttccaagttttcaggctggtctgttgacgctgtcaacggtttggccgtagccaggtttgcgagagcagcccccgagcctctgcatggagcgagaggacgatcaaggactgactcgacttttatcatacgccccttcgtcgcctttccacaatgaggaggggggaaagcgccatgttgccctcatagggcgccgaacatggtgtctctagtgagttgctaacaggtgatccgagtggacgcccgtgccccgtttgataagggtcagctaggtggcccagaggcgcgctccaaaagtacctgcatgtgatttgctggacccggtcccgttcgattgggtccgagggctcgatgcctccctctgatgggattccgttacaaaatcgctcctgctggtctcggaaatgtcctagggtacctcgggagtgtagcccgagcctcggccatgtaacggacgtacccagagtcatcccttgctctacgtggtctggggcgactgtcgaacccttcgaggggccagccttcgaactcctgattagtagtgggcgcggagcccgagtgctttgaggcggctgtcgaacccttccgaggggtcagccttcgaacctctgatcagtaatgagcctgaagctcgagtgctctggggcggctatcgaacccttccgaggggctagccttcgaaccccttatcagtaggagggctcagggcctgcttccttcgtggagaaggatccctttcgaaatatcccctttcacggtccctgttagcaagagagagaaaggggaagaggaaaaggatatgaatttaaatagtgtggcgcaccttttatgacgcggtcatcatggcggaggtgaaacgacgcccgcttcgcctgccaaaggtgtcgcttgccctgttgaggagttaatgcgacgagacgggcgattcgcggggcggccgttgctcgtgctcgagtcgttcgaggaacgggcgtttcgcctttgagtttgaatttcgtggcgagttcgggcgaagttttgaatgaatctcgcccgggcctttatatacccagaagaggggccggcggtggttctttaccctgccatttgcactcgccttctgctttggtttccgcaacctaaaagaatagccagggaaaagaaaaccgcgcacctcatcccctccgcctccaccaccttcgttcggtg

SEQ ID NO: 3657 - DNA, 805 bp, Zea mays
tagtttatttttcccttaacccctgtaatacccttcaatcccctcctacccaaagaaggcctcagtgttatattacctatcaataattagaaagcacgaacaacactcaccataaaggcacaaagtgaaagctgatggcctatcagctatggtagtctgttcacttaattttaatccgtatcgacttttactgtttttatatttttttgtctctagttgcaacattctaaacagctgactttaattcaaagtgaacaaccactcgacgagcacgagcacgaatcaattcaccaactaataacttggctttctgcagatatcccgagatctcatgagttgacatgaagatgaatgtcgcattgcttccggagtaggaatgagctaacaattgtttagttgaaggctccagcatattaggacaaatagcaacgacatacgccaatccctagagtagtgctgagcgcaagtccacggctataaagagaccataaattcagcacgaaccaatcgaccagtcccatggagcaagtagagtaggtgtcaaccgaaatgcacctgggagctcacgcagaagagagaagacactacggccacctgccctggcatcgagagctgacctaatccatttgcacttcgcgcgcgcgcagctcagcatcatgcatatataaatgtggcaagagccaggatgggctagctctgtgctctccaaatcagctgagcaaccaggccagttccaccaagctaaggaggtgagaatctctgtaaaacgctaaagaagaaaaaaaaatgaaaggatccagcgagc

SEQ ID NO: 3658 - DNA, 411 bp, Zea mays
tgtgaggcttttgggtcaataccactgcctcctaatcacaagtctgtgtggatttggttgccggaagattgattgatgcggccttcaggatcaccgtagactcgctgtgagattccaaggctgctcaggtcatgttgggggaccagtgcatcatacaggcgttagactcggttagctcatcaagctctgcccctgattcgaccctctccagagagcttccttctgtgagcaggaactgtgtgattgggagcctgcaggtggcgcaggcgcagaaggggggacatgtggagggtctggtgaattgttgtcatagcaagaagaagaagaataggactggcagtggtttgtgggattctgcaaccaaatcctggccttctggcatggggtgatgatgagaacagtgaggccaac

SEQ ID NO: 3659 - DNA, 1085 bp, Zea mays
agtcagaattgtgatagcagactgcaaaattatttattagttgcattagctctatgtcatttgtcaaagaaatgtggaaatgacacatagaagacgagaagtagcttacctcacttgactgaggatagtcagaagtttctggccttgatcctggttcaatgagtaaagcaacggttaatacaatacaacaggaagatatcaaaggattacaaaaaccaaaggaatgtcctcagttgcttctacaattgtgtaggattataggaagacatctagtagtcacaaaaacgaagaaaaattgtggcgtagcagtctttgacttgcatgccattaatgccaaccccagtgtttacaatgaagaaaataatattacccagtagactcaattcaaagaaaacattgagaagaaaaagtttggtttcaatatacttgctagttgtcacacctaagaagattccagttccaggtatgccagtttgattcaagagggcctaaggagtctattgctcaatttgtgcaaaacagaacagggcagaattaacatgtccagatctacacaactcagtcctttatggttaacagtgcatacaacgtattaaaaggtaatacacccaacccatggaaacattataagccacaagagtgcatgaccataaaagcccagtaggaaatccctccgttccaaattatagttcaagttagctttgtcctaagtcaaacttctctaattgttgaccaagttagtagaaaaatacaccaacatctacaacgtcaaactagtttctttatattttccatgaaatgtgttttgacgatgttatatattttttctaaaaaacccgttcaaagttagagaagtatgccttaggacaaaactaaagtgaactatactttttttggggaggggggggggtagcaattgatatgaatttgatagcaacatagaatatgtagttcacatggactctcaacaactttgagtactttcctttaaacagataaatgttaatcccctggtgtttctctgtgtttgttcttataagtttccatccttaagagatactgctttgaatgccatatttctgcta

SEQ ID NO: 3660 - DNA, 1500 bp, Zea mays
agacagtagaaaacagatactctcacatatatctacataagtatactaaccacataaacattttagaaagttggcgaaggacgactgtgaagtcaccgcaagaatttggatatcggagtataacctatcacataaaacaataatttgctaaaaacacacacacacacacatgacccatacggtgttagtactcgaatatgcatgcatggtgtacatggaacatacccaagtgtgccttgctgatgagaaacccatgttctaggggagatggcttgacgctaatgcctagacggggcatttatgagaataaatgtggatgtggcgcccatgcattttcgatccaaccatgcggaaaatgatagccagcattgtagtattaggagtagtggttagcgagaggaagtagggaggccgagctggtcgtgaggcggacctgctgagcgtgagcgggcgccgccgccgcccagcagcagaagtccggtccggtccatccagcggagccaagacgccgacggtagtacctctcaccaaacaaaggaacgacggaggcagcgcctcaatattcgtgtgataacgcctctgccaggcgcgtgggcccaccggtccccgcacagctcggtccgtccacctcggcagcattcactcgctggtcagcggccccaacggcytcggcctcggcgtcggcccggtgtggtgttggttcttccgttccattcccccgtccccgtccccgtccgtccccccgcccggctggctggctggcatgggtcgggtcggcattgaatcgccgcaccaaacccccgtcggatccagatcacacggccccccacagtctcgaccccatccttccagcacggagtcggtgacgacaaacaaggcaacaaaataagcggcccgccccctttgactgcgctccctgcctgtgtgcccgagccccagggcccaagcgcctctctctctctcatcagcagcgacaccggggaggacaggggagcgtcagcgccgtctccactctctctcgaccgaccccatcccttcccttccttcccttgccccccccagcctttttcatgcgtccacaccacacgcacgacgggactcttccttcgctggacgactccctgtgcccgtctcgtcgtctcctctcctcacctcccctccacccccacttgctattttgaccctcctcccgttcctttctttaatccatcatccgcctcgctatccctccctccctccctccctgcccgccgtggagggtttgggattttgcggacctcagcagctccatatctcagtcacacactcacgcgcgcgcgggggccgggggccgctggacccgccgttctccttctcctccccccctcgttcctctcgtctcaccactactaccctacacgcgccgcggctaggattccgccgaggagacgctgcgcgcgtggatctccggtgctgtcctgctagcgtgcgacgaggccaggcaggcgcgcggccggcgcc

SEQ ID NO: 3661 - DNA, 252 bp, Zea mays
catttatcaccaaatggaatgagcccaaatagaaaagcaaaccacaaaaactgtgttcggcccaaatgggacccataaggctcgcgcatcgatcgatgcatctagcggcccttctttccgtggcccaattaccgaagcccatcgcacccaaaatcaccagagcgcctctcctctccctctccagcagccgctcccgacttttaccttcctacctggtgctgtagcatccgccgcctcccgcagaacccgaag

SEQ ID NO: 3662 - DNA, 1500 bp, Zea mays
tatctgttgcatgattggtttgatcgcgaccaacataaaaatctccttcgtcaacccttcaacattcgcctgcagacctctatcggcatactcctcaaaatttccatgcaccttatctagttccagacaggaagtcataggtagaatgttcaaacacccatattgggtaaaccaaatgtggtaaataaggacataattgctttcactcaacagtgggaggtctttaccttgttaattatttctcacaatgctttctcaatggaatcattatggatttttttaaaatacgtaaggtggtgaaatatcgagagcttgtacttagcataatgcacccactggtacatactatgttcctatattggtaaggtagactaaattcgatttttgatatattttaattataagtcctagtggacttagtattctgaatcaaaacataaatgatagcatacatgtgtacaaatgaagtcactctgtgacttgaaatagtaaaatcaattatggtacaactagtgaattcctttcactaaaggatgtctcccatcttgatgattgcacctatatgtttataatgaaatccagctggattttatacatctcccatatgatgcatatcaaaacaggtagttatcatataagataaaacatttaggtaaaaccaaattatgcttaagcctataacttaagaacttacatcagtcctccaacactcaattgatattgtatatcgatatccaaatctactgtcgacacagatggtcattcaatctctaaattaaatatggattagtcgttgcacttgcagcctttctgggtagggatgttcctaagcctttctgggtagagatgttcctaaaacgtttgaattatgtgacaaatctaatattttaacctagatatgcatagaattttgtgctaaattttagttatgttattggaaatattatgaagggcaaaaataatttttttgtgtgcatccgaattgagggcaccgaaaaaggatgaaaaacatttgaatctgaatttgtatctgtattcaaattttatatgaatcatttaaaaagatatagaataatttgaggtttactttttataaatattattactctcaatgtaaaaaacaagaacataaatttatatagcaaattctatgtgctatttgttcaccattgaagaaaaaaaacaaaaaaaaacatctgaataagtatccattccgggctcaccgattcagcacgtgatgcgtttgcgggttgcgcggacgtggggcgggttattagccgcctctgtcatccccgattattgtgtgctagtggtgattatattatattattatagacagttctggatcgatatacgccgccgggcagttagctagccgccggggcaaagaacaggtgaacacgccacactcctagtcctagtatatatatacctagtatgtagtaccaaattaacatcgtcagagacacgcgtccaaacatacagctagatagcctctgc

SEQ ID NO: 3663 - DNA, 184 bp, Zea mays
atgtatctcatcctgggttgcgccttgataatgtgacaggcacgaaatggtagtgtaatttgatttaagtagttgagttttgtggaaacacagttcctggcacgatttaagtagttgagttttgtggagacactaaggcttagtttggatactctagtaatgagtgggattggagtggattgac

SEQ ID NO: 3664 - DNA, 145 bp, Zea mays
  unsure (1)..(145): unsure at all n locations
ggtacggcggcggcggctcctcgtgcaaccgttttctttaaagagagtgngctcgtaatattgcacttttacttactacagtaataaataaacaacaccggcaccgctgccgtacgtcgttgtggtaataaaatgggcaggtgaa

SEQ ID NO: 3665 - DNA, 249 bp, Zea mays
ggtaagttagacgcacggccggacgctgacggacggacggcgcgcgtgaactttggacccgcgctgaactcatttctttattccaccggcatggaaaaaataataattccttaacaaatccctcaccggggcccggcccggcccggcccgggtacgtggacgccgttttttttgtttttgatttgttgttgtattgaaggtggtgcatgcgggtaccagaacgccgtcgaccagccgcctttcgcgtcc

SEQ ID NO: 3666 - DNA, 1265 bp, Zea mays
ggtaggtacacaaccaaacaaacccctccatcctcccattcatcaacaaaagacccccaatcttcagtcagaacaaccccaaaaacaaaacaaaacaaaacaaaatgacgagacacccttcagaggcttcagtcatgtgaatgtgaatgtgactagccaaaccatccggtccatctgcagatgacttgacccagcctccagcaacaatttcgttttttagacggagcagtagagtacctgttatagaccgtcagcgaatttcctctttttttttggaactaacctgcgtgggcacgaccgcacgaggctagaagccagcgacctacagcagtagagcatcgctgaatcaggtggcaaatcaaaggatttgacctggcagtctaggctgccgtcttattttatccgtcaaacattttctttttttacagagaaaatgtctctctgtgctgtcatccttcagacttcagaggattgcaagtgtgtgtgtgtgccatcttattaccctgatggctcgtcatacgatcaaaccagtcttccacgtatcgttctccatttcccactggggccggactttatttgaacaatcccgtactcactttaatcaatgtgtattgaggtagattagagtataacttaaactaatttataccctagtctatttcaatacgtatagattgaggtaaataccaaacaatgtctgggagggatttaaaaacacccaacctgaaaataacataaatccgcaaaaacaatgacaaactacttgagggcttattcatttcaccgttaatccacgtggattggatgtattgagtcggtttaaattcgtagcaagttaaaatttattccaatccatttcaatatattctaatccacgtggaattgaaataaccgaacaagaatgatctatctagatgtacacccacactctttcctggcttgaaaaattaaacagactacaataactcaataagattacccagcatccagaaaaacgaatgtgtaaaaacaaaagagcgagacagagctgaggcttgggtcgtttggattcgcatgtatctacctcaatccctatgtgttagtggtttggtgtatattttaaactaaattctacacaccaaaccacttcatcctgcttagattaagttgaatactatatgcagccaaacaagacctgaatgtaatccagtgttggatcatcgttcgaggagaaataacagcatgattgattggcatgaaatctggaacaggtccctctgttcctg

SEQ ID NO: 3667 - DNA, 123 bp, Zea mays
cgtcctccttggataaggggataggcgcgaggaagagcggcctatccgcatccgcataaatcccagtcaaattgaacgagagcgccactcccctctgctaatcccagtcaaatcgaagcaagc

SEQ ID NO: 3668 - DNA, 173 bp, Zea mays
ggtgagatttcccgcgcccgtgccagcttgatcgtacgattcctgctccgtttattcgtccgcggctgccgtttcgtttttacttcgccctcttgtttaactaacttcggcttggcgtcgtttcgcagggagatttggttagggcaggggacgaacgagcgcgggcgtcaggt

SEQ ID NO: 3669 - DNA, 1500 bp, Zea mays
ttattaatttacgaagtggtgtttttaaaaactgcgcaataaaagaattgccttgtccgaagccgtgcacggaactgtttaattaatctcctatccaagcggagcagcaccacccaccttccgttccagctcatactccactcgtccatcccaatccacctgttcccaacttgaacttcccatataatagtcccatctcttggcacccggcccgacgttcggagcctcctgccgcaatttttttttgaggctggtctgtttcgtgacgtcccgcgagaagagaacccccgtggcccctggccgcgacggagcggtcagaagcagcggcggccggcgcggtttcggtttcctggttggcccgagaattccgattcctctcctgatttgtggtgcgcgcgtatatcccgtattcctttcggtgtcagttatttgttacgtacaatcctgattcagttgatctagtacatatagttgcctggaggccccgtcgctgtccccgcgctctctgtctcctcacgcttggctgttcgccgcggcgccaccgtcggaggcagctgctaatcgcgcgtccggtggccgcgttgcagcggcggagcgtctcttgttgtgcagtgctgcagcggattgtcgcggcctgcccgcggtgaggccggcatccctcttcggaaggcgtgctcgggcggggccagcccaaccgccgttcgtgcgctagagttcctcgctcaggtgaatctggcggctggtcttcatgttccaacttgattcgttccttcaggattgctgtctggatcgttcttgatttgctctgtaatgattccgcaaaatttggagctttggtttcccgatttggtatacttcttgtcacgtgctgctggttgtagttgtaggtgctgatactgtttcgtcttcctcgatctgtagcaagtttcaatctttgagacgcactcgtaacagtactcccatcatcctggagctggcgttacctttagctcgtcgtgcaagaattttcccatctcgggcttacaaatatatatatttaatctgcccatgaaacttgtagccgatcgatggagctgtggtgatactggtcaatttgatacggattacggattcctagttcttctcgggaaactttaagtgctcttttattggtatttattttgaactaattattaattgcagagtagtaggactgtaggagtatgtactagtagctgcgtttcttttcaccgagcaccctttccatgtcattttcttgattaccttttatgatgtcatgctcccacccacatttatttaacttgtttgcttacttttgccgttcccttgtttatgccacatgattgatgcttgtttcgtcacatggccggtaatatgcgactcttaggatgtgtaccttgtatcattctttaatggttctttggtctgctgcatttgtaagctcataacttctttatgatgtctgcctagaaagtggagaaataagatacatagtggaag

SEQ ID NO: 3670 - DNA, 97 bp, Zea mays
tctttgtggtttaagaaagctgcatgctcggctatatgcatccatgaactggaactgcatctcctttgtgtagttgagctcgtcaaggtgtgcatcc

SEQ ID NO: 3671 - DNA, 214 bp, Zea mays
ctgcagtcgtttattcctattcgtccaaaccacgaattccgtgtcatccacgtcaaaatgcagtcatgagagtgctcaccatcaaccctgaactattgacttgagagtatccttgcaatgaacaatagagactattattttcattaccatcaacctcctccttgccccagtctctaccatcaactttccccctttggattagattattgtcgca

SEQ ID NO: 3672 - DNA, 381 bp, Zea mays
gactaatttttagttactttattttattcactaaagtactaaatacggaaactgaaataaagttttagtttctatatttatcaatttagagactaaaatataataaatggagggactaaaaattaatcacgagaaactaaacacaccttaataatgttctctcgcaaatattgccaaatgtcaaagttcctgctctagagaaaattaggacaacgtttggctcaccaagagaaaacgacacgggtgacgcgcctctcagctaacttgacatgaatcacacctaaaccattttgtcgtcgtcgttccagctgcagtccagagttggaacccaagcgcacgcagcaccgtcgtcgaactcttcccttttcggcggcattggag

SEQ ID NO: 3673 - DNA, 1500 bp, Zea mays
ttggttaacttgtagattcctaaaagtctgattttaggtgtgatctgtgaaaaaactgttgcgacctgatggttgcaagagtatggtagcttggtagcttggttgagagctacacagaaaatctggtgtagaaggtaattataaatttaactagagggatacgtagattttcagtaatctattccactgttgtacttgtttgatttagatttcagtttttttccccaacgaatctgttcagaagagtgaggcacacccttcgtctcatcagtgttttggacttcgcatagatcatcttttcaactcaactcaaatttacgatcctgatgccatgcataggtatgttcatataaacgcaatgtctcattaggtgcaacgaatcctagacagttttacaacatataccagtcgttttttttccaagaatcaggcagcggtcattcttctttttaatggattatgggcctgtttgtttcagcttatagattatataatctggagtataatctaaattatataattcagattataatctagatatattataatctatatgtagttgtttggtagtttagattatataaatgtagattattcacaaagacaacaatatccttatttgtttatttgaggtgagaaaaaaggatcgtatatattgtaatttctatttacataaccatgggtagtgggtcttttaccaaaataatctcaaataagctactcttgaggagattatgagattatcataatatgggggtttagattatataatctgaacccataatctagttgtttgtttacctactggattatttgcgatggattatataatctggagagattataatcagaaacaaacatagcctcagtttgcaacttcgaagtatttgagtgtcattgtctcattgatcaagaaatcagaaatgtcaacatcatcgagaagattctatttcactgctcgcgaaaccgattgcgtggcgatctctggtcggactagtcgtaggattagcacactcgctaaaccaggcacatgcgaaactggcacgctgccaattgtgtgccactaatccaatccgaggacataacatagtccacgtgaggctggatccagcagtaggcactcgtgagccactaattcagcccgagggcgtgacatattttccatgtgagtcactaatgcgttgttgtcagtatcaatcaatcgcgtttgtcccaacgccgacctgttagtaggtcaggtcagtcgaccaggtcggtgtaatcagtaacgatcgatcgatatcgattatatgccttggatggaatcagacggtatcaacagattttagttgataatgatcgacagcgtggtcgataattcggttaatagctgacatggtggtccataaagacagaaaggtttgaactctgaattctgaaaacagtttcggcttgctggtgccattgcggttgcggcgccagatggtagcagcagccagcaccacccaagcacactggcaa

SEQ ID NO: 3674 - DNA, 350 bp, Zea mays
aagctcctcgtccagccaaagaaacaatacatttttttcttattaacaaaaagtaaccgaacaatgctgttatgtaaaacagcagcagtcggttaaaattcgaactctcttgcgaagcaaactgtgcaggaatgtttaatgatcataatgtgatggtcctgtaagaatcgtgcagttgttccaaatatgggttaaacttagtttacctgttacattgtcatgtggttgtgggcactgtgaaagctctttggccactcacagaagccctagaataagaatattgctaatgatgagaagtaactaaaacaatatcatacaattgcagtgctctctccaatagtttggagggt

SEQ ID NO: 3675 - DNA, 1500 bp, Zea mays
gagaggtgggcatgcggttgggccgacttacgtgggcctccagtgtccacggccacgggcaggggcagcaacacaaacccagaagattattaaaaaaaggcccgaatgacccgtcattcattttttgttttcacacgcaaaggttaagcaagcccattatcagaatcagagcaacacaacgccggctgcagccaggtgcaggaccacgccaaggcccacgggccgcggcgcgcgtctccgtgtgtgtggccgtgtggtaccagacaggcgacagcaggtgcaggagagaggacgggtggcaggtaggtaggtgactggcgtccgagtcagacccagcgcggcgtgccggcgtcgtggtcatctctaggaatccaatccgacgtcctgtcgcctctgtcggtcaggtctacgacccagtcctccaagctgtggactgtctcggtatcggtctcttggccgtgtccaaacgctgacgatgagagagagagagagaagaaccgcaggggcactggggcaggcccacacaccgcgccgcgcccccatgtgagtgtgcttcgctccccttgtttccttctccgcagtctgcgtgccgccgccgtggttttgccgttcgtcagctgtatacgaagggaatcccacgtctagagatgtccaaacgggccgcccggcccggtccggcccgggctcggtgaaggccggccccgttttgggcccggcccgccgggcacgttttaaaaaccgggccggaccggctaagcacgcgggctcgatttcttgtccgagcccggcccgcaacggacctaaacgggccgggccgcacgaaaaaagcgggccgaaaagcgagctatacgggccgaaaagcacgttttagtgtaaaaaaagcgggcttaacgggcttagagctaaacgggccgtgccgggctagcccaccgtgcctaatttcctgtccgagcccggcccgcttattcgtgtcgggctggcccgggcccgcatataaccgggtcgtgccgggctcggaccgggcccaaacagcgggcttcgtgccgggctcgcgggcctcgtgcttattggacatctataccaacagtcataataaagaaaggctccaccatgcttccatgtcatggatccaaataaagagaaagggacacttgaaagctgaatgcttgcgccaatatatttgcttccattcaaatatatatatatatatatatgatatacgtataaataaatatatatacttgtctttcccgtccactcagtcatcggagcatcagattctgcttaaacaccaagcagtgtggagacaataaagctgcctagctagctatcccttccccttcctatacatctctctctctctagctactagtgcaagagctagcgaacaatctttgcaacttgcatgctggctctttatctttatgtaactcatcgcctcataattagtatatataaatatttatatatataatcggctgcttagcacgtacacagcta

SEQ ID NO: 3676 - DNA, 1500 bp, Zea mays
ataagcctgtttgctgtgtttattgaatggataaggacacctatatataacgatgccatcgtcactgggagacatgacaaacaacacgatatatagagagagagtatgataaaggagggtttgtatatattgtgtctttaaccaagacgtatccttcaagattcatgcgttaaaaataaatccaggactgatctagataaatcaaatcggtttagactcagtacaaaactccctaagagctttattgttatggcaacctgcatagccgtcgacctaaatagaggcatgtctaatggctttaagatttcacttgttatccatttaaaaaaaatctttgactttgaatttacgctttggtgtaacaaaaagagagagagagacttcattgatatgcgctaagtcaactggcgtgaccatcggcctaagcgcggaggcttgtctaatggaattaacactacacacctttcatccattcgagaaaactattttacatttgaatttggatttaggccggcttttgtgtggcaaaagaagcgttttattgatatgctaaccgtgggacgaaatagaggagccattcgcatttgtaaagtcctctcatcagctgtacgtagacgtagccatataaacaattaatggtttttccgctacacgttaaaacctcgctgttagttactggccggtaacgtatctttcagacgagtcgagcagcagcctagcacaggttaaaaaaaaatcatgtctgcatcgcacggctgaatcatcgccagcgcaccaaaaataataaaaaaggggggcaatgcaagttggctgttagaattatgtggaggacgctgcatgcgattcagccgatttcaagtcgtgtgttgaatttttctcgccgcgaagatgagcacgttcgttgggaagctttggaattcaactccgggcgaggcgagaactcctcctcatcagggttttaaaaaacgaacgagcgagccaacttggcaggatggatcaggattcaggtcatgaggctagctccagccgacgacccgacgcagacgaagacgaagaccaccgcctcatgcatgtgctgctggtgcggtaaaaagcgcgcgccggcggcatcagtaattagtagtagcattaagacacgcggggattatatataataagtactccagctaattacacgcggccggaagagctgctaattactagtaactgctagtgctaggggcggggagcttccgcgggaagctgtcttccccagcacgacactggagttgctatataaagagacccccaggctcctcccactttcgcttctcctaaacccaatccccttccaccattcacwcgtaccgccggcggagaaggaaggaattggtcgccgccgcctgcctctctcctcctcctcctccgtcagtggctgtggccacgccgtgctaagctaagctaagctaagctaagcttgcgcaagtgacaagttctttggttggttggaggcagagccag

SEQ ID NO: 3677 - DNA, 427 bp, Zea mays
gaagataagataggagatgacatagttgcctcacacaaccttaaggagtagagaagagatgagaccggtgttgagctgcagagctggggcacatgaaggaatgctgggatggaatttggactggccgactggatctttttctgtacgacaaagaaaagctacagtagtgctcatgttgggccttgggccattgacgacgagccttacatcagacccagaactacttcatcccgcgccccctgaagctcgagcacggcagcaccgtccgatcctggatccaacagccgaaacccacccacctggaaaccctagcgccgccacactatataaccttctctcttcgccgtgctccgatttgacacacctcccaaaccctacactcccggcggcggcggcggcggcgcagcagcggcagcagcatccgaag

SEQ ID NO: 3678 - DNA, 1500 bp, Zea mays
ccgccgccggcgcaccacgtacacatatactccgatctcaatcttcccttaatttcccgtttaatttcccggtgacgtgaccggtggtcgttctccaatcggatcctccccgatcgctgcaacttttcgccattattacgtaactgctctcggcaccacgttcggtccagttctaaaaacaaggcaaaaaagaggcgacgatcgatgatgtggactgggytccttcaacaacctgtttgagctgttcaatgaagtggactgtggacctctctcgcgcgctatacccaaacgtatcattgcccggagctgatatacatcccaaccaccacacgtacgcttccttcgccacaaaaaacaaaaactttcttcttcttctttctttctttctttctttctttctttccttttcattcgaggactaaagaataaacaatggaatgcaatggcggttaccatgcataatagtcggttggtaggggaaagactatccaatggtattatatcaagaaaaagctcaatcgacttcgaccgacaaaagtcacgaaaattayccccgtgcagcataaggatcggctaaatccttattcgtgctttgaccctgccagccttacacaatgaattgccctctataggccagtccatctcatgtgcacacgaccaagggaaccagcaagagactacccatataggtcaaatttttactcgtgttttgattcatcttatccttacatgagcatctgtcttccataggccagtccatctcgtgtgcacacgaccagaggatctaacaagagaccaccctctatagaccattactcgctctttgagccctcccagccttacatgaggatccgctagacccatctcatgtgcgcacaatcagaagaactagcgagagaccttttgtaacctagttcaacataaaatttgcttccactcggattcaaactcagcacatgaaaagtgttactcatactccctttatagtttcctattagttgccgtttagaacagcgacacggttcttaaaaaaataattttaaccaatatttttttcgttaaaatacaaataaactcttaatacatttatacttttataaaaaaaattaagacaaatcaatacatataaacattaggttttaaaactaaataataaaaccgttatttgtagtcaaaattttataagtttaacttaaatcttttccaagtaccaactaaccaactcagttagagtaccttttgcttaccatacataacaataaaatactttcttcattcttttttagttgtcaattttagttaaaaatgaacttacggggcgacacaaatattcgagaacggaggtagtactgtataccactgtacatgtacatatgcgtgcgctatactatatacgaatagcatagagccagtcaataacacacgcaactcacaagaagattctcagggagggatttctcaactgtattctactcgcaaacagtttaaatatacatactc

SEQ ID NO: 3679 - DNA, 337 bp, Zea mays
tgatagtcaaacaactaatttttaatagctaactattaattttagaagttccaaacagattcataatcatagaataggtaaataaacggggccataatcatgtggaaagcaaaatcacatgaagctagcacatctcaccagcttgtctccccacgctccgacttcatcacgctaataatttaatcaccatttatttactcgctattagtccctctccctccatccctcccgactccgtctccctacccttcccccctccgccgaggcgaccagccccgtcaatccgagactcccacgcaaaccctagccagctagctagccacaccggctgggtcca

SEQ ID NO: 3680 - DNA, 1500 bp, Zea mays
acatgttattaatggggatgtatgattatatatattaatgagtatctgttcgaattgtaagatcttgtgatatttttaaagatttgtataagtttgtaatttattgtgataatcttatcatttaaatattgtaattgatattacattattaaaatcatataagaagtctgcatggtacttatggttgtactggtgaaatagctagattaaaaaaaaaatctacatggctaagatcacaaatgaattacaaaatctcacatatttatatataacgtatcatggtattatatgttaccgttgcaaagcacgggtactcacctagttgttaacatatgaaataaattttgtatcatatcgtactcgtataaaaaaacaaacacagtttagtgtcagtggaactaaagttaagttgaaaactataggctttcttgggatcgaggcctcgcacgttggagatggcagggggcggaggctgaggaggatacacaatattctggtggttagatttgggtaataaaaaaagaagacttaaaactatccaatatgcttttgactgttagatttgagtgaagagaaagaaaaaaagattcacaagaagattttgaccattagatttaagtaagacatcagaagactcatgtgacacgattttgacataaaaatattttgacctccaaatttgagtaaagagagaatattagattttgattgatagatttgagtaagaagagggaagattaaattttagggtttagggtttagatttgagtaagaagagagagaatattagatttgagggaagatttgacctccaacatgctctatattaaattttacactacaaaatttaagtatcaaattggattagaaacgaactctatttttatttatttttaaactaaaattaattaagtaatgaaacttataacgaagaaacatttaggtcatgattcattgccgcctctgcccgcaatccaaatagatccagacaaaaatataataaactacaaaaatataaatctgctcgtgctctacaattatgaaataacttttatctttatctgagttacgattgtaggccatgggagcacactagctttaagctgtctgcattggggctgccgcagctggtgaaacctttggaatatcatcatcgaagggctggcagcggacagcggtgtcatgtgtacgcacatgatcgagcaaaggaaaccttcgttggtctttgacgaccccagatccgagtgacgcgaggaaggagatgagccatgcagctcgtgctcttcccaacgaaaccaacactcggatcatcaaaaggctagcctgccgactttgtctttttctttcttacttttttttttccttttgtgcctttgataacgtggcatcgaacaagttaatcctccagctactaactaatcgtcagtggaggcagccactgcgcacaagtgctcgacctctgtgctgcccttgcttgccgcaacagagacagagacagag

SEQ ID NO: 3681 - DNA, 312 bp, Zea mays
tgtaaaatgtactttctacctggtgttattagatggcagcaaaagcataaaatgcatcaactgtaatgttggcttctatgttcttttccaggcaaaacgtgacgagctgctttagtttgctcagggtgcgatctcagggctaaagataaatgctgacattgcaaggttctatattttctgttgggcagttgaaggtgtttgtagttccatttttgcgtgtccatgttttcatgctttaaaaattaaagcctcttttttcttgattccagattagataatgaaattactcagttgcaacaacagataaattca

SEQ ID NO: 3682 - DNA, 228 bp, Zea mays
agtctaagtccattgaaattttgctcttcccctaaacatggaccctttttgtggctttcattatgctgagtagaggaaaattgggattccctttctagttatgtaatttcctacttgttggatgctggttttcaccagcatcagtatttgcagccattcaaatttctatcagtgttggtgatggtgtttttttttttggcaattgcagtttggttcactcccaacaaa

SEQ ID NO: 3683 - DNA, 549 bp, Zea mays
ctgcagctcacactgtgagagcttcagttcacctgccaccgcctaccgagaagagatcagcgccgccgcgcgcgaagtgcttcactggggaggagcggagccgtgctaaagttggccggccgtgcccggcggcctcacgagctctccctcgttgctctacgccggggctgggccttgtcctcgtcgcgcgtacgtgctcgccgccgacgcggcgcctgctcgctgcccgtgcggaacaacggtggcctgcgcgcctcgccgggccactcgctcgtcgcgaacgagagctcggattgtttaggaggcctcatccgctgtcctcactcccctggcgagcaaaatccctcttgaaattccgaggcttcgcttgaggatcttgctctccagagctcatctgagttccagatccgtttcgtccccgccaccaatttggtgcgctcgcgagattctatatcaccggagaaaagccggtgtgctccgtaaggtcggacatcctgagattcagttgcgctaaagaagaaggaagacgcgcgcgcgcatgacgggcaa

SEQ ID NO: 3684 - DNA, 362 bp, Zea mays
ttaatcttgaataggagcgaataaaaaatagctgtctgtgtgcctgaaactagatttgtggcttctgttaggtttcaactttagcctacctcaacttgcttagcaaggttttgttgttgagttctaggcatttgattagtgcagctcctttattcaaaggtctacttgtgaaggggggatttctctatgaacttttggagcgtttccttttctactaaatcaaaataatatggccaatatcgtttcctgttacgaaacatcaaaacagatgcttcttttcttcttgtgccattgtgaaaatacatcacccacttttcaaacggtacaacagataaatcaatctctaacctatttattgaaat

SEQ ID NO: 3685 - DNA, 605 bp, Zea mays
ttaatcttgaataggagcgaataaaaaatagctgtctgtgtgcctgaaactagatttgtggcttctgttaggtttcaactttagcctacctcaacttgcttagcaaggttttgttgttgagttctaggcatttgattagtgcagctcctttattcaaaggtctacttgtgaaggggggatttctctatgaacttttggagcgtttccttttctactaaatcaaaataatatggccaatatcgtttcctgttacgaaacatcaaaacagatgcttcttttcttcttgtgccattgtgaaaatacatcacccacttttcaaacggtacaacagataaatcaatctctaacctatttattgaaatatgaagccttccaagtccaagtggagtgtctttgaaatacagacatcaagctgtagtagttatgttgcatctaccgaactaggactaccgagcattttaatagctaactatatttttatcttcactataatttcaggtaaaagccgtctgaagtatgagatgaggtcttacaatgagatggtggtgattcaaatgaaacagatgagtgaagacgaccaacaactgaattacctgaagaactag

SEQ ID NO: 3686 - DNA, 988 bp, Zea mays
ggtgccactggtccttagatgttagtataatatagttaaataatgtagtagtatttagtagtgtagagtagtatagtgtagtgtagaagtagtagtagtattagtagtagggaagtatcaactcataatgggttgatttgtaagtactattacttcccttgaatgaagaatgacttcgcctcctcctgtgtccattgttttgtttcgtagcaagttgatctcttttttgcgaagttgatttcttcagaatagaaactaagtaactcgggcatcatattgccgctttggaggtgatggccgagctattgttgtcgatattttacgcatttgaaatagagtccgagtgatgacgaaaccatgtcagcgtcgggatgacagtttgaccacgtcggctatcttagaggtgacagccgagtgacttgtaacgacgccagcgttttttagagataaccgccgagcgactgaggacatcgtgggcgctttaaaggtagccgtcgggcgactgaagacatcgtcggcactttagagataaatgccgagcgactggagacatcgtcggcgctttagagataaatgccgagcgactggagacgtcgtcggcgctttagagatagccgccgagcgacttaagacatcgtcggcgctttagggataaatgtcgagtgactggtgataacatcggtgttttagaaatatcagccgagttagaacgggccgtgtcggccacttttgaggataatagccgagtgacgatgtggcacgccggtgttttagaagtaactgccgggtgatgacgtggcacgccggcgttttagaagtaactgccgggtgctgactgggcgcttttggaaacggtatctgactcgggaatatcccgcatatactgcgctttcagccgcctctgctttctgtgccctagttcttgcttttcctgcctcaagatcttctctgcaattcggctcccgctttgttcgcaagtagagttgag

SEQ ID NO: 3687 - DNA, 754 bp, Zea mays
gcgaatcgccttttcgtgcagtggtgagtggacgcgtccattattccctggatggatggatcggactttgtgagtgcacaacagccacatgctgaattgtacacacatgcatgtgtgtgccgtgtggcggagatgaacaatgagtagtgaattcgtctctcggatcgattaggccggcgaagcgaagatcgacggagatactaatcggtcggccttcatctgcggttaggtgattaattaggtgggggtcggaggcatggccatgccgccgctctgcacgtaatgcatagcatgtattgtatgtatgtatgtatgtacgcgcgctcgtgcatcagcagcgcgggaatgactgagtgagcatgatgacaccatgcacatatcgccgtctgagctcaccgcgcgcctaacaaagcctgccacctggcttcggcacactacccaagaaaagtctctctctttctctctctcctagctagcccccgatctggccctctctctcacgcgctctagaactagaagggcatccgcagaagttgaccacgtacagcagcggcagcgcgggctcctcctgttatataacgcccgcctctcgccgctctccagcttcttcttaatttctcttctatgatacaggggtaggagaaggaggaggaggagtagaagcagctccacacctgtacgtagctgccgcgcgccggtgagcgaggtcgttcttgagagctgtatatatatatatagctccgcgacgacgccg

SEQ ID NO: 3688 - DNA, 381 bp, Zea mays
gttgataaattagttgctttatctagaattatggatttggctttggataaggctaacagggagataatactccctgttattcaaagaagtgtgactggcgggaggaacaccgggcgtgtaggagtcatcaagaacagggagaagcacaagggcagctttgagaccatccatgtgctgcttggacctttttgctatgtctagttttctcctatttgttgtataggaaaacatagaatataattcaaatttggtggtcgcaaaagtgtggagactttaattcatataaagttaggcttaacattaatgcaaacagttgtattttagtttagatttagagtacacttatgtatgcgttgtttgacaatgcttatgatatattga

SEQ ID NO: 3689 - DNA, 881 bp, Zea mays
tgtcatgatacgacaccagggtaatgagaatacccaaaatatgaaaaaatgttatgaatggagagaggacataggctagatgtgcactgatcctagtggagtctagtactagtatgctagaaactttggtaggtttgggccttgaaacatgtaataccctatgttctcttgtgtgtaatggatcgatgaacacaaatgtgaagaatattataagctcaagtacaacaaagcaccatgacctcctagttctaccttctcctatggttctgatgagagttctagcctaatatgtcttcccttagatgtttgtcggtgtttcgagaccggggggtccctgggccgacgagtgaatgtcgcggcgtgggcgagcgcgaaggggggagagcgaggcggccggagaccggcgtgagagaggtgggaatctcgcggccttcgtgttcgtcccgcgcccaggtcgggtgcgcttgcagtagggggttacaagcatccacgcgggagagggaccgagcggccccaagcgagcgcctgtctcgtcctcgtccccgcgtggccaaccctctctaagagggccctggtccttccttttataggcgtaaggagaggatccaggtgtacaatggggggtgtagcagagtgctacgtgtctagcggaggagagctagcgccctaagtacatgccatcgtggcagtcggagagattttggcacccagctggtgtgatgtcgtggctatcggaggagcgatggagcctggcggagggacagctgtcggagcggttgagtccttgctgacgtcctcttgcttccgtargggggctgagagccgccgtcgtcacagagtatgcggggcaccatcattgcctatctggcggagcgagccag

SEQ ID NO: 3690 - DNA, 935 bp, Zea mays
tgtcatgatacgacaccagggtaatgagaatacccaaaatatgaaaaaatgttatgaatggagagaggacataggctagatgtgcactgatcctagtggagtctagtactagtatgctagaaactttggtaggtttgggccttgaaacatgtaataccctatgttctcttgtgtgtaatggatcgatgaacacaaatgtgaagaatattataagctcaagtacaacaaagcaccatgacctcctagttctaccttctcctatggttctgatgagagttctagcctaatatgtcttcccttagatgtttgtcggtgtttcgagaccggggggtccctgggccgacgagtgaatgtcgcggcgtgggcgagcgcgaaggggggagagcgaggcggccggagaccggcgtgagagaggtgggaatctcgcggccttcgtgttcgtcccgcgcccaggtcgggtgcgcttgcagtagggggttacaagcatccacgcgggagagggaccgagcggccccaagcgagcgcctgtctcgtcctcgtccccgcgtggccaaccctctctaagagggccctggtccttccttttataggcgtaaggagaggatccaggtgtacaatggggggtgtagcagagtgctacgtgtctagcggaggagagctagcgccctaagtacatgccatcgtggcagtcggagagattttggcacccagctggtgtgatgtcgtggctatcggaggagcgatggagcctggcggagggacagctgtcggagcggttgagtccttgctgacgtcctcttgcttccgtargggggctgagagccgccgtcgtcacagagtatgcggggcaccatcattgcctatctggcggagcgagccagatgggacaccggtcttgtttcctgcggctcgagtcagctcggggtagggcgatg

SEQ ID NO: 3691 - DNA, 419 bp, Zea mays
gcaaccgtcgcattcaaagcgacggaggaaaaggactctacaccaagtaggatccccatcgacgccttcaagctcgacaacgaggaaatgacactcatcatcaagagctttcgccaaatcctcaagcaaaagaaggggaaggactacaagccccgctccaagaaagtttgctacaagtgtggtaagcccggtcatttcattgctaaatgtccattatctagtgatagtgacagggcgaggacaagaagggaaagagaagagaaaagaagaggtactacaagaaaaagggcggcgatgcccatgtttgccgggagtgggactccgacgagagctccaccggctcctcctccaacgaggacgccgcaaacatcgctgtcaacaagggtcttctcttccccaacgtcggccacaagtgccta

SEQ ID NO: 3692 - DNA, 471 bp, Zea mays
gcaaccgtcgcattcaaagcgacggaggaaaaggactctacaccaagtaggatccccatcgacgccttcaagctcgacaacgaggaaatgacactcatcatcaagagctttcgccaaatcctcaagcaaaagaaggggaaggactacaagccccgctccaagaaagtttgctacaagtgtggtaagcccggtcatttcattgctaaatgtccattatctagtgatagtgacagggcgaggacaagaagggaaagagaagagaaaagaagaggtactacaagaaaaagggcggcgatgcccatgtttgccgggagtgggactccgacgagagctccaccggctcctcctccaacgaggacgccgcaaacatcgctgtcaacaagggtcttctcttccccaacgtcggccacaagtgcctaatggcaaaggacgacaagaagaagaaggtaaaatcaagatcctccactaagt

SEQ ID NO: 3693 - DNA, 436 bp, Zea mays
gtcgacctgcagtccagttcttgaatccaggtgagttcaatgcaacgcccaaacttctttgccagtcttgttgagtgtctctcaagttcttgaaagattgagcgttttcagcatctttcgtttggttttaatccgtatcggtttgtacttgtctctgtggatttcaaacaatcgactttaatccaaaacgaacatgccattttttatttggtaaatgttggcccatttgctcttttaactgactccgccctgcgatgtgagaatcagtattttcgcggaagataggctgattcgatgggcgcgaccaccgattccctgtggttcttgcgcttgactctgtcccgagacgcctgaaaaacgcgccctttcccgtgtctaaactatttgtttcgtttgttctacacacagagctgcgattcgtgctcgcctgacgccg

SEQ ID NO: 3694 - DNA, 1402 bp, Zea mays
cccccccccccccccacacacacccaaaaaaatccctcccagccccttggtttggggggggggggacgaacaaggcctgaagtggtacaaattctttctgaaataccaatttatttcaaattaacagtagacatacattaacatctgttaggatggaaatatgttaaccgtggaacagagacctgataatctgttgcaatttggggtaaaagttgcatggtgatcataccaccaaaatttctgctgactgctgaacctattttttccaattggcttggggtcatgaaattcgaagctaaagtgtttgtatggtttagcatggccttcagcttagtacatagaagatggatcggtatcaaacatctttctagaatgaggtagtagagcatctcggctcatcatatttactaaatagaaaaattgaatgttttggcggcacttaggctaagttaagggagttatttgggattatgtgcaacaaatattttttgcaaaaatgtgttgaaattatggtcatacaagagatcgagtctgaaacgatgatatacgtgataagccagaggtagccccaatagaaaaaaaagtttggtcaacatctattaagatggttcggatatatccaacaaagattttgacaaaagtgtatagtgagattctaaggtatgataataatagggagagacgtagggaaatgtcaaaattgataggaaaagagaaattaaaaagagatttaaaatgatgaaatatatctaaatatttagtcttgaataggaacgaatgaaaaataattgtcgaaatacatgaactttaatctgaggcttttgctggatttcaacttagtctatcctaatttgattaggaataaaaagctttgttgttgtttggcagcactaaaactgatgcatcatatcagccatcctctaatgggcatggatgcattactgctgttggtcgaccagttgaggcgtgcatgctgcattaatgcatttttttccactttctgaaaagaaaaggagaaaaaactacactaatgttgggtccttttgggtgctaggaactggccaacgaattggagccgcagattcggcaacatcttctaacgcttgtggatgctgttgaagatattatcattcgagagctgcggtctcgttaggaccacgctgtcgacaggaatagctttgggggataatagacagcctctactggctcgtggatcaatgtttcactttcacattttgtacagaagcgactctatcaccgttacgcatctacggctgatttttttagtgtctggcgcgttgccagaaaagagaatcttgttcaactttattaagtttgaaccgtagcaaatttgaccagtcatgcctgattcctatacttgccttcatccttttttggcggc

SEQ ID NO: 3695 - DNA, 1500 bp, Zea mays
cgagacaccacgagctttgcgagatttacagttggacgttgcgtggatgccattactacttgccatctcaaatgccttacgatccgcaaattagcaggggcttttgcgctttaaagcgcgaaatcatatatagatttttttttgctttgagtttttaaattcgcgaggaaagagggaaacagctttgtccgggttgctttggtagggcgactctgggctgtccatttctgaaatgtactacacctgacctgagcctagtgtaggtgtgtgccttcgcccagttcagatcgtgattcgtgtgagcttgtttattcccatactactactactgcagggtgcagggccatgagccatgagccatgaccagcgttgtccgggtgagcagggcagattcaggcattcatgattcgagatttaattacaataatactgaggtgagggcgctctgaatggcactgaatacctaccataggaatggaattctttataaactaccatgatggcgtgaagagtgaagaccgaacttattcaaccgccaaagccgggtcaagatcagttttcacctttcactggccctttctttgaaggcctggatattccccttctatcctattgcatgatctggaatagaagctgagaagtcagatctgcagttacagtagcctgaaataaaaagatgagcggttagcgcctttaatttacgcctccaggcagcagagaacccggtcagaggcgacgaacaaggcggcagcgcggctgctagggtttccaaggtctgcttccttcggtcggcagcatccctcagcccttgggattacaaaagaaaacccccacgtctctcccgagaggcactgatgacaataaaagaaggaactgaactccaccacctgtctgtttggctaccactccccatttctacgtactccacagtactatttctctgttcgaatccactggcccccacgaggtcgttgcctccctcccccctccctcccccacccccacaaaaccctctacctctgtcctctgccactaaataagcgagagccccatcacgtcgagtcttggatccttgaagattctgcgccatctcatcatctctctcgctgggtcctattcttggcaggcttttgcgcttcctgggtccgtccagatgcgcaataccagcagttcctgaagtttcaggacccgccggctaaaaggtatattactcagagtctgcaaggcagattggcctgttcttctattctgggattgtttttgtactattttgtttccttctcctggacgccaaccagtcggctagagtagacgcaatcttaaatccacattccgtgttcatggcgttgattcgatcgaaatagacatcttcaaaagccgcgatcttcctttcttggaagttggaacctatgctcgtttgacttgctgtctcacgcacgcagactgaagatcacagacgctcggagtcggacgccgcggctgactacggaatcttaagag

SEQ ID NO: 3696 - DNA, 140 bp, Zea mays
aaaaaaaaattgtatctgcacaatccactcttcgtgcacaattagttctgaaggatccataccagactacgcgaatcgctcgtggattctgaacctgccatggcgccctgctctcctttcagaagcggactccaccaggc

SEQ ID NO: 3697 - DNA, 1500 bp, Zea mays
aagccattcctttgcagtaacttctagccactggagtgtggagaccggctggcagctacttttctggaagttaatgcagaggattcaactgcatatatgtgtctcccacgtcttagacatgtgttctgccagtcctcaactccaccagtggtacgatcctctctgccatgtactcacgtctgtcgatgtccctagtatcagccatggcagctactagctagtaatccaacttctttagtccctcgatgacctagcacccttcatttacactcctgatccatcaacacaaaaccacgtgaatttcacttttattgttgaccactgtcaccggactggacaccttgcgcatcacaagccaagatatatgcatgttgcacagataagaccaggttggttcatccaattcaacccaaggcactactatactgacaatcactcatcacaaaatcaaaccacaaggctcatatcaaccttgtattcaccataaatcattttattccttccgtgaactagcagctagtttctctgctgttacactgaattttagagagttatgttcagtcagttcttggcgtcacattttttttttctgaaggcgtgcttctctttaatcgtgtttagtttgtttagtaaaccagttagyagtagtgtgataagcttattttcggcggctatggtcctattttcggtggcctctagccaccgaaagtgactgtacgtgctgtagtgaaggttctttagtttgggctttgctttggatcttatttattttgctttcacagtaatctaatttaagtcctagttgttcctagagtcaacgtgccataagttggtttctgtgactttcataggtagaacagaagtgggtcaaatttggaacaggtcaagtttttgcgaagaatttttaattgactattattcatttttcttctttatgatcactattttggtccgtggatttaagactcattcgtctctctctagtgatctgttcagtcttgagtgcccagacaggtcatgggctcatggcagctcatttcgttcataaaaaagtttggtatagacttacgatatgtacgcgtaaaaaataagaaaatcaagagggccacacgggcttaccagcagcttactcattcttacatttatatttaaattttattttgcgaacattacagtagtctaagctgtagaggtgtagaatagtataaaaacaatgttttgaataaactatgtataaactgctagacatggttggttttattagtgtaacatatgtgcttaaacaaatcaatgattttgtcctagaaaaatcagtaagaaatttagtttaatgaggagaagatttacagaaactttatgcgacacgcatcagcttcaaagccgctaattttgaagaggaaaacgtttctggaacgcactgtccggaagttcctgcttagcagctgctgcaaataaaatacatggcgcgggtgcggctttgcagagcgcaaagcaaacacc

SEQ ID NO: 3698 - DNA, 757 bp, Zea mays
tcatttgtgattagatggataaccgcgcacgagataaagataatcgctggagttaatctcatcgcgggagcgcggaccgtccgagatccgggtgttcaacacatataatcggaccccactcgtataactgcagacctgtagttagatattgagaaaacagtactgtatgcatatgtatgttttttagagaaactcgtgaaattcagtggaagttcttttataaaaaacctgcatatatagtatgttttctttttaaaatagatttaaataaatattagcatatggtctatgatcatacatctatggagtagagaagaaaaaattattattgtagaattatatagctatgcattagtgtgtattaattatagaattttgcttttttttggccgccaccaacttttttgaaatttcagcgaaattttgaccaaactgtgaactctctctggctatatatgataagtccacaacatgctcacatcctcccatctcaacatcaatacaatccacgcggtaatttataccgtcagcttagtgttatactagtagctagtcttcttctatttagcctcggaccgcaccgttggccccgcgcgcgtacgtacgtgtgtatataaactagccgcgagagtagctagctacttcacgagcaagtcgatcggtcgagcagtgtggccagcccatcacatcatcaagtcgattgcaattgcaataatactactagcttgacgccggcgttgggggtgcgggcgacgtg

SEQ ID NO: 3699 - DNA, 805 bp, Zea mays
ggccaaatatgcatgactactactggttttaaacaacttatcgaaggaagtgtttttctttcattagctcctatttgctacaggctttgaggttgcagtccttcgtcagatagacttggagcttctcgcacagcgagagctctgcaacatgctggtagattttagagaggccagagaagcttcatgtcacttctagacgaatgacgggatgagcaacagagggatctatattttgcctctgttttctttttaggctcagataaatacacttggggtcagaaacattgatagggggatagaagataaagatcaaggataaatatagcttgctgctattattcctattgtacttagctccatagttccacatttgtacctatttttttatccatgttaattggcaggtgtggaccatgcgtgtactattataatattgtatctcacataatcattaatcgatacttaatatggcttgcgtattggccgtttctctctttgtttgctccgcctttttagacatgggtaagtgctctgccatcagtgaagaaagaattagagacaacaataactctagaggtttgaaacgagaccttatgctaaaaagcatgttcaatgtttgaaagtagatgcgctgcgatttcgctcgcctgcgtcgtgatgggggacgaacacggacacggcgctgaatgcgatggatgaggtgccctaactgccctttgctgctgtccgctctgactcagtgactcctgcggtcctgccgcccgcaaacaactagtcagacccggaaggaggcacgcgagctccg

SEQ ID NO: 3700 - DNA, 1078 bp, Zea mays
cttcgacggcccaccaggtgggtgggtcagtccgtcagtgtggtggtcagagagaaaagatgaaaaaaaagaataattcattggagccgcacgtctccttccggccttccccgacgatgccgctgccgccgggaggaacggatggatcccattggcttgccaccaccactgcccgcttcggttcctattcccgctcgctacggccccagtcgcgctcctcaccggccggcaccaccccgcccgccctcgccttttgcctgccgaggtaatctggagacctgcgatcccctcgcgcgcagacacgacgcgctttcgtttctgtcccgtggtggttagctcgttcgcatctcactgtcgatatgttttatgatgaacgattttgctgatatatcttgatctgttgtatttgtaatgtttggatcggatggatcttggcccactgctttgatgtaggtaggatttagttacccgatttgttctctaagccacaaaactgaggcagccagacaggggtgaccggctgaccgcgttttatgccttgatcgtcagtgtcgtcaccgtgtttctgcactaaaaaagaagaagctggaagcatctcacgttaccaaacgcacattcttgctaattcgattgccctcccccatcagcgttgatcaacgagtgaatctacctgatccaatggttaagtaaaccgtgtttgtgggttttgttgttttcttcagtatggccctgagttaggatgctagtgtcaagctgttcaactatgtttaatgctgacctgttaggaactactacttgtttttcacatcgaaaaaatcgactccgaaaatttgcattgcatcacccccttctctttcgcatgccgaagagagctgctgacacgcttagcatatgttgctttctagattgaatatacctaattctctacgccacacagagcaagtgttttcacatattgaaatccaatttcaccactctgctaaagaaaacaactgctgatcgaaactttggtgcagatttaggcctggcattctagcaatgcagaagaagtgatcttatgtaactacaaaagatagta

SEQ ID NO: 3701 - DNA, 539 bp, Zea mays
ataacagtgggtttacagtgaattgcaccacttttcccggttccaagattttcaatgttattgtgctacctaaatttaaatatcacaaatggagattcgaactattattgttagttctaaacacacatgcacgtccgtcaagccaacaaaacacatatatatgtatatttaaataaatagaaattgtaacaatatgggaacacttgatagtaatatattatatgacataatagggagatttcaaatttaggtgccgaatagaacagagaatgtttttttttctactccactcggtcggtcgcggactcgctctcgttaccgggtccgcaccgcaccaagtcccaacgggactcgcttgtcagtcggtgtgaggtcttgctccacggaccatcagcccatcattggacggattagacagactaccagaaatgcccccgccaaacggatttctctacgaattcaattcacggcatcttctccctaaaaccctcccgaaaccacgcgctcctccgatcgccctccacccgcgcgatctcggc

SEQ ID NO: 3702 - DNA, 1500 bp, Zea mays
tatctgctcgaggaaactcacagtcgcgcgggcccggcactgagtgagacccagcccggccaatcaaaagttttctgacagttcgttacaatcgactcctctgtttacgtgagaatcgattcgataaaaatagagtataaattataatctaaattatatgatcctgattataactagattattataatttatatgtagctgtttggtaagttagcttatacaaatatagattattcacaaagataacattacttttttttatttattgaggtgaggaaagaaagatgacatatattgtaatttctatttacataaccatggatggtgaaatttttgccaaaaataatctcaaataagctactattgagtagattatgagattatcataatctaagttttagattatataatctgaatccataatatagttgtttgtttaattgctggtttattgcgctggattatataatccggagagattataatytgaaacaaacatgatttaaataaatgtaaatgtagaatccggcgagtctccacatgcacgaactctcatgtagtcctaggaattggcccagcctggcctgaatctgtcgtgcttcgggtcaagaaggtccaaaaacttttgggtcgtgtcgtaaagcccgaagtataaaaacagaggtccagtttggctctaaaccacgttgtgtctttgttgagccgtgtcagcctaaacctgacccatatatttgatcacataaaatcaaaaatattacaaccgcataaagtctataacttactaaattaaagatattaaacaatcctaacatcatttgatcacataaagtctaaattggatagactagaagaaagaaagtctgtgtacagagaatcactagctagttgcctatgctttgatatggttgttacatatcgtataaatagatattgagatatttatttaaatataattattgtttatttctaaacactaagacatgtgatccggtggttaactccaaatttctagaacagggaggtatgagttcgagtgatcgtccacgttaaatttttaatagattagcatagattagtgttctctgtatttatatttaacatgatgtagagctgtatatttaagtcacagagatgacttaaatggcgtatttgaagacagtgttttaagacacggaggaaaaagaaactgacaatcccaagttacagtgttacacatggccccccaaatatctcgcctagatcatctccctacccctcaaaatttcgactataaaactgcactgctcccttggtcctccaagaagaaaggaacaaaggagagagatctcgatccgcacacctcacgcctcttttcctctcgccccaaggacaacgaaaacatcaaacaagagacccaaaggaaacagagcaagagcatcgctctcaaagcaaaacgcgcaccacgccgtcgccggccggccacttcgcacgtacgtaggacgcgcacgcaccggtgcatat

SEQ ID NO: 3703 - DNA, 912 bp, Zea mays
tagctcgattttccacatacaagagataactaagagactgcatgatacaacttagagtctatgtatcataaatacatttaagaaacaatatgtataaagaatcgagtagttgtatttctttaattagcctactagagacccctcaagagacctcatattaaacggggttgcacatgcacttagagtgttttccatgttccataaaagttgtgctttggaggaaaaaattggggcccttaaatccaaactagctctctttagctaatgttaaatgttggtttgtttaaggcgaaatgaacaagcctttatatatatatgcttcaaccatactacaggttcctgataaaaatatctcaatgttagcttgatggccctttgtgttcaaaaaaaagaaaaaaattgcttgctaattagtgccttggcattagatagaaatctgaaatgactgtgatagacgttgttcagtttaccgatttcttcctttacatagttattatacttttttcttgaaaaatacatcaattttctttttcaacctctatcccttctttttatatatacatttctttagaaacatacaaattagcgcgccaaggcgctagttagacactagttatagaaacaacaagagtgattttgaargagctttcgatctgacatgcctccggccgtgaattcgattgattccaagtttggacgacgttaaaaaggcccggtccaacagcaagacaactgggccgattaggccgctggcctattagtcctagcacatcagcagcgtccatccgcggcgcccgcgctagaaaagagtccatctcctccctccctggctcggctgtcggctcccttcgccaccgccttcacctccttccctcaccttccagagcccactgttccccggcggcggcagag

SEQ ID NO: 3704 - DNA, 283 bp, Zea mays
ccccctggcccacgcccactatcccaggccccagaccccgaacgcgcgcctggagctggtgctggctcagggtctcgaggtgtgaagctgcctgcctgcctgccgctataaaacacgcctgcgctccccacaggccgcagctcgcttgctggccttgttgcctgcccaccttgtgccagaaaacacacggccgccaccccccccccccccccccccaccccgcgccaccacccagttcttcgatcccattccaagcgcgcgcagcagcagcagcagcgccagc

SEQ ID NO: 3705 - DNA, 428 bp, Zea mays
cttggatcattgacgctgcactgctgagcgcgttcaggagtaatatatataggaacgaaagttaccgagaaactggaagatcctaaactgttgccaggacatggacatcatgcatggggatctcagaaggaatggttcaaaccagagcgtgcccagtcggcatggatggatcgatatggaggccctctctcctctggcggatcaatccatgtatccatgagagagagagagagagaggcataggccaagactaggccttttgttttgagatgggctgctgctatctagagcgatactgctatatagtggtaccaagaggaccaaaggtcgcgttgcctgaaaccaccgagatcatacagaaactaatcgccgcaacgcatccaaacccgaccaactgacggcgcgcgtctgcgtgaacagctcgcagc

SEQ ID NO: 3706 - DNA, 741 bp, Zea mays
gccaacggggtttattgaatatataaccatttaaaaaaatggcgaaataaggagtggattaacaaggtttaaccacataattaacgggggaaggaagggttgcttctgctcctgttacttgcccccttttatcagatagagtggtgtggtggagcctccccaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcaggtgagtgcgtttccctgttaattcctagcctccacccgctccttcgaagccgggcgcggcggttacgggggccgtcccgtgcgagacgcggctcgatctgcgccgcggggtgggacgccgctggtgcgcgcggctccgggtacgggctcgcggtgtggggattttggatttccgccgcgggtgttgctttgctccgggtcccgagctcgcggggcggcggtgttggatctgtgtctcttttgcgggggcaaagccgctgtttcgggcggggcttggagagcttaacggccttgctgtttctcttttcgtcgccgcagattcggcagccgtgcgcggaatgcccgtggaaggaggggagagagggagggcgcaggcgcagctgagctgagctgagcccgcgaggttcgcggtctgcggtgcggcggcagaggtctcgccagcgcg

SEQ ID NO: 3707 - DNA, 119 bp, Zea mays
cgtgaggaagcttttttttggcctcttcctccttggaatgacttcatttgactgaatgttttgtttctggtatttccagggttatatttactggaactgttgttgcagttcctgatgtt

SEQ ID NO: 3708 - DNA, 79 bp, Zea mays
gaacacggcgatgactatgggcgcttcacagacctgagtgaaggagacaaatgttcagttcggatcggaagcgagaagg

SEQ ID NO: 3709 - DNA, 290 bp, Zea mays
cccgccgacccgctgcgccaccgccacgctccccaatctccatcccaacgcgccgccgcctctaatctccctcgcttccgctccactccgcacccccggtcgcctgccctaacctcgtgctgctcgcgatcccgccccgtgcccagatctggtggcgccttcgccgctcgagcgcgtgccctcacgggtggagtgcaggcggccgctcggttcagccggctggccgatggtttcggccgcggcgcaggcgggcgtggtcgcgtcgtgcgtcgtgcgtgctcttcgtcccc

SEQ ID NO: 3710 - DNA, 1020 bp, Zea mays
tggcaacgaggtggcgaggtagcgtggctagaaaatgtggaagttggttcggaacgaaccctctggtaccatgaaagattaataatccatatgtattctgagaaccagccaactaatccatatgtattataagaaccagccaacgtagatttggcacagcttattttcaagttcttcgtagatttaagcagaagttgtgctaaacaagcagcttctccagcaacttattagtttagctgcttctcataatgaactaaaagcagccaacaagcagaagttgtttttcaccagcttctcagataagctgcttttctgtgcccaaatataggcaggctagactatatttagattaagtgggcttgcatgccactattgctgcatacgtagattgatccttttttttggtgtaaggcttgcatgccactaatcctgggtgcgtgcatgtccatggttagattatcctaatcagacaatcatctccccgatataccggaaactgtttctataaatcagttgtctactgaaggagtctagtctgcctgtatctacgttggctggttctctgaatacatatgaattattaatctatcaaaaagatatatagctgaagattgtctcaagtattaatcatcttatcgttgttaattttcaaccggtaatataattgttagacaaggaccaaacagggtcttattcacgtcgtatatgatataacagtgtttataacgcagtaaaatcggtgcactacactactgatttatagactgccacgctgccgagcggaaacgtttcctaggcgttcaagaggtcgtggcctcgcgccagccaaccaaacaacctcggtgggcctacgtctcggttatcttcctggacggagagacaggggattaggggaaggccgaggcgaggcagcatccagcaatccgccacgctcgtcgctcgcccggtcgccccctccacccactgccgcttcaactctctcgctccctgtcttctccaaaaccctaaccgccgacggcg

SEQ ID NO: 3711 - DNA, 1119 bp, Zea mays
tccccttgtcatcaaatcaaccctaaagctaccatctaaaatcaaggtgtttgacatcttgcgctcaactcgatacctactgctactgctaagcaactacacatctgaagccaaaatttgtcgtgcagaagatttttttgttggcaggtgtgactgtgatctaattgcagttgcccacgccatactgactatacagatgaaaaacaaagcatcaggagttgcatgagaacaagtgacagaggcaccgacgacgccgttccaatgagttgacacggtgggttgtttgatgtagttgttcacacttcgatgcaacgtagaactgacgccgccgtgtggtcgttcccgttcgccttgcgccaagcactggagccactaggaagtagacattctcttacgtgcaaggaacatcagcagccgcgcgcgtgcagcgctcccaaagttctagtactcgttgattctacagaacgtgcatttgtttgttgagaagtcaccgtaacttacaagaacaaattaccagatgcaaattccaagttgcccactcacctcactgctgttagcgagaaatttgccataatgaaattcaacgaaacgaaggctaaagaaaaggattcgacaatataaaaaagtagggaatggacatgatttctttattactcatcgacgaccaggattaatctccttccgtgactattagttgccttattcaccgcgttcgtccccggattaatctccttccgtgaccattagttgtcttattcacggcgtccgtccccatcattgcctttggctagcgctcggccagagcgctcggacacgatcagccagagagacgatgagaacgaacgccgtgaacaaggtaactaattgtcacggcagaagattaatcctggtcgtcatcggttaataggaaaaacatgtctattcaagagtgcggcctttcacctggtttgctttttcatactgtcaaattcattactttggactccattccgtcgaatccacgaagaatccacgaatgtggtgttatggcaaatttctcgctactaatagtcaaacaaagcatcccagctgatcaacgccaccgccagacagcaacacactgcacacacacacattgca

SEQ ID NO: 3712 - DNA, 124 bp, Zea mays
ggtaggcgtttccggcccccgtttacacgcgcgcgcgcaggggcagcgccgtgagtgaccgaccgatcgagtcggctttattatttgaatgcattgttaccggtaggaggtcgttgtgtcatgc

SEQ ID NO: 3713 - DNA, 575 bp, Zea mays
ttttctcaagggttttatttttccaggaaaattagttcaatttttttgggaaaattgaaatcccttgggaaaaacagtgtttataaactagcccaaccacattatcctaaagaattttcatttctcaagggaaattaatttattttcctttgaaaaataagaatctcttaaaaaatgagctttcaaactagccatagaagtaataaaatccggtacaaacattgcgatggtccacctagcattcttaattctttgatcgtttcataccgcgttcacgttaacggacggcagcagcgcgcgggcgggccggccggctcacgtgaacaacgcccacgaaacagcgctggctgttgcaaaagcaaccgtttccagtttcctccccagtgcaccccctcccctctcccctccctctctctcctccggcccccttttttatcgcccgatctcacacattttggaaggagagagagagaggcagagggagagatkggagggaggcccctgcccaaggcaagagaaaccgcggcgcgcggagagggaggaagggcagacgcagacgcagacgggcgaacaag

SEQ ID NO: 3714 - DNA, 1500 bp, Zea mays
cctccttgcggaaaggcgacgcaggggcgtatataaaaaagtcgagtctgtccctgatcgccctcttgccctgtgcagaggctcgggggctgctctcgcaaaaccggctccggccgaaccgttgacagcgtcaacataccagcccgagaacttgggacccgaccgtacacccgggctacggccagctcgcatgagggacgaccagaccagccgaagcattacgcgaggcattaagaccttggaggagtgaaaccactcctccgtggcctcgggggctacacccggcgggtgcgctcgcgcgcacccaccggaacaaaacgcaaccgagaaaggctggtccccttgcaaaaaagtgcgacgaaagcctccaagcgagtgctaacactcccttcgaggctcgggggctattgtcgaggaccataattaggggtaccctcaaggctcctaattctcagctggtaacccccatcagcataaagctgcaaaggcctgatgggtgcgattaagtcagggatcagtccattcgagggactcgatcacgcctcgcccgagcctagcctcggacaagggcagccaaccccggaggatttccgtctcgcccgaggccccccctccagcggcgaacatgttcccggctcgcccgaggccctgtcttcgccaagaagcaaccctgaccaaatcgccgatctctaaaagttatgaaaatttgtagttaacaacttttttatttgaactcattttggttctcaaaaattgcatctaaatttgtcaaatttaaaattcaaattttccaaacgacctcggatgaaaaaagtgtcaaaatgaaagttgtagaacttcaaaagttattcaactttgtagtcgactatctttttatttgaattcgcttacggtctcaaacaagcaatttacactcagttggttgtaatatgtggacaataaaactacaaactagacacaaatcataccatagacggagtggtagcagagggtacgcgcgagggtgagatagaggattctcctaaaataaatgcactttagatgggtagggtggggtgaggcctctcctaaaatgaaactcgtttaatgtttctaaaaatagttttcactggtgatccttagttactggcatgtaaaaatgatgatttctactgtctctcatatggacggttataaaaaataccattatattgaaaataggtctctgctgctacactcgccctcatagcagatcatgcatgcacgcatcattcgatcagttttcgttctgatgcagttttcgataaatgccaattttttaactgcatacgttgcccttgctcagcaccagcacagcagtgtcgtccatgcatgcactttaggtgcagggcctcaactcggccacgtagttagcgccactgctacagatcgaggcaccggtcagccggccacgcacgtcgaccgcgcgcgtgcatttaaatacgccgacgacggagcttgatcgacgagagagcgagcgcg

SEQ ID NO: 3715 - DNA, 816 bp, Zea mays
cggcggtactatcctgacccagcaagacatgggcagcatgctattagaattgtgtactaccaggtgtccccaaaagttatgggaaatataagcttttctttacagttttagagtctcagataatcccactgaacagcactaggctaggcctattagggaatttcgtatgttgagtggaaaaatataatcgacacacttggtgctagttagctactgaccaaaagcgtaggttccagacaatcaatatgtcttgtaacattgtgctaaggttctcatcctatgactcactgcaaaaataatccttatctgtgtttataatgtatatagtttttttattgtctaattaagtaaggagcagtctaactcttgaactacgtttcatggtctgtctattttgttatctgattcggtgattccattctttttaactgtttggttgactattccctctcttttaactgtgtaccagtttctgagcgtaaggttggaaaacttgaactggaagctatccaagaaggtcgttatcttgcagatttcagatatgcatgcattggctattcaatgtacttaaatggcaaggaaactcctacgggggtacgagataagccacgtgcccatctgcctgtttgtgctggagtcgaggtaatatatgcttaaccatgtaatcctatgcatttatgatgcattcacaaatcaggaccatgttagagtgtcatgatggataagtaagcagttagacatggtgtgtttgatgttgttaactgtgaactttatccagcgatagctgatgtagcacagattctcaggatctatctg

SEQ ID NO: 3716 - DNA, 211 bp, Zea mays
cgccgactgatcccaccaattctgcacccgcgcagttcctgattcgattggcaagcgcaattggccgctcctgaccagacgccggatagggctggatttgattggattggatccccaattgtgtttgccacgtccgtgcgttcgggcgggcgggggagttactttagggtttcggcgggtgcggtcgccgtgtaggcggtagggttttgcc

SEQ ID NO: 3717 - DNA, 1500 bp, Zea mays
ctgttttgtatggtggactggtagatggtcaaattctgccaaattttcaacctcaaagcctttgaaacggacattctttcctctgagtgcaacagtctagatcaaagattgataattagaacaacttttatcctgtaccatctcgtccacaccctcatgctgcttggggcacccatcaccaagagccccaatgttgtgcagcgtaaactctgtgcccagaggcaacacacaccatacccaagcgacgatggcggttatgactgtatgacgaggctcacccgccaccgttccttggaccggcttggggagcgatctggaaggattgtttatgcaaaactgatttgctgtgcagggctcctaattctacatgttgatgacatgtcttttgcacaatattaattttcgtgatggtatatcatttgacagaagttgaggctactgaaagattctctgttttctaaagcttagacaaccataaagaactacgggtttatgcaatatgtactaagtgaaggtatatattaaccaggtttctatttcatgaacagaactaattattgggcttcctagagttgattctgtagataaaccccccatatctgtattgttaactttttaaaatttgtatcgtggtagattgatagtgaccctaaagcttgcggtctcatccttcaaattgtggtcataaggacatcatcgattttttaaacttatcaagaacatatgaattcaaaatggggcagttctcagtgtgcagaaggcgagctcgtcctcttccttaatgaggttcttaagagtgtttcctcagctgtattggttacccttactactttggattttggaaacagtccgagacccttattagttaacaatatcatagttgttgcaaagatactctactttttttcatcatctcttctttaccattcatatctcccagttgttgcaagggaaaattaaccccagtaattctttcttgaggggtagaacaggagtgtcgttctcagattcaatgattatcaaacaacatgtactaattatattttagcaagctggcagttgatgtgatgctctgtgtttgcattttatcgaattaacgacaagggagttaagttttagaagcaactaccctgcacttgttattgatatatgtgaggacccaggttggtccccagtcctcttcgattggtgctctgtccctgtgatttgaggaaagtttcagtacaacacrttgtattttgattagtgaatgaagcatttagacgatattgttgcaggtgtgcattctctttcttacatttgatttaagctttcttatttgagctttatgatactatgtactcaatacttgtgctcttctaagataggttgagcagatagtggttgaaaggtctgaaggttggcattgtggatatttttgctatcttgcatggattcccagacaatgtgaggacggaccagaagggcgagttctgggtggcgatccactgtcggagaagt

SEQ ID NO: 3718 - DNA, 130 bp, Zea mays
aaccacattgctggtgattttatctgtgtagtgcattggtgccacaacactggatgagtataggaagcatatagagaaagatcctgccttggaaagaaggtttcaaccagttaaggttccagagcctact

SEQ ID NO: 3719 - DNA, 1500 bp, Zea mays
gtggatttgacttagagataggattttgagtttgatttgcaaaaacaaaccaagtggtggcaaaggatgatccatatatgccaaattaaatcaaaatgaatttgagtttttatttgaagtgatattgcacttgttctagttgctttatgttgtgttggcataaatcaccaaaaagggggagattgaaagggaaatgtgcctttgggccatttctaagtattttggtgattgagtgccaacacaagtacttaaatgtgaatctatgcccatggatgaacaaagtacaaatcaagagctaaggtatgtttctaagtcttagtacattggttttatgtactaacatacttgtctaagtatcagaaacaggaagaagaagaaaagaggagagttggctgtgtacagccaagaggctatttcggtctggggcaccggactgtccggtggtgcaccggacagtgtccggtgcgccagggtgcctcgagcgaagtggccgctctcgggaattcgccgacggcgtacggctaaaattcaccggactgtccggtgtgcaccggactgtccggtgtgcaccggactgtccggtgagccaacggtcggccgggccaacggtcgaccgcggattctgcgcgcgacacgtggccaagccaacggtcggaagggggcaccggactgtccggtgtgcaccggacatgtccggtgcgccaacggctctcgcatctgcaacggtcggcttcgccatttaaggaaaggaatcgggcaccggacactgtccggtgtgcaccggactgtccggtgcgcccgacgacagaaggcaaagatggccttccagatttgttctcaacggctcctagctgccttggggctataaaagggacccctaggcgcatggagggagcaaccaagcaaccttagagcattcttgatcatccacactcagtctttgcgcatccgtttgtgattctaagtgattcgagctctgttcttgtgagaaactgtgagatagtctttgagctcgattcttggccgtgtgtgtgcgcatttcgctgtggatttgtgtgtgttgcttccctcccttactccgtgcttctttgtgaatcttaagtgtaagggcgagagactccaatttgtggagattcctcgcgagtgggataaagataagcaaggcataacaccgtggtattcaagtgggtctttggaccgcttgagaggggttgattgcaaccctcgtccgttgggacgccacaacgtggagtaggcaagttttgtacttggccgaaccacgggataaatcaccgtgtctcctctgtgttgaattctctgtgatagtcgtattgtgcaagatctcctctttagccacttggcaattattgtgctaacccttaacaagtttttgtggctataagttaagtttttacaggatcacctattcaccccccctctaggtgctctcaattggtatcagagccgttctcttcacaaagggacttaccgcccgaagag

SEQ ID NO: 3720 - DNA, 1500 bp, Zea mays
gacgaaacctggaggaaagaaagagaccaaacggcccggtagcgcgcagaaaagatagctgtagacatccccggaagaaatggtcccgtgcgtgcgctcactcctttgctgtttttcttctctccgttcaccttgcgtgcgcgacatctagggcgaccgccgccgccgccgccgccctacgcccagcagcccaggtcttcgtygcgccctttgccggctacgagcacccaccacaccaggtacgtttgtcccttcttgcctgtgcaaaactgagcacacgaacccttagctaagctagttggctaaatggctatctgtattcggatctgatcgcccatccggtatcttcccttcccgctgcgcgtaacagagcacccaaaccctaagccagctgtattcggatccgatctaatcgcaggtgtgtgcgcacgtattttggctactaacttcgacattttagtaaaaaaatatcggctgtacatgtctacccatgttctatactcggtccgccacatgctccttctcttcaaagcgcacgatcaatctgcccatcaacggatgctgcttgtttccccaccaaaaagtaaaatcggctccaacccatgccccatggactagctggttccaccctgggatgagcatcatgctagacagctagagcgatttccatgcatggtgaacccctgggatgagcatcatcctagagtgatttccatgtctttgatctttgacggtaggctatccagtgaggaatgcagcatccatcaaatacactgtcttataaagtgcagcacataacttgctttgatcttttttcttgcgttacatgtcgctttatgctatttgttgtgctatgtgacacctgtttaagtctctataaataatcccctatgctgtgcagtacctgtgtagattttatcattattgcatgaactaccaaaatacaatggctcagcaaatgcagctatcattagttgattattatggtatcatgtagattgctgtaactatttgcatgtgtcatcaagtggaattgcttagcaaatgaagctaaaagcaacctttgttttgttattatgctattttttgctggtttggtcgttgctaagtttggcatttccattcttgcagatcactgtaatccaggctgaattgtggctggtattggcgatataagcattcgttagctgtttaaattgtgtcttttgtctttgattaagcgtcattggaaaggctgtcatgagaaaactcttttgttcaaacgtttctctcctgtaatatgaatgtactgtgacaatccttcatcctatgctagaatcacatattttagcttctaagctccttacagttctttacaagtttcttattcaaccgaatacctaatgcattaattcggtgctkgtgacaagcattcatgcaaattcgtggatattaattcagaacctggtggcatattaatcttggatacttggtcaactgcaaacttgaagattcattttc

SEQ ID NO: 3721 - DNA, 699 bp, Zea mays
gtctttcaataagtcttcaaatgttttctttgaggtattgatcttcttgatcactcgttgccttgtccaagtatacgttgtattctttgaactataaacataaatacaaacaaacatattagtacaattgatcatgtggagcattaaacaccaaagtcagatattcaaatgatcctattttctttaccatctccaaaatatataaaaagatgtaagagtttggaaaacggcccgtttatatgggaatatgtcaaatgcaaatcaatctattcatataggaacatataatatttcaaattaatccttacattttttgtatatatttttttaaaaaggttcgtttgcacgatttgcagtaatggttggtttccatcgaagatggaaacacacacagtgcaggccgtgatccgatggaaacacacacagtgcaggccgtgatcatcggatcgtccttccgtagccttccgtgaccgtgatccctcatccctgatcagctacttcgtacaggaaccttccagaactcttgagaactgggatccaacgcagctgggctcctctcggttttataaaaatctcaacagggtttcgttttttcgccttaatccccatcaaaccccaagcgcgcacccatcttctggcctttccagccgccaagccttctagaagcttcaagagctcgattcgatcggaaccctcgcc

SEQ ID NO: 3722 - DNA, 242 bp, Zea mays
caaaaaaaataacgaactgatttccgtaaaaaaagttgcgcttattagatttgtatcaaaaaatacgtaaactgattggatatgttgggataaggactctttctctctctacagctctattcagatacctcgtactagtatatcttcctaacagaacccctataaattcctacgaccccttcgctccaccacgcccctatcagatttgtttcttttcctccgatcagatcctctcagcgatc

SEQ ID NO: 3723 - DNA, 645 bp, Zea mays
atagatatagatgtataaatatacataacaattgatgatagatagatagtgtatttattaatgaaaattttgctattttgttactcttaattttagctctttgttattgtgccatcggtgtctatgactgatggaaccatatgtatccatgattttgtggattggatgatataatgatgaaacccataaataataatgataaaattacaaatgactcatttattaatataacagctgatcggacgataattactgcaggcaggaaccactggagacgagggactgacgactctcgccggcgccgcgacatcgacttgtgtcgtcaccctcccaccccaatttccccgcagcttccttccagtgtcgctgccgcagtcatcactctgcagtcagtctgcacccctccctccctccctccttccctccctgcctgttggccgcggctcgcgggaaccaacaccccatcgccacgccgatcccccaccgaccagccaagccgctacaagtcagccgtgccccgcacgcgtgcacctgattggtgcttggccggccggctgacccacccggggcggaaggaggaaggaaggaccggagaagctgcttccttgccgtcgcccagggggacagggtaagcaaaggagcggg

SEQ ID NO: 3724 - DNA, 187 bp, Zea mays
tttgttctttcctagcaccagctctctgcttattctgatgtgatttggggtaccgatccttcggatttcaaatccatctctgtctattgtgtctttcttgggtcctccttggtttttatggaagaccaagaagcagactgttgttgctcattccagtgttgatgttgagttgtgtactttggccagt

SEQ ID NO: 3725 - DNA, 893 bp, Zea mays
acatcgtggctaaccttgcgcatacaaaatgattgacgtgatgccacgacaaagaaaaatattgtataaactggctaagtgtaaaattaaacgatgttaaaagtcgagtggtgacacgagggaggaaatggggacttttttatatacagacgctatgcacgtggctatgatttctatacatatcataagtaagctttattctaataaaacacaaaatatatgcttcttttattggttatgtaggttaaatgtagaaccgataattaaacttcaaattctttcgtacatagttttactttatttttacaaatgtttgttatttttttcgaagaaaaaagagacccaaagcgttttcgggctatgtacacgcatcacggcccgtctcggcccagcccacgacctccctttgctacgctcgccgcaactgcaaaggcgacacggggcggggtccacatgcgcagaaattgcaaccctcaacaaccgcatcaacaaaaaaccgtgggcactctcgtcattccgcaccgcgccctcctgcatccacccgatcgcgacacggaaccccagccccacccgcgcccatgacacgtgggaccaccctcccacagcccaagccatcagcagccgcgtaagacgattggaggtgcgcttagcgacttgtccttttctctcctcttatttttcctcccctagttaacaaacatagggctagaggctagagcgagggaccggaagtgagagacggaccgaggagagagatagagagacaaaggggagagaccaagcgccagagacacagagaggggggcggaggagagagagggagaggggaatcgcgggagggaggcggggttttggcgagatttgagttctccggttttccccacgctcccgcc

SEQ ID NO: 3726 - DNA, 1500 bp, Zea mays
ccatctcactgagagctttagagctaaaaaataagctcaatgctctaaaacttttaaagcatttgtttgcagagaccggtcgattccggtcggtaccgcagcttgctgtgagagcctaacggttaattcacactaattagcatatgatgcattttgtagctcatagtacagagattagcagtagtaatatactactccaatacttattatttgactagatatgtgatcgtgcgttgccacgaagcgggagaactgcctctagactataaatataatttttgtttatttataaacattaagatatgtgtggtttaatagttagccccaaatttctaaaacagaagagggctgtgggttcaaagggcttgttttgcactatttttgcggatgctagacatgggaaatatgaagtcgtgatagcaacagctgtccgcgttaggttataatagagacgtaagcgagagaggctcgatccctctccaaacgcaacgggcttgcggcccgtggttcattaaaagaccccacatggcatgggctcgatcgacgaacaccgtgctggcaaatggcagattcctggctcgatcccccgccaacaagtcaaggcagcatgcaacacctctaacatgaatttaatgcacaaatcaggtcaaaccttgcagcctctactatgctactgcaactaaaaaaataaagcaatgtgctctttttttcaattttcctctatttttaatcattttcttctagaaaatagaaattggcactgtaggcagtaccgcagtagccaccactggtagtgttttctgaactagctattgcacttgcactgcagttctctctctataaaaccctcctagtggacgccatgaggctttactctagagtctctagtgcatggagcatgtagtacagaagtagcaaccagccaagctactctccacggaagctctactatcatcaagctcaaccagctagccactgtgtgtgagctcatttctagacacgtaccacagtgtgtgctattgtgacgcagtggatgcgtgctagaaagtccgtgtgtggctgtgtgtgcattgcttcgaccgaggcagtactggtcataccgtacctttcttggatctgaagctcagaagaagctagggttctctcatcaggttacaaggtatgtactgcatgatctgataccacccttcactcacttagcttatcggagatcgagttcataattgctacgatgatgtttgcaggctaattaacctgaggtaagaaactgaagatctagacatcagcagctggtgcagctagtagcagcaagcagccaggcaccgtcacttcactagcacagcctaagaacttcgaaaggccagccagggcaggctgtgttgttgtcgggagcagcaccaataaacggttgcgcctccgatcgagagcccacacactgatcgggagatcggccgctacggcgctatacctctaactgccgggcgcgaactacgtgcatcc

SEQ ID NO: 3727 - DNA, 67 bp, Zea mays
ggtatatcctaatacctagaatgctcaaaagggaacattctagcaagctgtttttagcatctgtaga

SEQ ID NO: 3728 - DNA, 129 bp, Zea mays
attcaagtgtttcgtttaatctcaagtttagtctctaattgattattaaatttacaaatatcaccttccaccactacatcccaccacggtatgatgatgtaatatgtacactatttacatcaatcttcc

SEQ ID NO: 3729 - DNA, 1242 bp, Zea mays
cgcgtagcgccagttagcagtcagcacctgcattctgactactttcgtcggtcgcagcccacgtcgacagttggaccaggtcagtcgcgtcttatttggactgacagaacaccccttggcatgtagctgcatggtgtagactgcagaggactagactagaggagtcatggcattggcgtatcaattgattggcacccatgccgaaatttggagccgatgaacagaaaacacatcagttaaaaagccacagcatgacggggaaccgcagaaaccagatggtagcagagtcatcgtagtagtgtcgtgacagctgacaacttgccgccgcctcacgccacgccctcggcgtggtcgcgagagcacgggatttctccaacggcattttcagcaccaccgctctcggccgccggtgacgtgccacttcgctgcaccgtccgccgccaattcgtggcctctgcttaacccccgtcgataaccttttttttttctgccactgcttcgttcaaccgtcgtctccacccaccgcaaccagcaacgcccccgtccatccaccgtcgggcaacctgtcgggggcttcttgggtgggtgagggcatggggaagagcaaatactgtctccgcggcgttcgatggcgcgccatagaccagcggcgtggagtcgcaaattatagtttgtcgcgagaaacgaagcggaagcaggcgaccagaaagaaaaccagagccgaagctgcaaagcacaccacaccaccgcgctaaactgttgaacgcaacagcggaccaacgtccacgagcatccacatcaggaggacagcgcgcccgcggtaaaggctccgtgcagtgagggcccatcgccagcctgccatcccgtccgacctgacccaccgcgtccggtccaccgacccggtcgcacctgtcccgagcgctcctccatcctcatccgtgctcgccaagcgacgaaacctaagacggcaacgccacagcccacaacacagcacaccggcggccacaccaaagccaagcaagcagcttaggaacccacgcgcccgacgccccggccttgctgggcgtgcggcggttcgttactggctgcatttctctgccgccgtcttggcccatctgcccttcggcgccgtgccaacgccgcgggagctatagcccccgatttaaagttcagttcgtggtggtgataccagacccagcacgctctccgcccaaaattcgcctgcaaccccgagcgacgagg

SEQ ID NO: 3730 - DNA, 557 bp, Zea mays
gcagaggcggacaggcaggttcttggtgttttgctgctcccctgcgaccttatccatgtccagtcgctaggtccctgcagctgcaggcgcactgcctgaaatctcatctgacctgcaggactcagaacgaccgagacaaataaagcggaaatattatttgtgagtggccacatacatgtgcttgcttatatatacacaacctaatgccagcggcacaggggaagatctgatcagatgcggcttgaccggagttggggaagagggaggttcttctagctagggaattgttctttgttttgagtgttttggctcccaaaatgtgcgacacacgacgaactcgggctgctttcattcgtgccccgttttaaacacgcgtcaactgtatataacgctggggccgcgccgacgtttgcacaggagtgccgagtacgtacagactcgccctcaccctgcatttagaggcagcaggcaccgaacgtcacttgacatgctctctctctctctctctgtccccattcattagaaacgtacaccacgcagtccactagtccaccggc

SEQ ID NO: 3731 - DNA, 316 bp, Zea mays
cttatgctagtagtgataaacacatgtacatacatgttgtcgcatacatcactctagttttctggactaaattaatactgaaaatatctatttctctaacaatgattaccatgaacgtcgtagtctggaaaaaaattgtcatgaacgactaactagcagatgagtgacttgttatacttatataccagagcattagacgatcgtactttgtgaggcgctggtctcttgcacagactcggagcaagataggcctagctggttacaagccaagaacaagtagagcggtagagggaaaatatatctggagagggaaaca

SEQ ID NO: 3732 - DNA, 59 bp, Zea mays
cgcaagaagcgatatccatccacggcgttgccctggctgctcgcgctccgccagctccc

SEQ ID NO: 3733 - DNA, 1260 bp, Zea mays
tagctgtctttatggccattttttgctgtctgctggtttggtcgaggatttgcagtggcgtcgaacgtagcctcgcaatcgccggcctcaacgccggcgagcgcggaggcagtagcaggcgagcagatgcgcaaggggaggggaagcgagtgggggcgcagtcgagggtgtgcagggaggttgcagcagaggaggcggagctcgacctcgctgaggaatctagagcgaggggagcgtggagtaggatctccggcgcggccttcttgttgtgccttccgtggccaccacgagcggggcgggggggacgacagcatggaaactgggagaatgggcgtagatggcgagccggcgtgagggtaatgcagggccttgcgcaaagggggagggggcagggggagatagcgcgcgtggactgtgagacatggtgtaggttgttggcgcacgcggatccgtcgtggcatgccggcgtgaggggagccggggccgtgcgcggagggggtgaggatggtggggaagagcgagaatggcaggttgctcggccttccatgacgaggtcggaggggggggtgcgaatgggggcgagccggcaaggacgggccttccatgacgaggtctgtgggcgcgcggtgattttcgcgagattgacgggattgacgagggcagtggcgggggcacgcttcaccatcatctgctctccattgaaagcatcgagcggggattgcgcggtcgcgaggagggaggagagccagggcctgagcgtgggcgaggagagtcgggcggagtcgtggtgaagcatggtggatgccctcgttgcatctttatagagtagtagtagataagacacattttgtatataagttatcatggtattatatgttcctgttgcaacgcatgggtactgacctagtaatagaataaattgtgatgaggaaacttttttctacttgttaattgcaccttcgttcactgatccttggaagttggataaccctgccatagcaaaactgtaaagtgcaaggatttagggtttgtttggtttgtggctaaatgtgacacactttgactaaggttagtcgtccaaattgaataactaaccttagacacaaaagttaggcaaagtgtggcaacttagctagcgaaccaaacctgactttagtactcccttttcttcttgtactactttattttgtaaataaaaaaggcactattacttatcggactaagtagtctgcaggatcaaattactattttccctacagg

SEQ ID NO: 3734 - DNA, 205 bp, Zea mays
tgtaagaattttctcttcgaacccaagaagacagctatgttctatcaatgatgagaccaccgtcagatgatgctaatgaggagggaaaagcatgcttttcttgctttgacgtccgtggaagaccgtacacttctgcctggacaaacccttacagtttggctgtcttgtacgccaaaagatattggcctgcatacatcaatcgtgc

SEQ ID NO: 3735 - DNA, 66 bp, Zea mays
tgtaagaattttctcttcgaacccaagaagacagctatgttctatcaatgatgagaccaccgtcag

SEQ ID NO: 3736 - DNA, 1500 bp, Zea mays
agcatttgagaacaagtgaacaacaactattactaaactacaaatttttttattttattaatcaagttaattggtttttctcctaattactaattaaattaatttatatttgtttttagaagcacctagcaagtagtgataaatgatctttaattttttacatagatattatcttagccaaactaagatatatacaaatatttttataattttatgagaaatttaaatctcaatctatataaagttatgagaagtatttatgtaaattatgggacaagattcaaagttctcataaaactatataaatttttatgtatttgagtttaactaggaaaagatttgtgtaaaaattggagatttgttactgtttgataagtattttttaaaattaaatatataattgattagtaattagaataaagatcaatcaacttagctaataaaatcaataaaaattagtagtttgataatagtattatttagctctagtaaaattttagcattagaagataagagattaattgagacaaatatattaaactctttttatgtagctttttagtaaataatctgttaattctaaaattttagaaaaattaggataaatataatatataattatcactttttgtaaaattatataaattttagacactataagataacagtactgaaaagataaaactgaatactacttaaattagtgctatatcattaaaaacgtaaaaacttgctcaagagattatttatcttattttataaaaccgaagaggttaaacaaccaatgttaaaaataaaagtaaagttgacagctctattttttctttagaaaataaaaatcttttaaaaatggagttaccaaattagccacaaatatttctagttagtattcaaacaatataataactacactaaaggcatgtacatatatttaatatagagatttttgagatgtctaaagaagatttttgcaaaaaatctagagccttctctacttctgtatttattaatagactatatttataaatattttattatataataaaatcttttaattatcttttgtacttgaagaactattttgatgtctgttcattgtacgtgccctaagttttccgctgcaagacaaacgaaggagcaccgcctttacaaattgtgcgttggcttttttgtgttgtacaaataggagataggacagaacccaccaacgtgttggttatttaccccgtttaccactgagtcctccgcaagccattcttcccgacatggcgatacccacggccacgcacgcgtcagagatgaggacgacgacaatcaggatgagggtttgagcacggacgaccccctctccatcgtccgctctaatttcttcctcccccgtcagcaacccttgtagtctctgctaccgtcagcccgtacgcgatcaaagccccgctgcactgcggccaaccgtttctggcaccggcaccggcaccggatccgccgccttcgtcgtccagg

SEQ ID NO: 3737 - DNA, 582 bp, Zea mays
gtaaacaaacaggactactcaaattatataatccagattatataatcatccaaaaataatccagattatataatctatgggggtaaacaaacaggccctaaatctatgatgaaattaatttctttgtaactgaataaaaccttatctagagcacggggttaaatattgtagtagtattaattgatatttatatttaatgtgacacgaaactaaactttagtggtgaactataaacctctcttatctggagttcgttttgactgacacaatgatccacatctggcgcaaggctcgtcgtctgggccgtccaaccccgatgcgacgatgaggacggagactgaatgaatcacgggatttccgaaggcctggaagccgtcaagccgatatgcgacacaagcccaacccttcctgacgctccacgcgctcgtctctctccttccttccatcctccctccctccttccctccctcgctcgcctctggaggaccctcgccatcctgcccaagcgcaccaccaaacccccagcagcggcgctagggttcgcgcctcggcgcgtcggcaccgccaccgccaccggcggtg

SEQ ID NO: 3738 - DNA, 61 bp, Zea mays
ggtagagcaagaactagctagctagtcgaccgagacctcttcctcttacgcatacgcatgc

SEQ ID NO: 3739 - DNA, 933 bp, Zea mays
gcttgcatgcctgcagtttcgacgccgaatcctggtatacctcatttcatctgtcgagaagcccacctccatggatgcatgccggagatcgttgagaacttccggcgaactggaagcaatgaactcgggcctaccatggcagccaacaagacgacgataaaaattatcgcatcgccttgaaaacaaatgtcttgccacttgattctcctccagtcgaatagatgatctcctgctccgcgctagacggtagattcaagtccgtaggacaggagctattggagatgcccgactctgagtcattgggggccagccatgggccaccggccaccttcgcaaagtcaaagatccgtagccggattgggagtcgctggggccggacaccggccaccgtgcaattgtgtatgtcatccttagtctatcagtctatctgttcttaaatatttgtcgttctttaacttatttttaaactaaaatatgataaataaaaaagaaaggagagagtataaaaaatgagaaacatgtgtttttttcttgtctctctgcgattgtctgttcttcctcttgcctaaatcaatcatttgcccctctctttgtgtttttatgattaggaaacggttgactgaatggcaaagcgaaggtcttaaactgatcgaccgtataaaatccaacacacagcagcttcgatgacgaaagcgctcacctcagtgactcagctggaaacgacgctcagaaaagaggcagctgtgtccggaacatgacgcacgcaacgacgtctagatagcctgtgcagaaaaagagaaaagaacgagcgcgagagctcgctgctttgttatataaatcatcacatacaacttctcctcaggatatgtcacgactcaccacgacggaaacagtagtgctgccagtagagagctctcagaactcgggaaaaaa

SEQ ID NO: 3740 - DNA, 694 bp, Zea mays
agcgcactgcactaactgaagtgatgatggcatggacgaaaaggaccgcactgcgcaggcaaccgagacatgatccccattagtggccagcggggggtggtggcccagtaaaagccgcatcttggacccaaaccagattattggacggttcataccgtgaccagccactggatatgtactgtaggtgtatgcaattgcgccacggactggtgcagtatcatactgtcagttatcaggatagcgaagcagtccttgctttcagcaatggtgacatcagatcacacagtcatataaaaatgtcttctctccatctttttaaccatcaggcaggaaacaatggcaagtggccatgactccatgagtcctgcagtgctgcactgcatcatccgaaagcaaccaatatatccagtgaattgcatgttgccctccatggttttgcgcgtcaactgcttttgagacgtctcgcctcctgcttcacccgagggaaagccaaataaagtccacagcttggtctttcatgcttgctttgcaacaagaacaaagcctctttaagctcccccctcccctcctctttaagctgaccaaacaagctctccatcttctgtgtgcttcattattccggttgcctctgagtcggtccatggcgtcagcactaatgtccacctgatgttccattcttaattcatctgcgtgt

SEQ ID NO: 3741 - DNA, 797 bp, Zea mays
ggtaagcccaccgctgcagcccgtccgtttctgaattctcccctcccccaccgcggcaccgccctccccccgaccaatctgagaaataaggcaagggagagtaatggcggccacgtgatcgcgcaggccacgaacgcccggcctccgctccccgtatacacgcacacgaaacaaaagccgctccagcatttctctggcctcccatgcgtacgtgtgcccgtttccgtttggtggttcggggttcgggcataaactactcgccgccatcgggttccgtctttctcgagatcatcacagactgggtgggggtactactggggttccacactccactagggtacccatgttgctagctactgctagactagtgctgggactccatttccatcgtaatggggggcctgactcagaattgggctcttgacggtcgccttcggctgctcttggatatggataatgcggggatgtttggatggccgcctaagccgtcgccgcccgccatacttcccacgccaccagtgtggcgctcgttttgagcgccacaggtgtggcgcggcgtggccgccggcgcgccgatccaaactagccctatgtatctgcgcaccgtttaacatgtcgccgccggttggaattccctactccattccgagctgccgccatcgccaccactgcgccgccaattcgaatcggatccccactccgttccgagctgccgccatcgccaccgctgcgccgccgattcgaatcggatccccactcctttccaaactgccgccatcgccaccgctgcgtcgcca

SEQ ID NO: 3742 - DNA, 628 bp, Zea mays
atttcgaaaccgttttcatccctaatagtgttggcctctatagctccgacacgtcttgtggacataaatctgtggccgatatatggcaggtggtataagtgtactgttaagatgatgttgaattattatagattgtactgttcacttgtgaagtttggaataggagatgtacaaacggcctgacacgagcacaaagagggctagacgctgacggttgtggacgtcgaactgtcgacttgaccctccacgcaaagcaagctggcctcgctcggtcgccacttcgccggcgtccacggccgggtctgcctgcccagccttgcaagttggaagcgccacgtctcccggtcccgaccgccggcccagtcaaaagcaaaccctccggacacggccgcacggggcgcaggtccctctgttgccccgcttggtcgttgctcccgcgcccccgcccgcaaatgcctctcctctcgcgcgccttttcttgtcctgaagccacccaagccgtgcctgcccctcgctcgatctacccccctccttcctcggctagctccaagaacccgtcccacttctccacttcttggcaggtcgatcggccgtgaacgatttcggatcctgtcgcgcgcgcgtgtcc

SEQ ID NO: 3743 - DNA, 1500 bp, Zea mays
catacaaatttgtattcgaaacaaaaccatctgaagattgaaaaggatgccgattcccccaaaacaattcacagaatacacaactgaagcagatttcgtggtgtaccatttgaagtttaaaactcaagtaaaacagaacctgtcctgtagcaaacacgatgggggggcaaagcccaaggcatcaatttgttagtggaggctgtcgatttgtactgtgtatgcgtgtgctgcccaagaaaggccgtactcgccaccacacatatggctccaaacaaggaatcaaagtggctccttgggcactgcataatcttttgtttaagagaggtgcgctctggtgccaaggctagagatttgagctttcagtcataagttaaaaagttggcacaagggttgggaaacactagaaacagcatccacgttcgcctcacctcccctttctcccctccagaattgtttttgtgtgttttgttggctaactatgtacatgtcacattagcccaatctccaagagatacaaaggatctatttggtaaaacttcaggccttggtgtgttccaatgtcaacacaatggaacctgtgaaatgttttccttttctgtttgttggaagaagggagaatgctatgatattggcattaatacattcaaaatcaagaactaacaagaatgggcaagattttaacttacaataatcttctctgcatggtaacttgtcatgattctgaaaattattatgtcatataaatctatatagtgatacagtaatagaccacccgtccaagttatcacattaattgggcgctagaaattcatgattgtggtcatgcaaactaaatactcaatgctgacacagtttatttggaccagttttgaaaattgaagtcgcacctgtcaaccgtgaaattcaaaaaaaaaagaattatctgtttcaggatttttctatgacaagcgaataaagcagacttttctatgacaagggaagggaaagtgtgtccaaattatgtatgagccaagagcagctattacaagatcaggtacccttttttgatgtacagcatcccagcacttacaacagcaattacggaacatgttctaaatttgattcataaagcagctacacatgcctatcactctgccttagagcaaggtgcattccacgatagtgccatagattaaggagtcaaccgtcaaaaggccgagtgatgcaaatatatatagccccctctcctggttgtctcattaatacttctaacaagcatactacacacccctcctccctccccatccttcataagctctcatacgtctctctctctctcccttcttcaaaacaccccaccccatccaaaacctagaacacacacaacaccagagggctttacaaccgcgcacatgatcatggtaaggactctaaccttcatgttttcatgtgaattctcgtatgaaatcgccatttattgagcaaaaaaaaatatatggaattgggcaacaccagcaggca

SEQ ID NO: 3744 - DNA, 1034 bp, Zea mays
agtcaacatactgcatcgaatatagaaaaatgtcaaagtccggcaacagtaatacgctgcctcagtagtcaataccacgggttgccttttttgaccctccagccaacatgtccactgatcggagaagttcaatgataacaagccatactcattaagcaatcaataaaaagaggggcttccatctcgagcttcttcatccgggcatttttcgttttcactgagacactgaggcgatgatacctacactacgagcgttgagcttgagcagcgaagtgcgaagacgaaggatatttggtggcgtggaaagagcagagaggcgacttggtcaacgacgacgtgcacaccgcgttgccgcgtcgagttcactagttggcatcgcctgctgacctcatcgtcgcgactgctggagttaatcctcgccgtccgttggcagatcgggcggccctaatcgccgcgtcaatggtcaggacgcctctcatcttcgttcagtcgtcgtcagtgctggacgttcatcatcacgctgcgcgaagtcgggagtctcagcatccgcggccacccataaatagattcacgagctcaccgagatggaagacttgaaatcaccaaagatcatggaaacaccggcagtagctcgcggtggcaaccggaaccagcccgagaactatgagcagacaggtgaggctctcgcatcacaattcacaagagggaggcgtcctctgcagtatcggacaccgctcgcccagcaacagggggggcgaaagcgaaacgagcatttttacccaattcgtacgtatccccgacaaaattctcgggatacaacccggatcatcaccgcgctaaggcagcaagaacgcacaccggctctccctacctccgcagccgaccgaccagaccgcgtcatcgccgtccagaggcgaggcgtcttcgtcttccgcctgcagctagcctcctgccctcctcgctccccgcctcgatctccaccgcccgtggggtagcagtagcaccagcaccggcggagacctgcgacctgggcc

SEQ ID NO: 3745 - DNA, 169 bp, Zea mays
agacgagatcccctagctagcgtagcgggttgggttcctccttccttgaggcgtgcgttgtgctgtcagcgttcttagattccatctgttccttctactcttctttctctcctttgctttttctcctcccctctttgtgctatgtaaatatgtaatttttttcagattg

SEQ ID NO: 3746 - DNA, 1500 bp, Zea mays
gcttagatagctaaagacgttaacagctatatagtgatgcaaataatgatatgtgaagtctccaatagttaatcttcgaggggctattgtcacatacagacactcaacaagcaattttcaaatttggtttacaaagactgataacttactattaacaaattaaagataaaatggtaatttctaaataaatgtaccaggcaagacatccaacaaccccatcttgacattgggtgacagaaaagaaaaatagaattctaatttatttattgtgagacaaattagttgcattcgaaagatggggttatataaagtggacagaaatgagttaggactgttataaaaaattcttagttttaacttattcttgctgattttccatagttaccgtgcatggagcaccaatttctggactacagtgtctgtctaaagcttaccctcgctgataacattcacctgcctatgcaattacagtgctgtattatagctacacgacctagataatttaatattgattcatgtggataatttgctctgttttgcgaccaggaaaatagagcaacagaggaactagggttttcttgccacacgcagaggcgtacaagcaaatgaatgggcacactaacactccaaggaccagttgtgcagaactgagtaagcagcaatgccaacaaaagcaacagcagagacttcgtatccatgccaatgcattggttgaagcaaatgatgcatctcatgatttcctagataaccttggcctcctccatgaatggatctattgatgatgctatacatgaactgcaccaatgcaggcataccatggtgattagacacttttgtaacaaatagctaacgtagaactattaaatagtcatcactggtattgctgcaacctggaaaaatgagactgaggttctttcaaaaaaaagaaagaaaaattgatgtcgtcactccatactacattgtactatgtgctattttatatgcatgcaaatgaatgtttctttttttgcataatatatgctgcattatatgaaaaaggctaaaaatacagtataacagaagttcatctcatgatgaaactattaatattaagtgctgactttcatgtcttcacccttgctatagcacctacaaatattgatatgataagcaacttggaagcctgactgcctaggttaatttaaatgtttgatttctcatgttctgcacaagtactaccctgccagtaggcaagtagaaaatagtgagatttgaaatccaaaatatgatcggtatccgtgcaacatagcacactaatgaacagaatcaagtagaggtgacattagtgacaacaccacaacccacaacttgcaaatattttggcatcctctgaagacatccgccacccccacagggcctcctacagcgacaccgtcagcggggtacaggaggtcagccccagaggcggtgctggggttggagtcgccgccctgagagagcgcctccttgccctgcgcgacg

SEQ ID NO: 3747 - DNA, 1124 bp, Zea mays
ggtatgtccccttcatttcaaataatctgtctgaatcattttacattttcttacatgtcatattgttagattgaaatttagttttcaaaattgaggctatttgctacttcaacttgaaagtataatccagatgggggtcgcatacttgaattctcaaagtggggatgctttacatcgattgtagagaactctctaattctgggttatgtaaattataatctttggtccttactccttagttaatttttttctgaataaggtaattttttttctgaataaggtatttattatttgtaacatagacatacactccagatgtactatcttcagtccttagtttttattcttctgaatataacatagtttttttataaaggatgttgacatataacttcctcaaatcatttggtatttgggattccaatagctgttctggagttccctagaaacagttaaaaagacctgctcttgtggctagaattttgggcttttgagatactgaaattttctggcctttgcagtgaatgcaaaagaataattggtggtttcatagtgctgccttgcttttctgttacctacttaatctgcaagaacgacatggacagttgggggtacaagtagcactacatgggttaatgttgtgttgcatattataatcaggtttagacayatttggctgatctacttaatcaccatgaactggaaactgtgtgattttactaggagggctataggacttttgatatatttttgacagaacacctgagtttgctttcatttctttttcatttaatttgtctgtatggacatgttctcttttgcttggataccacaaatttaattggttactgagattttgggactgggtcaccaaatgaaaggtgcatttcaagttttgcttctgtgatgtttccacttttattttcagttatttcacctattttgctaacttattgtctgaaagtctgactaggctcattatacatatttctatggaaatgaaactgtatggtagttggttgcagactaattgttgattgtaaaatccaggtaacaaagctgttggaagaaccccattggactgggagaccagggtgaagataactctgggcacaacacgcgga

SEQ ID NO: 3748 - DNA, 136 bp, Zea mays
gatggttatggaaaatcttctctttggccacaatatttcacgaatttatgacctcaaaggtgctattttttcatgacgcttcactgactcaaacgatcatgatactgtttacctagatcaaaattatgttgaggac

SEQ ID NO: 3749 - DNA, 983 bp, Zea mays
gaggccaccagggaggaagctgcaggccttctgcccccgaacaccaaccagtggaacaaaatctaccccgaaatccttgctctgatatctcgtacctgacctgcggttctgcaaccaagaggccaaaaccgtttaagggcccattcttttctacaagaatgcactaaaaattgttccttttaattaaaacttataaaaattaaaaaacaatataggtaggaataattctggacttccattccgtgttaaccgaacgggtcctaaaaaggcatagaaaacgccgaccatgttcgattctaaataagtatacacggtggattttcaaggtaggcaatgcccagagaaggaattcctctgtccatgactccacgaggctgtgatgatacacgcgggctatccagcgcatggctccaagatatctggctgtgaaaattggaatcatgcccaacgaagcatggctggaagttcaaaccgtttcccaccaaccgtggagtccgaaatttgacgggaaatctgacgagcccatttttttcataaaggtccggaacctacacaaaaaagttctgcgtcgtcccggtcctctcagaaaacgcgttgcatgagataaccaaaaccacatacagccggaaccgagggggtgatatggaataacagcgctaaaattgaactaaccatagttagctggggacgcctctcccgcggggctgacaccaaaccgtggttcctcggacgcaacgcgagcacaaccagaccacaacacctcgaggctcgagcatccctgcatccctcccccccttccccatcccacctcctgctacaaccgcttcgtttcctcccctcccaaatcccccaaccccaaatcgagctccgagtcgacggcccttgccgaaccgctctccagttcccaaatccccctcccccgaaattcaccgccggactggcccggccgatggagtgacccagctagggttccgaagccggca

SEQ ID NO: 3750 - DNA, 417 bp, Zea mays
gctgccttgttgctcctccgctgccagaaccactttgaaagatcatggatatcccatatccaattgaaggctgctctgttcaatgccgaagcttgttacaggtacactattgaactccatgggaagacagaaattggtgaggagatatctcgattgcaggttggaattaaggcacttgtggatgcaaagcgaactgcaagaggagctcctggacccctgtatgattatgctttcagactagaacaagatatgaacaagaacatggagacagcgaaagaggagaattttcgtgtatacctttttcgcattccagctgccgaatcattggcctctctaccatcagcttcactcgtccgttctgcatccttgagtgagatcttaaatccaaagacagaaaataccactcaatctccataa

SEQ ID NO: 3751 - DNA, 111 bp, Zea mays
agctagctatctaccagtatatatagagagaggcgctgtcacatatagaaacaaaacattatcagtatcttccacaagcacctgctatagttgtgtggtgcaaacaccaaa

SEQ ID NO: 3752 - DNA, 622 bp, Zea mays
tcgagtggctctgagttttctcactttgagcaaatatctcaaaattgttgtcacaaagttgcactgcacatatattcagcagtcctatagtctgagttttctcgtttgggcctttaaaattggtccaacagatttattgatgcggaactgtacaagcaaacgaggatcggcccatrtgataggccgacccaacactacgaccgcctctctcttgcgtcggcaacagcagcgcagccagtagcccattactccttgctccacgccgccgctcgaaaccggcagaagtttagaagaacggggagggaagcacgcccccaaacgttccgaggtttcgcctctcggagcgcaccaacgccacccggagcgactcgccaccggcgcggagaaggtacaaaaccagagctatactgccgatctgggcggtctaggggcgcgcctttcggttagggtttttgtttacctgcaagatttttctgcttcactagtttcctagctttcgtctagcatcaggagcaaatcgtctagatgcggacttgatcctttgcgtttttttggcgcgtgtcagcttggctaactgggatgctctttgttttccccttcgcaggagggcggaggctaggcg

SEQ ID NO: 3753 - DNA, 653 bp, Zea mays
ctggacacccgactgaccgagacctaatacttgggcaatagctcgcgtccagtccagacacacacgggctccccccaccaagcccgtcgcactcagtggccacccaccaccagcccacctccgggcgcaaccgcgtctggtgcggtgccgtgcgcccgtcgtccggcggcaaccagactacccagagccccgtcgagcagacgggccggcgccgggtcagtgtcgagtgtcgtattcccaggcaggcggccatgcgacgaccggctgcgcgcgggccaagctgccagcgccggcggcagaaggttggccggcccatccaagggacagggaggcgtcgtcgcggagtcagctcggcccgccaacaacctaccccggtgccatgccatgccatgccagtctctgatctgaccccaacaacctccccctcccacccgtggccacgctatttattaagcccgccctcccccgcaccgttctcctcaggacgaagagcctacctttccccagctcttcgtctacagcactgccacattagtagttaccagcagtactactcttgtgtagtactagcttttaatttcccccagctagctagctagtttctacttccgtccgcgcgcgctcatctgcgcacgcacgtgtccccgtccgca

SEQ ID NO: 3754 - DNA, 97 bp, Zea mays
atttgtttgaggatcgcaacaacaattagaatttaatgttgaaagattgtctggtttccttgagaaagattttcaactttttaccgatgatgaggtc

SEQ ID NO: 3755 - DNA, 767 bp, Zea mays
tcttgtttttatttttcttcgtgaatttttttacatagtcttgattgtagctcttcttgtatcgactgacattgcaaactgggcatcttgctgcattctcaaaatcgccatgatacaaaatacaattgttcagacatgcatgaattttttgcacacccagagctatgggagatataagcttcttcgctttataagtgcttgttggtagtttgttgggttttggtagtaattgggatagaaaattcaaaagatttgtgaagctattatcagaccatccggcgctagccttcaacttaagaagttctagaactgtacgcagtgtagtaaactctttgtcacaaccctttgattcatcatataaaggttcttttgaggcactttccagtcccttcattttagatagccctttctgcaatcccacagaactcaacatttctggtttcatatggcgcaacatctcttcgcaattaaattcttcaaaatcttgattaacatccacataatccactttaccatcaactttaagatctaaaattccgacaactctctcgtcattaccaggcacttcacacggatccaactcaccatgttctgaccatatcgtgtaattgtttttaaactctctttttagcagatgtgattggattactcctgtatctctccaagctatcttattatcacaatcgatgcacggacataatatctccttactctttcgcaaattcgcgtgcttgttggccacttcaataaagcttctcaaattttga

SEQ ID NO: 3756 - DNA, 403 bp, Zea mays
ggttaggttcaccttgactgcagtaaaaatcaaccgttcattatcgtataattctaccttgcatatgactagtaaatactgtataagttctgcctctgtagaatgcttagaaacaaatcgcctctggcatataagaatgtttgagctcaaacaaccagacacgactggtgcaatgatcatacaccaaattttatttttttttaaaatgggttttctaaatgaaatcagatgctgacatcctgtttcggaggaacacaaatgttgcttgaccttattcttatgttaaacttgcctagctgcaccaccgaaactgtactttctgaagagaaactaaaccctttgagcacgagtgatccggtgctaacgaatttcagttgtccaggtgctgtcaatcgttcttggg

SEQ ID NO: 3757 - DNA, 410 bp, Zea mays
actatacacatacaatgggaagagctaaagtaaacaaaacatttagctccaatcttacaaatcatacacacaacacatactagtacatcaagaaaaaagcttacctttgaggttctaccgacgatctaacgaaagaccttctccaccatacctggaaagccctaataaggttcggacactcagcacctttggtcgaatagaactggaaccattcttcaaacaaacattgctgctgcctcagagggagggttaaaatgcctcgccctagattctcctccagtgatcttaggtctagacctttggggcagcgctgaagccagccaaaatccaacaacatcgtgctgaaccatccacgaaagacgaggcttcgtacattgccacgacactgaacttttcctttaccaagtgca

SEQ ID NO: 3758 - DNA, 587 bp, Zea mays
gttattttctttcataattttatccaacacaatttacaaacctgatgcacttttatttaggcaccagccgatcataccgctttgatgtcagaaaaatgaatttgatccgacgaggcgacgacagtcttaaatactgcggcgtttaaggatctttgaagcaattttgacaggccattgctatcttctgatctcatgatgaattgttctttctttagcaattgatgaatttgttcttggcaagttggcttcataataaaagagaaaaaatataggccggagcggcctgaaatcaccttcggccctggtacaactttgccaaccataaagtctaggccgacgaatagttggcccaacactacggcccataaccaccatttactcattttccctttcctccgacacktcgcccctatttctctctgcctgtctgcctcgcttccggttccgacctcccaggctcccacttcctctgcaagtcgcagcgcaaagcggaagcaggatttcaaaaaccctacctccctaccctactccgcacacaccccgatctccctcccccacccagatcggccggcccgcggcggcgcgaa

SEQ ID NO: 3759 - DNA, 493 bp, Zea mays
cgataatctcaatttcgtgtttttcttgacatataaggactagtttgagaatctcaattttttaagaaatttctattttcccaaagaaaattagtttattttcttataggaaaatgtccttaggaaattgaggttcccaaactaattaacgtagatgccgtcgacgattggagactcggacggtgacagcttggcctgtttgtttgctgtctaatttgtcatactttaactaacttagttctttattttggacggctagtcttagtaaagtgtgacatagtgcacgcttggtcaacttgttcggagcgcgctagctcgttggcggcttggagaggcgaccaaacatatccagtaatcccgctccctgctcccctcccatcagcattctgtcgcccgcctccgtccctatacaccctataaatagctcgcgccggccggcagtgcaggtcacgacaggacgacgtacgagagggcgcgcgccgatcgaggcgat

SEQ ID NO: 3760 - DNA, 247 bp, Zea mays
ggtgcggcaggcggccaatggcattcctgtaaatgctgggcctgtctagggtacttttggcaatagatcggactgcgcacgcagcagcagaggtagagagagagagagagagagagagagaagcgctggtaactcttttctctcctctgttgggggcagggaaatggtgatctgcaagcgcgggtagctactgtattttgttggtaattatggcaactaatgatggtgcaactgcaactgaaacaag

SEQ ID NO: 3761 - DNA, 1500 bp, Zea mays
tggtcatttgttcatctcgcatgatggttctaacattattcacaaatcttgtacatctctcttgtagtttcataaattacgagagataggttttataaataaatttacttctattttgtcatatgaagaaatgatcaaaatataaattgtacatcttgatgagctatataagtttgtagttgaaattttttcgtttgaaataatttactgctttaaaatatgatttttaaattgtctttgtttagtgttggaaaaaaaaacactcgccaaaaaagctctttgcctagtgtccaaaataaaacactcggcaaaaaagctatttaccgaatgtcaaaaaacactcgacaaagattttttttgccgaatgtcttttttatcgaggattttttgtttggcactcaacaaatagtttctttgccgagtgcccgaaaaaaacactcggcaaagagccgaattcggtaatggttgttcgccttcttcttttctatgtcctaccaagtggactcggatgtctaaagattttttatacgtcagcataagaagaagaaatgtctcactaaattcgttcaggatttcctgttaatagaatcatcggaaatgggaacctgctcaacggatcaaggtctaagaagcgtacctaatgctgtttgaggaattcagtagcatattgtttggctagtagatattgcttgaacgtgactgaacagtgagacctcatggtagtcatcatcagatatggggacctttatattgcgcaagtcctcgggtctacacaatagttggcaaccctgagttcacactaaacacacaaagtttctactcgaggatgatagcctacaccagttacctctgctgcggacaaatttactcatatttaaaaatgaaacaacattctaacaatgaacaaactgtactgtgaaaacataagtagcagaggattgataaaactttttcaatagaaaattaataagactacacggtttaccgggtaaggttggagtttcaaaattgattcctaggattggacacagagtaaccaaaaacttaagtagtttggtaactcaggttcaaaatatttaggatgccatgaatctaaaaaaaaattgagataagagaatattctagattgaatcagaggattatatagattttaaaaaattattcagcttttatacctttttagttggaattttattttttgatagtaaatctgatttagaaagcagaattgcaaatcacagatccatggaccgggttcacgaaataatgatagcacatacagacaatcaacggcaaccacagagccaacccgatcacgttgctcccgcggctggactagccccacgacctccagctcgaccattcccgatcccgtggactcccaattgcctgcctcctctacctgtccggctgtcccggctccagcatttccaccctcgcgcggcggtcgccggagcgagcagagctgccggaaggcccgtcggatccgccgccgccaag

SEQ ID NO: 3762 - DNA, 1160 bp, Zea mays
catcagtattaataatgaggcaagctgcacccaaaagatcgactaaggagattccttttgtcgcattgtttgcagcaagaaagaccatcataattctttttgaattgtattttaaaaataactcacttcaattctttactgctataaatcaccaatttccactgttgatcggctcccccctattcaaatgacaaaaaagctaaaattatacataaatgtgaattcaaacctagttgttggctccaaacttacattcacatacacctagtcaacagaacacatatatctttgtgttttatactttatactaaatataaatggaaataatagcaacacacgggcacctaactactctattttttataatgcaattcataaatggtctcgggcaggatgttgtgtccttgcaaagtcaatttatgctgagttatctgctactgcaatagcatgcaggagaaaatttactcctttaaaaacatcttactggccccacagttttattcaggaatggttcttacaagaatgcaatttctgcacttcaacttccacttctatgccaaagtacaacccaacagtccatacgcacagttgaaattagtgaagtgctgaaaattgtgcagctgtaaaaatgcagacatggagtaagaaatattctacccaattttagatatttggccaaaatcgttagtcttgaaattgaacaatgatggtttcttcaaggtaattaaaataaaaaaaaatagtcatatcataattgtagcattgtatgctaaggttgtttaagttgtgaatctaatttttgaaacgaaaatatgaagtaggaaaggcttacctgccaaagataacatgttaggtatcaaatatctgtggcacaagccatcagcagggcaccacccacatgcccaacccaaccgctgcttttatttatacacctcctttggcctcttgcatcatcagctagtttacttgcgctgggcaagtctctagtgccagcttgtttacttgtagatccaggctctctcctctccaagcctttagcacagcaaagtcccagtgccatccctgttctgccgttgtatgtgaaccctcctatgcaatagcaagatctccatctctctcagctctctccagcttcatttccactcaagagttgagcacgg

SEQ ID NO: 3763 - DNA, 435 bp, Zea mays
cttctttcgttcttcagacagtgtctccctagtccctccttctcttcccgctctcctccttcatcagtcatcacacacgcctgcggcctgcctgcctgcctgcctgagtcctgacaccatactatacctccacctccccggccctgtcctactagccgtcagaggtttgccgcctcctcgctcctcgtcttcatcaccccctctctctctcttccttcgtcctcgacctgtggccacctgtggcgtcacgctttataagagcacgcggccggcaaccatctcccttgccacccacaagtagagaagaatcttttgttgctgacgcctgagacgctggcactgccgccgcgccgtctggagagaaagagcagagggacactgaagcagaggagccgaggggtagcgacgagagacgagcgagagcggccgacggag

SEQ ID NO: 3764 - DNA, 104 bp, Zea mays
tacattgatagtttgttgccaatagctaacttctggataatggccattgacagattttaatctttctcctttaacaaagttttggattgttatcctcatcaaat

SEQ ID NO: 3765 - DNA, 511 bp, Zea mays
gctaaccacaagtatgattgatatccaatgcccagagtcagctcgggcgtttgctgcaagatctgcacgactgcacccagagcagaggtgtcgttgagaatgggaacacagtgtgtttttatacaggcttgccttgacctgtctgtctgtctgtcgcacacgattcactcctaagtgctcgatcgcgatcgattaattctcatgccttctgactacgaaatctagcgctgttctggtaggagactgacggaattccccctttccaggcaatgacgcgcagctcctcaagggcatcaacagctacaggtcctcgctcaaggtcccggcgctggccgagaacaagaacgcggcgtgcctggccgagcagctcgcgagacagttcaaggggcaggagtgcaccaacacgacgggcgccaacaccgtcatcggcaccgagcagcagttcccggactaccccaggtacctggaccgctgccacctcaacgcgtcggtgaccgaggacggccaggtg

SEQ ID NO: 3766 - DNA, 104 bp, Zea mays; identical to SEQ ID NO: 3764

SEQ ID NO: 3767 - DNA, 374 bp, Zea mays
gtgatagaggtttcttgttgcactgggaactcctatgttcctcaagagccaagaggaacctgcaaaccgagcaaacatggcgacctgtccatgctaagcaaatatggatcacacaagaattaaacttactcaagtttttttggcattatggcgaagaagttttgttaacatataggttttcagctgctttctagttaaatgttgtgccagggaaacaacagctaaatcgcaatgtgtaaaatgaacgaagtaatgtgtaaaataaacaacagctaaacatggcgaccttttcattgtctggtacacgccctttgccacatttttttttttggtaaggaaggatagctcgttggttgcccgtatatgttttttag

SEQ ID NO: 3768 - DNA, 542 bp, Zea mays
aaaatcggtatgatgccatccgcattatgctttggaggtcagcattatgtcatcaatattatgcttcagaggtcagcacatattttgtcttttgcagccgagttcacaatccatccatatcttgctaggtggtgcaatttatttgctctgcggctggttggacatttgatggacgttccctgtctagtcttcacgtcgcttctgctggtcagattctgtacttccctggctatatttggctttcctctgttccttactgatatctcatttttgtcttgaggtattcactgcatgccctgcacggatgtgacagttttgaaaaatacactgataattcctgggcgtcccccccaatgggtgtgggcaagggacggcttggtacgctgagtgttttagccggctgcttctgagtagtaatgtgatgtgacggcgggtgtaatcatatcctccgcgctgttgactggagtcccaatgggtgttgtgttgcgtgaaacggcgtcagccgcctgacgtgtcttcagacgggttgaagtgcttattga

SEQ ID NO: 3769 - DNA, 1398 bp, Zea mays
ggtctgaggtgtcgcgccgtcgctctcgtcgccggtcgctggtgcggccgcaactgttgcgcattcatgagtacgctgcacggctagcgctcggctcggcgtgtggatcacatgaccggtgagtgctggccggtctgggtgtgcatagtcaaatacggcgagttcatcccagccgcgacgtttcaccggtaaaagctactagtaccagtttggtacctggggtctggggacgagtcgtgcatgttaaagtgagagaacaaagctatagtgctgtctcatgataacctaataagtataatatataatatactttatggtaaatctagtgatccttattttagatcatgaaaatattagtgatgctatttagtttaatatatgctaaacttaaagatagtttacattaggataaagtcaaaaatacatttttttgaaaaaaaaatgagggagtactgtttaaggctgataaaacaatctccttgcaatccaaacactcgaaatatgtattagtatatactgctagtagttcatcttcaacagaatactggaatcctatagtccatctcaataaacctgctaatagcatgttataagtgctcaatgaacacctgctagtagttagcctcctttcatgttggactttctcgcatcaaactattggagatctattaaaattcgtttttaacatgtcatcagcaggagagtgattcctatatggcaatgaattatttcgacttgtattgctactgctacggtcattcgcgaagagtacttcctgcaggttgatatatagcgcacatggcgcaagatcccgttcttctccttcttttttaaataaaataaactagcccttaatatctttgcttcgttcgtttatagaccgacaacaaaaaatgacaatactgggtttagaacgaaagctactttctatgacatgctgcctttattttaacttatataatataatttattgctagaaaatctacaatagttcgacttggctaaaccaagcttacatttgtgaaaagaaataggagaatatgtagcaaccgagcagcagtagagtacacaatcgcaatctgacgccgccgccgccgcaatttctcgcccgatgtccacctcaaactctacgagctagtatttcttgcttagccttcaacccaaaggattacgaattccacaaacgccaacaggctctccttgcaagcctctctttttaagttacggggcacttgtcatgcacatgggcgaccgagctcttccatttatatctctaccactcctcatcggtgaccggacgaacgccgggagaaacaggccgatccgtagctgcctgcacacatcggtgatcgttcgatccatgtgcgattgattgatcagggaggagcgagtgatata

SEQ ID NO: 3770 - DNA, 204 bp, Zea mays
ggtgtgtttgaatgcactagatctaatatgtagttggctaaaaaattactagtagagttagctagctaacaaatagatatctaactattagctaatttgctaaaagtagctaatagttgaattattagttatgctgtttggatgtctttagctatttttaacagctaactattagttatagtgcattcaaacacccctccctaa

SEQ ID NO: 3771 - DNA, 1500 bp, Zea mays
tgacttagagatagagatttgagtttgatttgcaaaaacaaaccaagtggtggcaaaggatgatccatatatgccaaaattgaatcaaaataaatttgagtttttatttgaagtgattttgcacttgttctagttgctttatgttgtgttggcataaatcaccaaaaagggggagattgaaagggaaatgtgcccttgggccatttctaagtattttggtgattgagtgtcaacacaagtgcttaaatgtgaatcaatgcccatggatgaacaaagtgcaaatcttcaacaaaggtatgtttctaagtcttagtacattggttttgtgtactaatatatttgtctaagtgttagaaacagaaagaagaagagaagagaagacttggctgtgtgcagccaaggggctgtttcggtctggggcaccggactgtccggtggtgcaccggacagtgtccggtggtgcaccggacagtgtccggtgcaccaggctgcctcggccgaacaggccgctctcgggaattcgccgacggcgtacggctaaaattcaccggactgtccggtgtgcaccggactgtccggtgagccaacggtcgactagggccaacggtcggccgcggattctgcgcgcgacacgtggccaagccaacggtcggaagggggcaccggactgtccggtgtgcaccggacatgtccggtgcgccaacggctcccagatcagcaacggtcgactgagctgtttaaggaaggaaatcgggcaccggacagtgtccggtgtgcaccggactgtccggtgcgcccgacgacagaaggcaagatcagccttccagatttgctctcaacggctcctagctgccttggggctataaaagggacccctaggcgcatggaggagtgaaccaagcaactcttgagcattcttgatcatccacactcagtctttgcgcatccgtttgtgattctaagtgattcgagctctgttcttgtgagaaactgtgagatagtctttgagctcgattcttggccgtgtgtgtgcgcatttcgctgtggatttgtgtgtgttgcttccctcccttactccgtgcttctttgtgaatcttaagtgtaagggcgagagactccaatttgtggagattcctcgcaagtgggataaagataagcaaggcaaaatactgtggtattcaagtgggtctttggaccgcttgagaggggttgattgcaaccctcgtccgttgggacgccacaacgtggagtaggcaagttttgtacttggccgaaccacgggataaatcaccgtgtctcctctgtgttgaattctctgtgattgtcgtattgtgcaagatctcctctttagccacttggcaattattgtgctaacccttaacaagttttgtggctataagtttaagttttacaggatcacctattcaccccccccctctaggtgctctcaattggtatcagagccgttctcttcaagaaagggactaaccgcccgaagag

SEQ ID NO: 3772 - DNA, 412 bp, Zea mays
ctgatgaaggattcaactcccagctgctagtcctaatcatgttcgggtatttgtcaacgtatttgtaatgtgtagtacttgctttagccaaacgcattggcgaataaagtagcttgctttgcttcttggaagggccgaggctggactggaggagagttctttttctttttcttttttctggtcagtgtgcctttgctccggaatggcagagttgtaaataagaactacgaactttgtgcgtatttatggttgttgtatttatgattgttccctaaaccctaaaccaatcaatcaagcaaatagagttgtaagctatatttagctaggattttaaataagcaatcaaacaaataaggcagccgttgccactatccatttctcatctctcccagatccgatcgcggccactgcc

SEQ ID NO: 3773 - DNA, 1019 bp, Zea mays
gcgccggatcggagcggcgcggacggcaaggaaacgacccccaaggacttaccgccggtggagattgctgccggagcggccctgccggaacatcgagaacgccaatgtcctgctccacggggagacggacacggaaggcaggagacgaaggctgcagacgagaagccagacctgaggagaccggagagttggcggcaccgggagaaggggcggaggccccgccgccagggaaggcggcgccacgagaggccgcgacttgcatatcagacagaaccccaactatggtgtgatgcatgcaattgttaccctaagaaaagatgattcaacttgtttctcattgtcttgttttagaagttcaagctgtaacataaaaaacttctctcttcatctattgattgtgctgcagaagcaacagtttcagctgtatctgcagtatcctataatttatccacaattttattgatggtaatggtagaatcatatgcacgagtaccctgcactaactggtggagttcgtcatctttaactcgaggtgtctcttgttggtcacagatgcattgccattgccacaaaaatagaaatagaaataaaaaaagaatttcagtacccaatggtcaaaatataacataatataatttcagaagtatacaaaagagtagtaccatcattgctgtgagcgaacaaccgccccgccgtattggatttggctatcctagctgtcgtggattcacgagtactgctctccgctcgcctccgcctcgtagacatgtggctgacttcgccaacttggcctgtgcgtgcgtctgccaagttccagaagccacgccaccgatcgtgattattatccatcaatcgatcattccggtagtatccatccaactcttcataacaggcgacctgagagcagagcagacagagagcgttctggcagccgttgcggagcttgaacctctgcaaccaccaacagctaaactaaaagcagcggcggacggcgcgcggtactggacgaccggccgacg

SEQ ID NO: 3774 - DNA, 1500 bp, Zea mays
ggtagtatgacaatactttcatgtaataaaaagtacagagaaccgtactaagctcctattacagcgcactagtgccattaaggcaccgatccttgctctgggtaggaccttagtaggtcacctcaagaggtatgattagaccaacgcacacccgacacatactacatgcttacaaggtagggaccctgccatgttacaaggttgtgatggaacgtgggcaattggtcctatggcagtagggcccctaggtatagaatgtgcatgtaagctcattgctacattggactataaaagggagtttcataaaaaaactataaaagggagagatagagcaatatttaagggggtttcattcagacwtcatctccaacgtaacaccagccaaggaagattaattcgatctagccaaagaagcatccattgtggtagtctatcttgccacaacacactccttacttagaaagccttgtagctcaccagtattggagcttgtaatcgtttcgtcatctatattcaccaatcaaatgattaggcatagggtgtagaatgccatgactttatatgcatactctaaggtaacaggactcactccgtgtcccccttctattttctttggtacttttggtaccctattgtctttgctatgagagagggtaatatagccaagagtgggaaggagagagagcaaaaaggatagtgagtggttcagaatcttggagcgtgccttttggatctgttttctaaacttcatgatagaaaaaaaaatcgtataaaaacccctttgagatgctctaagaagttactataagacaaaccaagtgatatatactacctgctaaactaactgttgttcaagtgctgagagcgactcccaaaccaatttgtcgttgttagttgtttttgacccggcttatcttatcttttctttttcttatgaaccctaatcctaagaagttactacgagacaaaccaagtaatacaacatgctaaactaaagctaagaataataaataagttgcatccttcgatgcaagcacagcggtgcatgcagtagcatggtactactactgctacacttagggggtcgttgaactaccgacggatcatgatcagttgcaccagaattacctgacgcaatgccggaagaccgcctaacgactccagccggttaagctaagctgcagcagctccggtcagaaagccagccgaaattctcctctccgatatcccctttctttccaaacgatttatatagcccacacatccccatcctttccactactcatcagttttctcatctcagctcagctagctttcccctcccttgcaactgcaagcttgcccaacccaataagctaagcaagcacgcaccatacacactctctagtagctagctaagctagccggccgcccctcctcgcacgcgtgcgcgcaccagcatctatcatcagagctagccacgaaacggatcggagcagcagatctcgatcggcggcccac

SEQ ID NO: 3775 - DNA, 1027 bp, Zea mays
ccataacacccctaggttctatctagagatataatatatttagaaaaatagaaaatgatcaaaccatgtgattaaattgaatgtttctagtttcccgtctttatgtctgaaattctattctatatatagagcgcgacgcaaacgtgcgcacccgtacatccacgtcggcaaaaaaaacatgtgcgcaagatgttccatcaacggacgagatttcttctcagcctcccgggctgttgtagatgcctagagaattctagccatgtgcagtttataaaaaatcaaccgttttctagaagggtctcaataggcatcgcgtgcctagcgtcggctaccgcgactgcagcgtcggcggctgggaccagcggatgtgcgttcctctctctagaagctccgtccgtcttcacagccttttcctcccaacaacgcataatattagctagggtttcaacgcatctgacggcggaagctagggcgtcgccaccgtcaatgtcttggcactcccgctctgttcatcaatcgcatcgacaggtaacagtccatcatctccgtatcacctccttggatcctcctctgttccgtgacttccacagcacgctgccaggagccctatcctcaatcatgtctttcccgccgagctacacaccttcaggagcccatcccctcctccctcaaacgacgccgggtgacaagcaggaaaagtagtaatgacgacatgcttccaaatcactttcaacagtttcttctacttctttttgtttgccttatgatgattatctactgtcagttactcagttttatgatttgactagttactttggtttgtggagctggatggaacaatctttcagggtgcttcaccattagattgtgcttatatattgagctgaaaatttaacctatatatgtcctgttttaggtgctccatgattctctataacatccgaaataaattaggattaaagcaagaataggaagttattcaaaactcaaaagtaaagggtttccggtcttccagttaaatgaccaa

SEQ ID NO: 3776 - DNA, 1434 bp, Zea mays
gctcccatcacattcaactataaggaaggaggccggcgactaaatgcatgttgttcgtctgagccgtactctccaccgacaaaaccttaacactaatccacgagggtgcgcagccaatgatgggaaaccaccaccgatcttcaccgtcaccaacgtcgcttccccgaccgttgctatactagcacaaaacttcactgatgaacgagatggtagtgaacaccacacccatgatccccaccaagggtattattttatggtttaatatctagtggttaggacacatgatttagtcgttttaggtttgtcctaagtcaaactattttagctatgatcaataatatatataagattaaattattttaaactaaaagaattacatagtatggtagtttaagtcacgataaatctaataacttttttttattttgtaaaatcttataaaacatccagtataaccaatggaaattgacaatgattgacatagaacaaacccaaaatgactaaatcatgtggacggatggagtatttgatgagcaagaaaggcctagatctagttctaataccgatatctttatatattaaagcatgcttgacatatcaaactatccacgtcagtcaaaagataataatgtctgtcggatcttttaactgttgaaaatctggtcgtccgatattaaagaattgcctttaactgacctatcaaactatccacgtcactcgaaacacaacgtccgttggatcatttaattttttcaacacgcctaggatatacgtcggttactagttttattgaaattatctgtctctaagatcgtatccaatagttcagttatatggttttgtattacagactacactatttatataataaagtttaaatatatatatataaagattagtaaactgctgaagatagcctaactaattaatcagactatccacatcactcaaaatacactgtccgttggatcgtttagccgtggaaaatctagatgaagatgaggaccagcaactgaaactcttctagcccggcgccaccgctagttattataaataaacgytgctcagcctgagttcacttcccacgcggtttttgtgtttgctgccgccgcggtttccattgcttctcccgtcgctagggcgctcgtgaatacgtgatccatcgtctccatctccgtctggtgtggtgaggtttgagagactcgaggtgtgagcgtcgcttcgtctggaatcggctctctcatttgttagatagatccttctatctccccacgtttgggcgtcgcttcgtcggctgcgacttgcgagacgccggcgccgccggcgccggtggacgaaggcgatcaaggattaggcgatccgatccgatccgaaccaattctccattctttgattccttccttgggtgggcggctgccctcagattccttccac

SEQ ID NO: 3777 - DNA, 1500 bp, Zea mays
tcgccttcaccgtaccaaatggcgtccggaattgtttagtcctgtagtatatatgtacgcggaatcggtcgctcgtacgatccgccatcggttagcacgagaagctagcgcctggtgcagatcttctcggggtagtttttagtgttgtcaactattattataaacaattatttagaaagtgagtctaacttcattggttatgatatgaagaaagttgagctacacagccatgtccatcggtgtcggcgaaacgtgcagcaactgaaaccgaaaccgcggcctttctcttcgttcgagttttacacggtgtctattccgtggccccggcggatgccttgccatgaccggggccgggaccgggaggatcaacactacgcacctcctcagctacgtaatttactactaacacaagccaggcgcaattaagaccggccggtcaatgtccagtccctgtttccctgttctgcttgcagggcggaccaccgagaggaaacaacgttgaggacggcacgcgaccgtcacgacgcgcggccctcacggccactgtacatgatcgtcgtcgacggcagcagctccgtaggacgactcagcgctggagcctagtgaagggtctgcagtgcactcgcgacgacgtgtctcgtgtgtgtcgtcgccctcggagtcgatgtgggatgcgcatggcaccgcagcccgtttccgccgcggtttcggtctcggcgctatggacacagtcagctcggcctctggcctctgggctcgtccgtgctcgcttgcaggttgcaattacacacctgcgccgttgctggctccgccggcgtggaccagctggagccggagaaaccgcgcatgtgcccggggcagccgccagccggctcccagcctgatggctttctgatctcgtttttcgtttgtgtcggattggtgggtcggaacgattcttagccggattgcttctctaatttatataaactttaatcaactggaacgattccgggtgcaatccgacgtaaacgaacaaggccttaccgggatcaccattaccataagccgcacggtccccaaacccgtgacgccgacgtataccataccataccatactatgtaatacgtactatccaatcttaatccccgcattttttaaactagtttctcatcatcatcgtcctcgtcgtcatcttcttcttcaccctttccttatcgtgtagtagtacatgtcgttgtcgcctacatcactggctggcagagcagtaagcagtaaagagtaggcgcagcataaagccgaggcgagcagccgtcgccgcctatatatcgcggcgcagggcagcaggagttccacacttccatacacgcctgccttgtgccttcccttcccttgccttgcttcgcttattgccggcacatcacatcggcaggcgagggacggagcgagcagggaagcccatccaccagccagccaccgcgttcctgagaagcgaggagcgagaaaagcgaagagcggcc

SEQ ID NO: 3778 - DNA, 477 bp, Zea mays
atgctgctctgtttctctagggctggctctagcagtagtacagatttctgtaatccaaatatttagcagagtgttaggacctggtgatgaaatggattcagaaaacaagttttgaataaatctgtctctggtggtgtctatttagcactttgctttggcatgaggaaagaggaatcctcccatgtcctgcacatgtactcggaatgaaggaccttccagacaaggtattgaagagatttaccaatttaatttcggcaacaaaactgctctggtctggtctgcctttagccatatgtaagcacaaaattttcgttttcacgtcgtgtcttgatgctcctatttaggagtacgtatacatagccaggaagcgtattttttttgccatccattctccttattcctcgttgaattcggcccattggattcctccgacgcactgacccgcagtcccgcacaaccaccaccaccaccaccacc

SEQ ID NO: 3779 - DNA, 974 bp, Zea mays
attttgctgagaacacctccaatgtggtggtgtgtagtggtggaaggtgttatttgtaaattgaatgatcaactagagacgttagatctaaaatgagtggtgatgatttaatatgtgcaccatgtgcatcaatcttccatgtgcacaagatatgtcccctttaaggaaaggtagctgttacctttgatattctctttccttggatggggttcattcttttttttcattacttgtaggcgctagaaaaatgtcttcttaatgaagacttctggttgatataaaaaacatcagtcatcgcaaaaccttaatcaatttgacggcagagcacgtgattacctttcttataaaaagtaaaccatgccaggagttcagggaagcttctcccatgaacaccttttccataaacaaacccatgcatgccacaaattaggaggctttttatccaacaaacttgtgttctacttattctagtggcagctgggttattattcgtctgtggccagccgcactactgaatgttttgtagtataagcatcatgaccacttgggcaattaagatccatccttctttttttgattaagaaagaaaagaactaatgctgtccatcgtctcgaaagcagatatatatcttgtaatgctaaattttgcagcagcaaacaacagagcaaaaaaaaaacttggtatcttttaagggagaaaaagaaatgcctctataaatctcgatcactgtgctgcttgatatttctgttgtccggaacgcatgcatgaacatgcagagaactttcagcccccgctcttccatgtcactttatactctctttatgcagtcctggcaattcacacaaacgaacctggctggctcgtcgccgtcctcgcgtatatatagcggcgctaagtgagctctggggcaggcacagcggcagtgttgatgcgccaccgatccttgtcctgtactgtgtagtgggtagcctcc

SEQ ID NO: 3780 - DNA, 1317 bp, Zea mays
tagctatcgaaaggtaacagaggacggggggaataactgtccctatctggcaaggatgtgaggtcgagaataccatactggcgatgcgcggctgcggagtaccaaaggggcgaagccgcgcgacgagattattacaatctcaaataactcgtctcgttgcgcctagtcgacgaaatgcgacgccgagatcactgggctacgagtacggctgcgcgccggcacagccaagcgcggcagcggcgcttgcgtcgaagggaaatggttacatgataggggagagctggatatgcattgtcatgccctaaccgcgtcttactcttatctcagcacttttcgctggttgctcacctcctccgtcctcttgtttaatgccgcaggttcgccggattcatcgccccattccgctctgggctaaggttccaccaggtgcgcattggcttgtcaaacgagccaacactgccctatgttttattcttccactgaccacagtggtaacccgcgtcactgtttttttggatgcaaatgcgataattttaatggacattggggaccatgttcttagcaatcctattgggctagtttatgcttctgtctgttgagttcattttcctgatcgcatatcaaccgagtctaggcactaggcagggagcagcttcaggaaacgtagccctgaatctgaaactagtacggacatcaattgttggtccttccatggttgcccggatctgtttatccttcagaaaatttgcaaacaaataaacatatagtatgctacaattgctgatgcctataaaatggctagcaaccgaatcttctgtctaagttccatgtcctgccagtggctctttaaatggttttgccttgttatgatccgttggttgcgcagtgtttcatttatactatatgctgataatttctacatctctttttatagatagactatgtctaaaagagtaagtacatattagattccactgttttaataacctcttcgggaaaatgaccgaaacagctctcttctatgccaacttatatttgatgagacctatttagccatttgggaattgcaaatggtactgatacatgttacctgcatgtgcaatacattatgctttaaagtttcctgtcatagaagctttaagttttttcgacacaaaatcttatttgctgaaaataatgcgccatagtagaatcaacaagaacaggggaattattttttaacctacgagtgactccattagttcagctggtatctttcaatttaaatttgctttacctacaatatgaccagctgtctctgttgttcagcacaaccct

SEQ ID NO: 3781 - DNA, 285 bp, Zea mays
gcgggagtttctgcccccccctcccactgttcgtttgtttgttaggtaagtttttaataggggaaaaaaaaatgccactaaatgatgagtaggtttgaatagggatattttatagttgtagtggggtatagagggagaatatagagggaaccggcctgcgggagatgaaaaagtaggggatggaatgttaatgatgtgacgcaaaaaagtgatatatatgtggaaaatttagagtaaaccgttgcagatagtctcacctcgccgccttagaacaccctggccgcg

SEQ ID NO: 3782 - DNA, 1122 bp, Zea mays
ttgcattgtactttgttaccacattaccttgtgatttaagactggcctcattgttctcctcgccggagttgtgtttgcaactgtatcacagatttgatttagattattgttgttgttacattgtctacattatttgtgatcttctattttctatcacatataaaaattaaggtatgaatagttatcgtgttgactaattcaggtgccacgatcgccaccacgccgcccacaactgccacgatcgcctttggccgcctctacccatgcctatgccatgttctcccaaatacatctctgcctagagatgaattatttaattgttttaatattctatcaatagtttattattttaatattatgtcatttgagtaacaaaacttatgcgtcacttatttcggatgagaaatgtacatgagatttatcggtctataattatccattatttggatagcctcggaattatgacgagcttggtggttcgatcgaaatttcgatggcttaacctacattgttctctagtgcaccatatacgggcccgcatatatagaacaaggggctatgctgccaaaatttcattcgaatctcgtaggctcgtcatagatatcatgctatatcggtcactcttgggtgggtttaggacatatccttatctatagactatataagatgctcaacattgtataacttgatttgtactatagcaaaaaataggtcagagaatcgtcggtgaatatatgatggtccgagtaaaagtcggggcgtcgggctcacttagctggatggagggctaaggctggagaattcatcaatcattgggcgtgcacacctagcttgcgtacagatccgcgcttgttagtgatccacacgtacagatccgcgcttgttagtgatcacctagctcgcgtgcgtggccataagcctataagtaccctcattgggcgtcaaggcaagacccgtgactctaaagaaacctatactactgtctcatatgtcatatgtccttcctctgcaactcaccaacctacacatgcaaagagcttcagccacaacagagccctattgtaaatcatccttgataataagcagcgtacgttattagctctcccatccaccgactccaag

SEQ ID NO: 3783 - DNA, 385 bp, Zea mays
tttttctgaagcccgttgttggggatactgcggatccaataaactccagcgagagggagcgcatccgcacgtcgccaagggcaggtcgctcttcagtcttcaccaccgaccgcctgacaccaaggctcagttattgggttgggcttcgatgaaaggaaacagtaggtacgcctcgaccacgacgagcccacgaaacaaacagcacgtgccggtgccgcaggattctcgaacgcaggggccagctcgcttcacccctttcggtctcggcggccgtcgggcccacgccgcagaagccccgacggcgctagccgcgctacgctacgctacgctacgcaccgcgtttctccgcttcagcggttcgcctctgcgccgcaagctcctagag

SEQ ID NO: 3784 - DNA, 1321 bp, Zea mays
ggtaccattcagatatagatacatataccttttcattttttttgttgtagggagcaaataatgtataaaacaatttatgaaatttttttattattatacgtaataatgtgtttgataacacaataaaagattagcatcaaatttcatacatatctattttaaaatattaaatttgttttaatagtttaggtacccgttttcatccgtatgttcaacaacctccctatcccatcttctatctcactctatattttagacttcactttataaacaatacactctaaaaaatgatgttttacatgcttgtatatacctaaggtgctaaaaattgctacacattttatgccacacttgattaagtttaggggttgtttggttttactacctcaattgctacagtttgccacatccaaggctaggcaagtttcactaagttaggcatgtatttggtttgaaggcatggttgtggcgaaaattttcttctgctatgtagatccactcgtcaatgatttataaaagtgtggcaagattgccttaagtaagcttggcataaaatgtgtgacaaaatttgacaaaacactgtttttagagtgtactagtcatatgcccgtgcattgctacagtttatatatatatgacataaggataaattttgttttaataaagcacaaaatatatgttttttattgattaggtgggtgtgaatgtggagctaacaaccaagattcaaacactcacttatacataattttaccttattctttatataaactctcctattatagtaatagagaagaaattataggaatgcaggttgattcgaaagaaatatagtttttttgaaaaatattgatgcgggacaaccgttgaaactgatgttttaatatagtagagataaagaagagattgtttttagagtgtatttttataaagtcaagtttaaaatatggagtgagattgatgatgtgataagaagaccattaaaagtagtcttagagcatctataataattatgtaaaagaacaccataatttggcatacctaagataattttgccacacttttataaattattgacgagcaaaacctatacagtagaaaaaaaatcttgtcataactgtagttataaactaaacactggtcaaatttggtaaaacttacttaaccttaggagtgacaaacactccacgattttctagacacgatccaacaaaaaaaacccaaaacttacaagcaacaaacacttcattataaaaaaaaaaacaacaaacacttctcgggttcctttcttcgtgcgcactccactttcgccggcgtcgcc

SEQ ID NO: 3785 - DNA, 127 bp, Zea mays
gtgattcgacaaggctgttcctacgtccgatcgctgtgtataaaatgaagtattcggttcggggcctgagagagcacattgagcgaagatcgactgcactgcagtctccaacgttgggacctgtgtg

SEQ ID NO: 3786 - DNA, 1376 bp, Zea mays
gtaaccaataaactatatatacccaagctctatccctaaatttataccattatattgtcatgtttcttaagagttcattgttattttaaaaggaagaagtttcactccaatctatacataagttataaacttagtcgatatttattgcaaatctgacctctagtttacaaaagcaaactctcgaagacttcataagtttgtaagctatctccagcaactatcatattctatccgtatatcatatcttattttawwttttactctacaaacaatatattctactgtgcaaatcctctattttacacggtccagacagcataagatgtataaaaacaacacgaaaatctaaggggtacgtctattcaaagatggccaccgatgtgtgatgtttttgtttaaaaaaaattattaaacggcttcctaagattctactaacaatgagatttaataaacaaaacataggtatgtacacgtgtacgacgtaaagaaatcatgttcaatgtatcaatttactacgcacgttactagaaaccaaaatgcaaaaaatggaggtggtggtctcgctcgcacagggccagcatccgcacgttggagggaggaagcttccaaatctcaagattttataattcgtcgcccggggatgtacgccaccggtgagaatgagatgatgcctccactgcataggcatgagtacatggatccgccaggaactagctggggtcagtgagacataggcatccatgacggtctcattttctgtttatctggtaaacagatgcgagagatctaataagctacgttgacgcccaccaaaccattaaagaaaccatcccgtgacacgtcagagcatcatcagttgtaaaccacgtacgggagtacttgggagcgaaaccacgtccagttgggaatgatacacgaaattgtctcgtattttcttggccgcgccactctctgtcactgataacagttggcgccgttcctggatcggaagtcaaccctctccagcttataaacttaacatatatatacctgctgcacactgtcactgactcacagcggctttctgaaatgaaaaactccaacaacgtatttcattcggtattagtgtatatcttgttactacttatgttccattttttatttttatttttttaaaaaaagtaagacagggagtcaagtactagaattatgtctaccttttgcatacattcaacaaactactaccggccccggcccattcctattggctattagtacatacaagtgcagctagcttctgttccactcacacgtcacacgacaccacaccacaccagcatcgcgatccccagccctgtcctctctctcaacgcttagctagtttagctaccaatacc

SEQ ID NO: 3787 - DNA, 1430 bp, Zea mays
aggtctaatttggaaatctcattttaccaagtgattttcatttttatttttcttagtaaatgatttattttttaaaaaaattagggttcccaaactagctttaataaaacgaaactagaatagaatctctacaacagcctaggtaactgtaacttgaaactcttttgcaactgaatttataataaaataataataaagaaggttttggggcttccaccgcttcctcgactgacctgcccatacttggaactccacagtccactccactctactaccctcctccgtcgaaagcgacgcctcaccgcaacacaaggccgcccgcggacactgggtcggcggggcccgcacctcctttccacgcagcttttccacagcacagttgccatctgtcctcgccggcgcaggagcagcctgccctgccccgcgtgcgaccctcctctgctttttagagagagacagcgagcacgcgcagaggagaggagagagaagcaccacgcctcccaggctcccagcgcgcacgcaccagggtccaggagaggaggacaccgtcgcctcctggttggttcatctcgtcagtcgtcaccgcctcccgcagccaaccggcggggattcctgtcctggatgcgacaaggccagcaggagagaccctccccctctccttcttctccctgagcaggaagcggaaagccttccgcgcttttcaaagatcgtaggccgcacgcctgcagcagccgccgactcagggcgagcgttgagaggaggacgaagaagagactgaagaagagcagaccgaagtgaggccggaggaagggatcgggccttgcgggattcggcagtccatcacgaggtgtgtttgcttctcctcctccttacccatcgtcttctcgtctcgactcccatcaccttctcgtctctagagtcgagactggcggccatgcgctagtacccgtatccctttccggacccaattgaatgcccttgcgacgaacaacgccgtccttactcattgtagccaccgtttctagtacacctctttactagttcacctcctcctcctttcagatagtataatgctccgtacggcactgtgctctgcctttgctgttggcttcacaagattgtttgctttcttgttaattagcatgggaaaaaaaagggtgaaatctgttttgatctacctgaacttgttgctcatttcgctcgccaaggctaccgacatgctcatctggatttgctgctctggttgtaaagccgcgcgcgcgcagcctttatttgcattaggtagcttggagtgatccgcttttgccatggctaccgacaacatcattgttctctcagaaggctccactgcttagcctacatattggagtggggttactgaaccagggctcaacactgcgcaggtaaatgcggcgctaggagctgcagcg

SEQ ID NO: 3788 - DNA, 489 bp, Zea mays
aaaaccaagcatagcaaagaccaaagcaaaaggccatctctgacggcaagaaagaggaaggagaccccccgagggtcgacgtctcgcgatttccggtggcaaggttcggttttgatccagacgcggccccaggttgctcatcccagtaacagtcgccgcttccggcggagcaaccgtaggaaaagatcccgatttcctttttatccggtagcagttcgtggtggcgccgccgccccccgctaccttcgttttgcgaggttccgattcgccagctgctggagtgaggtggggagcgcgtgtcgtgggattcccgttcggatctgcggagggggctgctctcctgctccaatttggttggccggcaatgagggtccttgaatcttgttgatgcgctgccagatgcgggaggagtactgggggaaggtttcttgaaatcttcgtctgggctccgtggagtgaggtccctcgccgggatcgccctgtcgtcct

SEQ ID NO: 3789 - DNA, 127 bp, Zea mays
cgtatgtgttctccgaggtccgactagcaaagtggaaaattgatttgtccacatttcaggcggacaccaccgtgttgcccccgcgtcctaaacttctcacctcgccggggtccggtagccgcgaacg

SEQ ID NO: 3790 - DNA, 1500 bp, Zea mays
gattccttcacctcggggaacatgcattgatggtgtccttaagttttaagcactttttaggtgtgtagtctaggtgcccctaattgtcgtacccgacaataccaagtgtggtagaacctgccaagttattgggcccacatgcacctgtcctggtctcaagaccttcagtcggctatgcatgtgtactagataacgttaaaggatccgtccaaatgtcccaaaagacttcagataaaccacttacaaccaagatcgcagggttaagtaaacacaaatcacataccgaagtttgcggcggaattcacattacaataagtttacaaattacaatatcagagtgattacaaatttgattcaaaagtattacaactttaaatcatttgaattacaactttaaatttgaaatacattgctagctcaatgacaatcctcaataaaaagtatagacgagctactttaacctataagaaggctgagcccaccgacacttagcaccatcatcagtagcacaaatctagtacctgcaacaacatggtgggataaaaccctgagtatacaaatactctgcgagacttacctaactaaagaaaaactccaagggtatactggttttggggactcaaggtaagattaagcaagaatcaaagtctcttatgcagaaaagcttacttaaaaataaatccttaagccatattttagattataaagttaagtactttcataaatctagattaacctgatctagatcaatcacttgtccttcactaacttcattttaccatatcttgttccacttcttaaactacaatgcagagtagtgatccaatcttcatatcggggaagtaacgatgatccgaatagattaatacacagttgtgaatatatgtagcacttaactcttgcatatgtcaacacatctttggataatttaagatcataatgatttcacgccagccgagagtacaatactccaccctctagcctatagtcaggataaatacacgctactctcgtagtatcttcacttccagtgcatggtagctgttctaccggagtgctatggtaggactgacgagtgacgaccacctatagtctgatcaatagtaagttccatcaccaatagctaatacaatggtagatataaatccacacagtaaccagccatcgtcacagcacactgctgcatagtgcaggtcgccacaactcttctaattttctttgttgttgctgagatggcgacctccagggccacgaaaaaactggactattttgcccacgcctcttggtacccattttccctttgcttttctataaaaccaggcgaggcgccacaaggccggagcccacgtcccacccctcctgcatttcaaaataatatctccctgcgcttttcctagccctttgtcatccaaggatacaataaacaaccggcgcttttacacccccgccaagaacaggagcaacaacaataaggctcctcgcaacaatccattctcatcc

SEQ ID NO: 3791 - DNA, 1380 bp, Zea mays
ggtggattgggaccagcggccacaatgaatatttgtggagctgagggtaccgtttacgcctatgataggataggaggtgaagatacggtactcttggaggcctacttttctctttttttcctaaaaagttttaggattaaaagtattaggatctattggagatgttctaacatccaaaatttctaaccatcttacaaggatggcggcgtccgggtcctattcgggtcctcacgacttcagacctagtagacatgaaggacgatgatgtcacgatgggtacctacaccaacgtctccccctctttaatcaaacaactacaatatcgaattgaacctaaccaatcctgaatttaccaaatcaaaaactcatgtagatcaatcaatgatctgacagctctgctgcgttgacacctgatagttctatttgcacatgccattgtcttgattacacaattgtctgcattcacgatcacatcattagtgtacaagtatacatgtctaaatgggttgtgtatgttaggtgrcctgtagtccagcacggtttagcccggtagcccatttctactggacctgtgtcgatcgacctggtttgatcactatgccatgtctggtccttaaggatggcatgacgagctaggccctatataaagtgattttattgtccctactttttcataaaaacatatgtatattatatttgagtacagaatataaaacacaaaaatatgtgtgctatgttaagtgttaactagaagatgtgtgtgaacgtgaagttctcaaccatggttcaaacccccacccccacttgtgcacaataaaaaggcagtagagatttggtaaaccatgaatgtctatttttttgaaacaccaataatatttggtttgaggaatatggtagtccatcttctcactacttattgttttgtttgtagagtggaaatggttgatctatcgtcatttcaatccttataggctaataattagtaataatatgaataacgagttattctaccaaatttgtggaataaactcatgatacaccacctaatcccttgttcggttatttctatcgcacatgagttagataagattaaaaaaaattataaaagatttacttgtttgagatttaaattactcaatcttatccaatctatatggactgagagcaaacgaacaagctggacggaatcttgtaaccaaagaacccaagtttttttcaatcagtcaaggaaataaacactagccttgaactccggaaaaaaatcttgaactcacgcttcaagattggtgcgagcaccccactacgacaaaaccggatagaccaacccttatcctcgagcccaaactgcggtagcgaaaacgcgagcgctgcggaacaacg

SEQ ID NO: 3792 - DNA, 1500 bp, Zea mays
gccctatatttagggcattgatttaagacaggcttgaagatgctcttagtccattcacaatggaagtttaattagatattttataacattaattagtataccacataggatttttgacgacattacagtatatttattatgaaatagttgaaactaactatgccaacatgtttccaaggtattggaaagcgtgtgaaactaccactgaacaatttattttatctccatctattttatctgttcctatagttatttatatttaacattttgtaatatgttagtctatgaaattgtgtcatgaaactcttcatcaagagagcatatttcatgctttatttcatcttactctggttgacgtggtgacattggaaatggtgtgataaagctaccactgaggccttactatccatttcgtgctcatctatgctgttgttatttatttttattacttggatggtagcatgctgctgctgtttgctgattctgcggtacctatgtggctatgtgattagcatgcatatctgtttcttgttgcttactgttccttattcctcccttggtctactgagactatgttcaacggtgcacccttggctccccctcccctaacactgtagccgatttaggggctacagtgtgcccctatccccttcaccggcttcctcctcctcctcytctcgcctcccgattccttctctctcccgctaaatggatgggcacgctacgccggatttctcccccgcagccggttccttcgtccacacgaccgcgcgctcggaaaactccgcggagggcgaaggaggcgaaccaagggcgacgtatccgccgccggagaaggtagccctcgatccgccgtctcccgcgattcgtttgtcttgcgacagctgggcgaccgtcgtcgccgccgcccttctccaggtgcccaggtcttcgccggtccctttgccgcctccttgccgccgacgagcaccagccaggtatgcgcaccccttctcggtcctccctgctgcgcgaaaccgagcgcccgaaccctaatttgagctatctgtattcggatctaacccaattacaagagcgcgcatgtattatggctcctagcttccatttttacacatgcatgtcctttgctgggcccgcccctgtctgaaccctaacctaagctatttggatctgatttagttacgagtgtatatgtgtatttgcacctatttggatcttgcggttcctaaggataacggctgtgatgtcgtttattaaggtgcttgatgttttgattgttttctccaccacagcctaagctatctcttctataataactctcttatataataagtatcacacaaaaaaatttccctataatgtttacataatttgcacatcatcatttattgtaaagtaactcaaatacgtaacagagcgtgcccaagggtgcccaaggttgtttaggagacttaattactgtaatttgggttggtttgaaggaagaaaagaagctgaacc

SEQ ID NO: 3793 - DNA, 1188 bp, Zea mays
gataaatacgagagtatcaaataaagtctaagcgaggttgtcttctactgtggatctaatcatagccctctcctatcctataacatactgctatagctaaaaatttatgagaaggctccacaggtcccatggcgataggaagcctcgagccctgcaacctctggcccaccgctggatcataaataattaagcttcacaagagccctagcagaaggtgaacaggtcatttagcatcgacttatgctatcgagtgaagtttagaaaaaaaaaatgagatggataagactacggggatagtctatggaggaggtggccgacggcacgtcaaggagacgatgttaagttggcgttaaaaaacccagaaaaatactacccaatctaccattctaaaataaattctaaaataaagttctttgtaatacactttttccgtccacattcatttaaacgataataaatatagatatacatataaactacatttatatattacctaataaacatataattagtcttaaacgaattatattttagaatagagaaactataactttattagaacatcttcaacaaggtgactcaaaataatgtccctaaaagtaaaacattatatcatttaaaatgtttagggcagtaaaaccaaattatgctccaacaataaagcaccaaatagaaatgttcttattgatgatgcagtttacaacggacaatyatatctgatatgaaatgcagagtaccagaaaagatctaaactgagggaaattacgccaattgcgttgatgatatttagatctcataattaatttaaattgcaaactagcgagtatgttttagcacttttagtcagttcattatttatttatttatttatttgcttgtacaaaaagaatatatgaaaataaaaaagaattcttcacccatgcttatccacatctgggctaccacgggcatcggcaacgccagaggcccaaataggcgtagatttttttttatatatatagcgggtctaaaatgtattttttcttatagcgggcctagaacgtgttgacccacaatagagaaaggcaccactgccgtttccgtcccgtttgcttacgtcaccaagccgccgagaaccagagacagacagagaagaaaaactgcagccgccgagctcagcctcagccgccgcgacggggacagggaaag

SEQ ID NO: 3794 - DNA, 1295 bp, Zea mays
ttaaggtgaggactttgttttgtattgtatatttgacacattatgttttgtatcgtgtatatttgtagttttgccatattgaaatcggccccgggcgctattaaatcctagatcggccatagggcttcttacgccgttgttgatgctaaggcgatgctctatggccagtggctaggcgaggcctgttggctgttgcatcttgctcgtgtaagcaagctgtttgatgtaatacctcaacgcatcttcctatttgaactgcattcagtttcttgcgtacctgatgccagagttcatcaagggaactttgatgatcttatcttgcttgctagtttcatagcacaaatggattttcaggctttaggttcctgccagtttacatgctcaaattattgtactactcaagtctgtagccattttgctgtgctcttgtattagcacaattatccttaaaagattgttttctctcctcccccctcaatcctgcattgttttggtaacatggtgctactccgttcacaggtcagactagctaacatcagaatgcctcctcctgacctcctccatctcatccaccttcagctgctctatttctgcattgttgacgtgagagttggtcgacagactctgatgcatttgccttgctatcattatagttgtaggtatgcaatgcagacctgtggcgggtcacatataaagaagcaatgttttcctcaatccaaatatttttagttcatgtattctaaaacatgccttaaaattcggtacaactgttcataatggaagctgatactcagatacacaagggtgctccccccgatttactaataacatagaaaatacatgtagttctttctgcgtctgacaagcacagctaaagttacatataaactagggacacatctaatgcttggatggaatttctgagaagatagcatgaatccgagatattcatatagcagccaaagtaacttttgaggacaaatgtgctttcttcccaaaggtgaacttagcagtcagagcagcagcctgtgggctgttccaaggccatgcatcgttcaagcaagcagatcattagctagttttgctgtcattttacagttttcggttggcattattttcttctctattttatcagcagcttcatcctgacctgggtgcaaagggtttagtcgctggcatactcactgatgacattttagttgctcctttgttgtcgacagattaattcagcacggtgccccctactaacttgctatcagatccaagtcgctgcagaagggagcaaacaaagggag

SEQ ID NO: 3795 - DNA, 319 bp, Zea mays
acccctgccgtggagctcaccggcagcgaagacgaggactggcacgcggccgcgacggccggaaggacgcagcagccgccgccgccgctcacccacgacgacaaccgcggcttccttcggatgctgcgtgacatgaaagagaagtgattagttgtgtaattgtgttgaacatatcgagtagtatcatgcatatgcttgcatgcatgcatgcatcaatctgttgttatatactgcactcaacggtagcgagcagcaaagtcctgacgcatgtcggtatatatgtcatgcatgcatggtatgtgtggtatgatggactggc

SEQ ID NO: 3796 - DNA, 948 bp, Zea mays
ttgttggggacttgttctcaagtgctatgagttaagaacaaggcaacacagaaaatgttaatcgttgaagtccttcgtcctccgaagcattatttcccctcaggatataatggcttatggacgaaggttatgaaggacgtaccttcataaattcattaaacaatgacgaaggatgaaatataaagaataaaaacaacatgaacagttatatattattatcaggcttaagcagaaatatcattgaattacaagtgtaccttcaattgggaggagttgacagtacaagcgtgacgcaaaaagcaaatgccaagtcagcctgaacagtacgggggtactgttctcttatttataggcacgggacacaacccatacaaaattacattcatgtccttcacacttgataataattctatagtaatctgtcgaggtttaaatagccttttcatctttaagtcggtttcacttgttgctaccgcgccgaagctttcttgctcacaccttcggctctgtatcaaccttcgtattactctggtctactgtgatgctgacttgaatccgaagatacctgttcacacatcatactccagaaatactgttaaatcatgtttttgaggaccttcggatgccgaaggtccccaacagtagcccctcgcaatattaatttgttttaaaataataaatttagattgcgacatggacgaaggcttttcgccgaaggtccgaaaaaacaccttccctttgctagaatagcaacagtcactgacaagcggggtctttcaattttcaacgctcttggcgtataaatacggccataccgcaaactcatttgatacgctctctggccaactgctcccactcactcaatttttagctcttgtgaactgagatttgctaagcttttaattttgaagcttcggctttgaaaatagttttttagcatctccgaag

SEQ ID NO: 3797 - DNA, 194 bp, Zea mays
ggtatgacaatttccatcatgggaattttgtttttgatgatgcttctcctctgtccgctgagctgcaggctacaccttggcctccgtcctacaagccacctcagcttcccatatttgatggccactcagacccgaagtagtttttgatgagctacgaagcaacagtatcttcgtatggtggcaatgctgcggtc

SEQ ID NO: 3798 - DNA, 804 bp, Zea mays
tgttgtgaaaataaatatgtcacacattttttacttccccctataccacttactccatcatggactaatgatcttcaaggtatgtatgctcagtttagatccaagtctccacatactccatcttaagtccaagtctctactttaaggtatgtaatcttaaaactttgacgtattgtaattctataaggagcaaatctgaaaattaaataaggaaaaactggtaaaggcatgtttggaaatcggaacgcagacattttgttgttcctatgtttttctttaaataaactcattcgtgtaaaatttcttcaaaattcctctccttcgaacagatccttttgcccccggacccctttcctacgcttgcccaaacccacaaaaccctcgccgtcgcgccgcgcgattgcctctccggccgccgcgagcccgcgacactagtaacggtctacaccactagaatgactgaagaattgaattccagcaaattcaagcttttgttttagccaagatttgagattcgatttgaagtgtggaagtccttacaatttgccaatcctatatttgatctctgctgtgctgcgttaaatccctaaacttcacagcgcggcgccggcccagccacgccggaagaagtcgccgcgtgaggtcagtgtccccgttgctgccgcctctaacccgaagcctaggccgctgccggtgcataacaaggagaatcaggcggaggggaaagtagcagaggagggggcagcaactgaggagggggagaagtaccgggcggaaccggaaatcttgccgctgccgccggcc

SEQ ID NO: 3799 - DNA, 729 bp, Zea mays
ggtaaggcttgcatcgattattcctcctcagaccccactcatgtggaaaccgtcagcactgggcccgtctttttgtcattagtttcttcatttttactttgaaatataaatatgaatgcgcccagatctttttttggttcatgatcatctttctcatgaataatatacatattaacaattttaaaattcatagaatatgcatgttttttcatgaaatgaggagcagtataagactatttgggttaatgcttacttaacactccctccccctcgccacattgccctagattatatggttatgcatttcatcttgtctaaagcatgccttattttgtccccatgtatttccaaaattcctttcccctcctggtacgtgtattgccttttcctttttacaaaaaggaagttaatgtgcttaagtgcattgtttgtctagttagtttccagtattttaggcggctaggtaagtgagaagtctatattcttaattataaagagaccatgcatttgagggcttttgtgtaacacaataagaaatgtaaggaactttgaactagtcatgcattttagtcttctaatttaatcattgtgttacagggaaagtataaggtgtacaatctttgctccgaaaggattgcagctaaatttaatcatttgagggaaaagaaaattatcctgatatttactttcatttcttcccctgtccttttcagctggctaaatacaaca

SEQ ID NO: 3800 - DNA, 1500 bp, Zea mays
gtatggtgtggtctggaattaataaatgtgttgatgaaggaacttaagtgaccgacaattgttgtgtgatgtgaggttgatgctgcaactgcacctgcaaatttgttgaacgtcatgtgtcatcttgtacatggaactcagttaggtggccagttatttgggtcatggtcttttttggagcctttctccagattttgcaccatgcagcccttgtgggtgcacctgtaatgtgatctgcaatcgccttttaggtttagccagccaatcttgatatatctcgtgctgtttccatccatccccccacccgccttcctccctttctctggatctttattaatggcgcttgctgtttgtaggtctggaatgttcttctgttgctttgcagctacagtttaaaccaatggccatccagaaccgtgcacacagaattctgtggattggcattgcaagcaacacttgtactccctccttttttttatttgtcggcttttaattcaaaaataaatctttttttatttgtcgtgttttaaaaatgaatcctttttattttcatgttttatttcaaaaataaactagaccacgataaatatcggagaacgtaggtagtagtacacttggtacggaagctcttcttgccaagatgtattacagtattagcatggccaaacttctttgtaccacaacacgtaagcatctttacaagcttcttttcccgtaccgagggatgcttgccaatcacaacatcttgattcaccaccccctgattagcttttgaagttttcttttaaaaaatgtcaacatatctaccgtaaagtcacggagactattatataaatataaatatgcacaaacaattaaagataaagtcacagcaaaatcctttacgttttgcacaaatccacatcatggtcaaatgcgatcactcaccaccccactactccactaccaccacctacctaaccaaaagctacaagccttgagagaatccaaacgcaaatgccatgtctgcgttcccggctttgcttgcgaatggggcgaaatgagctggggggcgcagcgcagccgcaacgcggtgcaagtgcaaccagaggcaggcggccatgtcatgtcaccatggacgtgtgacttccaaggcaatcctcctcccactcctcatcagtcctcccccgccaacaacaacatctgaaagcgtctactactagcgcaagcgaggttgacatgtcttctcgccctctgtccctgccccgccgcacggctcggtgacggtgaggcacacagcacagcaagcgaggaggttgacgacaacgagagccccggaacgctgacgcgcaccaacccgggggaggagacgccgcgctctttcaccctcgcgcacctaactgacaagccgacgcctggcctgaccgcgaggagagaggttcatggtgcagtggagcagcgggcggcagcggagcctcgacccctcctcctcctcctcccccgcgagacgggcgccgagag

SEQ ID NO: 3801 - DNA, 1088 bp, Zea mays
gtgccggcgtgtcacaccccagtccacgtgtgttggcaatggatgtcggcgaaaattcggtccattggattggatctatgggcatggatggctgaccgggaccggcgatttgcagtggcagaaacaaaagttatttttaatcaaatctatctcgttaaagtaaaccttacaagtaaaatcatcatagattttctcataagctaatttctccccatcatccattaccatcccgaacttccagcgtgccccggactcgccatccgacctcccccccccccccaaccccccccgtccgcttgcgcttgcgcctccctctgccttcgcgcatgccggccagagcccgcgctcctgaccgcgccgccgcacgcatcctcgagcctccttccgcttgtcgtctctggcgctctctctgctgctggaccggggtgcgccgatccgtccgggcttccgattgttcatccgctgtggtaagggaccccgtcgtgcttggattggatcgatcgttgtaagatgagctcgatccttgtcttcgttttcgttgattggagcaggcgaatccataccgccctctaatttctggaatggcgctccaatccgttcaatctgttgatttggcgaccgctaaatccggcctgtgttctgatttcctttagagcttcaccttcacgtcaacttcggccccttttgggattcgattcgtagaattacctttttttgggtgggtggggggcgaagtcctgttcgcgcggtagccattagtcttctgatcatttgcctttttttctgttctgtttacttctagttttgggattagagttctatatgttacgtgtgggtgcatatcggatagcttgtgagtaaatttgtggacaagctagcatgttttatgtttgcgtcgccttaatctaacgaaatattcctttgttcatacctctggagcgactttacaggttacagctttttttttttgcagttagtggaattgaactatttttgaggctgcagaaagagctgcttgttgtgtaatccacatcttgacgcctgtaccggtgcgataaggaattgtatcattttgatattattgcaag

SEQ ID NO: 3802 - DNA, 112 bp, Zea mays
atcgttttggacatccatcaaaaccacactccataatgtcaccaaaatgcaagtgtacatacatattattggatgaaaaaaaggctctcttgtttatttggctcttgtttaa

SEQ ID NO: 3803 - DNA, 866 bp, Zea mays
tgatgggttttggtcttgagttatttcttctcctctgtactcttctagtttaagtttttttatggattttgagaatctaagttcttgaggttatttgggctttgatataaacgtgctagraccttgtaggcttctagtatcattgctattaagtggtatgagatgattcacctagagcataaattttccaatcccttgagcaattttgtgaaaccccttatttgaatatgtatttttttaatcgactttaaagtttaaatattttcgagctcaaattttgtaaatatctttgaaactccttatgaagttgtttgcaaattgtttactcaatcgcagtctgataggatcaattttgcattttagaacttaatttcgagttgctagaaacaaactgagtaagcaatactgttttaactcatttcatactttttagtgtccaattgtttcgatagactcgtgtgtgtcctaggaatatttgcaaaatatgaaattattggttggttgataccttttttgttttgagtattaccttcatctccaataaagttaagcactcattttcttgagtttggaattttcttttgcaaagacatctctagctgatttgagctctttactgtgttctttggtcatcaccaaaaacatcttgccaccggttagcatttacgcgtcttttgtgccttttgaaattttgaaggtttagtatagctaagcttaagcgcaaaaaaaatattgccttatattcaccccctgctgctgtcgcatattagatccttcagtatatatataaccataagcataaaacaagatcacccattctcccaactccgatgcaaatcctcgaccgaaccagcagacagcaagaa

SEQ ID NO: 3804 - DNA, 248 bp, Zea mays
agttcctcaccgccctccttctcttctcggccgccgtcgccgccgcagactcctactagcaagctaccaaccttctttctttcattcccttaggtagctcagccgtacacacaacaacacacaagtcatcagttactagctagttagtagcctatacaacacatacatacatacaaaggtgagtgaggttcgcgtgcaagcagagccaatcgtgccgatcgagctatatacatagccggcggcgaggg

SEQ ID NO: 3805 - DNA, 98 bp, Zea mays
agtactaaaatttcaaatcagatgtctaatttcctaaagcagatgtaatatttttcttctacacaagaagcagccttgttgtaacccatttatcttac

SEQ ID NO: 3806 - DNA, 672 bp, Zea mays
ttgatatggatgcccaggtaatggtttatgtgttcccttgtgttcaccctttctttctttctttctttcttttttgtttgtttcaatgaccatagccttaactggttatactgcatcatggcttagaattaaggaaagaataccaccaccctgcgcgtttaacttgagagttccctcctaccattttgacttttttttccctgtccgttttaactatgctccctgatgcagagcgagacaactctatggaggctgaaattctttgtgagggaagcgctggaacgacaggccaacgttgcctctgggaagatggacgaaaacgccaagagaaagagggagatatgcaatgctctggccaaaaccacctcgagacggatcaagaagcagccctagccatcttccatatctttcactcgcgtcctctgattgtttagaagttctttttttgatactagccaccagctttgtgaaacgttttcctgcattttttttgtgatgtgtatatagtagtatagtgaactgtccagtccagtaacaagtgatttcgtgtgtaaccatgagctggtcgcattcgcgtcccctctgatccaacaacaaacattgtctcacaatgtgattgattgtagaagcaagcttttgtcacagggcgatgttgctcacttgtggaatcag

SEQ ID NO: 3807 - DNA, 533 bp, Zea mays
aagtggataaaaaactgacagtgaccgatcactcagaaagccagatctgactaaaaaataaaggtcacaattcaatytgtttctactcgctttcytatgcaagtgctcgggcttcatagatgctctgtattaaaatccaatcagaagtgcaccttggacagagaaatttaaaaaagttaattaaactttacagctgytcaaaaagtgtagttcaatgcatttcataatttcatatgtaagatcatagtacagaaatactgtgtcgctatggttcaaacaaaaaatggagttctattctatactatataacaaccattacagaatggaatcaatgcatattcttctttttacatatcgtgcttatatagtagtagggatatatattatatggtcaaacctaaaatggtttcagcagcaaaaatcctaaagcatgttatgataagaaaaataaaaacagaatagttcctgaagcaagaactgacaacctacctaatgtgcaactttctgccctggagaacatacattacattcat

SEQ ID NO: 3808 - DNA, 1500 bp, Zea mays
catgcatgcgggcccggcggcaccacctgcctgccttcagtctccatgtgttttcaccgtacgtacgtgtgtgtgtggctgtgtgcagtgtgctaggtgcagcagctgctgcaaaaggtcaagctggtattcagtggcgtggtgactggtgaatctactggcagtggctgtactgtaccggcaggatcttaaatatgatcgtacgtactacctactactaggggacctccgaaccatttttttttctatcaggagtatgatggtgttgggccctgcttcatatgcaatctcgcaggctcggatttctccgtggaacgccaaaaaaaaaaaaaaaaatcacgcggcgccactaccagcagtcgatcaaattaagcccggtccaggatgtggtagcaaacagtgagctgccaaccattgtctcatttttttttacgaagaatggcataaccacatgcatattctttggcaccgtttttccgttgctgtatccgcgatcatgcatattcgtcattcgccaaagcaaactgtggtatccgtagtcgacttcttgcaatgcaactaagactttgtgcgaaagaacaaaaccgacgcactgagtttctcaccatcgacagaccgaacaaaatattcatggctcgttattttcaattttatcataacatctcagcttgttttattatcgagtctattcggacgaagctcgagctgactcttatgcttaaacaagctagatttgtcaacaaaataaagtcttaacttatgttggatgaaataataaaccaagccgagttaaacgagctagcatttaattatattattgtgtatatatatttttatattgttattttttttttggtatggtatgggagttaaacgaaccggccagagtttgcaaataaacccagccgagttagttctgtgtgtgtgactcagttacttaaggagccacggctcgagctagttcgatatctagcgactgatggaaagaaaaaaaaatagcggcgcgggtaaggtagtgtctcgatgcaaccttagcggcgaaggaaacctcctttttctttcgcttcgcttgaacatctccacgagttatctccgtctcaaacgaaaggaacaacaaaacttcattttcttggatgtgcgctgtgttcaggatttcagattgttcaacggagaacctccacgcgtcgtgagagcgcgagctctgaccgaagatctcagtggtcggcaccaaatttcgcgtgcacacctgcgcatccggcccttcccgtacgcccatgactcagccaccgcgttcctcgaacgtgtcgtccgtgtagcatccatagagacccgtcccacgcaaacacctcagcgatccaccgccctccctcttcgctaaagccgtaatccgaaatcccgcccccagacccagattgcacgacgcaaccgatccccaaatccccaaatcttcccagttccctcctcccgctcgacccagatcgaggcctcgatccaccggcc

SEQ ID NO: 3809 - DNA, 1500 bp, Zea mays
agaaaatgaagttttgttgttcctttcgtttgagacggagataactcgtggagatgttcaagcgaagcgaaagaaaaaggaggtttccttcgccgctaaggttgcatcgagacactaccttacccgcgccgctatttttttttctttccatcagtcgctagatatcgaactagctcgagccgtggctccttaagtaactgagtcacacacacagaactaactcggctgggtttatttgcaaactctggccggttcgtttaactcccataccataccaaaaaaaaaataacaatataaaaatatatatacacaataatataattaaatgctagctcgtttaactcggcttggtttattatttcatccaacataagttaagactttattttgttgacaaatctagcttgtttaagcataagagtcagctcgagcttcgtccgaatagactcgataataaaacaagctgagatgttatgataaaattgaaaataacgagccatgaatattttgttcggtctgtcgatggtgagaaactcagtgcgtcggttttgttctttcgcacaaagtcttagttgcattgcaagaagtcgactacggataccacagtttgctttggcgaatgacgaatatgcatgatcgcggatacagcaacggaaaaacggtgccaaagaatatgcatgtggttatgccattcttcgtaaaaaaaaatgagacaatggttggcagctcactgtttgctaccacatcctggaccgggcttaatttgatcgactgctggtagtggcgccgcgtgatttttttttttttttttggcgttccacggagaaatccgagcctgcgagattgcatatgaagcagggcccaacaccatcatactcctgatagaaaaaaaaatggttcggaggtcccctagtagtaggtagtacgtacgatcatatttaagatcctgccggtacagtacagccactgccagtagattcaccagtcaccacgccactgaataccagcttgaccttttgcagcagctgctgcacctagcacactgcacacagccacacacacacgtacgtacggtgaaaacacatggagactgaaggcaggcaggtggtgccgccgggcccgcatgcatggccggcaagcccacgggcgcccggccccaccctgccccgcacccgctccctcgccgccgtatgtactctccgccccgccaccagtcatgggcgagcgccgatcgatccaccacccggccgcccatcacctcatgctcctcttctcctgcctgccagctgccactatatataccacccgcgccctcccgctcgccgtcgcccaccacaacaccgacccccgcttcaccaccacaatccacaagcagctccggcctccagctgagactctcgagttccgagtcgtccgtacgtgtcgtacgtcccagcagccggcgctcgtcgtacgtactgcgtacgcgcgcaagcgcttggtacgaccgattcagcacgc

SEQ ID NO: 3810 - DNA, 523 bp, Zea mays
gagatagcgcagtggccgagtattttttgggatgctcgggggagaggagaccgggagagcgcgaggacgaggaggaaccgagaaatccttgcgtttttagggcctgtttggttcactacctcagttgccaccaacctacagatcgctctcaacgctcggcttttggatccggtttgaatagttctgcatgtgcaatctgatctgcatgacgttctggtgtgccaatccacgggccaggacttagtgtgcgatgaagtatttgacttctccaacctgaagaatcggatgccggaaaccttcagatttagatgcggcaacctgcaactttaaatagacacctgcggtgaacattggagaccactcgacgcctgccaactgaactcaacatcaacggtgaatagtgggtagaacttgacacccgcaacctgaagattgtcacactactgcgacagctaggtggtgtacggtgctgtcgataatcggatgtctagaagctgaaagctgccgctgcgacttcgacggt

SEQ ID NO: 3811 - DNA, 185 bp, Zea mays
ggttgtgggattgtcagcagtgtttttttcttttggcttgctctgtcggtgtttcagtctgtcattatttcaggcgtgggatgcatgctcttcccagctagcaatgtgctgctgtcgctggttgtctggtcaggtcctgtcttgtgtggctctacttgggcatgtaggggaactacttttgatta

SEQ ID NO: 3812 - DNA, 50 bp, Zea mays
cagatccatggaggcatcgcaagcccagatcccgctgtcgttaggagcta

SEQ ID NO: 3813 - DNA, 558 bp, Zea mays
gtagaaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtgccacaaaggcctttggtggtcttattggcgcataccacggtggggtcttcgactggggtgaagtcgtaacaaggtagccgtaggggaacctgtggctggattgaatccttcgcgatggtcgcctacttgactaaactaaggacctcaacggaagcttatgtagatcgactgaaaagacgattccattttccttcttgtttatcaatcaccaatcaagacaaaccgggcactacggtgagacgtgtttacacccgatcccattccgacctcgatatatatgtggaatcgtcttgcgccatatgtactgaaattgttcgggagacatggtcaaagcccgcccctaaaggggatttctttcagccaacatcctgcctgccttagtggcccctctctgataaggaaacgaaaaaaaa

SEQ ID NO: 3814 - DNA, 1500 bp, Zea mays
gagctgctgacgaggggacggggacgggcgcgaggtgggtggggatcagacatgcgaggagaggactagaggagccacgcaaccttgccggcgcgcggggactggcctgcctgcctgacagtggccggccgtccgcggtagctagtacgagccttggagctggagctggagctggcctgatcgagtcaaagccactgcacgtctgcatgctactactagatgagatccaaatccaatccatctgcctgtggatctctgcctagtgtttcggggtggtgggagggagggggcacggcaggtcacaagatcgaattgcatcagcgtcaccgtcagatgcatgcactatgcagcggtgtggcttcctagaccactcgagaaatgacactctgaccttgtgccggtacgttgtccggttgctcatcaatcaccctgctacaagcgcggttcggttgcacaaccggtctacagacagggctctactacggctaggcgggctatactagctgtacagacatgcacagtgcccatctctgatcgaatgccacaccgtgcatcatacggacaccaaccaccaccatccgataaggttggcatggcattcgctcgatatatacacaaacacacacatatgacatatcacagcggtgagcttacaactggcgtcaaaagtgtaccgcgcgtatgtccgtccatcactctcgcggacgggacgacgaggcgaggagagcagctggcaggcacatgatgggggcggggcggggcggggcggacacatgaggggctagctagcaagcagtccgattcggcgagcgtaccaaagtggcaaagcgaatggtctcgctatggagctatttatttagattgttcattggaaccggcggccgagatggccacgcacgacgacgactagaccaacgttattatacatttacccccttcccatgtcttcgctctgcgtccgcttcgtacatcacatggcgcgcaacatgcacgctagctgagccacagccgaccccggcccccatgcccctgccagattaattaagcggtttcgccaggcgcacgttacgctagcttcgctcgcatcattgcatgatgagattgcgtggtgaacttgaacgggccggcgcgcccacgagacgtaccacgggcgagcgcatcgatccagctcccctgccgccctgcgcatgcacgcgcgatgccggccggctgctccggcagtactccggccccttcccttccctacccgtgcctggcccttgagctagcccctgacgcgcgcgcatgcatgtggcgtacccgcccggcggtggccgtgcgtgccctcatgcatgctgccgcctgccgcgcgcggagccccgcgcgagccgcccacagccgagcgagggaggcaggcagagcagcggccagcgctgaagcccacggtggcagcaagcagcttgcgcatgtggcctgtctaccggccgccggcccgggtaggcgggcgagccccgtcgtcgg

SEQ ID NO: 3815 - DNA, 272 bp, Zea mays
tgtgagtgagttctagagtgacacctagcactgtatgtgagtgtgattgtgcaccaacactacactagaactctcttggtcaaactactcatcgacaacccctctttatagtaaggctaatagagaataaaagacctaactaaatcacgagtgtccacatctccttgacactcggactccgtagtccttcaccttttgtttcgtcgttttagccgtcgcttcgagttcttatctctgggattgttttcactgttgtagtacttctacctgta

SEQ ID NO: 3816 - DNA, 263 bp, Zea mays
gttcataaaatcttgcagataaaacaggcccatagcatgcgcacagagaagcccagcaacgggccggcccgcaaccgcgagctccgcacgcttggtcaacacaagagcatgcgaaccgtcctgcgactgcgaggcggtctcgacgaccgatcccccctccctctccgcgagaccaccacctggctcgttccctccccgctattaataattctctcctcctttcgccctgcggcttcgctgctgatccgaagagctagcgcgcg

SEQ ID NO: 3817 - DNA, 1500 bp, Zea mays
aatattattgtctatcacttagagtctctattttgacatgaaaacaatgagaaaattaatttcccacttaatcctatttcaagcacataaaacctttgtaaattcataatttaaaatctataactccaaatttaatgattcctgttcctatgatcttattttaatgtgtagattatcattatgtattttatttacatgtttggtgtgatgttaatttttgctatactatttatgtttgtattgatgcgagtagacgagcaagctactgaggatcgtgctgcccaatagatagaagttgctgagcaggagctcattgaaggcaagttgtgcccttgaccactttttacccaataatgttctttaatatcacttattcatgcataggtttaattttgatgggaccctataggtcaacctagactgtttatccattataccttgttatccctgaatcacttgggtagttttgttattgctttacatggtttttggataatatttcattctatcattgttccaattattttgttattttattgatattcatgtcaagatcattatattattgttaattggaacatggagcttaacttgagaaacacgtgccaccataagggaggaatgggaccccttggctaactaattaggaaaaagatagtggaagactaccttacctgaaaggggcaaggacggtaggggagttgcatgcaaggaggttctcgggttgattttgctgcgatggcagttagacgagggattcttgcaagtgctcttcccataaactgtagcgggttttcggaagctagtggaactttgtaaaggcctcgtagtggatccctagccattcacctcggtagtgtctaagggtctagctaacactggtaacatgggaaacatgacttgtgggtaaagggtacaacctctgtagagtgtaaaactggtatactagccgagctcacggtcatgagcagctcaggactctcgcatgattaatttatggaacttaaattcaatttgtcatttgcattgtatgggattatttattaattttgtactattacttttattaaggttttgtatttacttacatctagtaactgctaataaaattttgaccaactaattaaaagcaatgctcagctttaacccctgttgttgattagccttacacataacatgaactcccacctttggtgagttcatgcccactggtttccccacaacttgttgagctatgatcatgtgtgagctcacccttgctgtctcaccccccacaggagaagaacaggtggttcaggaggagccacacatcgaggagtttgatctgatctaggtgtcgttccccagttgactttatggcgccaaggatgatccttagttcgttttatatttatcttttattttgtaagacttccgcattgtaacaagtactctgatgttattgtgacatttatctctatacactctgttattatatatgttgtcttctttggcgcatgt

SEQ ID NO: 3818 - DNA, 257 bp, Zea mays
cgaaattactagctggagatcctaatcgtaacaatctagataatgttcaccagagatcctaattcctagccgtatcaatctgggagctccatcaatctagaccaaagatcctaaccatattgtcagcatgctctccaaatagattatagagtccagtttcaccacgttttcattcttcctattgtcagcatcgctctccaaatcccaaaaccctaacctatccatcgtcgccaccgtttaccgtcgctgccgccaat

SEQ ID NO: 3819 - DNA, 1500 bp, Zea mays
gacatactaaccttagagcctgtttggacctgaagtattttttatagtttctaaagaatatcatttagtaatatcatagtattttatgttataaggtgtctgaaaactttgttttcaaaatcatggtattctagatactatggtatttttagagtattcgaaactccactacaatttaaagtttttatgacattgctagaattttgcttaataccatggtttacaatggtgtatcaaaacaatctttcttaaaaccatggtatttttggagctcacaaaaactacgatattattatgacaattgtaaaatatagtaatgaaaagtcatggttttaagaaacattgtacccaacacagccccttgcacatttcagcttctgccatctgggatggatcatggatgagtatatattaattcacaagtggctaaccactccactcttccgtgattaataactcaagttaaaaggccaagcacataaatgaactcagttgtctttctaccatgttttctcattatatattggcataccagtttttttgaagcagtattaatttccattctcatcatcattaattaaaacaaaatagcgattttttcccgaactgttggtgccactgttactcattcaattgaaccaaacactttcttttccctctctataaccacccatcccatatccatcagcactgagttgagcacccctgctggctgcttgccctgctcctctcttctgcccatgtcttctccctcccccattccactgacgacagtagcaaccaacggtgtctcctctgtcctctctcctaagttacttgcagccctatcctgtctatcctcatcttcctcctctccctgccatcttttgcaagatctctccttcgtcttctctttccccttttaaatccaccggaatccctcttttgtcacgagccaagccgccgagcgcagcataaagcgagcgaagcaccagcaaaagagagcgacgccgcctgcgccaaagcttcggattcccgtctattttaccccccaccctcgccgactcaccggcgcgagatccatccgcaggtgtcggcggcctgcagccccccttgaaagatggcgcctttctgaggctccccgggggtttctcgtcgtttcttgcttggcccctaaagcgggagagcggcttccagggagctcctcccgttcccggccaattcagctgaagtggcggcaagtgggtttagggctcgatccggttttgtgcccgggcgtgtctgactctgacccgggctagggagcggtggttcttggctagttcttgagctggttgcggcgcttatccctcttcttggagctcttggattggtttgggggaaagcaggttcttgcaagcagctgcttcggttctcgaggatgttaattttttgaattcagtcggggggaatggggctctcgcggtctctggattgagcatttctttattggaattcgacatttcgtgcggcctccagtcc

SEQ ID NO: 3820 - DNA, 1280 bp, Zea mays
atctataaataggtcattagatgcttatataatcttataagctgaattatataatcatataaggaaacaaacagaacccaagtcgttggatggatggttttgcacctcgaaacactgttgcgtgccggtttatccacaggttcagcaacataaatggatgacggtgttcctgtgctgatatgcgatgtgggaacgaaggcagcttaatctcccaaggtctgctggtcgtcagatgttcggttggggcaccgccaaactcgtgccagaacgagcgggcgattgggcatctgaagattatgtgatagctgtcttcatcagattgttgacacagatcgcgagtagggcttatgtccatgccttttttttttctaatcaagttccccttgtggtttttatcaaggaatatttgttaaatatcaaggaatacaatgacttttacaaaatatgactaattttacacaaaacaacctctaaaagacaccattacaaggctttgaagaccctagtactgtcaatctgctagagggtgttattatgtccaatgtatgatgatgcttttggtatgtattctgtcgtattttgtttgttggttgtactgcagatgataaatacaaacttgtaataatgtccacatggctgatgagattttgtacgtgaggccgttcgtgcctagtgttggtagctacgaagaaaattgtgcttctcccgagatgtgtaaacaagatcgactgaaccccgacacggtgcaaacgctgtgatgctgcacctaacttacaagagtgaagaaagaaacagagatgaaaaggaaaagaggaacacgagagagttggccggctaggtgtggctggctccgatccattctagttccctgagttgggtgcccgctgttatgttagatagacccaccgagaggaacagtgtgtacaccgaaaaaaggagacgcttgagagggagagctgattacacagcaggatagcgagagggagtcagatagagatagagctggaggcgagggcgggccccgatacccgcggccggccgtggccagagcgttggaggggaaccaccagccacctctattctatttaagcagcccccctgcttcactcgctcatcactcaccaagaaccagagaggagcttcatcagctcattcaattctcgttccatccctcgtctcttgtgtcccgcctccgttccataattcaccagcgtcgtcctacccatatctcccatcgtcttctccctcgcgccatcagcttccccaagccagcggcgacc

SEQ ID NO: 3821 - DNA, 960 bp, Zea mays
ctgatgtatggatcatacagtcaaataaaacactagaatagcagatgactcaacatatcaacaaattgagagaccagaaatgtatgatcgttgaacggtagtgatttggcttgatgctccctaactggaaagacaagctagtcactctatcacacaagatataatgcccaagaatggaaataacagataggagtatcgttttgaataaggctagaggcaatacaaataacaaaaacaagaagttaacaacatagaacaaatcaaggttatacatgatatttaggcaatttttatcacatggacaagggctatgtcccatgaaactctaaaaaactttacaaggaatgtgcagataacaattgtcattggaatatgttatgctttcagtagggaccatttaaagtgttgctagtgcacattaagtttacagagaaaataactaacttgagatcgcagaaaatcaacagatagtaaggttcccttaattccagagaaaatagaaaatcaatgggaacattttttgggacaagcctttgttccagaggttccttaaaggacatttcctatgccacgacccagtactgcagtccaatatccaatccttacacccatgaccacctaaacctcccaacatctgctgctggtggtgatgagggtatcaccgtactgaccaactatttgacacaccaaccacaggaaaaccccggcctattcgttaagatctggaaccccaacgaaccggaaccaccagtccgcgggatcgcgaagcagtctatctaggagcgaagaacatgggcaaatccgtggagtttttgcgcgaagaaaaagggaacagggtccaagaaggcgtgagctaggcgtggaagcgcaggctagtggatctgaccagactagagtccggactctagggtgattggagtcgttacatggacggaggcaatcgaagattcggaagggtgg

SEQ ID NO: 3822 - DNA, 300 bp, Zea mays
tgcagcactacttgctggtatccctcaggtgacaacaacactttctacagcttcaccccatgttttgaggcggctgtctttctgctgctcttttcttgtccttttatttattcgaaacctgtgatacctggatgtgtaggaagcatcaagcctggtaattctataacaaaaaaaaaaaataatgttctgatgccgactcaaacaaatacgttatctcccagcttctgcattttcttgatgatgctttgagatggatccattgtactaaatcttttcgtgcaggtaacatgtcctttcctg

SEQ ID NO: 3823 - DNA, 768 bp, Zea mays
gtactagatctaatagttagctgctaaaattagttgaaaatattcaaacagtctaactaatagttgtgctttttaacaattagctagtagttagctagtttaattttactagaattttttttacccaactaactagcaatttcctcggaacaaacatgccccataaactgagtctgcactgagctactcctggctaccgcaccacgcttcacccggcgtgcactccatctctctgggacgactacggccgccgccgccgccgcccccacctacgccaggtgccgaggccttcgttggcctcttcgccggtgacgagaacctaccaggtattcgcaccccttctcctcctgcgatgcgatgccgagcacccaaaccctatctgctatttgatgcctactaggaataacttcgaattatcgcaaacattgctgggtccgctcctgacccattctcttcccttccctctgtgcgaaacagagcatctgaacccttacttgaagatattttagctacatgtattcggatctgatctagttagaagtgtataataccatctcaaaagagttacaagtgtatacatgtattatgactactaatttccatttttcggcaaaattattggttgttcatgtgtacacacatgtcttttgctggttcgcccctgcttttatgctccaagacagactattcggtactattttctgtatttccagaatgcatctttactgctacgttttctgcctgcagacttggagcaagcctctcaac

SEQ ID NO: 3824 - DNA, 1422 bp, Zea mays
tttctttaagaaacttacaagtatacattataaagataaacctaatctcaatctcaatttcttatatataagcacatatatgttactatttacttaacgctatattaaagcccctaccccccctaaaattaatgttgtgacaaaaaataatattttggtcaagctgagaagcggtaatagcagcatctatgactataagatgacatgtgacgaaaagtgttatacattcaaaattctatataatcattgcacaattaatagtaaaaaatattttaagaaactgkagttatatttcattatgatataaaataaatcagaactcaaagtttgatatattaataaaatagataataatatatatattaatagcttgattatgggataattgtacggaaagttttaggatgacacatgcccatcacaccgtgggctggacacttcagtgtctgacaagcaaggcgatgatagactagccatacccgtacgcccttcagctgagaagcagtacgcctcccatcactcccgtccctccacctcactcaggcctactctagcttcttcctcagttgtcagttcgctgtcctgcccccgcagcccgcaggccccgccccgcctccacgcgccccgcctccataatcgacacgcacccccagtcccaccgagcacgcggcagcgcactgcgcacccgatcctcgcgccccccgcgcgtcccgtccccactggcgcggcctcgacacctgtcccccggccccccacgcgcgcgcgcacgggagtgcacgtagctttcctgcccctccgtccctcgcccgcccgcccgtccgtcgcctcgcgcggtcgcgcctcacctcgcccctccctccctcctttctgccggccactcccggctcccgagccacagcaattacccagctcagcggctgccaaatctccctccgcttcccggctccccaggtcgagccgtcgagggcgctgctcgccacctgcctttctttctacagttcgacgcactttggtggcggtgccgctactctccttcccgagttcctaacttcctaactaggagggcgggcgttgtctgcctgtgtgcttttggcgattcgggggcttgggctcggatctgcgcgtgccttcctccggacccgagcgaggctcggggcgcctgatttggggcggatcagcgcagatctggaggcacatgaggaggaggaggcggaggggtagcgggagctatgcggtgcttctgcgaaggacttgagccggcctgggaaggtgatcctggaggaggttgcggcggctgcaacggcggagggaaggctggaggatgtcgtagcggtcgtggcgccgctcgcggctccgcctgcgccgacgtttagccccgctgcggcggagctcacgctgatcgccgcggcggtcgtgggagcc

SEQ ID NO: 3825 - DNA, 520 bp, Zea mays
ggtaagctaccaggattgtatttttttttcttttgcaaatcacaatgttttgtttgtttcacagttcgtgtctagaactgtttcttatataattgattccccaacgtgtttcatttcaattcgagcaaacatagttcttggttttatttgtacattcgtgaagaccgagtatcactcactctatgtactagtttcgtcaaatttctaccatactggtttggattgcacaattcatcagcaactagtagaaaaaagaatccgaaatagtcacatccatccaagacaaacacaaaagttctagagacataacgttccttatagggactagcattgcatttgattaaataacatccgaaagatatctaaatgccataagggtcatggacctgtacagattgaatttagattgaggctgaatttagattgaggcacagttttgttgtttcctaaccatgtcctgcaacttggtcacatgcgtctgaaatgctgccttctttaattttctttcttgcagcctccg

SEQ ID NO: 3826 - DNA, 1455 bp, Zea mays
gatcgttttggtgctctattaatgacagtggcggagctggcgagtatgtcgtcccggcataccctgcaagtagtgatttcccttcgaccccttctgcatagatacgtgctctacgttggctattcccgttttcaaaccttcgtacgcccgcagacggctgttggctaggaattgcaacggagaattccacattaggttttggctccacatacccgtcttcgtgacaaaaaagtttcccatagggatccccaygaactcttatagacgacatttctttctcatcaccgttcctcgtagagataaattcctgtcggagatctctgtgcccgcttaaattataatcatgacatactttttttgttattaatataaaacattgtcacttatacacattgtcagatgttaaaaatcattttatgtacatcaaaataaacatatttgtgcaacgagcgatctctgaataatataattatttatttttatatatattacatgaaaacattaacatatataagtttaacgggtccccgcggaaaaagtgatgagaaatgcttcctcatcccgtcctggtttactcattatgggaggatttttttttcgtttacatcctgtgggagagaaccatcatcatccctaatgaaggaattctccacagcaaattagggattgggtgcacattgccatctctactgctggctacagcttgttcctagtgcctgcctacctgaggctgcggtggcgtgaccacgccggcctagtgggctggtggcctggtgccctggtagttgctagttcgagctagggcttgtgcacagtgcgtctgcggctctgcgccattgctaacctgatatctgttttttttttgttcatttatatacacacgttatcatgggccatggacccttaaataaatttattaaattatatttaaaagttttgaacgatatacccttaaataaaatcctagatccgccactaattaatgagacggttttttgtatttttgtattctcgtaagctttgagcttgattggcagcctttcatatagtgaattctgatatagagtacaaggccatataggataggaacctatacacaagtacacaaccacagaaaatcctagtacctctgtatgttctctcaccttgtacgtcatcaacctgccgaagtcttggcgtagccacctcacaccccggcgctatgcggtcaagaaagactgtatggtcacgtgttagtggttaattaactggatggaccgagcaaaatattgtcactccctatgtcacgttccacccgatcgaatttggctcggctaactttatacttctataaatccatagccatcgcgcggtgtggagcatagcaaaactcgtgctgacacaacacacaagcacaaattgtgaactgcgtgacgccgcgaggggttaagtcagcaagcaagcaggcagacagcc

SEQ ID NO: 3827 - DNA, 873 bp, Zea mays
ggccgaacttggccgctgtcagcctcactctgtcgagtggcacagcagtcggagtgacgcaggcggcgctgtcctcttgtcaggctggtcagtggagcggcgaagtgactgcggtcacttcggctcagtcgactgaagggcgtgcgtcaggataaggtgtcaggccacctttgcattaaatgcttctgcgatacggtcggtcggtgtggcgatccggccaaggttgcttcttggcgaagattgggcctcgggcgagccgaaggtgtgtccgttgcttgagggggccctcgggcgagacgtgaatcctccggggtcggctgcccttgcccgaggctgggctcaggcgaggcgagatcgtgtcccttgagtggaccgagccttgacttaatcgcacccatcaggcctttgcaactttgtgctgatgggggttaccagctgagattaggagtcttgggggtacccctaattatggtccccgacaaattgaaagcaatgcgctttgttgggattatgcttcgtcgccgaaggtcttgtagggagaaacagtttcggctgaagctgtccgcatgtgatgaccgaaggttcctctgtatgaagcttcagaattacaaaccgacttaagagtagaatgaccttttagtccataaatgtttgagtcgctgttgtaattccttatgagggacataattgtaattcctcacaggctgtgtcccgtgcctataaatagtgaacattattcctttactgttcacagattcctgtaattgcaactgcatcaatcgggaatcaatctttgtcaaggcaaagcatttgagaacaagtccccaacattggcgcccacctccggtcaactcacttccactttttgagctg

SEQ ID NO: 3828 - DNA, 245 bp, Zea mays
tgcatgcctgcagcggctatcattaaagcaatcaggccaggcgttaagccaatcagccctccgaatcccacctttaatcagctcctccagctcccaaaccttccattataacgcataaatccgtgctcactctatttctactgcttctagtactctccccacaagcatccccctccatgatagtgcttcctctgagctaaggctctctcacctacacacccgctcaccccaagtccacgccggcg

SEQ ID NO: 3829 - DNA, 97 bp, Zea mays
aaggcaagcgctaacgatagatatacctggacaagctagtatcaaacaaaaccagtaaaaaaagtttactttcttgtcgaatttcattgcctacctg

SEQ ID NO: 3830 - DNA, 567 bp, Zea mays
ccagcgtcttagttttgtacacgcccttagactactcacatggtaatttaatgatggtttcatgcacctttaatagtgtgacatcactatctatgacatgtcatagtatttaaaataaatgagtttcgtgggatgaatttggtttcatgggaatgaaaccatgtcaaccgttttcaaggtcttgacaatcgtgtgaaacatctattgagagtgatttgtttcatcttcacatatttcactaatttctattggttatttagttaacatttaattagtatgttagtctataaaataatgaagtgaattttttattgagaaatattgttttattcttagttttacgacactatcgatgatgtggcaaaagactgttatggtgatgccttttacggtggcaagccggacacagtagcacggaggtaggtggcttgtggagaccaaatcaaattcacaatcagctgccgtgtgcccgtgtcacttttactgatccgttgttgcgcataaagctgcccgcgtggacagccccctcctcctgccccgtgacctccactgcgcgcgcgggcacca

SEQ ID NO: 3831 - DNA, 100 bp, Zea mays
taacagtaggaaattaatgaatggatctctccactctaactaacaataatatgtgtaaattaaagacgcggacggcggcagctacaagcgggcgcagtcg

SEQ ID NO: 3832 - DNA, 1500 bp, Zea mays
gacgtcgacggcatgtcactgccaagagtcatttggtgggaagcgttgtcatgccatctgtcgtgccattttgtcctcagttcgaccgccattaccgtgagctcaacctttrcgcatggttggccgcttccatcacccttattccgtttcctcgtgttggtcttgccccaaggctatggttagcagacygtgcatatggccggcaaaagactattttgcactgtagattgcactctttatatagtgaagtttaaaataggagatgagatgaataaggctgctggagatagcctaaacccttgcagctcgtgcttgcatcgggggacccaaaaggcgtccacctccaccatcgccgaagcactgagctctactctggcttgtgtttcagcaccacaccgcagagtgcttagggccaccaacctcctcttgcctctgtgcccagagcaccatcagctctgctgcctccctctgttccttgtgcttgctaggcaggcaattccgagctggggcccaacttgtaacgctgatttcaccatcttgccactgccgggcaccaagtggacacatttgacttggcctagtgggttttctgcataaatcacatacatgtggatgccatatcaggctctttggtgttgtcgtgtctactttcgacaaggatgagatcacttaaacatattagggagccaagtatgtaatttcatagtttagggacctacacaaaaatcgtataatactttagaacagccgtgcagtttactcaatcaacacatacaaagtcagatcttaagctctgatacttcaaaggaatggttgagcccagttgacaaacaatcttgcttcattcattgaattgtttataggagtggctatgtaactactgggtggttttgtttgacctgtcatccaaattgtgtagtcaaccataaacatacacgtcacacaatacattttggatgtgacagataggatttaggcgagagaatgtacaatgtcactgaaaaattaccactgtatggaaaggacaatctaagtgaaaagagaaccagggcctaatggtttcaggacttcaaactccggccaaatgaatttacagtgcttaaattaactcatgttaatcatgatagccaaagcatgggcaaaagagaaactatgaataaatcgacaatgtattctatatagcagtaatataccatgtcacgagcttttacactaatgggctgtatttttctgcagttattttaactggcaatattctatgtcacagtaatatttgttaaattttttccagaatagcaactgaactagaagtctagtatttcttaattggataacaaaaggaattagtgtgcatttggcttacgaacaatcagtcacccaacattgaatttgaagttctgtttcctctttgttcagacgacactctccaaatgaatgccttatattttgtgttgctcctcttttctgcagagtgttcagtaacttcttccgatccatatt

SEQ ID NO: 3833 - DNA, 229 bp, Zea mays
ctgaaacattattgactgttgttagctctatgttttgaacacctctgtcctgtctctgcggtacccttctattctcagttcgccttgtcttgtcggcgttctgatgtttacagcaagctgcatttgatcttgctgttttcatttagaaaaaaaaaaacattctgcttcgctctactgtgttttgaattgtgaatgaattttgaatggaaccccgttgtaccatgtgttc

SEQ ID NO: 3834 - DNA, 533 bp, Zea mays
aagatattagttgacaaagttatgttgatcatcaatcaccaaaattctttaatcaaatgagttggagtctattttccttactgaccactgattactcaaattgtttgtaagtttagagcataaaacttatttataataacagttttgtgtttaaagtggctctaagatgatattgattgtttggctattgacgacacactataaaaaatataggtcaaaatattttttgtatgatttattttgtagtcaaatacgtctatcgtttttttggatagaaggagttgactttagatattggtagcttccatttgcttcatgtttttttttgaacattcttatttgtggtgtcttgcttgctatttgttagtttctctcgatagattggcctagatctgcatgccttgtccacaggctaagaataaaaaacacatgtgcaatcgccctatataaacaaccccaagatccatggtggtggtcgtccgcccatagccgtaggcccgtaggtacattagctagaagctttagtagcggcg

SEQ ID NO: 3835 - DNA, 911 bp, Zea mays
ataaatatttctgattctcttttagcagtgtgccgaattttctgtattctggttcgttcgttcgttccaccacgcgcgctggtataggtatttgttgcctgtggtatacagatttcgcagacgccaggcacaggcagtatgtgagtagctttgtacatctgctgtctgcgtctcacgagaacgtgctaccgttgtgtcactgacactgtgtggccatatcttatgttgttggtgaccacagttcaattcttgcttgatgagttgatcgagctgcaccaccaatatccctgtcttggacgaccgattcgtctcttgcggaatctaacgtaactgctgaggttcgcaaaatgtcttgttgggtcatctaacttgggaatctgtgcgtaccgaaagcgctatgtcggcccgtgctgcagtgcaagtaccacgttttggccagtcgcccgttggtttgccctctatccattaagtaatctgattggtcgaggcgtgtcaaaagccaagtaggcaacaacagcaaggtgacaagtgacaactattctgactagcgaataggccggcacctcccggaccggcattgctgactttgacatgaggaaatatgtggcgcaaacagcagccgcggtgccggtcatcactctccggtcagctgtcacatatctaccaccgtacggtagccgctccggctcgtgccgccgccgtcaagcaactccagttcaccaaggatttcgtggctgcacgtctcgtccggctctagtttttttacgcgatgtcggctgatcttttctcatccgtgaccgaacaacaacccccgaccggcctataagaagacgcagatcgccgctcgggctttgcgactggggttcgacttcgacgtgaaaagagaccgtctgttccgaggttttgcttcc

SEQ ID NO: 3836 - DNA, 1500 bp, Zea mays
gggttgtttggatgactgcatgaggggtggacctgtcccaccgcgtgcagacgttgcttgtttggataactgaatggtgtgtggagcctggttgagctcgtgcaaaagtggcttaagagcctggctcagctcatacgtccaattagaccgtttcttgggggcctggctgggcgtgtgcagccgcgcgtacgtgttagagagagctcgtgcaggctatcaagcaaccaaacaactactcgaataaaacaggcttggacgaatcaggtatccaaacacaacttgttgcatgagtggagcctgtccagacacaatctggttgagggaggcgatccaggattgactcattcaaccatccaaacacgccatatacgtacctaggaggactgcgctgctgtaacaagagttagggacaattttgacttttagatgataaatacatggaaacaaattataaaaaggaataatacatattaaatggtagtataattaattagaatatatttatagtctttttttacgaataaaatctttcgaatgatatttgtgcgaagcgcaatgtttagagtcaaaatatacaattatctgggagtaaaaccgcgcgtcgtcctcttccccaatctctctgtcggaaaccgagtcctcttccaccgcacgccaccggccaccgcgtcccctccaacggccaccccgccccctcgctccggcccctccaccggccaccgggcggcccgccccctcgccccggcccctccaccggccgccgcgcgcccgcgcagctccggcggcgcgcgcccccctcggcccggcagcgctaccaccgcgcctcggccccgccgcctccaccgcgcctcggccccgccaccgccctcggactgtagtttgagataagctagcaatttttttaggccagtacgcatcacttctctgttttttttttctgctgaagtaatttgagataaatttgtgttttacctgaagcttctgagctctagactggtgcttccatttttagcacaagctagttatgttagcttctgtttctctaatgaaggtgctagcttccatttgatctgaacacgcctaactgagtggcaagtcttccttgtcaattatgttacccagtcagtaggtttcccttgtggcatgtttaactttttaataaaaaaacaatctgacatgttattgctcagttacaggcttggcaactctgaatcggctataatgaacatgttcagttttagttccttctgccttgtgatgtaaaccacagtacagtactttcttgcattcaattgtaattttctaatagttcctctgatctcgtgttgaactttctgtgttgttatttatcctgatataggcagcaacttccacaggacctcaagccgccatctcgccacatgacctgattgcagccttgcaggcacagcacagaagcagggttgcgccacctctctgagtgtcataggttggtgcataggcacacacacacaggtagcc

SEQ ID NO: 3837 - DNA, 103 bp, Zea mays
gccgtacgtagcacccctagtgatgagctaatcatcagctcccggttatcgacgcctatcattcagagtacctcaggaacagccgttgtgcaaccacgaacga

SEQ ID NO: 3838 - DNA, 403 bp, Zea mays
attttaatataggatagagagagtatttttttaagacgagtggattgacatatttgatggaaatatatacattaaatattgtatggagatacacaaataatggggtgtttttttcttaacttgatcgatcagcctatattcatgtagccgaagctgggaagtggggatgtggaatacagccaccgacattttgttcacaatgtccgaaaaagggaaagaataactttttcctttgctcatttggcaaaaatacacgcaacactgactcctgtgcatcggctctgcaggcgggccctacaaatactccctgcctcccctgctttcttcccccccaaatttgcttcccagatctgcccgccgcacccccaacccgtggcaatcaatccccttcctcgcttcgcaa

SEQ ID NO: 3839 - DNA, 360 bp, Zea mays
cgtcgtgctgaggagggcggagacaactgcggtgcggtggtgcctcctcaaatccccgccgacactttctgccgcccccaggtggatcctgtccgcggatccaggaggtgctatctagctccctgatccaagctgaaattaggtatgctccatgaatccatgacgcaggagctcttccgttgcacgaattttggttcgacctctagagatggggggagaccgggtgccgtttgcttaacagcttaagtcgctgtgatcctgttgttcgatgctatgctcatgtgaacagatgctcaaaatggcccatttccccctctctttttgttctcgtgcaggatctgaaccttccggggcgagctg

SEQ ID NO: 3840 - DNA, 1251 bp, Zea mays
agtacattcaccaatgccaacagtcaaaaaagaagcagttgtcttaaagctggactttgctaaagcctttgatacaatagagcacaatgccatcctggcgatgcacagacagcttggtttccctgacaagtggatcagttgggtccagaccattctcaattcaggttcctctgcgattctattgaacggtgtcctcgggagattttttcggtgtatgagaggggtcaggcaaggtgatcctctttcaccactcctttctgtcattgcagcggaccttctctaatatatcatcaacaaagccgtaaatatgggcatcctctgggctcctctagatggcgccaccccttctgactttcctgtcattcaatatgcagatgacaccctcatcatcatgaatgcctcgtagagggagttgttctgcttaaaaggtattatgcattcattctccatgttgacaggactcaagattaattttcacagatcctgcctcttgccgatcaacctggatgccaccaaaaccaatcagctggtggtagtgtttggatgtcacaagttggcaccttcccgttcacttatttgggcttgccaatgggtctcatgagaccgaaagtcaaatactacctccctctcatcaccaaagttgaaagaaggctcaatgccatcagttcttggttatctatagcaggaagacttactctggtcaactctactttctcagcgatgcccatctttacaatgtgcacacttaagataccggtaatggtcattaacggtatcgattgtatcagaagggactgtcggcagcagttaaacaatcagaagggactgtcagcagcagttaaaatgcgcacttgaaaccctctggttgcctaggacaaagtgtgctgtcctagaaatagagggggcttgggtgttctcaatttgaagattcagaacacgaccctcttgcttaaatacattcacaaattctatggcagagaagacataccttgggtaaatctaatttggaccactcactaatctgggggcagggtctcccatggctaccctaaaacaggctctttatggtggaaggatgtttccaggctggttgactatttcagaggccatactatgccttgggctggggatgccagaacaattctgttgtggcttgatgtttggaacaatatctcccccagattcactttcccttgtctcttctctttcgccaagaaaaaagaatgctaaattcaagaatttttaaccaac

SEQ ID NO: 3841 - DNA, 1500 bp, Zea mays
aaaggaaacatcgcctgttttgttttgttagctttaaccgctaggggatgggccatcactgacagcaagacagcaaaaaaaaaccaatacaaaacaaaacacaaatgatgggagaggacgaggaggcatcagagtcatggaagaggagcaacatggctaagcctctgggaggcagcttctgcatctcaagcaggatgcacatgtcgtcatctgcctcaagaaactaaaatctgatccaaacatataaatctctcacgagacctggacgggcgctgcaggttaattcctaatccatcgattaaggtgtggggtggtgggagcgaagcaggcaggcatcagagtcatggaagacgagcaacacggcgtgcctcgtcacggaggcagcagcttctgcttcgtaagcatgtcgtcatctgcccccagcatgcccccgcaccaacccaatccaatcaatcaaatcaaatcccgaggaagaactgcaaacgaggaagaactgcaacaacaaaaaaaacgcgcaagtgggcatggatggaacatgcgtgttctctgaacaagaaaacagaaaaacataaagaaattgttggcggcggcggatcgggaagacgagatggctacccccacccgtgcggtatttatggacagatggtgctagggttgggttgggtgccctcggccgccctccattctccgcgatgacacctggacatatcttggccgtccgatctatagtggcataggagcgagagaatcgtgcgaaaatagagtaagcaaccgatgtcggatgcccgtgctgctacagtcagagtcagcctaatttgatagaagtgctgctaaatacagttgtttgcatcgactactacacgagacgcgcacacactgcacgcaacgcgttgttgccttgccgttgttcttctcctttttgcacaacgtcacaatgatccgtcgtcgttgcttccagttccagcagagggggtgtacgactgccacgtgccgcatgcagcacacgccacgtgcttcgtggtggtaagccacagcgacggatgacgcacgcagctgaattaattgcttgaccggacgagcacgagcacgatgatggcgggcggggcgtgggacgggaacagaaagacggaaacggaacgagtcagaggttgcccagtccacgaaacaaaaagcgacccaccccaaacccaaaccaaccctgccgactgccgtcgtgtcggctcgccaacgccaatcccaccaggccaccaccacgccacgcactgcgcctccctcccttgcgtccgcctctcacccgcaacttcaaacccgccgccacctccggggaccagcaaccccaactccagcgctggggaggagcgacgacgagctgcccgattccaccaccaccagcaacttgaggaatagcctcctgcctcctgcctccagcagagcgcgtgtccctcctgcctgccggctacattcgcccgactccgactccgctgagaagccaagccagcc

SEQ ID NO: 3842 - DNA, 330 bp, Zea mays
gtcttatagagtagtagagattatattatgttttagttatattttatatttaaagtaccgtgaggtgagggttgtacttaaaaactagccaagcggccaagcggcggttctgcgctctgacattcgcctcggcctctctcggccggcctcttcgtttcctcctcccagccgaccggccagccagccagacccacccaccgccgatccccacgcaaggggaacaggagaggaaacaaacccagcctcgtacgcggaaggcctgcctggtgatcgacgatcgtcgtgctcgtggtggcgggtccggcgtgcgagcgagcgagcgcggcgcgc

SEQ ID NO: 3843 - DNA, 522 bp, Zea mays
gtggaatgccggttcactaaatagatttgggaggagattgctatatgggttgccattgaagatttgaagtcgtctagctgggagctatctcccatgctgattcattggtcggagaagttggctgtgttgccaggatgtaatagaaaagggctcagaatgttgctgatccttgttaactggataatatggcggaaaaggaacgcaaggacttttgatcgtaggtttttgaccagtcagcagagcataacttcggttaagtgtgaggcgtcagcctggatggcggccggggctaggcaattggctactctcttaccttcgtcaacttagttgggttactacttgtgggttgttttcttagtgggctagtggcggagggatgcttaataagcccctgacgcacttctcatcataattgtattgactttcttgccttagagcattcctctctttattaatatataagggtttcaaaaaaaatgcatagcagataatttctggacagtatgtaggagatctgggaga

SEQ ID NO: 3844 - DNA, 686 bp, Zea mays
ggtccgctttatacgatcaggtctagatcttatcggattatcgtttttttttgttgcctgggcgtgatgtgatttcgttggattactgttggaagctattttttctgatctagattggcctaaaagcaactccaagaaggagttctaaacttgagccttaaaatttgtattaggaccttttgatttatttaggatctccaacaaccaggccttaaaatcaggatacccagctgggatccttacccagcttccatcttctctgcacgaggcaacgcgcttttttctagcatatccttctcgtcagctacgcattcgttcgcaatcggccgcatgaggcccacatcatccttcctcaagggctgcacagttaagcgcgacggctgcacacggctgcaaggtacagctcgacggctgctggtaggggcatcaccgcatcatccctgcacggtaggctcttgacccctgcacaatacggctggagggctacgagacgagtggtggcggagtctgctcgctggaggttgggcgcgtggacgaggtgaatagttcatttagaacctgctgcagatttgcaacaagtaagcagtgtgttgatcaagtgtattttgcattgtaaccgttatatgatgcgatatatgatagcttagaaataatattttatattgccatatgtgcactgcagaaac

SEQ ID NO: 3845 - DNA, 1500 bp, Zea mays
gaatatggccctcttttcccttttttcttttctaatttccttcctattttagttttccaatttaaattcaattctattttgaaattcaaacacatgttctaatgcacagttcaaaaacctagcatgagatgcaaytgacttcattttacttatagtttattaaataagtttgtgaattgatgtaccccttttcttcaaatactcctataaaggaagttatgctttcatggtaatcatgtaatgtgacttaacatgacatttttcggaggtgaacatgcaatcctccatattatttttcggggggaggggcccgaggggcttgttcggttgcgtcgtaatcaaacaggtttggaaggtattaaatcgtgatggaatccccttcgatcccgacgtaaccgaaaaagctcggaaatgaaattgcacacgcgggccctaaaatattatatatatggaactatggaaacaaccctgtgatcgtcatcaggagcatgacatcagaatcctcaactcgagttgccttctaagttgtaacccctacctgagcaatcacgcacggttcctatctgaagccatcgtagcagggtcgtagggtagggtgattaagaaacatgaaccaaagaagtgtgcagtcaatttggcacaccacaagagaaaaatcctgcgaaccgtgggcgcaaagacctgatggttcttaaggttcgagtcaagaacggtgggaaagcagatcagaccaaggtcaagccgtgcaagtccccggcatcaaagaaccttccgtcaattcttttctactttgaaatttcgcgtattactgccaccaaactgtgaagagcagagcaggaccagacaaaaacccgctgtatatgtaaacaaacaaaaggacgctactggagtagtcggacgtacagccgctacaggcacagtcacggggagcgaaccggccgggaatcgtacaaaagctttggcttggatctgatctgacgagacagaacagaacatgccatcagcaccttggctgattagcactaatggctcgcgattcaatacacaagacgccggattcaagtaaatgacgacgatgaggtgtccatgcacttataaagaaacatcttttcttgaacgattctaggcctccttgcacgtgcacgtagacgtacgtagcaaaggtcctccgttccactgttcaaagttcagactagcaggtcgagatctcctctctacaggcagccagagttctagctgagcagcaaaagattgcagcgatttgacgagcaaacaaagatatatataagattcgccacaccgacacctagatgtcacacgccagcccgcaggtggtatataataatagtgaaaaaaaagagaagctgcttctgggatggctgcatttatgcaggcacactgctgccggcagccacgactggttggaaggagggaggggtagtagtaaaaccaggtaggtgtggctggctcgtgcarcggcggcaggcggcagtgaragcg

SEQ ID NO: 3846 - DNA, 604 bp, Zea mays
caccacacttcaatgcatccaagttttcagccttcacacctcatacaagagctatagacttcattcaagacacatacaaagagatcaaatcctctcccaagtccaaagatcattccaatcaaatagtgactagtgagagagatacttgtgttcatttgagctcttgcgcttggattgcttttcttcttcctctattcttgtgttcaactcacttgtaatcaaaacaagagacaccaagttgtggtggtccttgtagtggacttagtgtcccatttgattgaagagaaaggctcactcggtctaagtgaccgtttgagagagggaaagggttgaaagagacccggtctttgtgaccacctcaacggggagtaggtttgcaagaaccgaacctcggtaaaacaaatcatcgtgtcatccgctctttattcgcttgtgatttgttttgcgccctctctctcggactcgattatatttctaacgctaacccggcttgtagttgtgattaagtttgtaaatttcagattcgccctattcacccccctctaggcgactttcaattggtatcagagcctggtgcttcattagagcctaaccgctcgaagtg

SEQ ID NO: 3847 - DNA, 581 bp, Zea mays
ggtagttgccaaatttgttgggggcaaacacaagggctccaagacttgtgtttgggtacccaaagttcttgtttctaatgccaaaggacccaaaactgtttgggtacctaaagtcaagaactaaaattgttttgtaggtttatgcatccgggggctcaagttggatactcgacagcgggtgcacaaaccacatgacaggggagaaaaagatgttctcctcatatgagaaaaaccaagattcccaaaaagcgatcacattcggggatggaaatcaaggtttggtcaaaggtcttggtaaaattgctataacacccgaccattctatttccaatgtttttcttgtagattcattagattacaatttgctttccgtatctcaattatgtcaaatgggctacaactgtctttttactgatattggtgtcactgtctttagaaggagtgatgattcaatagcatttaagggagtattagagggtcagctatacttagtagattttgatagagctgaactcgacacttgcttaattgctaagactaacatgggctggctctagcatcgccgactagcacatgttggg

SEQ ID NO: 3848 - DNA, 780 bp, Zea mays
gacgaggctaagacatgttgggctgaagaaaaaaaaacttgcattgaaaatgttgtctgaatgccctcgtctgcgtgtgaatagaggggattatttgtgtgatctcggggtggaaatgttcagaacatacactcgtagtcgtggatgataataattaaatgtatttattattccatattctaacatcgttttaccacggcgtggttgtttctcaattgttggctacagttgcacctgccaaaaagtttgtggtgttggtatgttacatttgcaatgccaacatatcgctgtttgatgtgaattctgaattggttgctggagacttaacatttacatctgccaaaaaaaaagttagtgtgctgtgcatgcatttgcaacactgccctgccctgaaacttttaagggtcatctgtttgatttgtgccagaagtcactgcgaagaaaggcacaaagctggcatgcaagcacgtaaaacggttacgaaaagaaccaaagatcatggacggggatggttaagctgagcacgaacctgtaacccaaagccaaagaaaggcatccatgtcaaactgaagctgctgcagaagaacagtcgtcttgctccggcatcacgcaacagcatagccttgcctgatatggtttgtcgtggcaccagctctctctccaccctctttaaaaattgcaaccagcaggccattctctcgccgtctcatcacaactagcgccactctagtagtaagtactaagtagtagtagtaggtggcagcagccaatcttgccacg

SEQ ID NO: 3849 - DNA, 86 bp, Zea mays
ggtatgtgtgtcgttgtggaatgaaatctgatgaatggaactgcagattcgttgtcaatgcatgctcaaatgatgggctctgattc

SEQ ID NO: 3850 - DNA, 208 bp, Zea mays
cgtcgtgctgaggagggcggagacaactgcggtgcggtggtgcctcctcaaatccccgccgacactttctgccgcccccaggtggatcctgtccgcggatccaggaggtgctatctagctccctgatccaagctgaaattaggtatgctccatgaatccatgacgcaggagctcttccgttgcacgaattttggttcgacctctagag

SEQ ID NO: 3851 - DNA, 1500 bp, Zea mays
ggggctttgagtggcgacacattgctgcccctggacctgcttcctttcttcctcttgccttgatttgccagctccataattgcctccatctgatccttgttgaggggttttaagaaaaggctttcaatctgttcaataaaatttatatgattattggaggtggaagcacttaaacattggtattgtatggttgcagaattatttaactttgcaatgaraatttcctgggctttggagatggcatcgcgactgcccctcaatctttagtttttgttttgctgccaacctgccactcgatcgtttacctgtcgagataacatttttatttgcatttgcacctagattgtctgacccccgcactactggtgatatggcacacatgtttctgttcggaggggaatggattaggggtggttctggtatgtttgtgattgactcaatgaagatctgcaagttatcatttgagttgagctgattttctattggcaggggagtggaatgacctggagtgttgtggctagcagtcggaacctcgttactagataaaatcagttgtctatcctcgtctactacattatattgattgttttggtatcaccgcctaatattataatactacaatctcaatcgtcataatggggatactaaatttcagaagccagcagctcgcggcgaatctcccttcttctccggtatccaccaccgcttcatctcggtaccgcgactcgtcgacatttcggtgagtaatcagtgcgataagaggtgcgccgacctttgatccagagtagtggcagcctggcacgccgtcgcgtgctcatacctgttctcttcaggcaccgccttccgccttccgccgcccagaccggcgaccggctacctgtctatgctgccttcctgcctccaggatctcccacgacggcacgaattgcctccgcccgtggttgatttcggttaggccttgccttgccgcttaattcagatgaggtgttgttgaggtcttgaggacatcacgtcgtcactagtggactatttctgtgagtaccttccttcagaggacaaaaaaatcgaagtagctctctatcaagcagctgattgaaccctcttgctgcctagagaaatttggtactcgtaaatgtttaatttcatctgtcctattttagggcatgttcgttcgtttctgtagacgggacgggatagtggaatagtcggtcaacattcttcctattttttttttcaatctcatccaatctatacgaaataagaataatcggacaaggctatatagattttgtaatggcagggatgacttgtcgctctattttttgacagtaactgtatggatttaatgtattgaattaagacaacaactacaaattaataattgtcctttccagaaatccagtttgtcaagtgagtggacgaccccaagcctctttgctagccagtgaaatccaccaataaacaaactctggaaaaaaaatccaggagagcattccactt

SEQ ID NO: 3852 - DNA, 712 bp, Zea mays
tctcactcaatccatgaattgagagctaaccgaacaagcccttagtagttagtggtgagtcacctcctaaaaataaactagactcggtagagttaatattattttcatcatcaattgtggcttagctactagatctgatcatggaccatctgacctgaccaatctgatctgatccgytcgaaaaaattgacccgaccaatgcaatagataggtacagaccatattttttgacccataataattcacaagctggatacgcgccataatttttgacccaaaactcgacccgaagcaaaaaaaaacctaacccgacactagacacgggtcaagtacagaccgtactaaatgaccacgacccgaattcaacccgacatttcaacatgtctttgggctagacaatgtagcaagaaatatttggtacacaagatcatatgtagtgaacccagcaattgcctcacaaaacaacaggcaataatccgtgtgacccaccccgcaggcacacccggattccctcgccaaacccgtgtattaaaataccgccgtcggccatcgcccaacgatataccagcgccgttaaatttccaacgcccctgcccgtccggccgtccccacactagactagaccgaccgccaccattgcccccgtgtcttaacacggggcgaaaattcctttcgagatctcgcttctctaagcttccgcggcggcacggtg

SEQ ID NO: 3853 - DNA, 211 bp, Zea mays
tgcatgcctgcaggccgctgaagcagaagataccgtgaggtagcatagagagagagaaagaggaagggaagccggtgtcggtcgccaggcatgtcgccgccgctcctgtcgaggctgcggctggtgacggtggacgtgacgggcaccctgatcgcgtacaggggccagctgggcgactactactgcatggcggcgaattaagcacgccaag

SEQ ID NO: 3854 - DNA, 90 bp, Zea mays
tgcatgcctgcaggccgctgaagcagaagataccgtgaggtagcatagagagagagaaagaggaagggaagccggtgtcggtcgccaggc

SEQ ID NO: 3855 - DNA, 211 bp, Zea mays; identical to SEQ ID NO: 3853

SEQ ID NO: 3856 - DNA, 396 bp, Zea mays
agtgacccctaattttcatatatatatatatatttatacatatatatatacatatatatatattgctgtatatccaatgtttagctttcatttgctttttaggggatgctttcatgtcttcaatgctggagaaaagctaaatcttgttgaatttaaagcctactttccatcaaaagtgtcatccaagttattgatattgtcaagatgatgcccactgttttacagctggagttattacatcgaatggatgactggccaacatattgccgcttcttcgctacggaccctttgagttgtaagaccatcattgagtatccgtttgagttgtaagactttgtgatattttctgaagatttgtataagtttgtaatttattgtgatagtcttagcatttaa

SEQ ID NO: 3857 - DNA, 1500 bp, Zea mays
ccaactctccactctccatgatgggaaggtgtggttgttgttagtggccagtaatacccagctaccccggatcacagccagcttggacaggtttattgcaaactgcatggacgaagacgaagctgccaagtgccaactaactaaatcctggctactgacagaaaccaatggccagctgatgatcccttgcgctgctcttttctggtatggtcgatacaaccaaaaggtactaggtgtgctaagtacttagcattgtctttcttgtaatcttgttcgtgatccccatccgtgactggaggaagcaattagcagcacggtcttgttcgacaaaaagacaggcatgtgcgagcgattattcatgcgctctgtacatgcgccgacaaaagcatcgcacgtccatgtgggggcgggcaccctgctgcctctgcctctgcctctgcctgataacagaacagcggcaacaaagtactagcgcagtgcctgatgtgatatgatgcgcagccggtagcaccacacagacatcgcatcctgcggtctttgcccatttcgcaagccagtgtttccaaagaacagggccctagtagctacaggcattacgatcgactagccagctgccaagactttcagtacaacaacaacggatgatccgcatatggacctgcagacctgtggaccaaattgctggataggggatggaattgaatcggagaaggtgcgagagaatctcaggtgtcattacattccgttcattggccaggagcatataatctcccggtggccaaatgcaatgtacattcgggttgccaaacaaattttttccttaggaaaatgaaaattctttgaaaaaaataagaaggttgtaaaaaatgtgtagtaaaactgcaaactcctgcaggcaagcttggcgcttcgccgcttcccctgtacgcgcgcgcaagaattcaagaattgccgagcaccacgcccagatcctactgatctccgtattcaatccggccagttatgcaactgcaaatttctctctgttgcgttggcacgcatttacgggctacgccatttccttggagcagttattttctgtttttttttaatatcgtgcggatcttcagttttacgagtgccttgaacgcccttaatttttgtaaagcctggcactgttctgtgtgttatttaagtgctgtgcttgcaactttccactcgtctcttcgttcctttcctctctccctctcggtcttgcttaatagtggacaggaggaggagcgatgcttgtcatctactcctgttaagttccccactccgcccaccccctcacacacttcttccgcctcactttccatcagattattgttatcgttgagtgagtgaggcccaaaggcagcagcagcacagagcaagaccgcaaagaaagcaagcgggcaagcctccttcaccattaccgcgcatgtgctctgcgccggtcatctgccttcggtgtaggaactcttgcctgtttgctcggtc

SEQ ID NO: 3858 - DNA, 818 bp, Zea mays
ttaataaaattttagcggataagaaaaacatgataacttaaatatctatttatattttcgcctctgtgctcgtggtccccagcatgggaaacgtgaaccacccgaccggagacaagaaaaaactgaacacagcgagtattgcgtatataataaataaaaagaaaagaaaaagaaataccgtggcgcagagaggagagagagaatcgggtatcgtccgtgtccgtccagatccaccacacagcagcgcaccagccagccacagccacaccacaaatccgccaccgcaatcgcctccccctatttaatgccatcccgcttcctccgttcttcccaaaccaaacccagctcaggcacaaccccaacgcaccgccgccgctcgcctggcctcacctcgccggagaagagttataagacaggagaaccccgtccccggggcgcaggcctcggcagcttccgtgaccaccgcccaatcctgccacagctgccctccctcctcccctctgggcgtggccgagttgtaggcatcacggctagcgttgcagccccccggcgcggccccgcagctgcgcaggtggagcccacgggcaccatcgcctccgctgtcgcgtccagccccgctccgcacggcggccgcggggcgctgccctcggccggaggaagcccgtccgatctcctcttcctcgccggcggcggtcgcctctgagccgttcctgtctctcaccttcttcctttcctagcaattagtcccttctgctaacccccccggaccccgacgagttctcaccccgagagtaactgaccgacctaccggcatggag

SEQ ID NO: 3859 - DNA, 1500 bp, Zea mays
gcgtacgtacccggccgtggtactttgggtccggctcgctcccagccagccagccaggcgcagcaggggctagcggcctggatcccatctggaccgcatgccactcgcggctgtgcaatcacagtgtagctctttgtgggttctttttgcgcacattttcaccctgtctcgatctgtctcagggctgtttagtttctataaactaatttttaatcccttttaatcattaaattgttaaacacaaagactaaaatagaaataatttttttatttagttcatgcctttggcaatttaagaactaaaatagagagattaaaaattagcacctaaaaactaaacacctcttagcatacatcaagccattcgtacctgaccaaatcgagagcatccgtgtaatccacttttccataaccaacaaaaagagaataccgaaccctcaataaacatatactcaaacatggccaacgtgtgtgtaatatatcacataatttaaaagtaaagtttataatcgtggaacatgcatgttagcgtctacgaaaaaaaaatgaattttaagtccacgttgccaaccactcttatggttacctcttaattttgttataaataatcttctgccatatatacattttttacttggtattccttttttgattcggatagttagaccatgataacaacactttcaatactcaccctcgtattatatccggtagcttgatttctatccctatacatctttgctagatattttatctatcctctggatattattggctactgttgccactgcaattatattaactttggccaacttttatatgctattgtttactgtaaacagtttacgtttttttttaaaaatctatatcggtataatctttcgaagatgattataggagtgtaggatgcacatgagtggatttacatgaatgaccagacacacatatatcctctatttctattatgtgtctgggaaaaataaatttaggaggattttttgagctcagcgtcctttccttttgccgggtaaaatagtgaaaaaggaaacatttccagccacagaaaggcacccccgcacaagatcctgatcacaggccgatatcgggaggcggagatctctcacagacagtcggctgcatctgccgccccgagccactccagtccctcgcagccaccacccaccgccgagactgcctcacggaccccaccagtacggacccacacgtcatcgggagtaccgcaggtaagccaaccaattagactccgcctctcgggtgccacgccggccacgtcacgccgaaataattacccctctctttcccaaaatccccactccttttttctcctctcaatctcccccgtctcccccctccctctcccttgcttccctctccagtccccagcgcgcgcgacacgacacgggccaatcacccagccgccgccgccggcgatcgccggaactcggcgccggtgcttccgagcacgctccgctcggaacc

SEQ ID NO: 3860 - DNA, 1500 bp, Zea mays
atgctaaatttgaatcaaaacaagtttgagttcttatttgaagtgactttgcacttattctatttgctttatgttgtgttagcataaatcaccaaaaagggggagattgaaagggaaatgagcccttgggccatttctaagtttttttggtgtttgagtgccaacacaagtgcttttgtgttaaacttgaaaaggggtggacaaaggtgcaaatcatgtcaaaaggtatgtttctagacttagtacattattttatggactaatgtagtgtgtctaagtgctggaaacaggaaaaatcgagttggagaagagatggctaagttcagccgaggtcagcgcagtctgggtgcaccggactgtccggtggtgcaccggacagtgtccggtgcgccaggctgactctggcaaacttgctgctctcgggagttcgacggcggtgtacggctataattcaccggactgtccggtggtgcaccagactgtccggtgggccgttcacaggcgaactcgtcgctctcgggattttaccggcgacgtacggctataattcaccggactgtctggtgtgcactggactgtccggtgagccaacggtcggccggaccaacggtcggccgcgcgatctgcgcgggacacgtggccgagccaacggctagaagggggcaccggactgtccggtgtgcaccggacatgtccggtgcgccaacggctcttaggctgccaatggtcgactgcgctggttttggaaagaaatcgggcaccggacagtgtccggtgtgcaccagactgtccggtgcgccagtcgacagaaggcaagatcagccttcctagattgctctcaacggctcctagctgccttggggctataaaagggacccctaggcgcatggaggagaccaccaagcatcctttgagcactattgatcactcacacatcattcttgcgcacttggttgccattctagtgatttgagccccgttctagtgtgctagtcttttgagctcaagtctgggtattgtgtgtgcgtatttgctgtgatctttgtgtcttgtgtgagttgctaatccctcccttgctccgtgttctttgtgaatttcaagtgtaagggcgagaggctccaagttgtggagattcctcgcaaacgggattgagaaaaagcaagcaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctctgtgattgatccttgttggttattgtgttttgttgaggattcctctctagccacttggcaattattgtgctaacgattaaccaagttttgtggcttaagttttcaagtttcacaggatcacctattcaccccccctctaggtgctctcaattggtatcagagccgttctcttcacaaagggactaaccgcccgaagag

SEQ ID NO: 3861 - DNA, 527 bp, Zea mays
tggcccctagcactggtggtactgaaaaataccagtgcaaatatttctaaaaccgccagtatagagtttctatgtactagtgtatatagaggctctctctgctgttcactatataatattatatggattagcaaaaataaaataagtataacatattcgagggtatgacaaatacgtacatatgtataaaaatttaaagcaaaatatgtctctaatatagatatttaacatataggtgaaaagataccgaaaatgttgttggaggaataggatatagagaaaaaaagaaatataaaggataaggttgaagaccgccgcaatatgattgaacatccttggacttaaatatacatcactcctgcgtagaatttttcccccctcagatgatcctaggggcccctcctatatatataaacagcttgcacggcacgagtggaccacgcagtagcacgagctataactaacgtcgtacgtacagaaaggccttgtcttgttgttatatcttaaaggtcaatcgagagctagca

SEQ ID NO: 3862 - DNA, 1500 bp, Zea mays
ttcctcagtcaaagactctgacgattacagtgacaggagaaggcggccaggtcagatctaaagaagaagaagaaaagagcgaatcggagatcccaaacccatgtctcccaacttgcctcgcggaggcggaggcgggggcgatggatggatggatggaagcaccaaaaggaaaggaaaggtggtggcgtactggcttattgagcaagcagcattgatgcctccattactcacccctgttcagttctttagggcttgaacagcatggagatttcttcttatgaatccctccatttctcagtgcaccaaaccagcccttagtaggttggaggagccgaggaggagctcacaaagacagcctgttctcgtggccttttcggggatggaggtttgaggggtgacagactggtgagactacagtgacagtgagatcagacagcaccacagattctcaccctgtacatttctgtaacaaacaagcaatgacacaagagaacattactaggattcagaaccatcatttacaagttttggcattcttgctgaaattttgtagtggtaaataatttttcctgcctctacttgtgtctgaccatgtttcatggcaacgttcggagggactgcagcagttttgagggaattcaggtaaacagatacacatggcatagttatggtatgttttgttaggtttgcagtaaagtgatgacctgatcagaccaaatagatggcaacaaagccaagaacaaaagaggtgcatgtcaccatggacaggggctgtggctgtgctgtgatgtgcgcctgtgccaccccaaccccaccaccccattcctcctcaccgaagcacagcacagcgcaatacacagactcgcagggctcctagaaaagagaaagtagacgaccaaaagaaactggagaaaaagagaggagctcaaaagcaaggcgaggcctcctccgcccctttttctctcctcccaattcacacaggattcttcactcgcccgcccagttgtttcttttagtgccgcccccattccgctctgatccgaacctttcgctcaaagcctccagcttttgcaattgtttggtcacttcgggaatcaaggaataagttctcgcgctgtgcgcgatagagagcctgatccatctttccccatcctcttcccgtggcatttcggtgtgcttgcgctctgtgcgtggccactgcaaggggaggatttttggcctggtttctgtcttcttggggttctaaaatttcgggcgagatcttagcctcaaggaggttccttgcttttctggtattggcgactcttgttgctccctacaagtccaagaaaagaatttggaggccatggtgggggtcccttgcgaccggttctggtcgattattcgtgctgttgaattcaatatgccgctgtgacccacctctgcctggtttcttggaggaaatttgcttcaattgggcgtcgttgagctagagctctcctccagctcttgattcggtcc

SEQ ID NO: 3863 - DNA, 681 bp, Zea mays
cctttagtttaagtacaaaattcatattcatagttgaattcaaattcgaaacctaaatatgaaaatgagagaaatagaaaatagaaaatagaaatggaaatataaaagaaaaagaagaaaaacccgctgttgggccgcaccctcacaattcggcccacttctcccatctcctcgcgcagccagcccaactcatcttagggcgcggcagcagcgcgcatcaccctggccaccactcgctgacggtgcgggccccgcatgtcatctctctttcccctccgtaataacccgagaatagaaaaattcgtggggtccgagcttctagccatgaaatcggatcctagcaacaaacttttgcgggaattcaactattcccttcggctggctggacctcccggtcatggtgcttaaatgcagaactagactttccttttcatttttttctgccatctcgagccgccacctccgtgctcgattcttctgcctcgtgctcgtcgttccgtgcttcttccctacctagtcctacatcacctccccatccgcctttggctcgcaaccggcggccctcaccattaatggactcccactccccccttggcggtacagccggaagctgctgaaacggcacggtacacatacagcctgaggctgcggtggcggccggatgtggaggagtacttcatc

SEQ ID NO: 3864 - DNA, 1500 bp, Zea mays
tacgagtttttacttcaatatagaagtgcaaatttacccagtgatctataatccatttgttttctcttggtgccccttgatcaaattttaggctaaacaagcgaacattagccacacatgaacacaagcgaatcttcatcacgatgtagtaggagaagttcgaaactccaccctcactccctgttttgtggttgcattgcattgcatctttttcccttttcttctaagatggtggagttttagctactaactttatattaattattataggagaaactaatgtttattaaaaatcaattttatataggtctaatacgattattactatatattatttgggctgggaggagggttgccggatgaaagcggtaatccgaactgttagaacaaatttaatattttaaaatagatatgtataaaatttgatgttgatattttcttatattatcaagcacattagtacaaatatgaataaaatattatataagttgttttatgtattatttgctccctacaacacaaaaagttgaaaaaattaccgaatttgtttccgaatccataccgaagtttatatctattatttgagaaaatgtaggatgaatttgaggtttaccttttatgaatcttaactagctggatgttaaaaacaagaatacaaatttgtattgtatattctatatcctatttattcgcaatcaaagaaaaactatttaccgaataaataccgtttttgaccgttttcatctctagttgccgcgcatggcaggcacgccttctcgagagtttaccgtggctgcttgttgttgatccgcgtacccacgaccacgagacagtcgagaccaagaaatgatgagcaacggccagcgctccaagccaggataggatcgtatcgtatatgcctgccatttggccggcgaggcgacgcggccatggccatacatgcattgccggcggaggcaagctagctgagcacagcagccaggaacgcatcgaccaagtcgtcccagagtccagacaaacaaaggaattagcaaatgcatatgtactgattggagagattgtcacatcaatggataattaaataagtagagtacgctacacgtacgtacgtacgtacgcattaaaatcccggccgccttaaattaccgtggaaggcggagcgcctagacatgatcggctagcttcattgttagctaatctcaagttgttaatagcatctactgtactatttgtcaggttgtgggttgtcgccggagccgacgacgacgtacggcactgtatcgtacgcggggtaatagtagtactaatataactgtgaggaatggagtagtctcaccggccgcattaggggcggcaagctgaagcagctgctaggtgcctagctagctgtggtatcatttgcagcgttcgtaccgtcggccggccggagggcaaaagctaaaaagctaggtgaacgaaggagagctagctagctaggaaggaagagggtcgactcgaggc

SEQ ID NO: 3865 - DNA, 245 bp, Zea mays
ggtacgcaactttccagtctacctcatgttcctttcacccgcagcgacatttgcgcatcagttgtgtgaacaccaataaggtgtaagatgtttttgcaggcaaacagacatcaaataaactgtaccatcaaaataccatctttcgtactttatgctgctgtataagttagtcaaggatcactagggatagtcctttgcaagtaaactcacactatagcaaatgatgcttgatgatgtaaattctg

SEQ ID NO: 3866 - DNA, 1500 bp, Zea mays
tggttaaaggaaaatgaccttaatcatttytctaattgattttggtgcttgatgaccatcacaaccttatggattaactagtttgtctagtctttaattctcaggtgaataagtccactcaactcagttgtaagccagaaacaactaaaaaacaaccacaaaggggtaaaacttggaaaaagtaaagaatgcctagtttcagtttggataagttgcatacaaccctaggaacctatttgacacatttaatatgrttggaaagttcatgtttaaaaagacacttttggagcaagtttgagctaaaacaagtttctaagttggagagagaaaaagattcaaaaaacacgacttatactaatgtttggaaggttggaaggggtcttgtgtcttcaatatactggttgggctcaaatagctattggagaaaagctgctaaaactgcacagttgggtggtgcaccagatatgtactgttcatggtccggtgtaccagcctactgtgcagttttgacagcttttcgactggtttctattagttcctatcgatttatcacgattaatcggctatccggttttggtgaatcttggcagtggatactaacacgtccttttttgcctgcaaggcagtatgtttgtcaagccatgcgcttcgaatttggatttacacatgcctttgatagtgatgctccgttttgtattacagataaacaaaagaaaaggcgagagggacagcattacgttcgttcctctcatggtccggcgtggcgacacatggtcactacgcgcataccatatcctaggtccgtcgatgtgtctcgttttggtcccctggcctgtgttgtagtagcagtttgcaatagcggaggaattgggtgaatgttttgagtgccagagagaaccagtgtgacacagccacgctggctttaccacatgctacatcaggtccgtcgttgcatcattgcatgcttggaacatatcatcgaaccaaaaaaattagcgagccgtggtcttaattagctgctatttttgatttagcttgctgagtctgtgataaattttggtcgcaaattaaataggtccagaaattataaatcacggttgtgacgagtcacgagagtatatacagaaaccaactagccgtaacctttataccaaattacataaaagtttttgttgttgttgttgtcatgaatatggtatagtaatatacacatctcgaaagctatggccctgacctctgtctgcgtgtctgtgttggacgggtgacccaccggctcgggaacggcaacccaggacggcaggcgcggcgacacatggtcggggtacaggggtacgtctctttctccacgctcgatgcccagtgcaagtgcccaacctcagactcctcccggaccagctgacctccgctccattcaccccacaccttcttcttcgtcgtcgtcttcccctgctgcggttagcctggccgtggccgcctcctgctcttcgatctcacgctgcg

SEQ ID NO: 3867 - DNA, 1030 bp, Zea mays
tacgagttcacaaaagtctagatcatgtgcaagatcattgcattgaggcctcgggaagtgtggatggtagtcttagatgcttgggtgggcttaatttcttatacaaataaaacaacaaataatgacatgatttttggtataaacacaagatccgtaaataaggtcgtaaaaatacctcaactgttttcgtttccgtccccgccactttttctcgggaattctcttgttgctgttttttgatacattatacgctcggatattatggtacaccatgtcgatcgttacaagatttttctattttgttttggtccctacttgtgcccctgttgtgaacaaaaaaatctaggttgtacgtacaagttcgaacaatttttagagtcaggaattggaactacaaagggatgattgatatgtgagagatccattcaagatacggtacatgggtttaacccctattaaccgaacatggccttagagacatagttttttatccgatttttaaaaatcgaaaggccaaaaccgttccatcaatcatgcatttccatgcctttagaaattagaatctgaaataaaaactagccatccacttgcatttcgggcccgcggggcgcgaatcacgcgcccataatgcagcgcactaccgaattcgtgttcccttgggcagttgggcccttcctcaccacgaaagagtcaccacatcgctgacagagtgatagtgacaccgagacacaccaaagccaacacccccatcgccgccgtgcacgcgctcggcgctcctcattgacacgtttgcagttggagtagggccgcggcccgggcatatagcccacccgtcattgacgcgaagcgggacctttctagatatttcccaaccccctcagaaaggagaaataatcctccctttctctcctctcctgcctttccccattactactccccagtcccactcccacccgcaggccgcgccgccccagcaaatctcacgcacagaaacaccaaagccccaaaggcccaaactcaccacctccca

SEQ ID NO: 3868 - DNA, 1500 bp, Zea mays
atggaccagcggcagctaggccggcggaatgcgctctgatttttgcccgtggactggaagagcctggcacgcgcggtcgtaaattccgtgacccaaaccgaatcatgcatgcacacctggctggctgcgcgcctagctaggcgcgcacgcagatcgcccgacgcccggtgaaccttccttgcgagttcgcagccctcctccttgttctcacgactataggcgtttaaacacgcgtccttggatcaccgaaatggccgtgtcgccatgctcgctaggaagggaagggcaagggcgtctgttgtttagttagtcagaatgctgtagagtgcgtgcgcgtgcacagcaactcagcgagagggttagggctgggacgtgcgcgggtggcccccgcggttgggaggagtaaagcgccgccgcggcaggttccccccgcgcccgcgcgtcatgtgcgcctgtaggctggaggctggagctcgctctgggcggcgcggaatgccggccagctcactggatcaggtggggccggggccaggctgcgtcgggcacagaaaaaatggttctttttttttcttttcttttcggagaggggtggggctgctgtaccgtcggcgtttcggcttgaaggagcttgagctctcttctgacgtcgttagtacctccttcctcctaccgacattaatggagataccctcgccgtgcctctctcgacgcacttgcgttgcgtggtacatcgcccgagatgcgctgcgctgctttctgtcggtagaaagcctttttgtttcttttgcgtggtatacttgtgtgtctttcactgggatcatcagccttgcattgggcgtacgtggccgtgtcctggcctggcctggcctggggaattcaatraagtgactagatccgtacgtctaagttctaaccccggccggccggtagtaaagttgagttccgccaccgtcgtcggtaatcgggtccctcggctcggaccagggcatgcagcagggatgactgatgagggagcgcacatccactggcagcggaacgacatggccacgtttccgcaattgaatgcgcggcggctcccagagcttccgcttccaacttgagctcgatcggtgtggagcgcgcgcccggcccacgccggctggacactgcgctgcatgccacttatgtgcagtgcaggcggcgactgtgcgtgcactcgctacgctagctcctccatccctggattccctgcacactgcaccaccgcgctgccgccgtcctcgccctgctcctgctgcctatatatactgccgcgtgactcgcagggacggagcagacgttggccgcccgccattggtccgccgatatctctttttccctctctctccttttctgcttaagttcccgtccacgagagcaggtagtagtagctactagtagctagcaagtcggccagcacgctcgctcgctcgcagcagtcgctagccagacagcattggcgccggcccgcgcgtgcgcgcc

SEQ ID NO: 3869 - DNA, 262 bp, Zea mays
atgtaatggcaagcaacacattgtggatttttatgtccgaattatttttatttttatgggccgggggatggttcatccagccatgtagcacagtatgagtgtgagccaagtcaagtcgacggggacagaacaggtcaatcagtgccatgatgtgcggcagcgacgactttgctcaacaagacaaggaccgggggggcggagctaacgtcgagttcggcaaggaaatacgtagacaatttctgtgaaatggagtggagttgcc

SEQ ID NO: 3870 - DNA, 221 bp, Zea mays
aaatcataggttctccacgacgcggccatctccgccaccgccagcgccacctgctagggtcaacacccgctctctgcggactgcgtgagcgtgaagcaccagcggcggccaccgggcaggacgagccccctccccaaacagagaggggcggggatcagtgcgtgcgctcctggtggagggcgtggaagagcttggcaggcggcaagcaggggtttgggagg

SEQ ID NO: 3871 - DNA, 159 bp, Zea mays
agtatggttcatcacatgtttcttgtccagcatattattcttctttttaggcagactgagtactcttagcatatttgctgtgattgtgctatttgaaagagataatgtcatgatacttgctgcagaagccaagaagttaaagaagcactgagagcgcag

SEQ ID NO: 3872 - DNA, 505 bp, Zea mays
aatgtgactgtgtgtgtgagaacaaaaccctagaagaggacccaaagccctcgggcaaatctgggccgtctacccccaaaatccaacggcgcacctcgctccgcccgttgtacttaatcgagccgcaaccggcctctgactgatttcctctccggtctattctctactcttcttccccagtcctccctactcagtacttacctcagcacgccactgctcgaaggcggagcgcctccaaaatccatcccaatcccaaatcctctgaattcggacgccgctcgccccacgcagatggatgcccgcccctcgattcgcccgcgctgagcatccgaacccggttcccgccgcctcggctcattccggcgctgaaagattcagctccgcgcttccggccgccggagctcggtaatggcggggttctagcgcggcggacttaaagatctagcctcctcttttcctttccattttctctctttcgctgctaccccctcacacccccacggcg

SEQ ID NO: 3873 - DNA, 1459 bp, Zea mays
cccaggatcatccatctgacgaataggtcgcagacgactgttaagatgtcttcgtgagatactagcaattggataacagaatatatgatctgttgtacacgttttgaagtcgtgcaccttctagatgaccaaatcgacgaattgcaaacaaagccgtagtgatgccacggccgagcagatctgagttaaagattagatacgcttcatctcgaacttgaaattgttgttggagatgacgaccattgaactgtcgtagatcgacatcgaacccctaacgcgctagctgtcgatgtttgcttgtgaccctcccgcgcaccatggggttacccacgtgcttttgggtaggacgtcaatgtcacgacaaaaacacaacgaattatacatgtttgggtcgcgagatgcgtaataccctatatcctattttgtagtgtgttctattgctttgatatctggagcttacaatgactcaatgagggctagggtttgtatgtttgatgagagagaccggggggaggggtgtgtgtatgaaatcacattccttggaggaagatccctcacttgctttatatagtctggcatggcttgggttacaagtccgtttccttctatatctcctagatggtttagattacaatagagtgcttgtattgtgcgctaagtttattcagccagtcaacccatatagagaatacgtctcatttggatcgagagtctcatttggatcaagaggatatccacccccacaaccttaaatgacggtagaacgtcaaaaaatagtacatcaaagggattatagaattgtcttgagactataaaaataatgcgttcccaaacatgactaaatttgccaacacttcttgaacgagccccaatgccattggaaccatcagcccctcagagcgatcacagccattgatcataccggtgcggccaaaaatgctcgtatctgtatcgtccaagggcccctacatgcctacagatgaaggtgggtcgcatgacgccagctggcatggggggagcgcaaccttatcctcttttcacgaggcatctcgtgcctaggcgcggtccaaggagccctaacacaccgacaaaccaaagggtccatatatcagtgattagtggtccaggagaggcctcacgcgccgagcgcccgagcccaacacacccgtggaatatacgggcgagtctctgccttcaccccctccccgacctctcgcctccctctctggtcgcgtacccattccgaattggccaacccacaggccacaccacctccctctctctcgagccgccgccatcagatcagatcaaagaggaacacccaacccccctccccacaccccccaagagtttggtgacaatctcggtcctgctgatccgaaggggtarccgggccggctagggcgtgctcacctctcgcggcgaagcttttctctccgctccgctcggtgtttcggcc

SEQ ID NO: 3874 - DNA, 664 bp, Zea mays
tgtatcattgtacactgatatttttgtatgccgttgcaacacacgagcacttaattagtgataaatttaagttttatctttataagctaaatgttaaaaacaaaaatataattttttatagcagattccatattctatttatttttaaaaacaaacaaaaatttgatatccgaataaatatctattttcgatcgttttttgtccctacttttttataatatcagacattctttgtaaccatgttcaattgaaaatttgtgcttagcgcccatcatcattattttttaacctcaaatccactaacaaccggtgggggatggaattgttcaaattttcgtatgataggaagcaagatgtgcataccgagcgagaaccgactatcctcgaagtcgaatgatcttcgacaggggtggtccatgcgtttgagctaaacgatacaggactggctgtagcggactcctgcagcttgagccgaaaaaatggtgtctgccggctaaatccactgtcctcttgcaaatcccatctccctctcgccgccgccgctgcctccgctccgctcccctccccgtcctactcccgctcccactgtcccacccaccacccgaaccttaaacccccacgaacttcgcccaaaccctaaacctcgtcgagccgcagccccgcc

SEQ ID NO: 3875 - DNA, 893 bp, Zea mays
atatatttttatagccttcttgaactggacaaataagctttgaaagaattttgggccgtgccctgtctatacgacacagatagccatgggcaagatacacactacggtttaacatggggattttttccattaaaaatgaatccatatataatgtgatagtatattgcgcctgcaaaagattatgagaaaaatgtaggcctgatgcgatcttaccgagtcaccaggtcaatggttctatgtagcctttttcatctatgttagcagtggggaagggaatccagaggatagcaggaggaagagaggtacacaacaaagacgaagagaggcagtagaacggaggtagttcagagtttcagagatttgttcatttgttcgataatcccctttcacaagacacagactcttatttataccatcacgccaccctgacaagctagaccctatatcacagccacacacaacactaggtcccacagccagcgacacacttacaccactttggccttctggtacaaacgttggcacgacgctcgcgatgaggctgcttcccattctcctgtgtatggtccgacagcataagatgtgtgacattgtgccttgtccggcaacataggatgtgtgacattcccctccccttaagcttcggcttgcccccaagccgatgtagaacctttgaagcaccaggattccaagggaaagtggtgaacttgttcttgattgcatcgtgactcaccaaaggatcctgattatatatgttatattttccatagaatacaatttccagctgacaaaaaatatcacatagctgccggtgtactgccccttgatttggagtctgccatggaagcttcttgaacaggttacaatacaaaactgaagtaattataacactg

SEQ ID NO: 3876 - DNA, 1366 bp, Zea mays
ttttgaccctttattcttataatcttggcttggcttgtttatccctataggcatgcacatgaaaatgaaagtttgccaccatagaattatgttgatagacaacacattccctaattattaccttgcaatccaagcatgcatattgaggaatgtcacaaaattggaataaacaaaactgatgtcatgatgggaatgtcacgtcaacaaaactactcactaaaaccgtctaaggggttactagcttggttttataaaatggagcaggttaaataactgattttaaaggtgaggggtacacctcggtcatgtagatttttggagttatttgcccattggtcagtatcaaaggggggtttcacccaaataccatcacggcaatgggcttcgccactacgccattttcaaacttcatttcacagacaaaatgccatttgtactcttgagcacattattagactctttttaccatcttttacccttggcaaaataacratgtcaacactcatcgtgagaacttgctatttgaaatcagcgtgtatgaagtgtttaaacttgctatttgaaatcagtgtgtatgaacttgctatttgaaatcagtgtgtttgaacttgctgtttgaaatcagtttgaaatgtgtctgtttcaacttactgtatactgtttgtattgtgtacgtttgaacttgccttttgaactgtggacatctctaaaatctatggtttttgagttagctgtgaacttcctgctttctgtgccagacaactagctagctggccaagtgaaaaagacgaactatgcttggttctaaactgtgtgcttgaggactattaactgtgcttggccaaatgcaaaagacgcactgagcgtcaggcgtcgagtacattgcgccaacgtccctctatttctctgttccgaaacgttgcgccagcgtcgaaaccgtgtataggtaacggcgttaatgaccgaagggcataactggaaataaagagttgagattagcatccaggttagtcaataggagaaaatagccttttgtctgtgaaacaagagataattagatttttgccactcacaatgttatcttcttgttataactatcaccgtgtctatgaattgtgggttcaactgagtgtctgagtctataaaatgtggacttgatggtgacaaatattagaatctctcgtgaaactatgtttgaaaatggcttagtggcaaagctcattgccatcagccatgacgttatttgtgccaagcccgtcatgacattaataacggcaactaactcgctctaaaaaaataaagggtccttcgctccttcggtcgcagcctaggaaaaaaaaacgcataatttcagattgagatcgcc

SEQ ID NO: 3877 - DNA, 934 bp, Zea mays
gattgatgcaaaacctagtttaattttcgctctaatctatagatgtccaaatgggcgggccgtgtcggcccggcccgagcacggttaggctccgctcggattggggccgtgccggcccggattagctagccggttgtgccgtgctggcccatgggccccaagagaggtctaggcacaacccgctaggttaataattgtgccgggtcagctcattgtctgacgggcctaatggacccataacaacatataacgtttaaatgataaaaatatcctaaaagtatgtatatttgtgggtttaaaacatatttattagctctaaacatttatttacacctacgtaaccaacaaaaacacatgtttcttgtgtttcctactttatattcaagtataatatatgtatttatatgaaaaataaaaaaataaaaccgagccctattgggtctagcccgccttgccacgccttcagccctgtcacggtccgatgaccgggccgagccagcatgggcccgattcactacggatcgtgttgggttcgtgtcgagccaaaccctttaatccattttaacgcatatatgtgtatcccggataagtccttatttgaaactgagagcgcctaggcgacgccgtccacttgtcttttaattttccgaaagcgaaaggttagagccgcccattacacattgtattaataagaacaatctcgtctggtttatgggatcagtgtgtgctgtagcacagcagcaaccaaggtacgaagaataactcatcgtcgtctcggcatctcttctctgtagcgtgagatgtggaaataaataaagccaccttcccatgaacaacccattggacggatcgagctggtactggcacactcgatccaatattttagctagctagcaagcaaagcaagccttgagcttgagcggcggctagcgca

SEQ ID NO: 3878 - DNA, 1048 bp, Zea mays
gccctgtgggcgtgggggctcccctgtaggctgtagccgccaatgcaagaggaagtagctggcacgcggagacaggtgcgtccagccttagttatcctgcttcttctccttgacatcaggtcagctcagctagtaaaaaaggagcgtccattttatatttataataataggagcatagcaaaaacaaactcatcattacagtaccgttctgtccccgccgattttagtgcctagtttttttatttactcaaggaagtatatatatacttttttattagagcgccgcaaaattttaataatcaggcggagggtacagtcctaggcaggggagggagagggcacatggggttatgcggaagcagcctggtaggtaaggtgccggtgccggtgccggtgccatatgggcctgtgtgcgcttgcaaatgcctgcctgccacctacatattcatatacagctcaccttcatccttcgttccttgcttcatcatcaccaccatctctctagacgcacacagacagaaagagtcggtacaaatcgtcgagggaggccgggcgcgcgtaggaacagaaagacacgcagccagattgacagagctgagtgtgagtacgtactacgtagatacctacagctatactgtactgtacagagtgggaggaaaagggagggagagagagggacgtgtacacacacgcgcgtacaaaaatacagaggaagcttagcttgcctccaaccccgaccgacactcgggctcgtgaaccccgtcccgtaatttctctatatatcccgtccctccccccacgtacttcactcggcctccatctccccacgcaccccggcgcccgcgccgcgccaccttctctcccccctcctcctcctcctctctctctctctctctctctgccacacagcacaccagaagggcagcaggggaggtagagagaggtagcttcgcattctcggtttccctccgcgcgtgtcctcccagcctcgacagagagaagggccaccatcgtccctgcctgattgcgcgccaggcaggcaggcatt

SEQ ID NO: 3879 - DNA, 1500 bp, Zea mays
ttagctttaagttatctttgcctaaattactattatcagaatagaatttaaatctaagggtctaaacgggacataatggaagttgtatagaagtaccgtggatcccgacgatgatcgaacaaaagcatgtgccgacaaggcggtgaccgtgaagataaggttaacgattaagatcggcgatgatatgtagcgtaagagcggcatcatacctttcatctcttctagtacaagcctcttcttactgcactgttcctactccctccgtttcgttttagttgtcgttggataataatgtaaaattgaactatccagcgacaactaaatagaaacagagagagtaacaaaataaggagcgctgataacatctggagacatgaatggaactgcggaacaatacatgtaaaatgtgcatagagctttttcattgatctttattatgaatatataatatgttggctctactatcagaatatatcccccttaaacctccgagtcaaacaatgcctcatgcctttatcatggtgagtctcatctttagtgattccattagtaagggatcaaagaaaatgttatgacgagtagttcactacaacacttcctttgaccccttaccggtggagacactaatttaaaaaagaaagagacatggccaacgtttttttaaaattttttttgttaagaaatgctctaaaaatatctttttcttatcactctgtgactattcctagactactagaaagtaggctggctacctaagattccggttgtgatgaaataagcttaaatctttaaaaaaaagactacatgcgcatggacgtgtcccatacgcctgacatttcacgaagagaggaggaaaccatctgcctagttgtaacatatcctatacctaccgtcgtatccacttacccgaacaggaaagggccagcgtggccgtactcaccaagtcaccccgcacatttcgctctcccacgaggccacaactccacgaggaggacacgtcccgctccgacgcaacgcggccagctggcacttgcaccagcccggcgcctgcctcgtgaagcggcgcgaaggccactccgccagcccttgccacttccatgcaactgccgaccgccaaaccaatcaaccaacgaccaaccgcgctaggcgctaggcgctcgccgctctgtcgtctcgcccggcctcgccctccgcctaaatcttaggcgcgcgccggcgcgcggctccgcacagacgacagcacacggccatttccgctcgtgcctcaagccctcaactaccaccgccggccgccggccgatgcgcgtgtctgcaggggggcgaatggtgactgaacctgagctagctagtcagcttgctgtcccgactccccccaactccagatggatcctgtgccttttctcctctcgcgtactgtattatatatgcctgcaggccgtgcttcgggggacgacgaccccgttcccatcaggcatcagctgagctgagctgagctggtcc

SEQ ID NO: 3880 - DNA, 863 bp, Zea mays
acaaagatgtttgtgatccttatgaagcaacatcatggagaaatcacacttgagacaccaatgactcaaggagtttacttaattatattttatttaacttgagtataggaatcgtcgtactatcaagggggatccaaaaagaagattggtgttggtactaaagctcaaaatccttgatctaaaacttccattttacccttgttaatcctgtcggcgtttcgagaccggggggtccctcaggccgacgagtgagtgccgcgtgccccagcccagatgggtcgagcgcgtgggcgagcgcgaaggggggaaaggagcgaggcggccggagagcggcgtgagagaggtgggaatcccgcggcctttgtgttcgtcccgcgcccaggtcgggtgcgcttgcagtagggggttacaagcgtccacgcgggtgagggaagcgagcggccccaagagagcgcctgtcccgtcctcgtcccgcgcggccaaccctctctaagagggccctggtccttccttttatagacgcaaggagaggatccaggtgtacaatgggggtgtagcagagtgctacgtgtctagcgagggagagctagtgccctgagtacatgccaatgtggcagccggagagatcttggaacccagctagtgtgatgtcgtggccgtcggaggagcggcggagcctggcggagggacagctatcggagcggttgtgtccttgctgacgtcctcctgcttccgtaagagagctgagagccgccgtagtcacagggcatgcagggcgccattattgcctatctggtggagacagccagatgggacactggtcttgttctctgcggcccgagtcagctcggggtagggtgatg

SEQ ID NO: 3881 - DNA, 351 bp, Zea mays
ctccgtccctgccgtgtgccgtcgtgtctctgagtggctccggacgcttctttgtttcgggtgaaaaggcgacatcgtcctcttgctttaccccccttttcacctctgatctgccgtgtaggagctgagttgccagtgaaggaccacaagaccattttttactttccttcatatcttgacagaggcagcctttaggccatacgaagctgtaytgtccaaggatgtgacgaaacacccacacaccagtccatcgcccgttccgtgagcttccacaggtctatttcacccatccgtcatcctaacaaaggactactctctctcgtcctcgtcccgcctcgcagtcgcagcacg

SEQ ID NO: 3882 - DNA, 655 bp, Zea mays
tgttgccacaaagaccgtggcaggacgcaccgtagagggtgtgccgccacagtgccactcttcgaattgctggggccagatagcccgggactgtgcatgatgctaacacagctacacatgtagtgtccaacagacgccccggattgtatatactcatgctactagacattggaatcttttcaagtccctttaccttgcccttaccattataatcaaatggtatgctctcatatttattcttgagaaagtagttcattagtgaagtgctgtctgctgtgtaactgatactaaattttgagcccagaatgtgcacagaatttgactaaatttggtccaaaaatgtctaataagtttgggtattcaaatcagaataatacccttcacaaaagtggtcgcagtaggtaacgagatcaaaataaaggacccttctcggtcgagactgtagtataccaaaaaccaaagtagctgtcgtcactgatgaccacaggtggccggccgaacaaaccctcggcacgatcgcctgcctccataaatctccctcttcacttcaggcgaaaaggatcaaccaaaccctctaatccatttcggcatttccaacgccttcgccctaccagccacgtcgcttcgaggccgatcgaccgagcagctggtggca

SEQ ID NO: 3883 - DNA, 535 bp, Zea mays
gttccagctcggtacccctgcagatcaaagatggaatgcggagtaaggatgctcgggagtccgaatttagtgaagtgaatctcagtgccgcttagtggtttgatgggagtgcatgctctgtccgagctgaagttaatactgtgaaatgtcagttctctatgagatagaactatcgatgagtatggttttactgaagcgctcacttctagattattttggatctgaaatgattagttcaaacgtggtagcttacttttctgggacttcttcagtgcttgtttacatactgcttggtttctcacttcagtgctcttattcagtccttttgtaatatgtactgttgcatcacagagttctttcattttgatgttgttgttgagatttctaacctagttgtacttaactgcaggcaaaggcaatgaagatctctaatctggatgcacacttaatcttgtccagctcttgatcagttgatcttgtgctttgctgctcctgctcaagttaatttgttggccaatcaagttcagaggcgcag

SEQ ID NO: 3884 - DNA, 107 bp, Zea mays
gcactgcagtcggagtggcgcaggcggcgctgtccttctgtcagactggccagtggagcggtggagtgacggctgtcacttcggctctgccgagggcgcgtgtcagg

SEQ ID NO: 3885 - DNA, 473 bp, Zea mays
ctagagccgcgagtccagttgagtgaatcctttcaggctggatggatgcggtgggctagctctgctctcttctcgaaattgcatattgcatagagtagtattgtacgaaacgatatctcgtaacggaaggatggaaaccaagagaaagaagacagctctatctcagaagtgagctccgtctcacaagttagctccgtcgacacctcgagctattcaaacgagtgttcagtcatcagatctcaatatcgggttgggaatctttctagactaaaaagtttcgttttcgtgggtcggtgtcaagtctatctctcatgttgctcctcagaaaacgcgtagaatagtaatgtcattggcccactagataaggatgggacaaacgctctagtctatgcgttagaaggcaactagtatttttggttattttgggagggagtctttttctgtcttgagggttggtttgattggaaatcgaa

SEQ ID NO: 3886 - DNA, 1500 bp, Zea mays
gaacctgcgaccattaggttaaaagcccaatgctctaccaactgagctatacaccctattttacaagaaggcttggtgcggaaaagaaaagagggtggcctggccccttttcttcttatcatatcacaagggcgcggctctgtatggggctcgtactgcggagcaagtctgggagtcctttccactcattgaggattctatctaaaaaagaaggtcaacgggggagactacagtagctcgaactcagactatctacgaaaaagctaaaactcccttgtcttcaactatgaacttacatctatcgataacacgggcttcttaggtcaatcacatccccaggaacttctaactggcctagcaaggacgggcatctttcatcaatgatttcgatttaacgagaggctcggagatggtatacgtagaataggggaaagtaaagacaaacttcggtcaatttacgttttcaaaactacagctatcttgcctagagtcccagagcttaacggaactcttgtttactataagaataagaataagaataagagcccaccgctttagaagtgctttcctctctctttctttcgaaccataaactccgaagcggtttcactttaccatactggagaagggcttcactcgcgccttggggactgaactagagtacagaactagcttcctctgtacatattgttttcgggtaataatactatcattgagaaagaatagataacgactatcaggcatatgactgatttctatatgggtgtgggctcatactctcattttatccttgctcgcggaatacgtcacttaaaataagctattgacgtcttagttccgaccttrtctcctttctttcttttgttcaccggtgcaaggcaagggcggagctctcttatgttcatcttccacgcctgtctgcatcccaagcactaaatgagtgaaatccaatcccggaaaaaggctctcttgcatcttttgcttccccacccggcctctattctagattcaccgtcttcggatgcatcagtttattatgcttatgcctaatcttaatactggctagttacttcaattaccttacccctccttttaaggaggtttcagagcacccagtcacagctcgtcacaagaaatgatggtcgagtccccgtgcatgaagtcagtggattcgagtgaactgaccgtactacaaatcgacatacttgaggaagcttcttactaaaccaaagaaagggcagctccagttgtgttgtcgattcccttctcccgagagctttcacactatacttctacgagtacgagaaggttttattgaaaacgttcgaaaaccatagggaaagtaacaaatctttcttggcacgtgcccctgctcctggtcttcgaactagtcattaatggtcggcaacataggtaccctttttcggtatgcgttgcgaacactttcatttttagcgtctcatcttctctggagaagctcaaatcgaacggatagagcag

SEQ ID NO: 3887 - DNA, 1500 bp, Zea mays
catatactgcgccagcctagcaccccgaccttacccacgcaggtaccatactgtgtaaaaaatagtgcagagcgaacacttgaacccacaaccacaactcaagaaatttgggattaaccaccagaccacatatactttagtgtttaaaaataaacaataattatacttaataaatatcttaatatctatttatatgatatataacaattatagcaaagcacgtgcaattggctactatatattattaagtatatataagggaaattagatggggagaatggttggagttggccccatctctatgttcctgctccactatactagacctctaccatttattattcttttggggacgactgctgtttttctccttgtgttgtatgctcgtcgtcgaaatggaaataactatctcgttagttttttagggaaatattgcaagttgttggagtaatattattttttaggatttgaagttttaaggaggtctcaattctcatgcattggagaaatgttttttggatttttttggagatgctctaactttagacataaaagttagacaaactatagacaacgaaccaaacatgctttagatctccaataagtgaaccaaaatagttctaaaaataaaaatattaaattattcaaaatatttagggcactaataataaattacgctccaacatttaagttcgacgattaagccctaaatcatatacttttggaagtgatttacattattaggacagaaaatattgagaataatgtagaaaacaaagatacctcactagtatatgatgtagtatatttgggtcactttatgaaatgtcctgtattttttgataaaaattataaaatatagtaccattagagttgttgtttatgagttgagttatatacttcaaaataaagcattgttttaagacactactgaagatgctctaatcaccactaaaacaaagcaaaacaaagaactgccctgactagatctgatcattggccacttgatccgaccaactcgtcgaaaaaacgtgattcgaccaatacgacaggtatgtatgaaccatactttttaatcgacgagctgagtacgtggcataattttttaccttaaatccgacctaataaaaaaatctgacctaaaagccgaaaagacacaacccaactaaaaaacgatccgacccatccaacaggaggtgcgggccgtgtcaaaccatctacgacgacccgaacggacgtttcgcactgatccattcgggcccatcccgctagcgatgggaatacgcgtccgctggggagttgacgtacttgatgtcgtctacagaccccgacggcccgactacatcaaccaacgcgtatcggcggtggcaaaccctctagcttcccactccgctcggccaccagctttgaccgcctcccctcccctccgctcctgttcctccataccccacccccccgcaggagcggcgcggcggcggcggcggcaaagccaaaggcaag

SEQ ID NO: 3888 - DNA, 1500 bp, Zea mays
cgaggaaaagaagaccccctctctctattatgtcaacagggacagattaccaagcaaacatcacgttacaggatgattacgatgaatataatggattgatctcatctcgtatctgaaagtgggcctaaattaattaaagcgaattcccgccagcaagttaggctttgtttgctcttgattaaacagcaaatcatcggtaatacggttagtaaagccgggatggagacaggtaccagcagtaccactttagaaagaaacacacagttttggaaaccttgtaggttgttgaataatgcacatcagtccatcattaatttatataacgtaccatgcatggatgatatatatcaacggaagaaaaaagaagagcaaaagaagttccatgctatctctactatatttaaagtataattttttttgtttgcacggttctacgatcatagtcgttgtgcgtcactcttcccattttataaaaaaataaggtaaaattatatatacgtagagatttaaacattagtttttgaatctacatccacactcacataacaaactaaacatacattttttgtgtattattaaaataaaatcaacacatataatatatagaagtcgtaacaacatacgagcattctaactagttgctattagaggtaccataatttcttttttttcttaaaaacaaaatggtacacgcatagggacatggtgtccatgcatgcatgtggtgcacctaatatgtcttcaccggtggttagccaggggccggcgagtggcaaaagggcatgcagtacgacgtagagatgtgggttccaaattaagggaccatttgcatttccggcaccaaatttgcacatcgtccgacgcatggaagctagggagtacaagagcatgcagagtggtttctggagtctgtttgacatgcagggtagggagtttgtttttgaagttttaaaccatccgtatacgtacgtacgtgcttctggctctaaccgtgatgcagctcccatccaagatttatagtgtatatatatattagagtataagaacttcaaatttcacaagaagtaatgctccggtcaagcaagctgcactgcatagtggagcaagtacaagaggcgacctgaactgaaacagatcgcgcggcagggagtcgctgtccctttgccaatgtggtgccttggaagtttgacctgagaacaaccgggcaagctagtgcaagtgcgaggcctcctaccggaccagaactcaagatcagtgcgtcgtcgtccttaaccgaagttgggcagacgctgaccagcrgcgcataataaaacatctgttggaggttgggcccagctgcagcttatatatataatacacaaggggattggagtcctgcaggagcagtgagaactgcatgcaagaggcacaaagcagcagctagcagttcattcaggttagtcatcagaggtgacatcgctctggaactggaagacaagcagcaggaagacagagagatca

SEQ ID NO: 3889 - DNA, 238 bp, Zea mays
cccggctcatcttgcgcttaatccagtccgttcaattcttgacatccgaacaccccgccgacgcagccctagattccgcattcctctgtcacctccgcggcgccgccagcccgccatcacataacttcggcttctatcccttcgtaaacccttctctcttcttcccgcggcctgctcgttctatctgtccagcagacttgaggttccgagcggccggaaaccagcggcaaccgtcggc

SEQ ID NO: 3890 - DNA, 1500 bp, Zea mays
ggtcctcaaaaacgtgatctgacaatgttttccaagtggattatgtgaacaggtaccttcggactcagaattacgaacatgaagtgcggtcaggatgaagcctgaaccagacgaaggacgggctgattaccaagctccacgaaggatggtgcacagccgaagctgtgcgcagggaagcttcgtcgcgatagcagagaggggaaccgacttaaagatgaaaagactacgtgggccttgtcagatttccataagtcattgacaaatgtaatggacataaatgtaattttacgtgggctgcgtcccgcgtctataaatagatgaacagtactcccgtactgttcacgctgacttggcatttgcttttgcgtcacgcttgtactttttatcttctctcaggaccgaaggtacatttgtaatttgaaatcatttctatttttccatgttaataaaatagaaatgattctatgatgatgcttatattatatttcatgctttatatgaatccttcgttattacttgttatgtttacgaaggtatgtctcttatgaccttcgtccgaaactcattatttcccgaagggacataatgcttcgaaggacgaaggactttaacacttaacacttttcatgttgccttgttcttaactcttagcatttgagaacaagtcaccaacagtcttcatccactagttatactctaataccctctagtgtgaatacaatgcccacaatatcatagaaacgtcatttgaggtttaaaaggtgatctattgtttcgaattctttatattccaactttttagcaactgtatggtggaaacctgttatcacaaaaggtcattagctagcccaataacgtcttcatccactgttgggtctatgcttcgtcgccgaaggtcttatagaaagaagtggtcctcggatgaagctgtttgtataagatagtcgaaggttcctcttcgtgaagcttcggtattacaaaccgacttaaagatagaatgaccttttagtccataaaggtctgagtcaatgttgtaagcttctgtaaggggcatacttgtaaatcctcacaggctgcgtcctgtgcttataaatagtgaacagtattccgatactgttcacgcattcaagtaattgcaatcgcatctttcggaatccaaccttttgccaaggcaaaggtattattgtattcaatgattcaatatattaagtaaatacaatgtaacttgtttatggtgtatttatcccttttataccttttattttatgtcatcttataatttttattgaaattttattacgaagatttaagcttcgtaattatgctcttatcagccttcgtccaaaatccattattctcaagagaataatgcttcatggacgaaggacttttacacttaacattttctatgttgccttgttcttaattcttagcatttgagaacaagtctccaacattggcgcccacctccggtaaactcacttccacttttttgagctg

SEQ ID NO: 3891 - DNA, 1500 bp, Zea mays
tccgctccgcgcccccccccccccccatccatccatcggctcgcatcactgcgccccggccactggtgctgctcgccttcgcccctccacgttctctctcccctctctctctctgtagtatcacgctcaaaaggagtgccgccaaaggaaacgaacgaggctgaagggaccaaccaatcggagcacgagcatgcaatccgctcgctgctgctgttcatccgttatataaaacctcgtgccccctcctttgccggctcacccactcgctccatcccttcctgtccagtccagtcccgtcccgtcccgtccgactgctcaccaccctccggcgcgccagtcccgtccccgtcccactcattccattccattgcacaaagccctgacccctgatcggtaaggtcgtcttgatcacagcatactggctccccctctctgaggactcgtcagagctgatcgcttcgcaccgcgtgtgtaggcagcggcggcggcggcggcggagatcgacagaggcggcgcgcgcaggatgccgtaggcggcggtgccggtgaccatcgtgcggtgcggctgcccgtgctagctctctcccaccacgtcatatcccgtgcgtgacctcgcgccgctccggctgcggggcgatcccgcgcgacgaggtcgacgcccgcttggcaccccggcgatccccaccggtctctgagggggctgaggaccgcatgcgttttgggtctccgacgcaccaacaattcaggttcgatttccttccgtcgttacattgctcggtttccaaatgttcggtcgggccgtcgtctgttcatacgtggtgcatgaccaacttggcttggggggctcctggtgctgtcagttactacgacttactaccactagcgtagacaggaaagcgattgggccggggtccactacgtggcggccctcgacgtcaaccatgaaggctagcagctagctagacctgcaacgtgttgtgttgacaatgctttgctagctcctctgtttctttagttatatagtgtatgctgtttcataatatactctgctcttcctctgctctgctacattcttgctcttcttcctctgctcttcttattcactcactgctaccaaaactgaacgtacattgtaactaacctcaacaacaggttcatgcttgctttaggttttcgctattgttcctccgtgcactttgctaaacaactcgccaaaattgatcttagcgtcttggttttcgaaacatattttgaggtcgccaaatgtatgtaacattctaattttgttttccatccttcacatcttgcaggccgaacacttccgccagcagcttctaaagcccgcgacttagattctgccttcatcacccaaacccaaactaaccgaaacaattttgttttcgaccacaaaaaatagcaatctctcgaatttctccatttctttccgacgaccaagaggcgggaaacctcacaaaggccagaaaccaagcaacacttcacg

SEQ ID NO: 3892 - DNA, 1500 bp, Zea mays
ggtggtgtaaccatgtgctgtgatgttgcagccatgtgcgcgcggtggtcatggtcgattttgctctctgccgtttgaacattccgaccatgcctgaactggataaagatttcagtatataatagtgtactgttactacttactattgtccttaccgtttatgggtttacactaaaaaaaaatcttcgatgctctcctagaggaaaatgcaaaccgttccgattgtggaagcgacgtcgtcgtcgcagatggattcgcggcgtcgtgacaagacttccatccgcgcaaggcggtgtttgcccaacgcccatgctgctactgctactggtagccggcagccgcattgatccatcgatcgattcccattcccccctctcccacctgcctggattgaagccggcacccactcgcgtccattgcgcggcacggctcgccactcgcgtcccacctggcagtggctcagcagccagcacgacgcctcgacggtcgtgcagtgcacaagggttgggatttccgcccgccaccggcgaccacatccccaacggcccccgtcattatttcggctcatcaaacccgacctgccaagtgccaaccccgctgtccccttcgtcaaggcacagccaagatgcgcatcaaatccacagttattacagcagagctggagatgcgcccggtgcaccgtgagcgggttgcctctgatctgcatctgctccggcctctggtctggatgccatgccagtcaacctccgcagctcgccggttcatctgccacgcgaataggctgatgacttggcaggtgagcctaccaaacacgtcaacggttacgtcggtgaatttgacgtgcccaaagagtgtggcgcgtgctatgttataatctgtgtgtctccgtctgtttgttgtaacttacccttacccctggccctgagagtaaaaactgttcctgcgcagctgccttggctgatgaagagggcagccgaacgcttgtatctcacgtaaagactgctactttgactcgcattcctttgtaacctgcacgaggaagtgagaaagaaaggttgtccgctaggatgtggtctttctccgcaatgaatttatccagttttatactactactttcattcttaaatatttattatccgtcattttatttttatactaaaacgacgacaagtaaaaaataaatgaggaagaatttctctataagagcaccactacaagaacttgaaaatccactttgaaatttgtccgtccatacgaactctacgactacgagcctactactctactactgcctacggaggagagagagagatttcatgagttcgtgttcagttagtcttggtgcaccagttccacccaccaccggatataggtcatgccccttataagctcgacacaggggcaggcacaccgcacagcaccgcaccgcactgcatcggtcgccagccgagccgagccgagccctgctctctcctccagctccccaaatcacactccgcc

SEQ ID NO: 3893 - DNA, 1500 bp, Zea mays
gtcggcccctcctccagtccgccgctgcgctgcatggcgcgcactggcactacgcactagtacacaggcaggcgtcacgtcccgtcgtgtcggcacggcacggcaccgcctcgtggctgggggcgctggccgctgggcagtgggccggtaataaaaagtaaaaaccgtcaacggccgtcccgccgagcaagagcatggctgctgcaccgcacttgcacttgcagtctgtgcatgggatgatgggtgggcaggcaggaatcctcgtaccgcgagcgagacacacggagacgaaggtgtgggatggctgcttcagctgctgtttcaaagatgatcacagcgtgtgcgtaaggtgtaccaaagcgtccacttgcgacgctttctccaaaacaacccacatggatcctggtttacttcttggaggaagaggatccagccagtcaaagctcaaaaccttccaaagccacacactacagattcatcttcaggtaaaatatataaagaggggataaagggggaagagatagatatagatctaaccttttttccagaatattttttttactgtccctccctctctctcactctctttgctattctcggctcccccgtaaaccaaaagggggaaaatagagagagaaggggaacgaaagcaagcaaggagcaccgcaccacgccactccagtactccactccactctcgtcccctcctcgatccagccatggcggcctagcccccccccctcccctagggttctctgccagcccccacccacccaggcgcctcttgccgctcccacccggtggtcgcgctgcccgcgtcgaatgggaggccacccggcgctcggagtcgggcgtgaccgcgcgctgccggaggttccctgagctcggcggcggcgggagcgtggctggtccggagcgcgccgcgcgtgcaatgggaggttcgagtggggttcctgcgagccgccgcggcggtctcggttctgcgagcgcgtggcccatgcttcgcgaagggtagggttgtctgtctgtctagctagctgctagctgcttggtctgatgagctcagctccggcgccccgcctcggcttccccgcgcgcttgctccgtcggctgcccagaacccagcttgcccgctccggcgcttctcttcgcttcttcggggaaaggttggagctttgaggtggtgcgggtgctcagccgaggactccgggcgatgacgcccgcagtggcgcgcgtttgccgcgacagtcctgggttcgggtagcgagttcctcgagcggatttggctgctgctgcgtcctgcgtgggaaggggaggcggcggcggcggcagcagcagaggaaggggaacggttgctctgaagcggagggggagcgggctgacattgcttctgggagcatggcgagcttctaaggacgcgcagctcccgcagcccagccattctcatcgccgcaccttggtgttcttgcccccaggtcgtactggttggtgggagggaac

SEQ ID NO: 3894 - DNA, 134 bp, Zea mays
tgggcgtacctgacttccgaaaaagctccgccacgcccggccggaggtccgaccgacgcctagaccgttccaaagggaagggagcacgcgcgcgcgaggtagagcagcggcggcggcggcaggagtgaggcagg

SEQ ID NO: 3895 - DNA, 1500 bp, Zea mays
aaaccacttctttagatgagacaaagttattttaaaaaatcatttggcaaaacggcttataggttgtttttcagaaagatccttatatatgtatatctctcctgtacgtggctagggattgagggcaggaccaaaaaataataatctggactggtgggaggactatagtgcaaaaataacgtgagccgaagccgggtgagccacttttttttagttcattttggaaaagtacttcactggtgaagccatctgaaaaagaggtgtttgacataacttttgcatgagccagagccgaagctgaaaaacattttttatcatatgcagcagagtatctttttaaaattttagtttaattggctgcattttgttctggttattttctaaaattatatatatgcaattcatataattatcatttaaccaagaatatatgacaggattataagccgtgactttatataaaccgtaattttaactgggaatatttaaattgtttttcatcattgcattttgttttagtctcgaagggtgccgtgcttttcatttaggtccttgttttaatctcgatccaccggaattgggtgtttaaatctctagcaagtttggttgtataaatatatcatttgaatattcgttctttttgtatgggtctatttacagaacgcttggttgtgaacacgaatattcataagatatatttatactttttaaaggtattttatggctattaaatgtagctgcgtctgctcgttgatgtgtggatctttcctcagctcggtgaggtcatccgtttgactgctagcctaggtgtgctgtctcggatggatggtggttcaattccaccaagattctttagtgtctgttcggttagtgcctgttcggttagctaggattaagacctgaaactatttagacttatcagttttaatataaataaaactgatcacctggaatagttctaggttctaatcctagctaaccgaatgggcactcacttaaatcctcgtcgcctggcctctctttttttaaagtaaactagaaaaatgctagtacgattgctatattttttatttatacttaagtttagaatataaaacataaaaacatgcggtgtcttgttattgttactagtgtgaaattgcatggttcaaacatagtttgcctgttattatagatattgcaccaactttcttctatgtgcgctttcaaggtctatttattttccctctaaataagaggcaaataaataatatagattattagatagattatataatatagatatctagattataataatttgtaattagattcataagctggattacctaattctaaaggaaacaaacattcctaacacagcctttaacccagatcgccgcccgcccctcgcggtaatgcggcgcctccactttgcgatgcccgcgtcctcgctcccctccccatcctcctcatctaccgtgctctccattccccacccgctcccaccgccgctcgcag

SEQ ID NO: 3896 - DNA, 1500 bp, Zea mays
accatggctggcggctccagagccatgtcaccaccattgactatcccttcttattttccgtgcgtgcatctgtcatgcatgtgtcccttcttcttcatcgacagtttccctcatctcttacactgactttgctacggatacaccatcgagatattatgaagagatcgacaacctattccagcctaatctggtgggggaggtgtcttcaggccgactccctatgtcgtcgcgcaccgccgcatcacaggtacattcatttcatgaatcttttggcaattctactcttaccctttattttgcttgggcgttcaatatatattctctattgtgtggcatataattcggattttcaattcagctttgcccttcttgcaaccacggtaccacaccacttctgatttttttttgtttcctttatgttagatagatctttgtgttgtcgatctttcttttcaattcgccggagaacaatagtgtgatgttcatgttatctgtcgataacataactacataagcaataaccaagcatgacaccctgatcgatatctatctgaatctctgaacaaattgtaaatcctgcaggcaaattaaaccgtagatccagacacatcactacaccagatgagtgagcacaagatgtacatgcatgtaccagcagtccagcacacagagaacgggcagctggtgcagcccagctgtgcacaacatttgctagctgcctcgcgcgcgccatgcatcctgcagcggcacacaaacacgccggaggcatgcactcacgttcttctccccctcctcgctctaccgtgtataccagtctagctacgtactgccagtgccagcagtctgtgccgtgccagctagctagtcgatgacgaatatggcaggaaggtaacagctagaggccgccaaaagatatcatgctgttggggaaacgccaacgatctcttgttgcccttctcgccaccacgtcggtcgtcgttgcttgcaccacaccaccagagcgacggccggggttcaccgtcgcgagctcttttggaaacgagggggcggcgctgctggtttcgtctaatccaccattccaccatgcgtgagtagctagtgctggctcatgtggcgtgcgtgaacaacgtttatccgctgatagatctatcgtcgctactcgatcgctagtgctcacctcccccggcccatgccatgcatgcagttcttccttcccttcccggccggccgcaagcagggacttgatctcaagagacgcgcgcgtgtataaaatggccggccggcgcttgctggcctagatcctcacccatctatcgagctaggactgctagatcctcacctgcccgactctcgctcgtcggttcgatctttcccataggtgccgccggagaccttagctttaattagcacactgaaatcaaacttaattacctgtgattttttaatttctcttctagttgcaggaacgcacggtgctagtttcgagtgtagcgcggcaat

SEQ ID NO: 3897 - DNA, 455 bp, Zea mays
tgcatggcctgcagagcagcggctcgcagcgggaaaagctgcatgtccgagacagagaggccaagatggcccgtgagcgtgacgatccaaattaaattcgcacccacctgacttccctccgccgcgctctctgcctctaccaggcaccagccccgcgctgttttctcctctcccccggcttcagcggttcagctccttcacatactgacgtacacatctcctcgccgaggttgctccgtccggtggccagaccgtggttcttggcgctcttggttggtcggggtccttggcaaccggacgtctggtgttcctgtttcgaccttgaacttcttgggggtggggttttgggggcgtcacctccctgtttgtttcttgggttgatgtggcggcggcgcttcctgtgaccggaggggccaaggaggtgggactttttcggtgaagggaaaactgcggga

SEQ ID NO: 3898 - DNA, 175 bp, Zea mays
gacgttagaacagtagatggtgtattatatgccactgtgagatactcagattgctgttgtggtctattcattggcgattggtctagctgtttgaataaagcaaacattaaagtttgcatctgtgagtgaatacgtatttattagaattgggatgatccaataaagcattccatga

SEQ ID NO: 3899 - DNA, 341 bp, Zea mays
cgggttttaaaggatagaaaccgaactcaaacccatatcccaaaatatagcatatatagaaaccgaatttgaacccaaaaattcgaatagatcatcaatttaatctattcgaattcggttcatgttcgggttttaaaatacccaccctactaaacagtggcacctagcggaatctatattttggggttgtcaagcagcagcgcactgcagccacaggataacacgcccacggctctcgtcagtcgtcacccgccttgtcttgtttcgctgtcttgtttcgcgctcccccacccccctcccaaccccaaccccgtcccaacccccactacggccttcccccc

SEQ ID NO: 3900 - DNA, 870 bp, Zea mays
gccccacaaataggcctagaatagatccgtccccgtctccattaattttatgtttaaattcttcgccatcgctcgtagcagcgcttctagtttaaagaaagatcgccctttctatactagtctgatccagcagcatggggcctggccggctgccccccacggccccaccacacactgccaagcctgccgataccgcacgtaaaggcgtcgtacgtacgttcatgcgatgccgggtactgcgacactgcatgcatgcgcactttgacaagacgcgtgcaagtgtggccggggagcaggactgcaggaggagcacgggacaggtcgtcgtcatcagacgcctgccgtctgatcgatcacagcgacgacgacgacgacgccggccggccggccatgcccatgcatcgtgcatcgatcgacggccagccggacgcaccgccggatccctgtcatatattcgtcccacccaatcggccggcagtcaaatatatgaagagatccatcgtcactgccactgctacatgcatgcgctggcagcagcagcagcagcagcactgccagcacagcgtcctgatcgatcgacaagacaggacggcaggcgggcgtgccgcgcgcggccgtgcccctactgcttcgccgcccgcgcccacctcgctcgttgcacgccctgccgacgcgtcagcccctagctacgagtagctcggtcacgcacctgcggcatgccagccatcctggacctctgtctgccgcgggccgcggcgtcatcgtcctccactccattggctgctgcttcacctggctagtagatagctagctgagctgacgacggccattatatatattgagcgcccgggaagcttcgtcgccgaaccc

SEQ ID NO: 3901 - DNA, 909 bp, Zea mays
ggccatgttgtgtggcacatatgtgggtgttgcctgatgcaggtcaactgcggcttgggtgccgttcctttttctatcgtaagattattgacactagatcttaactcttgagtcttatcttctacaatgacagacacactcttcttcatatgtttggctaaaacaataataatactacaaggacattacagcttagtccaatcaatcgagtttcaaccaaaagactaagctgacttcccttaaaagttagaccaataagcagaaaccataagtcacaaatttatttggaaaaatcattgaatgaagtccaatctgtactgctctcatccttgaacgatgccagtttcaggatctaaccagggatggtcctacgtacgtggactggtggcctagttcttccatccgctatcttaaccgctgcatgtgatcacatcgtggcccgtagctgctggaattccgatccccgtgtaggccatcaagaaccctgaagaatcctttggcctcacctcttgttaccaccactcccgtgacccccagactttgtcgtttaactatcctacacacattccctaccacaaatccaagaaaaccccacaccctgaaaatacacaccgtccctataaccatgtacatattcatgggcatggcactcatcaccagcggtttctatacttaacacatcgagtgaatgaatgaagccacgcgctcacagtatagatgctctgaaattaccaatgccatggatagaaagagcagtgtatatcaattttgtcagtaggaagcatgtgcattttgcacatgtcgctgcctataaatacccgccggaacacctgagatgcgctgcagcctgcaggtgacatgacagtgagctagctagtgtgagtagaagcaagcagcaagatgggagaa

SEQ ID NO: 3902 - DNA, 609 bp, Zea mays
tattacatggtatatctaaaaaatgatctagttttgtcatatttctctataaaatttggtcaaacttacatgacttagggcaattctagaatttgatttatttgggaactgaggcagtaggtaggtgtcaaatgggtttgtttatctcattgctgtcatcaatataaatgaggatcaagcctctattcttgtcaaataaattggaacttcagttcctcgttacgtcttgttgagttctccaaatatatatcatagtttgattgctaaaatgttaatctccctgtatggttatttttcaatattatatccttagacttgctcacaaagaagtactttcaagactgaaaatgattgtggtgctcgtccagattggtaatttcatttggttttttttatatttacaattggatgtgaatgacaacaatgtggttttgttagattatttgataactgttgatatcatgtgttcttgaaacaaggccttgaattttgctctgaattgtgttgctttggttatgtctactatccagtcaacaaagaatatagagtatctaaaagaccaaaagacaaccataatgtttggagattaaaagcaaaagtgaaagtacc

SEQ ID NO: 3903 - DNA, 601 bp, Zea mays
ccacacttcaatgtatccaagtttttagccttcaaaccccatacaagagctatagcattcaatacaagacacaaacaaagagatcaaatcctctcccaagtccagaatcactccaactaaattagtgactagagagagagacatttgtgttcatttgagctcttgcgcttggattggttttcttcttccttctttcttgtttccaactcaattgtaatcaaggcaagagacaccaattgtgtggtggtccttgtggggacttagtgtcccgattgattgagaagtaaagctcactcggtctaggtgaccgtttgagagagggaaagggttgaaagagacccggtctttgtgaccacttcaacgaggagtaggtttgcaagaaccgaacctcggtaaaacaaatcaccgtgtcatttgccttatttgcttgtaatttgctttcaccctctctttcggactcgaatttaattctaacgctaaccccggcttgtagtgtgtgcttaagtttataaatttcagatttgcctattcacccccctctaggcgactttcaattggtatcggagcccggtgcttcattagagcctaaccgctcgaagtg

SEQ ID NO: 3904 - DNA, 785 bp, Zea mays
caactagttataggaggaaaaaaatatagggaaagaaggtagccacgacggtcgatgggcagagccgcagagctaaaggataaccacttgaacaaggagccaaggagggatagtatgggaacccggtttgctacttggctcgcggcaacatgtttggtggctcacatgaagcaccgggtgtggttcgagcgctataggcgaagacggaccattgatatttgttctctttcttgctttttagagcattcggtaccgtttcgttttcataatccgtttttagggattttagtagtagctatgttcaaatttaagggatattttatctcccaggtatttttttcttactactttagagaaatcgctctctcttattgtgatgactattttctcttgccttttagatacattgttttttcttattttaggatttaggatttcttttctcttcctagatggcccactagaatgaatcccaacttgcaatttcaggaaggttttgggtgggctgaccagtcagctaaaatgggccagatcgtacggaacccagactattaaagtagcccatgtcccagaacacgatccatttacactgacaacggcggcctcacgaagcttagtgacttagtcccacctgtcagctgcagcagcaagcaaattgacagcaccccgcatctcttctcctggacgcgacgccgtccccaacctctccgtcccgcgccgccgccgcgcgtcactgtgctcgcgatctcgccggcggccccagaggacttgtcgcgtgctcggcc

SEQ ID NO: 3905 - DNA, 734 bp, Zea mays
gggaaatgagctgttttcagcctgaattcttgtcttagcagggtatcactatcgtaagtgctgattgtacccgttcataggcagctaaaagatcaaattcaagtttgtggcatctcagacagcccattcagcttctcagccacctaaaacccctcacagttcagcaagaatctcaatcaatcatcaccagttttgtcagcctcagcaagaatgacatgggctctgcatcgtcacagccactgcattcgtagacaggagcggactgaacaaatatgacggtttgctatcattgatgcgctgcgcagccctctcccctaattttctgctcccatattccctgcagcagtcaaagatcctgagccacatggcggttgttggctcaaagggcatgtggtccacgaaatcctctagctcaaccatgtatccatatgctttcccaacagctcgatcatgcattcatggtgttcgatccgtggaacgatgctgttgtactcatcagagtgaagtaactccttcccaacctgacatgcccctcacagatacacgaaaccagagtcaccttcactatggtacgcgcatgcaaagatcatagaattccacaggacgacatcattagatgaccctaactcaaagacccgggcggaataatcaaacagcctacacttggaatacatatcaaccagcgcacttcgcagtatatcgtcaatgtcgttcctgtttctgatcatgtatgc

SEQ ID NO: 3906 - DNA, 476 bp, Zea mays
cgggtcatgactataaatttcatgtgacggcaccatcctacacctcagattctttcattggagcatcatcgagtctgacagcaccccaccaaatcctcatatacacatgataaatccttgcatcttttctttttctgaatggataagctcacatatatcgctgttaataaaaatgctgtaattgcacatttcctatcataactgtaaatattataatttgacagcacattacccatttctttttgctcacatgtatcactgttaacagaaatgctctaattgcagatcgggtttttcattctgactgtagtactaaagaagtctacaaggaaggggttagggaagttgccctctctgtagttagtggcattaactgtgagcataggccattcaacaaacaaatttctatttctgaaatgacaaagtgttttccctaaattagagctttttttctctgacagcaagtgtttttgcat

SEQ ID NO: 3907 - DNA, 817 bp, Zea mays
attcagcgtggacgtgtcccttcgctcccttgtcacccgtcgtagcatcggcctagtcccaccgcccaccaccaaagcagacgagcgtccaccacaagttccacaacgcaacacctcgtgctgccgttgcacgccaggacagacgtcgccggctggaacccgacgctggtcgccggccaacagcggcataggagatgggggtagccgcccgaccctccccaactgaagcttgcacgcgtacgcgagcgtggccataagggaacgaaggaatccaggctcggtacggttatgtgcacgagaaccgtttcttgttgttgcagacttgcagtagcaccctcagtccgtcacgcgtgtacggatatgtttgttcctgacacacggcaatgagaagcaaaatgatcatccaaaccaactgtccctgcagttgctgcaggcgagacttgtccgttcaaatggagccgcgtcctgctccatattcgcaaagcaacgcttgcttcagtctcagatcagctagtaatttcgagcaacagatccagcaaggactagcagaaagcagcctgtaaattctagccaccgggaaactgggcaaacgctgccaatcattgaagccatcactggatatgtgtgtccatctccatcatcacaaacaagagccacgcagtcggcacacacacagagacaagtcactgtctcgaagtgtcggtttcgaactcgaacagggcaggtgctcgccgtccctcttttactagccttcggaaagcgcggcctgtccgcctgtgtctccggcctttgccacttccacagggagtccggggcc

SEQ ID NO: 3908 - DNA, 492 bp, Zea mays
ggtagtgggtcttttaccaaaaataatctgaaataagctactcttgaagagattatgagattataataatctgggctttagattatataatctggacctataatctagatgtttgtttacccaccagattatttgcgctggattatataatctggccagattataatctgaaacaaacagggcctatgttatactgtagattagttcgatgtttggagtttgaaacagaagatgacgtcgagagtttatcggagacattctatttcactttccaaacaccgctgtcccttcccctcccagcgctacccaccatctccgctcttccctctccggctcatccccgccgggcttccgccttcctgcacacctcgccccgtttcttcctcgaacagattctctgccccaccccgattctacctataaatcacaactgcacacccccgaatcccggcaaaacccaacggccgaagctaagctcgagccgccgccgcg

SEQ ID NO: 3909 - DNA, 826 bp, Zea mays
cccaacccaaccccatcaataattcaatatctcctcccaacagccgtctcgaactttccaccgttcacattaatagcttttcctcttctttccccatccaccctcgcaccctcaccgaaaggagaaggcttcagccttcaagcgcacacagccacgcaaatcccctcttcatcaacctcgactcgagtccgcgcgcgtccccgaatcgaggtatggtgatcccttcgctcatgctgtcgatttaactcttgatccgatgattgctgggatcttggggtcgattttcaccaattttctggtgtcaagtcgaggccttgggggaaatctgtggcctgtgggcagtatgttcgcagtagcttctagtttgttcgatttctgcgcctatggagtctgcggttctgatggtgtctatcgtcatgtgctgtaggcggcgtttctgatattccccaatttttgctagtctagtgcgtttagggtatgagcgcggacgcggtgcgtcaggaacactgtagtaaccaacttccaggagtaccgcgcttgatgatgtagtgcggtccagtgcgctgggagcatgactctggggttgtagcttttgggtgaagccttgtcgctgaattgaatcgagaaatattcttcccgaaaagataggaagcgtgggcagtgtgctttctgcggagtgctattagcctattaccatcacgtgtagtgtctattgtcaataccaaataacactcacgttatttcctagtataaggatttccatgtatctggttgtgcttgtgacagtgaattcctattctgaggccttgctttgattgcagaggag

SEQ ID NO: 3910 - DNA, 121 bp, Zea mays
tgcttgaacggaaggtggaggatccagagtaataattgtgatgtgatgtgttgtttcgggtggggggtattattggcttctgattgccggggtgcttgctgctgtctctgcaaaggtggag

SEQ ID NO: 3911 - DNA, 944 bp, Zea mays
gaaaaagccaaaaaatagtagattagttttaccgcaatcctataaaccattgagcatttactagtactacttagctagggcttgttgagtttttggttgcatcggttgtgtcgagttgctggtcttagtttattcctttagagttttgagttctaccacgttttggtcaccacgagatccaccatcaccataaacatatctggttcgtttttgccaccacggatacatctcatgtccgatttggaagtttaaatacaatctggaaagcttatgttatcttctttccaacggatctgaccttatctcaaaattcattctgagcgctccgcaatcatcgtagagatttctggactttctatattaacaagatttgttaaatctgatttaaaggggctgttagcaatatctttattgtttgggttgtcatagtgaaaaaaagggtttaggtccctgcaaaaaaaacagaagaagaagaaaagaaagaatagaaaagaaaaaaaaaggaaaagaagaagaagggggctgaatctctaaatctgttgtttctctttgtgttgtgctagttcttctttttcagtgactacctttgtgcctaggctcacgtctctagcatggtttagcctaggaccagcacagtaccaccgttgaacgattattcagcttgcttttgtaactaacgtggtactagtgtattccttgcttcagcccacctacaactctacatatttcgactacagtttgacaggtcgtgttgctgcggcaccgatacacttattccacggttgcagacttgttggttgctgacccctcctgttgtgcaaggtaagaattggtaagagcttgtgtggcaggttgagagtgagcgccttgcagtagctacatcctaatagttgtagagtttttattccttcacgttttttcttgttgcctctgttcgtctaacc

SEQ ID NO: 3912 - DNA, 197 bp, Zea mays
gacatcgtagtcaagacacggaaggcttccgacctcctctccgaccttgaagtgacattccggtgtctcaaggcgaaaggagtcaagctcaatcctgagaagtgtgtcttcggggtgccccgaggcatgctcctagggttcgtcgtctccgagcgaggcatcgaagcaacccggagaagattgcggccatcaccagc

SEQ ID NO: 3913 - DNA, 685 bp, Zea mays
agggtgtgtgcaggaaaccactatgctaactaactttatatgatcttagggtgtgccgtggcctatatggaccacccactgggtccgcctctgcttgaaactgttgtatccatttagacttttgtttctccctacaccatatcaatctgagtctgtccactccttccttagatgttcttccctccattgaatctcatgcagaaataagaggtgattccagttgggagagttgtatttatcacatgagtgatacaataattattcatatgggcatgttgatggcaatatgtgcagttgcagcttcttgttttgttcattcgttaggagattgcttagcttaattagtctcagaggaagatttttaattctgtgttaaacttttggtggatttctataattgaactatgaaggggtgcttccggcttcccttgcccttttgactgaaaaaaaggtgatgcaagaagtgtaggttgggcttacctttgagcattcagttcctgtactttagattgatatgcacagaaaatcggaaaattggtttatgcagtcaactggaatattcaaataatgtttctatttgatctactcaactgaagttaaaatgaaaattgtttagttttctgcgaaattttctagctgtattcagcaatgtgtttgtttttttttcacttacgccaccttatag

SEQ ID NO: 3914 - DNA, 181 bp, Zea mays
aatgtcaaatcatttgtttttcttgttttaaccggttttcttttggcgaaaacgcgaaactgttttttttatgggaagcggtatttgaacttaaacgcgggtttggtggaccctgttctcatctcagcacggcaggcacggctgagcgaacgctcctccttccaaacccacgccgacaccg

SEQ ID NO: 3915 - DNA, 209 bp, Zea mays
ggttagtatcttgcttcagttcaacagtaccttaaatttgtgcggcagtgattggtttatataacaggttaattgggttttgacctgcatgggactttgatttccattttccatggcattcttgtttgctcttttggttggtttcaggctgaacattgtagctgaactcctctgtttcggtgaccgtgaattctataaggactggtgga

SEQ ID NO: 3916 - DNA, 1500 bp, Zea mays
ataacatggtatcccgttgttatctccctctctctctcctttggccatttattccattcttatgtgaatatcagctctgaattttttttgtgtcatgggaatatagcatttaaccaaccatgaacctgttaccgtagctgttgatgttactttgtacttgagggaaccaaacaaatttggatgatgccattgcatatgtcaaaatgctgaatttgttttgcaatcagaggtcactttgttgcacttgttttgtggttctgatttccatgtcactagatcacataaaaaggaattcagattcgaaatggaaaaccagatgacaaaccaagtagactagatggttatgcagcacatggatcgtataactttgttggtagctagtttcatggtcttrttattctggaacaaactgcgaacacacactgtcgctattttgatttgaaaatgacaagggtaggggcaataaataataatccctccattctttttttatttgtcgtggtttagtttaaaaaatgaactagcggacgacaaatattcgagaacggaggtagtattttaatagccaagctgggtccaccgcttcacgcacatccctacattgtggtatgccaaatacacaacacgttggtaccataactagatgtcgagaaaaagctgttcacagattctgatcgttctggatcacgtcagtcatgtctgggtaccattcagtgagattagagatttgagttcaatgacagttgagctatctacgcattatgcatggtaaatagcaaatgctatattgcatacagttgtagcctcgagatagagtagctagtgagacaagaggtacagaagtataacaataaaaaaagaagctttctcctatagtatgtatgtcagtgcacagtaacatgccgtagcccagggacacccttcgtttgcatgcatcacatggccaacctaagcagcgcaaaggacaatcattcatgcccatatcatttgcttgcctaatytttctcatctcatgtgcctttgcatcaataatcaacactgcatctagctagtgtgatgacacagctcctctctaatccttttacttaaacaaataggcaagttggttgaggagatctaaaacgctgctggctttgtagtagtagtgttggactttgaccgcaactgcacacacctaatcaagattcttatacttgttacaagcagaacatccattgtgatattattctatctccacatgtgatgtttaactaaggcaaattccagcttagcttactgacaccatgttgctacaatcatatgatagatgacactgattcatctcttgggatctccatgcctgatatgatcccgagcgttggttagtttgatctcaaycgttgatttcctaaccaaacgacctccttgcgcctgtaacagatccttataaagactgcccatatgcaggggatacaatgaaggcctggggttgcagcaacaagcctctgccctgagctgagg

SEQ ID NO: 3917 - DNA, 330 bp, Zea mays
ggtgagtaaccctagcctgctcggtcgggatctcctaggagtttgctttgcggatttgctaattgaaactatgtagacgctcgaagtaggtttttcttccttattagctcacaacgttagtctacccaaggtgcactttactttccagaattcggggttgtgcaatttagtttgcagaattcggggttgtgtaatttagttgcagaattcggggttttcaacgcccgcgtgaagtttgacgtgagattttttactaatcaccacgtcaacgtgttatctaactgtggcatgcccattttctcgactaattcggagttttctgcagcaaaa

SEQ ID NO: 3918 - DNA, 616 bp, Zea mays
tatttgcagcgtaagtttaaatattagtatgagtatggctatgctgctatagatagcctaatagcatgacccgtcgccaggccttatctcgtcagactctcttcaatgcttaccgcagccgccccccttcacgactgtagaggctgcaacatcacaccaagagatagttcatcggtaccccctacatcctccactatctgtgacagtgatagctgctagcacagtataccaccaaatgtgtgggtgcgacagtagccaccctagcgtcgatgtgtgtgctagaaagtgtttgctagtggagtaaaaatttgtaataaataagaaatatgtataaaaaatgatattttatagaggtagtgatttatagcgagagaatttagagtaaatagcttataaagggtagagatataggggagagagtgtgctgatgtggcatactaataagaaaacatcgaccttgcaaagcggcctgacaagtttttgtattcgcccaagcccggcccatccaccatccgctgctactcttcatcacaaaccctaataaatccatctccgcctctggttcgtcctccatctcctcccaaatcgcggcaccaagcacccgaccgctttccgc

SEQ ID NO: 3919 - DNA, 1500 bp, Zea mays
tagcagatgaattaataacacttgggacttcattctctcgctgtcgtacgtttcacatgtccagttttcttttttttaaatccttttcgtaaaagaagagatagcaataggtacacctgtcgaccgtatggccggccggccggacgcctaacaagacaagacaaccggaattcatgcatccaagcatgttaccaataataataatatatgatgatagatggcggcactgatcactttcagagaaaaaggggcaaagagatggaccacgtacgagagcagccagagttcagcacgagcttctcaccttcagaaaatctcgtccctgttctccacacacttgctagaataatcgaacaaaaaccctagcgcatctccacatcgtcggatagagaacggttttaatgtgttcatcatgcttcgaattcttccttggcactattgtgatgcttcacagattgatattttttttcgtgttcagatgagaagctaaacccgagttacatttgaccataagaatagttctttcacagtatatatagtagcacatgaaatacttcttcatcatctatcccaaaagagaagaggcctcacatatatactgccgattccattgggcttcgattccaaatgggacacaaaaaggtctggtggttttcaagaaggaagatttggctacttcatagtgaatgggaggtctgatgattttcatactatctggtatttcaagaagggaaatctgatgattttcatatctagtcaagggagattagaggcatgcttgatttaatttgtgcctggagttaaccaaaccaaaaactggctaactactgggtaagaccaaaatgaggacaaattaaagatgttattagagtaccttcagaagtctgtatatagtttacttatatattattacacatatataccgcgagctcgttgtcgagtgctagatcgtttcacatgtccaattttccttttttccttttcacagaaagaagagatagataggtacacctgtcgaccgcctggccggccgggcgcctaacaagacaaacgaatcagccggaatttatgcatccaagcatgataccaagaaccaataataataatatctgatagatggcactgatcactttcagaaaaaaactagggattttatatatgaagttgagatagggaattgtgaacgcagtcaacctaagcccagtttgtccagacgcctgggtcctgtaagaacgacggctcggcccataactgaaccaggacgaccgggagagccaccgtatggcaaaaggaacccatctaagcccacgttcctattcagcaaaggccaggcccaaggcccggtcacagagtagggtttcttccacgcctgccacacctcgctatgtatatatagtatccaccctcggccgcaccttagatttcccaactttttgttcctcgcgccgccgccgccgccgccgtgacggaaggaagaggaggagcaaggagcacgacgcg

SEQ ID NO: 3920 - DNA, 292 bp, Zea mays
agttatttaattagaaatatctgcgttgatatattatgcaagttctgtgataacttgacaaatttggattctttctgtaagctgtccactttctcgtccgatatgttatgcagtcacaacatgttttaggagttcattcagttttattttagatatgttcacaaagtcatcatctatttgagggatgacatgctgttttatgatttgagggctttggttccaggccttcgacgaagttatttcagagctggatagtcttggggaagagtcgtacaaggatagcaccctcatc

SEQ ID NO: 3921 - DNA, 111 bp, Zea mays
ccaccatatataccccgcgtcgccgcggcgttcttcgtctctgcttgatagctcgtgcctgccaaagtgccaacgaagaacaaaggatccatccgcggatcggcgatcgcg

SEQ ID NO: 3922 - DNA, 296 bp, Zea mays
tgtgttggcaagtggcatccctaacacatgacgagaaagaaaaagaattggtttgtgctccattttcccattcagattcactaattttatgcgtctttccaatcccaggttttctccagtccgtagcgtctttatcagttgcttgccttctgcagaggaaaaaagaaaaaaaaagagtcagctttgttactgcatcttcagcttgttcatttcgctctagtctggaaatattcatccaagatctctccatcttctccactcacaaagtaagaggaagcacaaaccactgcaatttc

SEQ ID NO: 3923 - DNA, 1172 bp, Zea mays
tgggggatgtgttcggagatgaaggtgggcgaggagaaggttgcaagtgcttcagaatgagcacctatctctatttgctttaacctctcgggaggagagattatgtgaatgtcatgaccgctacgcggtggaaaggaattcctgctgccaatattgctttaccaggaagtttcctttcttcttcagtcttattcctcccttctcgaatattatatttatcttctgttagtattattttgactgctttgtgcacgcctaacgacctggcttttattttcctagtcaagtcactataagactttttaatttcggataaggcttgtgattgccgtgtttcaactgaaagataacctttttttttcttactctttcggactttcggttgcgtgaaagacccatgcgaaccaaaaaagagaagacacaaaagaagaaagactcaagtcagtggcatcacaatcatgaagtgtgattctcttgctcaaatagctgttacgtggaaggtgcatacgaaccaaaagacagacaaaagaagatagactacaattgaagtgcgattttcttgcaagttgctatgctcggcctatctaggggtaccgtcccactagtaggagataaaaatatacctacatatttcgtacgtgacgtaagacaaccgtcaaaactagtgttttatagtagttgagattgtgatgctctagatatatatgcttaagttacaaaggatatgttgttaaatttttatatgttttcctattttctataagtgaagtcttctctcccttttttcttattttctgtttttatttcaatttctaaattcaaatcaatttcaatttaaatgtaacaataaaaaacccagcatgtagtgcaaggtaaaattttaactttaccttttttcaagaaaatatttctaagtagacaattcataagagaataattccctcaaataaataattaaaaactttttatttaattctgaacttaaaatctggtattacaggtcccatccaatcgcaggccatttgcaaaccagaaaaagcgaaacgcaaaaaaaatcacaattatgtggaccagtcatgtgcgtttgtttctcaaatacaagatgatactcaggctgtgactcttgtttctactcactccacgccactgactggcaggcgattatgtgattc

SEQ ID NO: 3924 - DNA, 1500 bp, Zea mays
cttagctccaacgtttgctcaatagaggtatatacgtagaaaaacaatgaaagaatgaggtctgatggtgcaaaaaaaaacggtttgcatggagcgaaatcgaatggtttcgaatgacggaggagcacgaaacattgaaacaaccgccaccccggcccgtccccgctcaaaaaaaaaaaaaaaaactgtcaagttgggcttcggccatagcgcagaatctttccatgggccagatttcaccgtgactctctaaaggatgccgtgcagtttctcgttcgggacgaaggaaaggatgaagcacctgtttggtttgctctctaccagagggaggaaaagaaagaacaggtggccaacgtcacatcttacaatcagtagagccccgaatagacagattccgcgttatgcaggcaggatcactgtgtttacacgtaggagctgtttggttcgtggctaaatgtgccacactttacttaaaagtagtcgttcgaattgaagaattagggtcagtttggtttctaacgcgcggcgccgcgccgcgcctaagctgcggcggtcgaattcggctgccacagctgcagcagcagaagtgtggcaggaggtggcagtttaggcgtaatatcaaacaggctcttaaccttaaacagaaaagttagacaaagtatggcaagttaggcatcaaactaaacaggtccgtagtatgcctgtgtgcacccgtatcgctctgcccctcgttccgtacagccagcgttctcgtcatcatcgtcgtcgttgttgtccgcccggcccgggatcacgagactacgcgtaagatggatccgcactccatcatactcatcacaggcgtaagtcacgaactgacgatgcagggtagaggagaaaaacgtacgagaggataccttgtacttttacagcgcgtggatggcagatacctataccgtcactttcgttcgtcttctcagctccggcggttcgtgtcgtgtgtgtttgtgcctgcaggtcgttatcaacttgaagaccgccaacgttcattgacagcgactccaacgcgtgaactgataaaaaaaaaatcttgcatccattgcactcaaacacccgccctgctacggaggttatcatccgaacacacgtttaagagacgaaaacgaaacgaagccaagtctgcgttcccggccggtcaatacgcttgcgcgtgcactcgtcccctcggccctcctgtgcagtgcagctgtgcagggccgcctccattttccatcccaaccgttccaactcccccacccaaaaagcccacgaactttcgacggttccttcctccctccctcccgctccaaccaaggcctacatatacgcccgcccaccacgcccccgaaaccatcaacccaacacggcgtccccgtcccgagtcaccaccgacccaagcaaaaccgcacgcaccctgccagcggccccccaactcccaacccaacccctactccagctagctcgcggcggcggccagcggcc

SEQ ID NO: 3925 - DNA, 1098 bp, Zea mays
gcagaaagccattgaggcagttgtcaggagcctcttctggaagaagatcaaggaggagggcgacattgctatctagcggaaagccaattaatcacattcattgcaaggccatccacaaagttatcaagtcaccacccttctgttctaacaaaaacccagatgctgcctgctacatacaacatcatgctaaccattttcagtttgattcgtggtactctatggtaaatcagtaaccttattcatgcgatcaattttaggtacgacaagatagaagcttgcataactccagtgctagattaggtcaccgcgcatagcagggtattttcatgatcaagcaccaactaactaatcattttgttgaatattttatataccgttgcaaagcacgggcacctaactataacaatataacacatatatacataagttattgtgttattatacggttccgttgcaacgcacggacactcatctagtgaaatagtaagataaaacttttctattgagagggggtgtttcattcatccataaaattgacgtggcatttttgaaaatagggatatgaaatcctcactgtgattaaccttagaaatatttaattattaatattttatcgaatagccagagactgcatatacgttccgtccgaaaccgaaaagaaactgggaaacgcaacggaatccggggagagacgtctcaaaagggtgagagatccaaatctccatgactccatcccatagccccgctcacgctgtcgctgtcacgcacatcatcgtcctcctcccttccccgcaggccccctcgcctcgcgcgtgcgccccccctaccccgtctcctccctgcctgcgcgatccactagtagaaataggcgcgcgtgccgcctctctcgctcgctcctccggttaatcccccatcgccaggagcccaggactcgcagccatcccttcacattatccgcgcgcgcgcgagcggacgtagcgtgtgggtagcgtcgccgtgcggacggtctcttggtgccggtgcgggccgcgtgacggtgtgtgagtgtgtgacgcccacgcggaggaggtcgttctgttggttggttggtccgcggcc

SEQ ID NO: 3926 - DNA, 377 bp, Zea mays
ccccgggggcgccgccgccgcccgacgacgactaccccgagcgcgccttcgcggcggtgcgcgccttcaacgaactccccgcccacgagcgcgcgccgcactacagccgcgctgtggacggcggggctaactactcctccaacgtcgacctgtacaactcccccgctgccagctggcgcgacaccatccagatcctgctgggccccaaccgccacccggacctcgccgaccggatcccggccgcctgccgcgccgaggtgctcgagtgggaggtccgcgccaccgccgtcgcccgcgccttgctcaggctcctctcccaggggctcggcctccgccccgaggcgctggaggacgcgtcctgcgccgacgggaagctc

SEQ ID NO: 3927 - DNA, 292 bp, Zea mays
tgtgcgcgcgcgtcgcgattctgtagcatccgcggcgcttgtttggtgaaatgcttggtgcatccgcgcgcgtcttcacatcatttattattgttatcgtccagcgtttgtagtttgtagtactacattgcctgtatctctcaaacagagactcgctatttactaattaagtgacagctaagcttagaattcctttttttcccttgttataggcattagattttgtgatcagcgagggcaggaaactataagatgaggctgatactgtcactgtgtaatagctggtaagatt

SEQ ID NO: 3928 - DNA, 1019 bp, Zea mays
ctctttattggatacgtagtttagatcgatgcgtgcattgttttaatttttttcctttaatcatcatgatactagctttgtatgaatagtcgagcactcgtgtataatatatatgcgcttcttcttatttaaaagacctgcaattttcctttgttgtcgcaacttttttgcaatcctgcaattttctttctttatcagtgttattactattctatgaccgcttcttttctgtcggatggtggctgatttggttcgaaaacaaaaatgaaaacaccagatttgacttttcaagaacaccagtttcagtaaaatgcatcagcaagttggctgaaattgcagcgatatgaatacaagtatacaactgccacaacaaaagtgggtcgaagcaaaatcgaacggttagcgttgatctcagaagtcgaaaatatgtgctggtcatgaaaccatcaataacggactaaggctatccacaaccgttaccactaaatttttccccctatatcactttttcccctatattttttcatctccctcagcggttccccctaaatactccccctataccccactaccactataaaatattattttctatatcaactatcaattttttatctactaacaattactcgtggacccacacacagtgtttagggtgatgaacagtgacacgctaaatctggggggagagagaaggagatcgacacatagggggcgctgtagggggacaccgctgcggccatagggtgccccctacgcgccgcatgcaaggggagggggagaggcagcgtctaccgctgcggctagtctaaccgtccatttcccattcccgctgacaatttactagccgttagacagtttatttcaccccatcgcttcctctcctgacgtgttacttcaaattcgaatcccgcgacccaccaaatccaaacaaataaactcgtcatcgacgacgacgacggctctttccttaccaatcaataaaaccattcccaactgagatttgaagcctaaggccg

SEQ ID NO: 3929 - DNA, 519 bp, Zea mays
tcattttgtgttgggctggatgttgttacagaacctaagcagttcaactccaaacagtgtctatgttgcatatagaattggagtgattttttttccagataagtattgaattttagctgtcttttcttctcctatagaggcagatatgattgtgttcctaagtttgaggcttgtttgctggttcatgttcttcatggaagattgaactctgcttggcatgatttttactaattgtgctgcgtggcagttgaggcctgcttgctggctcctgtttttctctttgccaagatttgatccctggcagttaggtaatttaaacaatgggaaaatccttgatgcttgctgtgtacgtggaaaccattaataattgaagttttctcagtacagatctgcatagcattgaactggacagcttgctgtgttactctgtgtaacgaacgatctactgctgatctgtactgttccttgatttttttttcctcttttcttcttttgatggcaagcaggactgaagataag

SEQ ID NO: 3930 - DNA, 290 bp, Zea mays
ggtacaagaatctcattccgtacagtagattacgctgggctcttttctgctgtcaccataacctcctcttgacgcaattgcagcatgacagtttctacagccagttcaatctaagcatgaggaattatatcatttctgtatctaagcgtgttgttgtcaattatatctcatcgcctgaagtgagcttcctcaccagcctacttggaagaattagcaacaaaacgaagcttgtgttccgctttcttgacgagagcagtctcgagccatctacgaaccagacatatggttcc

SEQ ID NO: 3931 - DNA, 635 bp, Zea mays
gcagcactcaccgcttatactgcagcactcaccgctataagcctataactgctacagtacaaacgtgatgcacagtgacccaccatatgcagggtaacgctagccgcttctctggcgtggttttgtatacacgtgagtatttattagatatagaaaaattaataatagataaaaagtaggtatagtaaatgatattttatcggtgtagtggggtatatagggagaatatagggggagataaaaaaataagagatgaaatgttaatgatgtgacgcgaaaaagtagtatagaggaaaaaaaattagagaaaatcactgcggatagcctaaaatgtactgaatttttgtttccttgtgctgctattgcactttgcgttttttcttcttatgaaaaaaaagagcccataaacaaaagcaaaaagttctctgtcttgctcctgccccaaggtacgaaggtaaacgacgagcacgatttggtcgcccgagctagcggcctcagccctcacatgacgaagacgaactagccgcacctgctgcgctgacttccgcagccactacaccccacgcgaagcacagcaagatttcactagcagaagccagatcgagtagaggcgggatccggcggaggcgcgaggc

SEQ ID NO: 3932 - DNA, 297 bp, Zea mays
ggttacggcacacaacgacgccggcgtctgtcgtcgtccgcttgatcggcaactgggtagcgtcgcagcgaacgagcgatcttgtcgcctgatccattgatccaactgtgttggaagaacggcgtcgtctgcaaacagcgaggcagagaagcttcgggcgcggcaaagcagcggcgtcttgcgcatagctacggcgggcgtggacagaacagcggcagggcggggagaaaagacaaggtttgatgtgttgtgtttttgacaataaggttctatgtgcgtttgaattttatttcatat

SEQ ID NO: 3933 - DNA, 1471 bp, Zea mays
cactcgcgctagtggagtctgcaattgcctagagccctagatctcctagaactagactcaactagaggtatattcttatttcacttgttcaacaatatttacatcaatttgcctttcgtaactcattttttcttttttccccagattttatttgctatatgtcatttgattgtaaatggattataatcaaaatgactattaaataaggtattttttaatatctattacttattttatagctacaagttactttaaactgtatcgtaatatttttattcatcgttgcgttagcaacacctagattcatcatgtacgtaccaaggctacttaaaaccgagtctatcgaaatctaatcgtccacggttaagttaaaagctttccttttccaagtacgtacgtagtttcttttttaatgcgctcttcgtcaacttcgcaatccttgtcactgggttctctatggtgttcctcggtgcttgaaaggattcatcgtctttaccgtctgtgcaagcatcccaccagggtcagggtcactgtccaaacgagacacaaaagcagcaaaccccagccggcctaaattttaatcatcacgtcagacatcaagagaggaggctgacttctagcccttctcgtcggcacgcaaacagatcgtcacgacaacgcgccttgcacgcggccacccgacaatccgctctcagctgtccagcccctgagatgggcctctccgaccctccgatcacaatataccgactcagcggctcagggctattccggtaacttccgcacgtgcgcttttggaccatcaccgcctcccagatatttctgcccatggacccacagctcaactacctaccttggtcactaaccggtgccctcgattcgcaatggatgacagatgggaccaacgggagcacctgggcccaggtggcggtgtgagttagtattgagtaaatgacgcgggagacgagcaggacggcagcccacacatcgtcttcttcggttcgtctctgctctgctgctgggatcaccgtcaccggcaaccgcgagggagggagagggacagagcgaagagagagaaaactgaagaaacaacattttccgtttttcttgcttagtgaaaccagtggaagagggagagaaaagaagacgaagacgacaatataagtaaataaaaaaaaggcagcgagcgaggtggggaaaaaggggcgagttgatagagagaaagatagagagagaaggcgagggaggcagggatcacgaggtgtgcttcctcctccgcccaatcgggcccaaccaaatcccgccagcgccgcctcctttatactcccacctctttcccggagcttcttggatcacgggacgcgcgccgcgggccggtacgctgctggtgctggaccgctcgactctcgcctaccagctgctgctttggctggcgcgccggcgagagagagagagagagagggacgcgacggcg

SEQ ID NO: 3934 - DNA, 688 bp, Zea mays
gtgttggaccggaagacaaactccatacaaatctcacgcatgcaatcgaaatagatctcacgcatagagtcagttgcaacatacttaaaaacaccctgcacgtccggatcgtgcgtgcaggatgatgtggaggtcgcgcctatcatggatacagggccgcgggagtttggggagactgggtaacataaacttgaagttcagaggttttaatatcctctctctatatatacagacatatgtccatatatacgcacatatatccattgcaggtatgtatgtttacaggtatggatataatattttcatactcacgagaaaaaaaattatcagattaagaactaaacttatgagtacaaactcatatctaaacccgcacactattacccgtgagtgcacgggtgaaacgtgcccgctgccatctcaccccgcggagacgaacggccgtgcagcgtgcacccactgcgactggcaatgtagccccgcggagagaatacaagacgcgacgcagccgacgccaccgggcaccggcaggcagcaagcgaacaccaaccaacccgatgtcccgatccaacaaactgcgaacgaagcgacggacgactggacgagacgaggcacggaacggagggaggggagggaccgagggagccagtgagcgagccagactacccacctactaggtccagcggca

SEQ ID NO: 3935 - DNA, 665 bp, Zea mays
gtttgatcggccacgttcgacgccattaaacaaatccaggactgtaaggagggatcgccaaacggtcctttttgcctcctcggaatttccgtggcttgcagacacagcaacccggcctccctccatccctccacatggctgcctgcaaagacagcgtgcaacggcaagacgatccatacgtagataccacgccgccctggacgacggtcccggcgtagctgccatgccacgccgaccgaccaaaccctgcagcctctaaccgtcagcgtcagcccgcacacccctgcggtcctgtgatgtcccctctaccaaaagaagcccaccaagacaactcaaaacccaacggtcactcctccctccctcgcccgcctgcctttcgcttctttttaagcctttatttactaccactactatactcctctctctttctcactcgtcacaagctctctttcatcgcatccacaccattccacttccaccccacgaggatccagcctgcctgtccctctcgccgcacgccacgaccgtagtcgctcgccggcgtgtctagcctagccggggcctgggcctccgcgctcgtgctcccgggaaacaacgaccgacgcgtcctcatagtcatagaggcagctaaggcagccacgcattcgtcgctcgctcgaccggcg

SEQ ID NO: 3936 - DNA, 240 bp, Zea mays
ggatttaaggagccaatcatcctctcttatcatggatgcatggttgaggattcgttgtaacctaccgaacacagctgacgagatgacccatatgcagtgatagcatacatcacaacggcaccagtactgcggtgtttattatatattagcccagtcggctgttctcccttgtcatgcatccccaattaacataaactagctagctaggaacgtggccaaaatgcattgctacatataaac

SEQ ID NO: 3937 - DNA, 973 bp, Zea mays
ccaaataacatctccccaaaattcctatggcctgcacgtcaccacactggtcctcgacgatagagatgtcaatgtatctgcgcttccggaagatagtgcacacgctctctctgctggcgggtcccgacagttctcgtacgtggagctgaagcaggtgaccaagggcttctgcaacgtggtgggggtgcgacatgtacatgacggacgtactacacagagaacgattcgtcttctgagcagcagcaactcgcgatggagaagaatacgctcgcgcgtatggattgggaagctatcactcacacgcaaatatgcgggaggagaggaagcggatgggggatgcagaacttttgggacaatgataaagaaactgttggagcaagatgcagaacttttgggacaatgataaagaaactgttggagcaagaaaaaacatatttctttcctaatatcggttttgggtaggtttaaggctttttttgggttcctcttagctctttgccagccctcgctctacgaacgaattgactgagttagaagaggaaccatcgttgatgcctgttctgacttgtcaaagcttggctggcaatgtggtcaccttgacagtgacatccgatcgatcctgtggcgtatcctgaatttgccaccacaagcatccaatccaattgctctcccactgcccagaagcttcatcacacytcagctagaggcagccatgcatggcaggacmaaaaagcggtccagtccaggtccgtacctgagagacttgtgttgaccctcctcatccatggcagtaggtaggttgagctgctcgttgatcactgctattatatatacgggtgccatggattcatgccttctccatcctcaagtcatcagctagctagccttccctacagcaactgcatacatacaacacttccatctgcccgctcgtcttcgatcaattcccaagtcaaataataatataacagca

SEQ ID NO: 3938 - DNA, 687 bp, Zea mays
ggtaccgtacctcttacatgtagtatatagtatgaatctcagttttttattgttttttcaaaacatcctgtctacatattcagtttagcatgaagcattaggctagctcagctttgtaacgcttcggatgctgtctattcacctcattacttatctccatgaccatttgaaccaacgactacaaaaaacatgcagcaataatctctttctttccttttttgtgtttggttcagagaacaatagaagaggcccttagttcgctactaagcatattgaaatagtgttcaaaacttacaagatcggaacaaatacgaagccgacagatataatgggactaatataaatgtcaaagacaatcaattaattgtcgtgttggccagccagtatgtgcagcaaatgttacttatgaacctttgccttttccagacttgtatgtgtcattagtgacattattcatctcaatgttttcaagttggaagacttgctagtcgttctggctgaccgacatgtttgagtgcttcaagccactacacaagatatgcatatgtttctctggacctgggatgtgccaatctggaagcataataattatcatgattcctgagtctggcataaattcatttaggcttcctttgacgttgtaaataggttaattctttgtatagatattttttcagccatgtaaat

SEQ ID NO: 3939 - DNA, 1023 bp, Zea mays
tgagagacatcaattgatagtacatgaagcactaagcaacataagtatcaattgaagctattcaatgatcaaaagtataatagatgtgatcaaatcatatgcactatgttatcaaataaacttgtaacaggagaatctagtgattatgctccttgaggaattcttataaaaaatattctaattaaaaatcttcgaattttttactatattctaaaaatgagatttaaggtgctacatgctatacgagaaaccaaacgccttgttagctaaccaaccaccccttccaaagaaacggggaaggctccaatctcaaggcaacaaaagagactggagttattgatgttacatttttcatccacatcttttttcggaacacattcgtgttcaatgtacctagagatcaaagaagccaacaaatatgcttagtctgtttgtttagtttcaatatgtaccggtttatatgcttctagtgacgtggcggccccgtcgctgaatcgctggggctacaagtgccaatagtgaggaatataccattatccgaggagcagaaattcaaacacttttttctgcggaataaaacccagtcgagagagattattcaggtcaggtcgcacgcacacgcacggcaccgggaccgggcacggggcagcctcaccaccgctcacatggctccgctcggcttgttttcgggcgggctttgcctgctccaccgccgcagctgccgagaagacacgcaaaacaaaaccccaagaccacaaggaaacacgagcgctagtggcaggtggcagcgagtgagaaggtgagctcgcctccctcgcgcctcccattcccccctcgcgcagtcctatcgtaggaatgggatgaggccggggcccctccctccttcctcctcggcgcttctcccgtgacaagcctccattctccagtccgtgagcactccactccctgtctccgcttttgtttctctcgtcccaacctccccttttctgcgggtttgatccgcacggtacaggataggggagg

SEQ ID NO: 3940 - DNA, 1457 bp, Zea mays
aaaagtccacatgcatgctgcatgcacacggttgatatttgagggcacagagcgcaatcactccctacttgtacacaccagtcctctctgattgcgttgtgtgctcaaattggtcacccaaggccaaaaactgtgcagatggggtctgcacacctaaaatgcttttgcattgcttcatgtgtgtgtgagagagagaaagagagaggagtggggagaaaaatcttgtagctagctagaaatctagagagaataaaaagggggaagttgtgggggctgggctgtgtgaggataatattggaagtgggaggtgggtatccttcctccactgtcctttttcatctctctctctctcttttctctctctaaaagactttgctaattggcctgctagccggtctccctcccccggcctctttccctttcagctggaggagatagatgagagagaggatcagaggaagcaggaaggagagagggatatataggccggtgtcttctgtagagagagagattgagagcaaaagggaaataaaggagctctcgcaggcactcggtactgacatgagtgatctcatgctcttgataccttggtactcttacatcaccccttcttcaccttcttcttgttcttgctcatccctcctctccggccctctcttcctcctgcctctctctagctaggacgatcttcaacaaccctctccccctctaattctctttccccatatagagagaataaaggagagagagaggcgaaggcaggcagctaattttcttttgttcaagggaaaggacagcacgtgccggagctcataagctggtagctgcatcagttcctgaggtaactgacatagagaaatagatagagatggtgaggaggaagatagatgtgtgcgctgctggggtgatgtgtatgtgtgcgtgcttgtgttgacatctgcgcaccccgtttttttctttgttaaatcacttgatgaagatgggatgatgcctgccttttcctttccttattaatatattttttctctctctctgatactgatgcctattccacatctctctcaagctatctcctctcgagctgctagatatagctagcttagtgtgttcttccttttccatgcatatatacatgctggcatgctgcaccctagctagctacacatctccctctcccccctgcaaccttcactcttcatggatccagtttcacttctcacgccacatactcctcaaatcattgctttggtattctttttcattttttttttgttcatctgaggtagtgttatgtgtttataacctcttcgattcttgttcttcctctttgggcttgcaggcaaaaccacctgcttacgatcttgcagtcatcatcacgctattagttgaggataatttcgcgcacaagagcacgacaagccgagatttttgggggcgtcggcgtcgacctgtaggcg

SEQ ID NO: 3941 - DNA, 1500 bp, Zea mays
ggatgagattagctgattgattaccgattagtctagtctagttagtctgagagaccagactaatttattcgccggatcgaaggcaagtgggatgaggcgaacgacgatgagacgtgagagaaatggcaccggcaaagtggcgactggcgagcgaggccgccgccgcgccatgtggtcgcggatttgtccctcgggtgcgggaatcccctgcttttacacgtggtcgggatcatctcggataggaccgagagtagttgcggagtttgcgttgcaacttttttcccccatccttctttcgtttggtagatgagatggcaccgcaggctgcagcgtctgcaataatctgtgtcagattgtatagtagtcgtcctctggttctagagatgtgacattattatatatgaaaaatgtgatcgaaaccgaaccaagaaacaaagctggcaaaccgggggagtatcgccgtgtgggctggcagcgaccctgccttacaaacatataaatacatactaattactactaatttttaaatggttaagcatataaaaaacagtgattgattcaacaaatatggttatttctttgtttgtatgtttgataaaaacatgtactcctccgatgtcctgttagttatcgttttaaataaggtttaagtcaaatttataaaattttgactacaaataattattttattatatagttttaaaacataatatttatatacaccgatttgtcttaacaagtaattttatttaaagtatcaatgtattaaaagattatttgtatttaaaaaaatattagtcaaagttatatttaaaagattgtgttatcgttctaaacgataactaatagtacatcgaagggagtagtctattaaattaaatttaaaatagaaccagacactcatatactacatataatctattatatattgtttatggacaccttaaaaaaatgtaggcacgcgaaagctcacgacccacgagtgacgaccccatctcctagcccatagaatgaagtgtcccgccgctttgcgaccataggaagcaaagttccacgccagtcgctcgcctgccgtgacaagtggcggcacacggtaggccggaaccggagccgaccctgcatagtgcgctctgattgtcgcgtcgctgaatcgatctcccagctcagagaccgactcccagtttcctccttctggcgtgtctgaatgaatggtagtccaccacaagattttcacgccgatttagcagttctttttttattcgtactaggttacttgcattatgatgagttataaagattactagtgctagaaagggcttttttggctgaattttaagtgattcactactacgcagtctgtgctcacgcaattgataattatacatttcctttttctgcgcacttagtatttcatttccattttgtctcaaagtccaggcagaagcgcaggacggggcagcggcagcgtgagcgacgccaccacccaagcggacggcaata

SEQ ID NO: 3942 - DNA, 824 bp, Zea mays
agtgcttgctcggtaaaacttataagattattgatgtgttgtggatttgaatggcgcctagtgtcttttactgtgtttggtttaaggtyaacatgggatgaggcgcccctcgattttttagcatcacgccgccaccaaaaactactctggtgtttacctcgttcgtacgtgactctcattcaaacactattgaaactatttaattaactatcaattaactaaggaaaaatcaaccaattagttaagaaaggaaactaacaaacaactatcaattagttaaaaaagggaactaattgatcaactatcaattagctaagaaaaaactaataaatcaactaaggaaaaaaacaaataaacctagctgcattatgcaacaggcttactagcattgaataattgtggccgttgttgtatatcgcttatcatggtgtcatgaaattatgtaacctggaaattttgtttttttggcataaaaatcactgtattcagaacagttcgtcttgggtcatcaacgacctacccaccagaagggctgtttgcctgttgagagggacgcccatttttgtcagccagtgctctgtccaagacaaagaagcaagagtgctgaaatgagaggataatgagcatgctgacttggctgccttggcttccacccacacactcgataggggaaaagcgagcccttccacggttccaccacccactcgatagtggaaaagtgagctcgagcgtgtccagcagctatggataactgacgatgggggtaacaagcttcacagaactctccctcgagctcagcgctaccctgaacaactgaagccgaa

SEQ ID NO: 3943 - DNA, 675 bp, Zea mays
aaatgcattactattaaaaatatttcatattctctatgctcatcttaccattagattttagtattcttaggacaaaaatgttcttaaaactcaatgttaattgaatcgatatgtttaactgatgttaatatgaacctttgggactttgatgttcattaagaggaagtgttataaaagtcaatgccaattgaatcactttgaaaacttgtcgcaattggatcaatgtcatgagtgaattgtttcacgagttccaacaagagaagcagcggaagctaaggggtcatcacttggaaaacatatataaacatatagtcccttcaagattaacaacttaactaaaacagagttacaacaaagctgttcttctttcgtactcaagactgtatgtataacagagagtatcagacaatgtgatcaaaacacctacctgttgcacataaaagacagccccccagggacatccaagcttcagtgggatttctttcaaaataatagtagatataaacaggattgaatgcctggagtacttctggaccatatactctgaggttatacattcctatcccagcaaggcagcaaaaccatacgaataaagctggcccaacagcaagccctactttgcttgttccaaaccgttgcagactgaacagaacaataagaaatgcaacagttatc

SEQ ID NO: 3944 - DNA, 631 bp, Zea mays
cttaaaaactaagttgcatctaaacaaggcctaagtcgttataaatcagtggtgattttttgatttatttagaatgaagacagtaataaaaaataaaaaatagcatctgtcacttcctttgcaatttttgttttgccctttagggcttgttcgcttatgtcgaattgcacccggaatcgttccccctaatcaaagtttatataaattagagaaacaatccggttaggaattgttccgacccaccaatctgatagaaacgaacaaggccttggtaaactaacactgtctcagattgaatcatgttcacatggtagggacgccactaaaaacttgtccagttagagatgcggtgagaggattgaaattgaataaaaagggatggcagccaaaagggattatcctcttcaacctcctgggtaactaaaaattccccggcatctcgtgctgtcttctctctctcctttccccttccccggctccccgcggcccgcaccgctgtgttgtgctggttggttccgtcgcgtcgcttgcttagatcagatctctccttctctccccggatcccgactgcctccctcccccttccacctcaggctagccgagagagatctcggcaccgccgcccgttgcc

SEQ ID NO: 3945 - DNA, 575 bp, Zea mays
tagcggccacaaatcatattagaaccccaaagcacaaactgacaaaagcaatgcataaagctacatgggaagggatttttggatccagaaccctggaggaacatatcttgaagttcatgcagatcaaagtaaaagttgggcgtatttttcaggctgttttgtttacctggggaggctcaaactggtatatgaagcactgctgcttagtttaaggattgttttgactgccgtacctgggtggtgtaagtgtgaaccgaaagggacggagacagtcttatctctcctagattgtccttattgagtcactgatccgccatttaaataaaccatgacagcttcaaatagagaaggaagtacatacaattgtttaatcttcaggctggtgggcctcatcaagcacctctggccttcatatataaacacaaggtgtgtaatagatttgcaagtgcagtagtatacagttcttgggtgttgtcttcacctcagcagcttcatcccagaaagccattcacaagataccttgtaagtttgtaaccaggagcaagcaggggcttcatcgctttagtttgcaaggt

SEQ ID NO: 3946 - DNA, 599 bp, Zea mays
tagcggccacaaatcatattagaaccccaaagcacaaactgacaaaagcaatgcataaagctacatgggaagggatttttggatccagaaccctggaggaacatatcttgaagttcatgcagatcaaagtaaaagttgggcgtatttttcaggctgttttgtttacctggggaggctcaaactggtatatgaagcactgctgcttagtttaaggattgttttgactgccgtacctgggtggtgtaagtgtgaaccgaaagggacggagacagtcttatctctcctagattgtccttattgagtcactgatccgccatttaaataaaccatgacagcttcaaatagagaaggaagtacatacaattgtttaatcttcaggctggtgggcctcatcaagcacctctggccttcatatataaacacaaggtgtgtaatagatttgcaagtgcagtagtatacagttcttgggtgttgtcttcacctcagcagcttcatcccagaaagccattcacaagataccttgtaagtttgtaaccaggagcaagcaggggcttcatcgctttagtttgcaaggtatggaggagaggaatggcaccaac

SEQ ID NO: 3947 - DNA, 1500 bp, Zea mays
gcagcctactccttgctgccttaatatagtagtatagatttcagtacggacctttgctaccgttacttttcaaaaaaaaagtttcataaaactatattaaatacacttatgtagcaaaatataaatagagaccataaaaaaaatttttgatgtgcgctatttcaatatatatgagaataaattagactgggacatcaaaccactagccgaaccgcacgccacccggcctccggccaccgtgcccgcctccatgcgcgtggcttgctctgccgcccgggcaacacgccaacacccactaggcgaacccaccgcgccgcatgaacgcccgtgttctggtggcacggccacgacaccacrcgacaaacgcaggcgcgccggctactaactgctgcatgggctcaatacaggccaacagggacgtactggtacggctaggtaggtacgccatcggcatcgtgacatcgtcgatgggttgggcaaacaggggcagcaatgaattctcgcacgtgcgcgcaccatgacatcaatgcgcgacgtagggcacgggtctgctagcatttgctgccgtgggtatatcatcacgagccattatctttattttaattggtacgactactatatactacgtactagtctaactagctaaggtcctatttgaaagcaatctagtttttaaagaatgggtgagctctcgatatgtcctataagacactgtgatatgtcaggctcgggagagctctcgattttgggtgtcacactagggtctgactacgagggttggcccgagatggcctatctaggagcttggtccaggcaaccaaacaactcatgggggttgctgggtttgtcctagctggggttagatcacccaaccaatcaattccaaagtgctgctcaagtagatggtatgtttggctgactaaaactcattccatcatcttatgagggtgtttggttctagtgactaaagtttccgtgttacatcgaatgtttgaatgttaattatgaatactatatatagtttaattacaaaaataattacataaataaagactagacgacgatacaaatttattaagtgtaattcatgattaataaatattattacagcatcacatggactaatcatggcttaattacgtttaatatgtttgtcttgtcgttcattccttatctgtataattaattttataattataatttaatatttctacctaaatatccgattgcgataggaactaaaatccagcctgagaacgaaacggcccgtaaaacagtccatgcagcccagcaagcagtttagacgaatcgaccggacgaaaaggcccagtccgatcaaccgccaaatcaagcatcaatcctagccgtctgttacctcttcagagccaaccattaatacgccccaatcgccgccgccagagccgcggagctctccactcctctcttacccttcctctccccacccacgaagcctcactagggtttagcggcggcggcgag

SEQ ID NO: 3948 - DNA, 938 bp, Zea mays
ctgagcccaagtccgagccctgggtcgggcggagcggagttcgccgtcttcaggggcctagcctgagtccgagccttgggttgggcggagcggagttcgccgtcttcaggggcctagcccgagtccgagccctgggtcgggcggagcggtgttcgccgtcttccggggcttagcccgagtccgagccctgggtcgagcggagcggagcggagttcgccgtcttccggggcttagcccaagtccgagccctgggtcgggcggagcggagttcgccgtcttccggggcttagcccaagtccgagccctgggtcgggcggagcggagttcgccgtcttccggggcttagcccgagtccgagccctgggtcgggcagagcggagcttcctatggtgcctgaggccgggcctgactgcctgtcagcctcactctgtcaagtggcactgcagtcggtgcggcgcaggcggcgctgtccttctgtcaggtcggtcagtggagcggcgaagtgactgcggtcacttcggctctgtcgactgaagggcgcgcgtcaggataaaggtgtcaggccacctttgcattaaatgctcctgcgatttggtcggtcggcgcggcgatttggtcagggttgcttcttggcgaagacagggcctcgggcaagccggaagtatgttcgtcgctggaggggggcctcgggcgagacggagatcctccggggtcggctgcccgtgtccgaggctaggctcgggcgaagcgtgatcgagtccctcgaatggaccgatccctgacttaatcgcacccatatatactcggaggagggtctggcgacggttctttgctccgcttctcgcctcccccttaggttttcgcaacccgagaggtttagccagagaaaaggaaaccgcttacctagtcttttccgccgccaccccttttgctcggtg

SEQ ID NO: 3949 - DNA, 1500 bp, Zea mays
agtggacgtacggcgatacaacttctgcatttttggatttggtttggacgacgcttgtgttgctggaactgtgagagaccttccgtgtcgggaggcgctgaaaaggacctgtgcttgggcttgtcgagagctttcgtgtgctaccctgccggctctgatggcttccatggtgtgtcttcttgattccggttgcttgcgtggtgtgtctgcttgattccggttcgctttgaaacaccgagtggctagaagaaagatgcctggcttgccaggatgggcagctcgttgccgcttaatcttcgtttatttgtggtcgactttgttacgcatcagcatccctttttttctctctgtgacccaaaaataaaaggagactttttagagacggcgaaatagaaaactctggaccggttacagttatcgatcaatatgaacagccggtcaagcagtttctggatcaatattaacggcgagttttactttttaaactaaaacacgacaaataaaaaagaactaatgaagtactaattacacaatgaatcgtcgtaagatgatggaaagcaaataaatcttttgagagaataatcacatggctgtcgctggatcctcacttgttggtttgccactaccaatcctaatcccagctaagaggcctaggggggaaaaatctaatatttacaagaccatacggatactcgctgtgtctctatccctctatccaggtctctctcatcacatctattttaaacttgggtaattgtggtttgttatgagattttttataaagctatacaagatggtgctaaaaggatttaaatgctaaatataacaatacagttagatctagatttaacagaacaaaagacctgtttaccgcttacacgatggcacctaatggttgcttacatattagtcgatgcctttaaactttactctgtaaacagcacaatctactgtgtaaaacagtgatctacattacaaaacaatattttgcataactgacggagacggtagatttttttttcctagagacaaattgcaattgacattcagcgtcagaccgaagtcattaacgcacgataaatgtacagataagacggaattgccgatattcatcctttgatgatcagattaaaaagaaaaatgttacaagtatcactatcacctgaggtaagcataacataaagtgatacaaaagcaaaactaaaacaacaggtgtttgtgttacactgttacagcttcaccggaaagcagcagttgagtaagcacgaagtgaggcaaaagcattgctaaatacgatagtgttacagcttcgccagaaagcggcagctgatgggtcaaaaatcagaagaccacagagtcatttgtcacggacgatggcgcaaccacaaggcagagtacctgttgcattgcatcgggggctccagctacacaatgcgaatccccttggcaacatgataaagaactgtgattagctaatggacgggtgccagctatttcatc

SEQ ID NO: 3950 - DNA, 207 bp, Zea mays
tcgtcgctgaaggcaccgtaccgactgcgcccgtaccgcggtgcttcatcggttccgcctcccgcgaaccgcgatgcttcttctcctcacagctgcaaagcatattcgctttccgccaccgcccgatccccacaccgccacccgccgcctctaaccccgctgtcccgtcttgtgctctgacctcaccgctggtcagtgtcagaccgc

SEQ ID NO: 3951 - DNA, 178 bp, Zea mays
ggtaggtaggtagacttgcctgctgttggtggccggagggccgctgttgccacgccgcctcaggggagatggatgggcatgggctaattgattggtttattggtccgctcatggttcgtaggtctctgcaggaaggtagagaggaggaggaggtttgtggcaggatttgaccagccca

SEQ ID NO: 3952 - DNA, 1056 bp, Zea mays
gggacgagaggggttggatggcgcctacctctgcaggcacggcgcgccggtgcatcgagaggcgggctcgggggagcaggcgtgaggtgcaccgggggaggcggcatcaggtttggcaatctgacatgccctcctcttggccccatcctcctcgcccctcaccggccccgtgggctcatcgtctctctcccataggaggatgacatcatcgaatccagcagctgcgaactggaggtcgggtcgcgcccagccacagtcgagcagatcgtcgtggcgttcgagtgggcgctagccgtggcagcggaagtggaggcggagggatcatcgttgttggaggcgaggccgaggtggtggagatgcagtcaatggacgtggtcggggatgggacgagggccaaagctgcggcgagacgtgagggtcggagactcggagggcgtcgtgaggcgggtttgggggagcaggcacaagtgcgcgcgggagatgcggtgagagagagaggaggcgagcggtcgagtgggcggttccgtggaggacgcgctgcacagcttgagcccgtggcagtcggacggtatagattgatccgagacagtccgtgcgagtcggacggttgagatcgcataacagcagaacggcagactacccttggagttttaataagtagtagagattttataatctgaaaagaaaaaaaattgtttattctcattttatgggcctggcccaacccacgtacggattggaacgcgcaattagactgtggtcaatcttccccgctagtccttgttcaccttctccggcggcagcctccaaaccaccctcgcgctctaccactccggtcgtgtagctccccagcaggcaaccaccatcgcgcacccaccggccaccgcgtctacatttgccaatctctgcttgaagcgttctgcccactctttcaaccgagaagttcactattatcctgcgcatgttccctttccccctttcgtcgtggcacgcacgttaggagttcgaccgattgccggaacgtcttccgccgtcttctgcgccatcgaaagagcg

SEQ ID NO: 3953 - DNA, 1372 bp, Zea mays
tattcttcattagtgtgatgatgaagcttcttgtggagttcgtgagttcacgaaaggaggatgccaatattgatcacttgttttttattgttaaaaaatataaaaaacaacacaacacaagttattaaacagtgagtttctccttttagttaaaaggagaaggtaaaaggatgaaatgataaggaaatgaaggtaatgtgtaaatcaagaacgagcattgttgtgtacttgatttcaatatcctaaaggtattaaacatcaaggcaatataattaagtcaagcttcttcttttacccctatcattcctttattcttagagaaaaactagactgatagggtgaaaatgaaggtgtaaacgaacaaatgaagtatttaaagttagaacagaaaaaatgtaaggtggagattcaatgggggttacatgtttcaaatacaaaaaacactgatataatgctctccctttcttttattaacttgaatattcatacaagtatcatgagcttcatatctttcaacagagtaagagaagaaaatacagcttcgtatgaagggtaatgcatccagcttcaatcgagagaaaagaatccttgagcaatgcaggacactattcatctattcataggcgtagggtatagctttttgaatttacaatcatgtcctaaaacctatacatttaaactgtcatacatgctgagggcaaagttatcctttccttcttctatcctgttggataagctccgaaggcttcctatgattttattcaggttcttcttccttcgggcacacgcacatcgccactttcgactgaagcctaacttcggcattagtcctacaacatatgaaacaaggtaaagaatagttattgaattagtattttgaggaccttcggaagaaaaaaaaacctccaacaacaatatcaaatgacttcaatatggtgcggtgcctcaatcaagctacagagcatagccttgacccatctcacctcaagaaaatgaatcatttatttgcctaaccctaacaccaacctggacttggtgtcacctgtggtacccaatcaccatggagttattgcatttttaaattcatgggccataacaaattggacgttggtgttaaattgaccctcaaatgaagacatttttgcttgtactgtattcttaggctcagtagatcatacacaagggcatttatgtcacgataaggcatgggaaattcagtgctgatacctgctgtcttgctaatgatttatagcagtggcagcgtggcctgtcgtcttctcatcctgctctatttatccttcagcccctctaggcttagcagtcagcttgacttgaggaggaaaaaaaaacaacacaccacactgcattaata

SEQ ID NO: 3954 - DNA, 308 bp, Zea mays
agtaggcatctagtttcatcatttttttgtcatctcttcttagttctcgtttggtactagtaggtttcccaatattcaatgtcttgctgctgcctctaaaaagcttgtaagcaggtgatactcccagacgctcagcacgcttgagcgagaaggtcaaggcaactgagagcccagagggtgagaagacccctaaacggggaagatcaagttctaagagaggcaaaaaggaggaaaaagaagacacagaggctgcaaatgaggctggagaagatggtgcttcggaggaaggtaaaggtacagatgtggag

SEQ ID NO: 3955 - DNA, 491 bp, Zea mays
ggtgttcgatgatatgcaagaactggtggccgtcttcgctcttgctgaaatcgagtcggggcatgatgtggtgagccaagtcatttctccgactacttagttaataaatgaattggttagataattattgctataatggtgttcgatgtatgataaaatgtcttggttgtgtgccatgattttgttgacgtcgagcacacctacaacccctctgagcacctatgtactatgagcagtttccttcagtctgcaggttcttccctttgggtatatactcttgttcagttttgattcagttattaggggcaccatgcacgtcagtgttcggtaaaaatttctaccccataattccaaaccattatgcacagtccctgtctccaaaatccactgtctgctgaaatgtccaatacttggaagccctatgcattatccttattactccaaacttctgtttgggctccattttaagttggtattttcatgcactctct

SEQ ID NO: 3956 - DNA, 121 bp, Zea mays
gctgcaccaccgtggcatggaagctccgcccccgacagccatagcacggtggtggatgagtaactgccgtagcattgctggcgacttgtacgaaaatatcgagcgcacacatggatagagg

SEQ ID NO: 3957 - DNA, 623 bp, Zea mays
taagtatcttataacgtaaaatggatgcagtatattatgagtacaaatggagtctatcatcatgtaaaaaacatgttatttcaatttaaaaacatgttattcttttggaactacaaaacaaaaatgtcacgaacaagtagttggaagctctatatgtctaaaacaaagtaaaatgcacaagtgatatataaacttatcttttatgaagagtgaggttcttgaactctcaaaatacatttttatgtacttgagcttgatcttgaattaacattctagagttcttgaaattttatgtttagtactttgaagttattactttgtttcatctaagtacaaatgagctccaaatcaaccacatgttggtctctaactctccatttgcatgtcttccctcaaccctctctagctctatatccatgctcttcccttctctcaacttttccaatctaatatggcatcacaactcgatctagaacttgccatccccaacacatatcttaatcatcatccacatgaaaaccaagacatcaccaatcatggtggcatcaaatggcaaagctagcactttttagacaaaagaggtacacaaacaattttcgcattaagttttttcacaacgaaga

SEQ ID NO: 3958 - DNA, 96 bp, Zea mays
ggtacttaacaagttaacatgtgatggtactgctttagtaaactggctcactttaattgtctttcaacagggaaggccaaggctttgcctgagaga

SEQ ID NO: 3959 - DNA, 357 bp, Zea mays
ctacttaatagtatatgtattatttttttacatcatatgatcttttaaagttgcccaggcttctaaaaatttctagctccgccactgatgcattggaattggtaatttacatttgaacaactcagggttttttttttgtgcctcgatcacaaacttcattccgaaaatagcaatacaaggacctacgatcagtgtagcaaagctggagtgctagagcagtcccataaaagggtggaaaaaaaagaatcacaacaactaaccttaatttcccaagccaaccatgttctgataccggcaattttactacagctgcgatcagttaatttccatccgaagcatcatcacaacatctccttg

SEQ ID NO: 3960 - DNA, 1500 bp, Zea mays
taagaaagcaaccaagaatgcagaagttttgatgtcatagtttgtttcatggttatgtcaagcacaaagtccaacctattatattccacaatatttttgtcatggtcaagaagagagcacactggacagtcttctatttctgccagtgtccatccatttcatagcttgaatataattggaaaagcaaattgatttttgattcatgcacgcagtgcataatcataagtatggctcatgtgaactcataaactgctaaccccgttgtcacattgtggtcagaaataaaggaaatcggttttacctgactctaaggtatctgcagagccaatcctagaaacccatcaattgaatcatttattggctacatcaacataaaacaaggtcaagtccaacagacttcaagtgtactgaggaccaaattcttggtagagttgatgaagtaccaggagaatgaatgtatgacaatattcaagaagaaatacaaaagattattaagcgcatcagtgtttagttggctttagatatatgtgattttatttgcaaatactcgagtttatgatacaaacaaagattcagaatttttgcttacttgttattctcgtccttttagtatgaattttaatgtatattcacgtttgattgtaaattgatttatataatttataagattgtgatccataatatgtgttacttgtttttatgtaatcattgtgcatgaataatttgcgtgccgtcgcaacgcacgggcacttgactagktagacaaaatgcaacggtaatggcagctctaaaattcgtattactatatgttctggccactggcggttccaaggcccgggcagggtgggctgttgcccgggcttggtctccaacaggcccattatatataggtatttatctttttgttactctctatttaatccaacgtctaaaccctagcgctagattataagcgccgccacatctgttcatccaaaaaaaagcagcctttctcatcccctggcgtggagcggtagcagatctgcagaagactgcaggtgcgtagaccatgtggccttcagcccttgcatgccgatgcggcggccagtgaatagattagtataatcttgcattcttgctacatgtctacatccactcatcggtgcaacccaccataaaaaggcactgctggcctgctgttcctgacacttgcatgcccccaccccacccccatgagagagagggggtagtacaatgatcatccattgagcctgcacgaaggcttgaggttcttcagttcttgctgctcatgtggttttcttagtagattaattagtattcttagtagtactaggcaatcatttatctcaccagtaaacagtaaattgttcacaatttttggtgtggtcagggcagccttactgctcctaagtggtatttcaagtcttatcaatttatttatatacaatacagatggttgatcgtcaactatttttttccgttcatttagcagctgctgtg

SEQ ID NO: 3961 - DNA, 694 bp, Zea mays
ccactccagaatttcttggctgctagctatagctcttgcaaagggagcctccgcaataggtgaatccagcatgcatcatgtacaaaagagcgatatagaggttgatttgtttgctaatgcgacaactatgaatctatgttagcaagtaatgtatcccatgagctgtacaacacaagtaacatgcaaaaaatggtacttcgttttcttggatggaatgcatatgccagcgatcaatgtcagcaacgatgtacgtagtgaatactgatataacgctttcctcgtaatctgactttgctgagagcgtgagagacatgtgcaagaaagaaacgaacgaaacaggggcgcccacaggaacaacaggttcccccttttgtggtacacatatatacgcatgtacggtacccagcacgcgatacgcatacgcttgtcatacaagcaagacgtatacaactgtgtacatgatggcacaggagcagtagtatctctaagcaatgttctgcactgtatcatccgtattatatataagtgaataaaaaaactgcagattttattgtggaattccaaaagcagctacagctagcctacatcgccggtctagctcaacaagattggtaccgtatctataagactataagataaattcgcctgatatatctccaagaaaaagcaagcccatcgtcctaccgtattagca

SEQ ID NO: 3962 - DNA, 849 bp, Zea mays
atgatgctatcaaaggtattgaatccgtaagcttattgatcgcatattgcacttcttttctggaatgagagaggaaagggtagagagagcgaggatatgcttaatccgctttgggaggcatatgcatttcagtctgcacgggcttacaaagaggcaggcatttggatagcacagataaccgagacaggaatagttgtcacgagatatgagagggagagtttctagatgagcaagaaggcgttaaatatataatgcaaaaaggaactacctaataagccagctcagctctatggtttttgcaacgtttcaactaaactaattggaaatgcctgctcttcgatgttacaagctagccttgctacgatttccatataggtacagaagattgtgatacccctcccagagtgtatgctccagatgaagctagcttccaagcgaatgaactgtaaaatctctactcttttgccatcttattcttacttaagaagcttctctagatcgacttctctttcttcattaggcaggcaggttcgccgctttgccatgccaggacgaatagagttagcgagcacgtagcattatctatatcaggagctaataaaagtcaagagatcaaatccgtgcactggcattttggaagtagcattggaaagaacttgctttgcatttgtacacagggtgtacacattatatatgaatgaaacatattcattaacttaagcatactcctttttttatttaatgagttgatattaattaaatatctttatttttttcgatttttgcaaaggtttcatttacgcctaatccatatcgagtagaccctgtcgttgtgagaattcttaattc

SEQ ID NO: 3963 - DNA, 276 bp, Zea mays
ttgacgtgattctaaaccatgtcacttaactatagaaattaacagattaataatatgataatttgtgctggtatttttcgaagctggaaatcttatattttgctgaagacgtgaactttcaccgtcatttccccaacaaataatcgaatcagcgatcttctgctccaagcaaggtagcagagccgcacccccgtccagaccttgacgaacggcgagcagcagcagggcgtcgcgtacccttcggaggcggatcgttactcgtaggcggcagcggac

SEQ ID NO: 3964 - DNA, 194 bp, Zea mays
tctttttttttaaaaggtaaaaaacaaacttccaactactatttgatacaaccaataaaaccatagcaatttcagagcatatcataggtctaaaggttggagttaatccagcaaactaactatcacacttataatttcagttcattagtatctattccagttataacgacacttgtatgcggtagggcctctag

SEQ ID NO: 3965 - DNA, 1014 bp, Zea mays
tatcttcggaaatcacgaaaatgtgtccttaaatacgaagcttagaaaatctaagaaactaagtaactattggcaagcaagagctaagaaattaagcaaagaaaagcaggcgtaccaaatgtgcccggggtgagttcttatttatatgcccagcgtgctccaagttggagggccccgtctgtcattggctgttgctattctagcaaagggaaggtgttttttcggaccttcggcttagggccttcgtccatatcacaatctgaattcgttattctaacaaattaaccttgcgaggggctactgttgggggccttcgtcttccgaaggtcctcaaaaacatgatttaacaatgtttctggagtgcaatacatgaacaggtaccttcagacttggatcagaaccatagtatgagaagcacgaagaatacgaaggttgacgcagagccgaagctatgtgcaagggagcttcggcatgatagcggaaaagggaaaaggctatttagacctcgatggatcactatagagtcattagcaaatgtaaaggacatggatgtaattttacatgggctgcgtcccgtgcctataaattgatgaacagtgctcccgtactgttcacgctgacttggcatttgcttttgcgtcacgcttgtacctttaccttctttgaagccgaaggtacatttgtaacttgatatcatttctatttttctatgataataaaatagaaatgagctgataatgatacataattgttcatgttatcttttacatttcatatgattcgcttttcattatcgtatgctgcaatgatgaaggtatgccctttcatgaccttcgtccaaagatcattatatcctaagggaaataatgcctcgaaggacgaagggcattaacatttaatattttttgtgttgccttgttcttaactcatagcatttgagaacaagttcccaacattggcgcccacctccggtgaacccttttcgaccaccttcggcaagcactgaccttcgtc

SEQ ID NO: 3966 - DNA, 735 bp, Zea mays
ttatgtctataatgtttttagattctatatgacttttgttagtttgattatatggtgataaaaaagcttcagaacagtttaactctttactaacacaagacgtaactacactatttaatttgaaattaacaactctaagggctagattgaaagaagggaagatgaaatcaggaaagaaaacctcctattagcaactagaaaatgatagagaatgatagagattttaaggggatttgagttttcttcaaactaaccctaattgtgttttgccattcattcaacggatccagctgtgggctctcacgtgcgtgctggacgatgaagtcacttcctaaaccgccacgtcccacaaaggacgccacacggcaccctaatcctgacggcttacgtaaaccgcgggcccaggcaagaggcaagatccgtagatgtccccgacgagcgagggcattcccggcaagtcgctccacctgcttgttctagcgatctcctccgcctccctggtccctggtccctactcccatttctcctcgactcgtccaagacaaggaaagtaggaaaccgcctgccctgcgtgtgggctgtctgctgtgttgctagcccagtactttctcttctcgctcacgcggcacgccgagcaaggggaccgacaggcggagcgcttctcagcccctccgcaccttcgggtctcgcgttggtggcgccggcgggcgctgccgatcgccggcggcggccgag

SEQ ID NO: 3967 - DNA, 144 bp, Zea mays
ccctgccgctatggcaattaatcccgacttcatgttgaggcccttcagaatagagcaagtcctgagactgaaaatgtgtttaatgatgccttttgggagagcttggatgctgttgttaatgcattggacaatgtcactgcaaga

SEQ ID NO: 3968 - DNA, 634 bp, Zea mays
tttgtatttttttaaaacaatgagtttctataaaatttctgtatgatcttttttaaatttctacgttctaaaggacctaaaagtttgcaccaaawtcaaaaggcaggcacgaaaacggcacagccgcgcgcggacgatcgtcctatactcctatcgaacgaacgtccatctcccagcatttccgtttcccaaaacgcctacgcacggacggtaatcaggaccacaggtcatcaagaattccgtgctcccgtgcaccgttgccgccgcaccgcccggctcggccactcctcggcgcgccacgctgcagggggacgctgacacgcatggcccacatcccggtgactctacactcggctccgctccaccaccgcgctcgccctcttcgtcgttgccgtccgtctccacagtccccacccatattccattttggttatcctcttgcgtcacacctcctccctcctggcctcctcctgcggcccacttatatataccaccacgtcgatgcgctgctccgccggcatctccatcgccgtcgcgccgccgtagatggcctgacatttttcacttcatttgtcatcccaattccacaaacctcgcgcgcggcggcggagggaaacaaaaaaaaaaaggaagg

SEQ ID NO: 3969 - DNA, 1000 bp, Zea mays
tcggatcagctgtagatcagttcagatgcattagaagagcctaagagtaagagtagtagggttgtgggaaacctggtgagcatttcacagcatctgttgcaacagggctatgtgcaaaacaattgcgtttttgtgcaccttctctctcttccttttttagagttttactgccggagcctccggtcttttagcgttaaaccgaaaaaaacgaattaaacctttgacaacattaggaatgacattttggggcagttagagcttactcggttataagtggattgagaatgatgggagaggattaaatccatctatatttaatttttaatataaaaagatttaatcctctcgatccctgctaatccctctcaaaccgaatagggtctaagcgtttgcaaacctcacgccgaaactcagacaaccgaaagaaaaccaaaccaaagagcagcaaaactactactgaagaaccaggaaacgaacgaagggtgcctgcctgcttttggcacccagcttctgaactcaaaagaagaagaagaagaaaaaatcagttgtccccccgccattagctcgacaaaacttcaggtaacagaactggaccatcttggaggagacagaaacaggtcgttagcctcactcttagaatttggacttcgtttccagcctcacagctgttctagggttagcctctcttttttttctcccttttaaagtcagcaagtctatcctctcccgtcaacagaaagtttggtcggagaacacacgtgtccgcaaaatgccacacaggagctcccaagtgctcggcctccggcactgtagcgctagcgcagagcgggaggagctggaaaaaaaaacgtggccttcttctctcgccagttcatcggtttctcggaagcctgtcaaacacggactggcttagtcaaagccggctttcagacatataatcgcgctcgccgtcgtgcgcacggcagtcggcaggcagtaccggagcagcgtgccaggcccc

SEQ ID NO: 3970 - DNA, 750 bp, Zea mays
ttgctagagtaataaaatagaaaaggagattagaggtctaagtttggcttagatgtactgtgctagttgctaaaagtaatttcatagaacattgatgtcggcgtttcgagaccggggggtcccttgggccgacgagtgagtgtcgccgcgtgccccagcccagatgggtcgagcgtgggggcgagcgcgaaggggggaaaagagcgaggcggccggagaccggcgtgagagaggtgggaatcccgcggccttcgtgttcgtcccgcgcccaggtcgggtgcgcttgcagtagggggttacaagcgtccacgcgggagggagggagcggcctcacgcgagcgctgtcccgtccttccccgcgcgaccaaccctctgtaagagggccctggtccttccttttataggcgcaaggagaggatccaggtgtacaatggggggtgtagcagtgtgctaacgtgtctagcggaggagagctagcgccctaagtacatgccatcgtggcagccggagaggttttggcacctagttcgtgtgatgtcgtggccgtcggaggagcgttggagcctggcggaaggacaactgtcggggctatcgagtccttgctgatgtcctcttgcttccataagggggctgagagccgccgtcgtcatagagcgtgcggggcgccatcattacttgtctggcggagcgagccagatgggacgccggtcttgttccccgtagcctgagtcagcttggggtagggtaatg

SEQ ID NO: 3971 - DNA, 417 bp, Zea mays
acgtcgacctgcaggaaccaccgcggtctgtcacaatactggggcctccgagtctttgtacagcattccaagactactggcaggcgaggaaagaccgttggtgtctccaagaagcgatgagctctatatcaccccgacaaatcttggccgcactaccatgtcggtttgtgtccaaacagtcctgatgaagggtttctgtttaggcagtttcctgaaatggtgttttgctctaggacaatatcgcggttattgaaccttaatatatcgtgtccctgggatgtgttttttttttgccactttataagtaatttcatttggatgagacttaattctggtttgactccttacattgttaactcttgactccgagaggagtgccttcccagtgcagttcgttcacattgcctgtggttgagg

SEQ ID NO: 3972 - DNA, 604 bp, Zea mays
ctgcagcatttattatttggtcgctgatgtgatgaacaactcgtctgcctcaggcttccacgtccgagtggatccgagctggtcacgcatgaggcaagcactccctctcgcgtacagtacgcagatcatccacctgtccagccccggcgccagccagcacgaccagaccacgctctccctctcgccggtgccgaacactaggcacggtcaaccagtcccgcccgcccaaccaaactctccagggatacggctctctctccctctcggtctgtctggtctgcatgtccacatctggagctccacggccacggagatgcttgcggttgcggttgcggaagggagctgggctggaggccgcctcgcgttccacacttccgcgaacgtgctgccgcgacgggcgcacgaaagagggacggagaagtgtgccgctcggtccagcccacgcccgctccccccccgcgctataagtagcggcccggtccgccgagtcgagccgtccacagcagagtagagtagcacacgcactcgcctcttgtgtctttctttgtgagctgtggtgtggtggtcgagacacacacagcagcagcaacaacaacatacatac

SEQ ID NO: 3973 - DNA, 1500 bp, Zea mays
tgtccaactgctattcatgctgacatgctgtatcattccatccatagagtcgcggtggacccacaaaggagacgaagtcagaaaaagctgaactaaactgctacagtataaaagcatgttgtacattatattatgtacattttagattagataaggttctaacaaagttctataaaatctaaagcggtaggaggcctcgagcacggtccgtccctgatgagagcgcttcattaaagatggcccatcaccgtgcgatggctaccaatgcgccacggccgaactttcatgttttaacctatttttaatccacgtttctagaaacaatcaaatatatccatagagcagcttcaatagtgtctctatattcctcctaattaatatgaatagagattttgtaaaaaaaatctccaacaacttatctaaatggctatttaaatatagacatcttctatttcgaatttctcgctagccaaatatagaaaatgtgaatgactctctatagtgcaaataagatgtacaaaaattgatggggattaaaaagatataaaaaatgatttttatgcaactaactctttaaatgataatttagaatgtgaaatttagaaaaactcttggagttgctcttatgcattccaatttgtatatctagaaatctaacttcaaactgtgtgtctagataatgcaatcactttttgtttatggagctagtaaatggttgccaaatgaagcaaggaattgaggttagatgagaagtagctaaatttaggaagttcgtatagagaactattggtgagtagtttatagtttaactacctaaactattgatttagggagctttttagagaactattggagttgctcttagtgaccaacaaacggttaagagtggatgaggtacattttttggcacttaattgttgtatatacatacagatatatattgagtggaacatgaattcttgcaaacgtatatttcttattagataatggatagaggatctggtttagtcataataaaaggagaattagactaacttttgcaccttagtcataaagttaaatttaaattccaatcccaaatctcgaatgccatatgcaaaacctgcaaaaagtttgcatacattccatgaatgtccagtctacctcgaggtttgtgcacttctgaatattcatgttaacttatctactcatactctgccttcaccgtaaaaggagatgttgaacaaagagttgagatttcatctgtgcatatgtgcacggagtgtatcttattcttatgtataggatatgtttttctactcagaacacctatttgcatggttcggtctttgcctgttagaactggtggtcaagggaggaaactaaaaaaaattgacgaactgatgcccggaatctccccagccttgcatggtcatgggcctcacggccaatgcgtgcagctacgactatttgctgcaccgtgacatttgcttcgtctctccccacggaggccggccagac

SEQ ID NO: 3974 - DNA, 91 bp, Zea mays
actgagtccaaatccaaatccagttaccccactcaacctcttttgatttgatttcgcaggatccatccgagaacaaacagccacttctccg

SEQ ID NO: 3975 - DNA, 166 bp, Zea mays
ggtaaaagtaattgatttagttcaatcagatgatttttatgtaatatgacccgttttctgatcatcattacaatttttagtaagttgctgagaaggcaacattttttggactcactgttctaacttttgtatgattcaggagaaaagcttcagagccgataaactg

SEQ ID NO: 3976 - DNA, 186 bp, Zea mays
cctccccctccccctacccgctgtggcaatccagagccgcctgacgagctgcactgctcgcctgcgacggctggaggaggaagcggcggcggcggcccttccgcggtcacgctcgacatcctcctgtccgaataagacggcgaccagtcggcagctgtcctcccggtcttcttcctgctctcggtg

SEQ ID NO: 3977 - DNA, 71 bp, Zea mays
cgtcctcattccctttctcaacaattccgcatggactgcagatcgacgcgtgcttggacggctcctcgtcc

SEQ ID NO: 3978 - DNA, 105 bp, Zea mays
cacagaatctggatgcctccttccaagtatgccctctgatgcatctttcgacagcacttctgggattagcttcacatgcgatctgaatgacaacatcgcagcccc

SEQ ID NO: 3979 - DNA, 153 bp, Zea mays
ccaaaggtgattcgaacttctttgctcccctctcccaaaaaagtggagcatttgcaccgtaatcaatgttgatcgaacaatgtctccatagcattttcgtggtttcaacagctttatccacttgtgctcaatagaaagcacatagatgttggg

SEQ ID NO: 3980 - DNA, 141 bp, Zea mays
agtgggaggggccgagggtgaactatatatcagcccgcgtggggccgatgaggtgctggtcacattgaccgacggagggtggtttggttctgccgcgctgccaatgcccggttacaatgccgctcctctgaaggagcctgc

SEQ ID NO: 3981 - DNA, 1500 bp, Zea mays
tattttcatatttcaaacttcaaaacttgtttatttcataccttttcatatgaactccaaatttagtgattcaaattgcaaaatgtttataggattattcactgttcaaataaattatgttcattcatagtctgtacactctaattttatacctagactataggttagtgtatgtgttgaattgttcactttataaaatagataaaaaagaaaaccctagtggttaaagaatagttaatcttgtgagattaataatgtgtattacatggatttatctctggttcaacttttatgtctcattaaaataagtagagttagattatgtaatcatggacaacctttaaaggacaatcaactactaaatgagatttgttactttataaattaaacttcttttgagtttatacttttccttttccttttgagaagtgttccattggttgtacatgattgatgtactgtttatttgtcatttaccaaatgtattgaatgcatgatcgctttatttagacaatgagtagcctgtggttcctgagtgtgttgctaaagatcttcctgagcaacaacctggtgaaggaaagtgtcctctgacctattatatcctacatactttataattcaccgtcccacattacattattgaaacctaaggattgactagtctgtatttaccttatccttgtttaccttttgggtttatcatggttagctttatgctattgctttaacttaatcaatgaacattgttgggggccttcggcttccgaaggtcctcaaaaacatagtttgataatgttttccaagtaaaatatgtgaacaggtatcttcggattcggatcatgagcatacaaagcatggtcaggacgaaacctgagtgagacgaaaggtgattacgacgaaggacaaggtaatcacgaagttgtgcgcaggaaagcttcggcatggcagcagaaaaggggaaccgacttaaagatgaaaaggcaaattagacctcgaagaattactatagagttattaacaaatgtaaagggcatgggtgtaatttttcatgggctgcgtcctgtgcttataaataggtgaacagtatccccgtactgttcacgctgacttggcattcactttttgcatcactcctgtaccctcacttttcgtcaaaccgaaggtacatctataatttgttattatggatatggtaatgaaaataaaaataagttgatgataatgtttatattatttttcgtatttcgtatatgaattcttcctcataatttattgtgcttacgaaggtttttccttcacaaccttcgtccggaattcattatatccgaagggaaatagtgtcttgaaggacgaaggactttaacatttagcacttttcatgttgccttgttcttaactcttagcatttgagaacaagtccccaacattggcgcccacctccggtgaactcacttccactttttgagtttcgaacactttcggcaagcatagaccttcgtc

SEQ ID NO: 3982 - DNA, 1088 bp, Zea mays
gacatgcatgtcgagtgagacttgtgcgccaagacttgtatcgaacgtttggaattttgttggtcgcgcaagaaactaaggtttttttcccgttttcagatgagaatttttaatcaaagaggggacaaatggcgtagcgtggccattaagccaaagccggcctgcctgtctgcctgcgcaagcgtttcaagtcagaaacaaaattacgacccacgaattaaactattatgacgcgttaaaaaaaagacattagaatttccttggtaaacctgcaacgagagaaggggaaaagtactgagagaaaaaacatcattcaggagcaagagttttacagaaatctgtcggaaagaggcaaacaaaacaagaagaggaggcaacgcaagcaacagccaaaacaggcggcggcggcgagcgagggagcagcgttgcaaaccaccagctccccctctggagtctcgtctcgcttccactccactgcgctgtgctcttccactccactgcctcctccctccctcgctcacacagcttccaacgattccattcccagctccctccctcctctccccaactttttcctccgtcccccgttcctcccctcccaacccatttcaaatcgcaccaaaacccccccgaggacctgcagcgaggcctcccctctccgcgctcgccctagcctagccaggcatcagccccccgcctagatcccccattcctcggccccatcgctctctcgctcgcccgccggcggcggccagattccggatccgccgggaagtctcgtacggagacgggaggcgctgcccgtgcctgcctgatcgctcgctgagacttggcggcgggtcctggcatgggattgcggcgccggggcatttccccgaccaggcggcgggcggcggcctaagatgcgagggcggctggcccggggtgtggggcaccagctcggggaccgcttctcgccgtgcgccggcgtccgcctgctcatgctgccggccgcccggggccctcggcgacgggcattggggcgcgctcttcccgcggggtgctgagacgctgacgcgccgcgccgcgccaccagcctcccgccggcc

SEQ ID NO: 3983 - DNA, 70 bp, Zea mays
tcgccgaaacgactcctcacgaactagtccgtttccgtgcgccgctgctgacgagggagtgggagggatc

SEQ ID NO: 3984 - DNA, 331 bp, Zea mays
cggggcctcaaaagaccccaaccactaattgacaaagtccgccacgcgtccccggatcctctgcgccagggaggcaggtggtagggcaaggacataccatggcccactagcagcatgctacgccgcagaggatcccacagctgccacgacgcccagccgcctaggccacaccacgcgcaccttcaaatacgggagagtgtccgttccttccagctcgtcgctcctcccttctcgtgtcccgtcgtccccttctcccatcagcgggagggcggcggcgtcagccggcaaaaaagcaaagcgtcacgagaagctcgttccttgacaggcagcc

SEQ ID NO: 3985 - DNA, 422 bp, Zea mays
caactcttctatgatataagctgtacatttaatatttagctcactctttttatcacaaactatcatggagttcatgagtaacctactttagctgactgatgatgcagtgtgctttcattattttctttctctcacgtaaccacaaatttgatgtgacatctcttgcaatccacctacgtcatattattataattgctctaatattaaacacatacacgccaccatcaataatctatatatgcaataaaccatatatatgttgttgaaacaaaaaaaagggaaaggagtgcaagaatggcgtggacttaagaaaagcaccagtggcatcgagcgcatcgcgcactcgtgctcgggctcggctccgtccgcgactccgccccacccctttccgtcagcggccgcaaccaccacaccaccaccca

SEQ ID NO: 3986 - DNA, 96 bp, Zea mays
cataagtctatctaactaaagttgaagttttgctatgcgatgaactgttcttcatttggagcttaacattctgtttgcctacctggtccagcttac

SEQ ID NO: 3987 - DNA, 368 bp, Zea mays
tgtaagttctatttttatttggccttaacagtactgttatagtgttaggaactcatatcctcctaataaccttttctacgtatcagctgtgagtacatgagtgatcttcttcctcttgcacgtgccatcaacatcatgtcaagcgagatcatttgccacgatattactgaaagtagagttaaaatcgcacagccacacgagcagtctgaccaccaccccttcccggccggaccgtgtgtcagtgtggagatggccactcactcaccgatctcgcttccacctccacgccagaggcaacgggctccccgccgtgagctcttcggccacgcgggcgtcttgcctccctcgtccttcctcaccgcaggagg

SEQ ID NO: 3988 - DNA, 383 bp, Zea mays
agctatacagcgctatataacaaacttgcacaataatatgctacatttctgaaagcaaactccgcttatcttcgcgttaaggaatggtattacacttaaaatgacaaaatatcacactttagaaccccacgcctttacctaaaaaaaagttgattgatacaagaacaaatgtttacagcttgttacacctcccatcaagcaaagaaatggaatcttttattttatgtacacgtgtacgggtagctattgtttataaattgcagaagacacctcaacatgatggataattgtatacgcaaaactactttcctcgaattccccattctataaattccagttaaacttaattcgtaagatcaatcataattctcgagttgcaaacc

SEQ ID NO: 3989 - DNA, 1223 bp, Zea mays
agggatagtgtgttggtagatgcaatcccgtttcatgcctaatttgtggtagaattgacaattcattgcatgaatcatcgtttgctattgtggtcttgttcatacaagtttctcttgcatcagacaaaaatcaaggataattctatatccttgataataggtgctaagaatatagacaagtctaggacatgcagattgtactcctttttgacatatggacagtgcacactagatgacaatcactatttacacttgcacgttttctctgttttttacatgtttctttatttgtcaatacataatgggaatctatagataattgttggacatatttgaattgttttttctactctatgcatttttaaatttgatggaagtccttgagctgcttgaatcatgagcaatggattagatactgacttattagttattcaccctttttcgtccgctgcagccattggaagtccaacaagcgaaatccttgaaactaattcctagattttgagttaaatttcgacaaatcttagcaacatgcaagtatccttttattttctaggtggattgtgggtgtgaattgcctgcattttcttgttgattttctaatcaacaagctctatgttatgtcgtgttagtttatttattcgtgctcaggatcttgaaagagtatgttttgaattgctattgcgtttatatcaaaatctttttgaagtcatatattcgtctaatacgtcgaggcccatttgttattagatgcatacattttccataacatataagggatatgtgggcttcaccggggtaatggatcatatatgtatgttgcaattcagcaagatacttcttttagcaatgttgaagagactgtcaaattgaaaccacttttaagtttccatttttactatccataatctggcctttgactcttgacagcagtaggatgttctatgttgcatccaatgattccaatctgctagtcttttttcaggagtaatagttttatccccctcgaatacgcagaagtgctgcttgctgctacttactaccatctgtaccatgaataacttccaataggtttttagctttgtgtcaggaattctaaaatcttaccggaagttcactgcccttgcccaaaaacacaaatgcacacccttaccaaatacagcacctgaacttcttcgctctacacaaaatattttattctgtccaaattcaatagttgtgat

SEQ ID NO: 3990 - DNA, 1081 bp, Zea mays
atctaatgtttccgtttgaatggcaattacgagtatttaatacagtttaattataaaaataattataatagatgaatcctagagatgagatgagttcaaatcctcgacctagccataggtgttcggcgatgttagactgttattatggtgcgtttggttgtaatgacagaacggaatgagacgagacgatctctcaaataatgttgtttagttcagggttaagggttgagacataactattctagtgttgtccttaatctctactactattatgtaagtagtgtaggcgtccacacgtcccctcggcgcacggttctgcctctgcccgcgacaccttgtcccgcttccgtcaatcacgcgccttgcacaaccgccccatccgcagccctcccacccccgtgacctcgtccgcccagatctggatcccgcccccctcatcggcgcctcctcccccgcgcgtccgagacctagatccgccgcttccccgtcaagctccccagtctccccctccctgctcggtccgtatggcggcttgacggcgaatcggatcttcctcggcctcctctccctgcgcccctctggtcgccatggagctcgcctataggttttctcaaactcctcgccgccggttttctcaaattgtcaatttgagaaaacctctacacccggatccgccgcttcctcgaactcctcgccgccggctctcctcagctccgccgactcgcttcgctgtcctcctcgccccaggccccagcctcctcctgatcccagattcgcctcgccggccccaggcgcccgccacgagcgccgtcaagcgaagccgttcttccctggtgcgtgccgctggcgtagctgccaggctccttccgccggagcacgtcgcggccagctggtcccttgctcgtcctccaccgtcgtcgcggcggacttcgtccccctcccgaaagcacagatccgcacggtctcggctgcatttctccacttgctggtaaggaagctcgctccgatggattactccgagggttagttccgccctggtcttccgtttctacgctgccagcaatcaagttccaagtcgtcg

SEQ ID NO: 3991 - DNA, 1500 bp, Zea mays
tgatctcctcttcatattttcttatccgcaggtaccagccaaaaaaaagacaccagcgaccccttttgacggcaggattgcgagggcgcgcgcgcgcgcgtcgtcgtagacgaggcgtgtcagcgcgacaagacagaaactgatcgagctctgccctctctgctggctgcgtataattcagtaattaactctggtatattaatgccatttacggttgacagcgaacaaagtatattattagctacataaggacatgccagcaggattaattttagctaggtcccaaaagcagccggattaattttagctacgtcccaaaagcagccgaaaacgacgtgcaggctcycatcagattatgcaatgtctccgtctcctgcacgattttttttcagccccgttggatccaaccacccaacgccccggccccttctcataagaaaaaaaatgaagcttgccatttcgctcagggccctgcagcggcggcagctggcgggagagaggcttgggactgggccgcccrgccgcgaggaataaactcactcctgtcttcatacgtatccatagccggcaggcggcagtacctgtatgtggttttagctatacgcgacctcagttcgggcgcaaggttagtcttcgatttaagcatagattttattttatcttcttggctccaccaaataacactaacaaaatcgctttggcttctatgggttcaaattaagcactggatcgtaccattttcttgttcatttatactttgtcatccaatccacaccgattaatttctcacggtcaacaacgcatgaagttttcatttctgggaagaagcatgtattttttttatctccgactcgatctagtggtgagaggaggaagatgaatagtgcatgcatatgatatctagagaggcaccagatctagtggctccatgttctgttcgcgggctaagaaaaaacataaacaagccaggcgcctgaaaaatagctagtccctaactttttagaccaatctgtatgtttattttgacgatattggtatgaaaaagtctctcaagaacaatatacatatgcagcatgcatgtgcatggtataattataaattattagcagagtttagataagtaggcccccacgtctgcgctccgccacctacagcgagcctccctttcctccctccctgattcgtttgcacttgctgagagctcaacagaatttggtcaccgatttcaattcgcagctactaattctcaccacattgaaattttcgatttgaaacagtacaatttctgaagagaaattgtacgtctgaaacggttgcatgtgtactatgaactgctagccattccctgcatacgtgggacacgctcagatcattcattcgcagcacgtacgtaaccttaatattctactatacatccatgcagctacaaccccgaccaggcgagaagaagcatcgatagtgtgacgagctaacccaccaccagcaacgtaatccaaatcc

SEQ ID NO: 3992 - DNA, 493 bp, Zea mays
cctgcagatcttccggtggattctgcggcatcgcagttaacaacgccggcgccaccaaggcgagcagagcaggagggcctggcatggcacgcgggtattgccagccaacagacaaaaaccccggtactgcatcatgcgccttcttgttgcccctagcgctgctcgtacggccaaaatgcgctggcggtctgcttcgaatctgcgatgcactgcacaacaaggggggaggaacgagaagaggttcctggaaaaactagccgtggtttctcgcgcatccacccggacccgggtgacctgacccctgcccgtattctcccgccctctgccggccccttttattataaaagcacacgacaagaccgcctcctctggccatcgctggcgacgaagcttcagacttgttcggttcaccagtgcttcagcaatcagtgtagtagtactggcactggcagtgccctaaggtctccagtctcctcggtctcatctcatctcc

SEQ ID NO: 3993 - DNA, 675 bp, Zea mays
ccaaagttgtgcttgttgcaagcttcaaattctcatcatgtttgtcgcttagagtaccatataagctagcatgcatctaggatagcaacaatacatttttggagatcacgatgtccacgtcgtcctcttttcctccatccatctaattgcaatccagtggctaagaagcctttcccgtatctttagccgcgaagcgtccgtccggcatcgaaagcttccagatccctctcccagtctctctcctataatcctatggcttggtggccgtctctccccaaccactcggcttctcgccccctgccctccattgctcccgaccccaatagcgccgctctgacctgcttttgcgtcgccgccgccgtcaaatcgcttccgctcttccacgccatctccaccgacaaggctgtctggtgagcgcgccgccctgctcgctggagccaaccaccaccatgcatgcccattgcgtgggcagaaggcgcagcacaagggcctactgcttggtggagaggagggcaaagtcgcgaccttttcattgagtagaagcatcggcgctgtgctgttccgccgtgccctcctcctccaaagtcggcctcccctcacgcttcttcagcggcgcctaccgagaggcgagagaggaagttcgctccgatctggaaaagttcttcgcaggccata

SEQ ID NO: 3994 - DNA, 1500 bp, Zea mays
atggccggtgattcgaagttccgtctgacgcgaaacgtatctcggccggatctctgcacacttctcgcggcctcactttcttagtatattctcccagcgccacggcgcgcgctgggagctcgtgagcagagagtggttgacagacagaaccgtaagaatattttatctccgccacgccgtccagcacaggcatcatctactagcactgtagcagtggagcgtgatctatcccggccgtggactggatcaaacccctggcgatgccgacgagcatgttccagctcgctgccggcttaccccctacccttcacgtggccgcaggtcctggttccaggttccgctcgatcgctaacctccccaaccgcggcgattcaatgcacctcgccccgccgcctctcggcaggttagcggcgcccgcgcgcaacgtaaccgccggtccctccgccgaagccggccatgcgctacgacgtgacgccgggcgtcgcgatccgtgcgtcccctggaggggaaatcgggcctcgtgtttcccgaaccaaccaagccgttggcccgccggacgcgtgcccgggcggtgccccctccccccctcgcctccgcctccccgcgttccgttcgattcgatgtgatcggaggagcagggcgccccgtggaattccgtgcccaaagcggatcgacaaaggctggggcgggtaaaaagtcgtggataatggaggccaccaacacacatgttcgagcaggccagagccagacagcggcgcggcaggcggccgggccgccgcccacgcagatttcgcgttcaattcggcgacttggttcgttgagctgcaagaaagacgttgcgttcgtttccggcactctctcctggcctcgaagctctcaccacattcggcgcttgcgtccgatcgattcctcgcgctgacaacaactcgtaacggattcgagaaatatatgggacaatcaatcagcaagcgtatcacgggctttgcaagcgccaaaaacccacgaccgagctgtagggaaatttgcatcggtcgggagacgacggcgtgctcgagagagcggagtcgacacgggcagggcatcatcgtcgcccgctccgacgtggcattacgggccgcccccaccttgccgggcggttgttcacccccggacgcgacaccgggtcccaccgctgccccgccgtggagcgacaggcccgacgtcacccaatatccttctttcccccgtcccacactcccactgcgccgtcgccgcgacccagcccgcccctgcccctggctcgccgagctacgacgagctcgcctcccacactataaataccccacccatgcccaagccattccgacccaggcaagaggcaacacagcaagcagcagaaaacatctccgggagtccgaaccacccacagcgcggcaggccacaccacaggttccgcttccgcacagctgctagctagctagcgttcgcaagtagcagtagcgttccatcgaggtcgaggca

SEQ ID NO: 3995 - DNA, 1500 bp, Zea mays
cgcgacaggtgtgcgagcaggagcgacacctgcctcattttttattggagcacgcagtttatctatccctgcttgcttaaccattgacgtacccaaagaaaacgtgttggcacgggggattttgagtggatctttttaaaggcaaactaggaatgacaagtagaagagggtcctagtagctaggaggagggcttcagagagcaggagcatgtgggatatccatccaaagaaaaatcagtgtggacttgttcagttatttctattatatatgaattggatgatattaaaaaaaattaaaagaactttaatttgtttgggatttaattccacacaatctaattaatctatatggattgagagctaactataccagcaccgaacattttgattgatggggtaacccgacgccggcaagtctcgcggccgctcgcgcgtttgttctatctgcggaaaaagaatagcaaggacacatttattaattttccccgcacggctccacgccgcacgcgtacccgtccaagcggaagcggccacgtgctcacgcacgcggatggtgcgaatgtgcgatacgatccatataaacctctatactacgctgctgcctgctggcacccgcacttggattccgcaccgggcgagcgatccgaggatctggccaacctcgacggtgatcttgcttgcagttgcagccctcgacggaacagttcacagccacagcctcaccacagccaccacaccacccggaccacagagcgagacagtgaccgacacgcagttaccttgctagcttgcctgcccaccaggcggccgcgcgtccacgccacgccgcgggacgagaagctaaccagcgaacgagcctgtcgcgttcgcgccacggcggcagcaacacgttgttggccgggccgcaaagaaaccccggggcggggcccccatggtcctgctcgcggagcgatcgatttgagctgggtgccgtcgttttccacccaccgcacgtcaccacgtccacgtaccccagtccgcacagctccggccggtgactgactgacccgcacgacgagaagcatgggtgcccgcacgcaccgccgctctccgcgcgacacctgctcccacgccaggctgcctctccacgcccgccccagagccgtgccactgctgccaacacgtttgaaaggcaccgacgcatacagttcggccgtgcgcctgccaacagcgcctgcctagcggctacccctgcccgccgaaatgacgcggacgcccccgtaaaaaggacgcgccaaagggccgcactccattggccgtttatatctgtggcgccggccgcgggacgcgtagccagacgcagaccccctgcctgttgccctgtcgcagtctagcatcaggcatccatcggcgagagcgagagcgagagcgttcgcagcaagcctacctcaccttgcctgcctgtctgcctgtctgtctgtctccagagctgcgcttgtccggagacggagccgactgaac

SEQ ID NO: 3996 - DNA, 270 bp, Zea mays
cattccactctccaacgcgcaccgggcggtttttcgttcctttctttttttttcccctcttccccttccccttctccttccagcggcgctcaggccaccgccggccaatcccatcacccgccggatagggatcgacccgttcgttgattggcgcgcgcctgcgatcgatcgattggattgcagggttagggcggccgccgtcgagatagatcgatccatccatcgatcgaattggttttgttggtggatcggagatattcattcgggtcc

SEQ ID NO: 3997 - DNA, 725 bp, Zea mays
ctgcagctgaagaggcaggactgctccaatgcctagccacaggatctgtacatcaccgagtctatatgcatgctgatgatgtagacctattcttgcgaccagctgccgaaaatatagcaaccatagtggatattcttcacctattcggcgtggcttccgggctgcataataatgtccaaaagtctaatgtatatcccattcgttttgacgagagtgacattgcagttgtgcaaggtttgctgccgtgtggaatttcgtccttcccttgtcaatgtcttggacttccattaacgttgtggaagataaccaaggaacaggcgcaaccaattattgacaagtttgcaaatcagcttcctggatggaaggcagacttgatgacaagggctgggcgaacagttcaactgcggtttgcgctcactgggatgcttatgtatttagcaatggcaattgatctcccagcttatatcataaaagcaatcgatgaaatcagaagagactttctttggagagatcgcaaagagataaatggggggggggggcattgcctaggctcttggagcaaagtaagacgacctgttgatgtgggcggtcttcgtatatgaagcgttaaagagctgagttgggcgcttctgatgcactagttatggctgcaaaaaacggagcctaaccgaccttggtcatccttgactatccgagttccggacaaggtccaggccttcttcagt

SEQ ID NO: 3998 - DNA, 1500 bp, Zea mays
gagataggaaattgagtttgatttgcaaaaacaaaccaagtggtggcaaagaatgatccatatatgtcaaatttgaatcaaaacaattttgagttattatttgaagtgattttgcactcgttctacttgctttatgttgtgtttggcataaatcaccaaaaaaagggggagattgaaagggaaatgtgcccttgggccatttctaagtattttggtgatttagtgtccaacacaagtgcctaagtgttgaatggtggacaaagtacaaaccaagtataaaggtatgtttctcagacttagtacattgtttcagagactaatgtattgtgtctaagtgctggaaacaggaaaaatcaagttgaaattaaagatggctttgttcagccaaagtcagctctgtctgggtgcaccggactgtccggtggtgcaccggacagtgtccagtgcgccaggctggctcaggcgaacttgctgctctcgggaagtgattaacggcgtacgactataattcatcggactgtccggtgtgcaccggactgtccggtgagccaactgtcggccgggccaacggttggccgcgcgatccgcgcgagacacgtggccgagccaacggtcggaaaggggggcaccggactgtccggtgtgcaccggatagtgtccggtgcaccaacggctccaaagcgccaacggtcggcttcgccaaataaggaaggagatccgcaccggacagtgtccggtggtgcaccggacagtgtccggtggtgcaccggactgtccggtgcaccaggcgacagaaggcaagaattgccttcctagaatgcactcaacggctcctagctgccttggggctataaaagggacccctaggtgcatggaggaggacaccaaagcattctctaagcattcctaagcaccaagacttcgattccgcgcatttgattctttgcgatagcaattagagctccatttgagttgtgaactcgctgagttgtgttgtgagctcttgttgcgacttgtgtgcgtgttggtactctgatttcgtgtcttgtgtgcgttgttcatccctcccttactccgtgcttctttgtgatcatcaaagtgtaagggcgagaggctccaagttgtggagatttctcgtgagcgggatatagtaaagtaaaagcaaaacaccgtggtattcaagtgggtctttggaccacttgagaggggttgattgcaaccctcgtccgttgggacgccacaacgtggagtaggcaagcgttggtcttggccgaaccacgggataaaccactgtgtcaactttgtgattgatctcttgtggtattgtgttttgttgagactcctttctagccacttggcatttattgtgctaacacttaacaagtttttgtggctataagtttaagttatacaggatcacctattcaccccccccctctaggtgctctcaattggtatcggagccgttctcttcaagaaagggactaactgcccgaagag

SEQ ID NO: 3999 - DNA, 1500 bp, Zea mays
gggcgcgcggcacatcgcacatgggggaggaagcgcccacgccgaggggacccaaaccgcgatgcaactagacaagatgggaggcacgggtcgaaagcctcagagtgtggtggtaaaacagcgtgtcgacactggtgcgtggccgtacgcctgcactgcatgcgccaccatctccagttctccacagcgtcctagagtcacactccgtgctttcttcgttccatacttccattccattatagaatctggatctgggtggattcacaagcggcgggagcatataccgttggtccgtgtgtcgcgtttacaacggactccaatgtgaccgatagactggctgacctcagatggtacagccgtacaaccaggatgggtttggatatttattaggatgtttttttttgttttttctttctttgattaatacataagatataaaatctgctatacaaatctatattcttatttttaatattaagcttgttaagatgcataaaaaataaaccttacatttgtcttatatatcttctcgagtgaactcgatacaaaattcggatacggatattttttcaccttttcattgcagataggaaatgatgcacacagaaatatgtactatataatgcgcttaacaacataactaaatattagtgccaaatactatatatttatatatattaaatttattgtataaatgtttagaatccatcccagcccgtcgtccctcttctactttcttttgattttgaggtagaggtagcttttatagcccaatcaattttttatcgggtgcggcagttgatcgaaagcgctcactagaataggggtgtaggtccatataatcaaatgggtcactatacatgcaaaaaagatgttatttaaatgccttgcaattgatttggaaccaacggggtactcctactttgtttatwaaaagtactggagtagtttatctctagtgaatttttttatctatggagaccataataatgtgcaccaacaagcaagggcaccacccctcgtcacgtggcaaaggccaagctctccaatctccatcatagcagagacagaaaacggatgccactgggacttggcggtgtactcgtactccgtatgaaacaaacagctagccatgcagaaaagctaaaacgctgctgtttttctctacggctcttgcccttgtccacattattactataaaccaagccagaggctggcagccaccacccctaacaccctactcgtgcattcccattgtcccttccccggcccgccatttctgcaggggaggaggggctgcctctgagcgctcagcgcatcggggactggggcttctcgaagccttaaaagcgatcccagagagagaggaggaggtaccaccaccaccaccactcgagcgagctcggccatttcgttctgcaccaggacagcgggagtgtcggtaggcgttcgctgcctgcttgtgccgccgtttctctgctagctcttcacgtgcgcgcc

SEQ ID NO: 4000 - DNA, 196 bp, Zea mays
ccctcctcctcgtccccccctcctgcggcgcacttatatatataccaccacgtcgatgcgccactcagctggcatcgccatcgacggcgtgccgccatagacggcctgacacccccccgctcccgcccccgccctattcatcccttcatcatcccaatttccacaaacctcgcgcgcggcggagggagaaggaagg

SEQ ID NO: 4001 - DNA, 1002 bp, Zea mays
tgcatctaataattcctatatgtgagtgaagataaactgtagtacttttgtcttctaatacacatgcatctggaaattattactctcatacagtttttttttcttttctagatgggatttgcacctaataatttctatatgtggggtaaccaagtatttatgtggattcgttaggaacgtggcttgaaaaattttgagtgaacaaaatatttttcttggagttggttttcatacattcgaaaagataaaaaataaaaggcctatatgttgagtcctaatcctaacacaggaatatgggaatagttttttttcttcacgtgcttttgtctaaaatcaaactggtgatttttccaaagtatatctttcactccgtttctcagaaacctctggcaacaaaagccccaagcctcctttcccttcatcgtcggaacagataaggaaaaagaagttggcacagggtaacggcggtagctgctcagcgccccgcctcagcgcagctcaggctcagctcagctcagctctgcatgagtccaaagccgcggccagcacgcagcacagccgcgggcgggcccagccagcgcacgccgcacggtgagcgcgcgcgggcgcgcgcgcacacacacacacacggacgacgggaccccacccgagcaaaacgcaggcgggcgagcgagcgtgcgtacgcgcagtcgcgtctcacctcgctcgcagacgcacgttttgcaaatctgccccggcggcgacggcgaccctccctcccactcgctttccccgctccctcctggcctgcccataaatagccccccgccgaggacacgggacacagcccgtccccgtcgtgcttcaattcgccactctcctggcccctgctgccgtcgccggcttctacagctactagcagctcggaggaccgggagcagctcccaacacccgcggagccagccagccgcttgcgcttggacccccgatcgatcgtctcgtcgccgcctgcccgggcggccg

SEQ ID NO: 4002 - DNA, 133 bp, Zea mays
actagaatgcagaaatcaaagcttattaggggcctggttacatgcaggcaggattagagctagagcatcgtattttctttttctttatttttctcctgccatcttgttccccccattttccggtgacgagaaa

SEQ ID NO: 4003 - DNA, 1002 bp, Zea mays; identical to SEQ ID NO: 4001

SEQ ID NO: 4004 - DNA, 505 bp, Zea mays
ttcgaacccctgattagtaggagggctcggggcccgcttccttcgcggagaaggatccctttcgaaatatcccctttcccggtccctgtagcaagagagagaaaggggaagaagaaaaggatacaaatttaaacgatgtggcacacctttttttgacgcggtcatcatggcggaggtgaaacgtcgcccgctttgcctgccaaaggtgtcgcttgccctgccgcgaagttaatgcgatgggacaggtggttcgtggggcagccgtttcgcgtgcgcgagtcgttcgaggaacgggcgtttcgccttcgagtttgaatttcgcagtgggttcgggcgaagtgttgaacgggtcttgctcgggcctttatatacccggaagagggaccggtggtggttctttactctgctgctcgcctcctgctttggtttccgcaacctaagggaatagccagagaaagaaaaccgcgcaccttgtccgctccgccaccacccccttcgtttggcg

SEQ ID NO: 4005 - DNA, 1500 bp, Zea mays
tgattaaatcttttaattagacgatataatgaaaaaaccaattaaaaacgtgtctcgatatgcgtgcacgagtaaagagctggctgagcggagcctggccgcgcgcgtgcggccgcgcgatgcgtttctgccgggcctggctcgcggcgctttaagttccgtgctagcctgtctcgtacgatacaacgaaccaaacaaacactactttttgcatgtgtagatgcagctgcaccaccggagaaggcaaccaaacgccccctacgtgactcttgcccgtatccgcgcatgcatgcaaaaagctaccgcaaatacgtgagttgcatctgcgcatgcatgtctaaccgagtacatacaggtaaccaaacatgctctcagagctagtcgacgcatgcagagagtcatgctagggaggtacatccaaccaatcatgcagtttgtgtttctatattgatctctctttataagttgggttatattttcctcgaaagtgaccttgtctgtttttgcattaagtgtgtttcttttgatatgggtcgtgtgtttccttgaagcgaccagcagattgatcgtgtttgtgctgcaaagttaaggatgcttttgtttccttgaaattaatcatgaggattcatgtttctgtccacctgtttatatcataagttttctgctcctgatgacatcccggtctgagtccacgaagaagaattcaagagagagtcataattcatttgcattgcagaattccagagcaggccgatgtgttttgtaactgaacttgcaggtgcttaggagtttggacctgggacctccatctcagcatcggtggagtggagctgaattctgggaagcctcctcaccagcgaagaaggttactgggaaggggtcctcagaggtgtggaagcaggaaattgtcgcctgcagctgcatataagttggaggctggaagtgtgtcatcggcgaaattgtaccatgtcactgaaatctcatctttcaaaacgaaagccgtcgtgtgctggtggttgtagtttgcagcagcagaatggatgtcttgaaaactttgctgtgagggcggctagctccttttgaaatgatgtttttttttctctctttcttttttctttttcttttttaggctgtgtacatattatgatgtagaagccaaaagtaatcatagtttaattgtatcatcttgatgtaattgtctaagattaataaagcttccattatctaaaatgcatctattagtgataataatgaggacaagctaagggcggctatttgccaacaaccccactaatggtggatattgatcaatagtgtatagctgcaatcatgggagccgcaagccgcctggtgacatacgtgcctttgggctttggcctacgatcttgcaatataaaagctactgagctgaggccccgcttcactcaacactcaagcagtcaagtagaacctccagctccccagcccccaggtggtcaagactcaagagacagagagagc

SEQ ID NO: 4006 - DNA, 1500 bp, Zea mays
ttggacagattcagagatactaactcaaacagctgtaacttaatttatagatcaccaaaaagggtgatccaaaatttgttggaaagcttaagaaaagtactacaattctcctataattactaagagctaattctcagtttaacttggacaaacaaggtcattttcgaaatcagtacagaatctggacagattctgaaactggacttaaaaaaatcataactcctaaactactgaacctatggtcatgaaagttttacacaagcaagataaaaagattatctacaagttttatatataacatttctacagaaaacacggtttactttacttaactagccacgtaataaaattggacatgcaatccaaacagcaagaactctaacttagatcttatttaacttctacacttatcatgcttttaacatttagaacactcaacactttatctttagtagaactaaaaccacataatacaacaaggcattcatgtcaccatacattagaaattcacccaaccacyaataaatcttrtcggcaaagcgctataagtactaaacgttgtttttacattattaacttratcactcaattcatatacaataaccaaatcatttatacttgagaaatatctttaccaaaatactctaggcataatccacctacaagcaccatgcatatctctaattagtttcataatacaagacatacatactcatgaaaataatttcattcacacaacacaaatcaatttaatagcacaagccttatatatccacacaactaatcattcatccgactaacgaaaacaatggatcgacttaccacgactaaactcgactcgactccgcaagatcgacaaccacatccggttgaggtgattcaccaagcacttggcaagcgcctcgctaaagctttcttctcatctaaatctctacctccaccacaaacacacaaacatacacataattagtatctagtaaatcgacgtcgggtacaggtactaatgaggaataaacacaaggagacagcgggtcctcaccgggctgaacgatgatgcaaggaaactacgccgtgaggagaggctcgctggtttcccataaccacgagcaggtgacgcgcgcggtcgacgaccagaccacgtggaggaactgcagtaggggatcgacggcgttcatggcgaggggaaaggagctgcttgctgctgggcggggagagcgagctcggctagggctgcagacagccatgggagcagccgtgagggagatgttttttttttccccggggaccgacgagcagggagaacgaggacgccggcaaggggaacgcacagccagccacctgcgctggggagctgggaaagatggcaaccaacaaagggacaagatgctcggaggggcgcgcgttcaaggagctgctgggcgtggccgagcagcctggccctgagatgggaggcgaggaggaagatgcaccaggaagtgggcgagctcgagcaaggagagc

SEQ ID NO: 4007 - DNA, 653 bp, Zea mays
tgtaacccctacactacacgtccaaacaaaacaaaaccagtagcttccgtcatgaaaagaggagaagcatgtcaaggaaggaacatgtacaaaataacttaatcgcataaacgcactgcatcccaaacccatggccaaccactccagcaagaatggatctgagctcaccaacagcggccaccaccaccatccaagcctgttctgctacaacagtgccatggcagcctcgccgcagcacccaggtggtcgagaagctgctggagagcgctgctgagaagggacattgaatgttgacgaggcatgcacaccgaaacggaagctcggcgccatgaatcatggtgctgagctctgccacaagacgccagtgtagcagtgacagtttagtgcactagatatctcgacgttgtaggctatgacgtcgagccgtgttaactctgtgtcatgggctatggtgacgagtaaatggttcaaaagcgacattaattcatccaagggtctaaacttaattaaaaaaaattcaaataatataaaattcgtccccagcatgtgggacttgtgggccgaaagaaactaagaagcccaagcccagctgaccaagagaggtagctgagcgaagcatccggtgtgttccctcgccatccgccgccgccgcc

SEQ ID NO: 4008 - DNA, 826 bp, Zea mays
tcaaactatagtttgtcgaacggttataaccacattattatgtaatctagattatatatataatccagattacggttcggattatataatttataacaacgagcattggacacggcgcggtaatacgaaatctatcctgctgactacaacttgccccagattacgcagtccctgaacctagaacggctgcttttgacaaacaatattttactgcaaggccagcatgacagtgctgctgccagtgccagccccagacatgaatactatccgcgcgtgcagacgcgcataaatcacgcggacaacgcaaccactgcatatgagcctgagcttgatttgcatggtcattgttaaagaatcaaatccccaatcctttcgcatagcccctgggcctggggcgaaagaaaagttaccgagcttttctctaggctggctggcacaaaagttaccgtatcagtaccacatggcattgtaaagtttactcgatttcaaaactttggcacagagggacacgtcaagcatagctctcctcctccctctttttaaagagaagggaaccaaaagcaggacgagagacgggcagcagcagcggcctgacctgcgcaaaaccccgccgctctcatcttgccaaaaccccaagaagccgcagggggacggaactccctccccagctttttccccagaggaagcaaccgcagaggaggagaagctgcgcagaaggggaagcggcggcggcggcggcggcggcgtgtaggctgcgcagagagagagagagagagagaggccggcagggagggagcgtaagctttttggcagtggtggttctgga

SEQ ID NO: 4009 - DNA, 955 bp, Zea mays
gtttgtgttggctatttatgtttgtgttgatatctgtgatgtatatatgtgatatattttgtttgtgtggatggaatacaaaaaacaaataaaaaaggtatatactggtcactttgccaagtgtaacactcggcaaagaggttctttaccgagtgttaaggccatagcactcagcaaagaacccagacctgggcaccggtataggttctttgctgagtgtaatgtctctgacactcggcaaagaggtcggctttgccgagtgccgcacagaacactcggcaaagagcctgacatggggaccctccctggtgggctctttgccgagtgtcccagatggcactcggcaaagatgtattctttaccgagtgcttctgggaagacactcggcaaaggtaactcctttgccgagtgtcatccgggacactcggcaaagacgccgtctccgtcacccgtcaccgtaacggctgcttttctttgccgagtgctccctggcactcggcaaacctctttgccgagtgcccgagaaaaagtactcggcaaagaaggctttgccgatgcactgtttgccgagccttctttgccgagtgcgacactcggtaaagcctttgccgagtgtttttacggctttgccgagtgcttcgggcactcggcaaagcgcccgttttcggtagtgatggaggagtcgaggtatcttaagatccaattcattggcgcgcgcgagcccgcactgcaccttgcttagaacccacttgatcgctgcctcaccttgttcgtttttcacctcacctagttcttggtacgcacgcttccccatatatacccccctgcgcacgcatagagctagccacaagcagacaccgaccgccgccgttgcaatgcaagtggccgcccgcggtcggtcaccggcgttgcattgccccgtctcttagtttgtcgccgtcgatcggggcagaga

SEQ ID NO: 4010 - DNA, 1335 bp, Zea mays
cacgcgtaacaatgatcctctgtcatggaaaagagtatgttgaacaagctctacaatgctaactagagaatgtcccgatcaaaattgtctgagcaaaagttgttgggtcgctctgccactgatatgaacgatgacatgaaaagggcccacaagttgatcttaaaaagtgaccaagcaattaaaatagacgaggaagaagatgcgaaagaagtggaagagaaaaacaatgagaagagtagtgtatctattttttttataaatgatgtaatttatatttcttaagtttgtattttcatgaattatgttttttcttaattatgtactctgatgatttttttactttaataaaacatcatgaattttaaatagaagtacataaaaaaaaactaatgtagcgttgaggtgattctaagctgatggcaaagactatacactatagcgctatggtagataaggaccgacaatggtcgataatgtgattgatagttgatgtggcagttggtaaggccggttcagtggtattgcccactcaatttgttatcgttaggtctatgtcattgtcacgtcaatggtcgtttacactacggttataacttatcgctaaccaacaatcacatcagccgtcaccgtcagcagaaataaccattttgtatcctctatttcaaatacataaaataatattgaatttaaaacactcatccacagtttagccacgcagtataaatttgttccttttttggccggaaatcgtccacaggtgtgaattcagtactggtagcagtagtactgagtgaatatgactatatatatatgtgtacattattccttttcaaacttcaacgttggtaataaggtaaccacttattattacctgagtggctgggtcaaaaagccgaaatggcacaaagaacgctgaaagtccatgccgtaaaagytctaaaaagtagagcgtctcaaagtacagactagaaaagaaaagaaaaataacagaaggaaagcgagcatccatttctctaatcacagcctcatccttccttcccgctgcccttgtccaagctttcgcgtactaatcgcgtcctcgtcaatgcttgccgaaaatgcccccgcctactctgcacgccggttcatacaaaaggggcctcacgtcacggcacacagcacgcagcacatcgctcactccgtcactcgctcctcctccactcctcgccttcctcggtcgcatcaagaacacgagcaggaaggagaagaggaggagtcctatcagagccagacagccaatcagtatctgtaccattaccgttcgggcaccagattaccaaaatcctgcagagggga

SEQ ID NO: 4011 - DNA, 1500 bp, Zea mays
tgagcattctcttcctaggcaagcagatggaccacaaatcgccagcactctttggctctggatatattttttatttggctcagatatgtacgtacttttgccctttcggccctttggaatayaatacaatagttgtcattttcctcttctcttctaacagtttaaaccattgtagatgtaatattattctaatatgttggtgctgataccttgggttctatcatgagtcatatagatttcatctgtatggcagcaacacttttatgttcatgttggactccttgtgccttaatttataatttatgatgttatcatattgtgcttgtatgatccatatgatgcaacacaaaagcgagcaaaatgctgcttatatgaactagtatgttggcattgaggttttgttatttaagttatgtttctgctaaatgtgttgcttataacttatatgcatatgcataggaggtacttactccgttatttttatttgttattgtttagtttaaaaatgaattaagcgggcgacaaatattcgagaacggaggtagtatatccgtgggtgatatatgatgggggtatttagattggtgatatatggtttttgctatatttatttggatgtactagttcgataacgtcactggtgtgcacgcctcctgcataatgtagatcacctctcactgccaacggacaagagagaaaattccctcagtggcatttctaagggctagtttggcaaccttattttttcatgggatttccaatttcttaagggaaaatgaactaattttccttgggaaaatgaaaaacccttgggaaaatatgattcccaaactagccctaaatagaagaaggaaaatttaccaagcggggcatctttcttgtcggtgagagcggaattggattgaccaataaatttcccatggaggattttgcttccggagttaattagctaatgtagattttaatctcagttatcttaagatttctttaatctcaagttatcttcaaccaccaacctgctagatttctatcatatcgcttccatcccaagtatcatcaagatagaagttgttaaggtatagccgaaaaaagaattgatgtatttactttgtccaagtatataccatgacgaaatctgtggtctgtcaacaagaaacaagaaaggttcaattacatagttgctaccaaccagataaacaagctaccaagaataagaagacgcgtagctacagtaactttgggggtggaggcccggagaaatcaggttgagcgtatgacaacctctggatccagttatcggccttcttcttgttctgatcattggattccaaggcctggcagatcgagcttaggaccttgtggagtgttccgtctgtttcaagaactacctcgagatcgttgaggattgaaactatctgctgaaagtcgagcctcttttctggttgccaggaccaacactgctcaatcagaagcttcagcgccgctgggcagctcaattga

SEQ ID NO: 4012 - DNA, 1122 bp, Zea mays
ggtacgtcagcgcgctcgctcgctcgttcgttcgattcgttcttgctgcgctagtaaaccttgcgattgttctagttctagctcgtagctcgtcatctggctggctggctggctgctgtgctgctgggcatggtagagtcgtcggtttcaccacgcaccagcaaggcttgtgtgctcgtagtgggcatgcgcctcacggagtgatagctacgtgcccgtgtggcccgggccccggtgcggtgattgacccatcacttcccttttttttttctagtggtgtttgcgagttgttgcgacaacagatgtgtttttcttttatcaataaaacgcgaaggagaacgttgcaagtttcattgcacaaaggaggaggactggagcagacaaataccactaaaaataaagcaggccctgcaagaacaaaaaaaaaatggatgtataccaggccaatccataagcttatcctctccctccctccgttgttgaccgttgttctcacctaaacataaaccgaggttcgctggatcattacggtggacggagctgaaaaggcgccggccaatcgccattcatgggccagagatttggttcccggccggccggtttggttgtttccaaaagctcccggggccgggaccaggcggaattcagcgcacaatgccatgccgccgggtaggttcgtagtcgtactacacgcgcggccggccaccactagcaagtagcaaagccactccctctctctctccaagtagatcgagcaactacacgtgcgaaagggaagttgaaagcgccatagcgacgctacttttgcaattgactgttttctaacaagtagaaattaacccttaaaccccgcaaatcgaaagcattttttcccagttctcttctttttttttttgacaaaagacgtcaagtattgttcttgtttcaatcaagaaaacagagtatatttttttggggtggagcatgccatagtaatctaatcctacaggagacacagacgacgaaagcttgcgtttctctgatctctatctatggtctgtgtacgatgttgctctttaccagggcttcatactgctgtccctgcaagcgcacctgccgcagctgaagcccgcgccgtgcgac

SEQ ID NO: 4013 - DNA, 323 bp, Zea mays
cgctttccattgtttcggtttgctgaagtccacaaagttttgttaaggaaggcaggagaagcattaggaatggtaaatacagttgtactgtaagcacatgcaggaattaggagactgcagtgcatgctgagtgagacagagatgcgacgacgagacgatgctgctgcgaacctactattccggccattcgccatcctctcatttaattcgaacagaaacatttttattgatcagcaagaacacgtctgcctctcaccaaccgcggcttgccaaccttctaattagcctttgacccacccccccgccgcccgccgccgcagacc

SEQ ID NO: 4014 - DNA, 1500 bp, Zea mays
caacccatgcatatcttgtaagtatttattttggctcaattccaaacaacctttgcacttacattatgcaaactagttcaattatgcacttctatatttgctttggtttgtgttgccatcaatcaccaaaaagggggagattgaaagggaattaggcttacacctagtttctaaaaaattttggtggttgaattgcccaacacaaattatcggactaactagtttgcccaagtgtatagattatacaggtgtaaaaggttcacactcagccaataaaaagatcaagctttggattcaacaaaggagcaaagaggcaaccgaaggccctctggtctggtagcaccggactgtccggtgcaccaccggacagtgtccggtgcaccagaggactccaactcgaactcgccaccttcgggaatttccagaggcgactccgctataattcaccggactgtccggtgtacaccggacagtgtccggtgctccatggaagcgcagcctcaggaactcgccagcctcgggattttaattcagccgctccgctataattcaccggactgtccggtgtgcaccggactgtccggtgtgcaccggactgtccggtgaaccacggagcaacggctacttccgcgccaacggtcacctgcaaaacgcatttaatgcgcgctctgcgcgcgcagacggcaggcgcgcccatactggcgcaccggacaatgaacaagagttgtccggtgtgcaccggacacccaggcgggcccacaagtcagaagcttcaacggtcagaatccaacggcagtgatgacgtggcagggggcaccggactgtccggtgcgccatcgagcagacagcctcccaacggccacttttggtggttgaggctataaataccccaaccaccccaccattcattgcatccaagttttccacttcccaactactacaagagctctagcattcaattctagacacaccaaatagatcaaatcctctccaaactccacacaacgccatagtgattagagagagtgatttgcttgtgttctttcgagctcttgcgcttggattgctttctttcttcttgactctttcattgtgatcaagcactcacttgtaatcgaggcaagaggcaccaattgtgtggtggcccttgtgggaactttgtgttccaagtgattgagaagagaaagctcactcgatccgagggatcgtttgagagagggaagggttgaaagagacccggcctttgtggcctcctcaacggggggtatgtttgcaagaaccgaaccttggtaaaacaaatccgcgtgtcacactcttcatttgcttgcgatttgtttttccaccctctctcgcggactcaattatctttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 4015 - DNA, 428 bp, Zea mays
ctcgtttttgatcgtctgaactgtgatctgctcccattctcaactcaggcctgtttcaattcatcataactgaactacactttagccagctaaagtttatccaaagctgctgggatgtttgctgggatcgggggcggcgggatcggaaggtgggttcgtgcgtgcgggattgtccgcatgcttggtcaaataatggcgccacctccgcgatttgatttcatttactaactgtcccggccggatcggagcgatagctgccgttgcaaatccttccgtacattgtggagtaggagtaggatacgactgctcctggactttataaaggagaccttccgttcgttttcctcgttcccaatcatcctgccgcgcgccgcacctaggtagctagggtttcgtcctgcacccgcattactagcattcagtgtcca

SEQ ID NO: 4016 - DNA, 614 bp, Zea mays
cgcgctaaaaactaatctctaacagtcagggctgtttttatagacgtccggggcctggattggcttgagaacttgaggtggtgtggctgaatcggataatagcattgggcggattcacctaactattgaaagcacggggctcaaatgtagaaattacatttatatatgtatgtataactctgattcttttattgatgaaattacttttgacgataaatatagccgcatatgtcgtaaattgtcggacaaatttttttagccaaaatttgaacgaattttaactcgaagaaaccttattggagttatatttcggatcattcgtatagtagtattccaatatgaaatattttaaaattttgcgtagatctgttttatcagacataaaaacttttttttttgaaaaagtagcaggcggagcactgctaattcatataagattggacaagagattcagccatacagcaaagttgtaggcttacatggttatcagacagaaaaactacgtggttattactttgtagcttaaggctgtctgcaacagatagatcaacggttactattttgatcatttgtgactccaatatttggcaggcaacaacctgtggagcgagaac

SEQ ID NO: 4017 - DNA, 550 bp, Zea mays
ggcgagtaggcagaggtcgtgctaggggctgactattccgcagctgaatttgttatatttgttctgtatattgtagttcgaagcgaacggaaacagtaggatatataagcacgattctgttgtagttcccttgggttttctttcatcgcatgttgtccctgtctcgtatagctcctccgacatcaacgccaaaaagccacacggcacgaggccaaaagctgttgttaccttgcttctaccgctgtttacttggttttaatttgaaacagattttaccttttgaacattggtttgtctatatagattaaatatcttaccaagggggccccgcgctccagacgttcctgctttccctttccaccatggacctttcctagatacgcaaccacagcacgcgaaatgagctatcgccgctaccgctactgtccatcgtccaagtcggaatcgacggctctgatctgttcgccaaacagcgaccgtccacgggaacaccgtataaataatgacttcccgtgcctctgtccagtccaccgaagcttctcactagtaa

SEQ ID NO: 4018 - DNA, 236 bp, Zea mays
ggtgagtacgttcgcgtcgcggtcggagtcggtcctgggaggctaccgccgcgacctcgaggacctcggctcggggctccgcctcgagacggccgcgctccgggccgccgccgcgcgcgccgcctcagcgctacctggcgcgctggaggccggcgcgtctgtcgcctccgacaggcttgagtctgtcggccaggccgttgacgacctcggtgccgccgccgctgggctcctctcgc

SEQ ID NO: 4019 - DNA, 607 bp, Zea mays
ggtaggagccgcgttccctatactgacgatatgtttccgttgcaacgcacgggcacccacctagtttataatataatattatagtgcagcggatacgtccagataggcctctctccatgccatccatggttgtgtgttgatcaacaggtaaaactaaaagactaaacgaagaagaaaagcagagcgtggattcactgcaatggaaggacggctacggcccgttctggcaactggcatgatgcagtcgtccataaccgtgctggcatggcgaccacagcccgttcaacatacatcgtcacggcccaacgagcgacggttgcatgcgtttgcccggagcccatcgattccggtaccatggccgaaaacgacaatggcccagcaacggtcgtgtcccggcgctcaggcgggggcgttcgaaatttgaaacccctggcaacgtctctctccatcactcacggcacgacagtcacgcacgccgccccgaatctctcccctccacctccaaacaaaaatctctcctcttcctcctcctcctctcccacgatccccactcccaccccaccccctcgatcccaactccacccagccgaggccagcccagcaaatc

SEQ ID NO: 4020 - DNA, 235 bp, Zea mays
agggctgttagtggatgcttcatgctctgaagctcgctctctctctgctcgcagtttctgttcgtactggttcttcaactcgtttaagattgaaaaggccacacagtcatgtagcctgttgttggcgcggttcttttgtgttttctttttgggatgcctaatttatgttgtgaataaattaccgtattgtcattttggattgccttacgtgtctgtttgtcgggtaggattatga

SEQ ID NO: 4021 - DNA, 49 bp, Zea mays
ccccaccagccgaaaccgaggctgacgctgcgcgagccaaccggcggtg

SEQ ID NO: 4022 - DNA, 1266 bp, Zea mays
cgcgcgtgtgcgtgccctaggtgtcagccaccacgggctggtcacccaactgctccggttcgtcagccaagacccaacacccgtcctttaccactcccggtccatcggtacgagcccatatgatcttcacctcagccgtcgaacgttgtccctgtgctccacacatacacaccacaagcttacatatatggttgcacatacataatcgcacactctggtcagcccactgactaccctagagtgctacccgttgacaatcactcatcatcaatccgaaccacaggggacaagtcaatcttgtgtctatagtttcacgtgtaaagtgatgaaggggaagaagtcagagacttgtgcggcaagaaagaaatagaaaagataatgatgcacatgtattatttctaaatcatggttgtaaattttatgggtatgcttgtaattttatacgaagttatatctcttccctataaataggtaaacagtgtcatgcataaattcatcatttgaaggccctaagcttcatctcccttagccttcaaagtgtcttgctaagacatatgagatgagtaacatgtttcgttcttcattacactcttatgcattcctacctcgttggtattctttgttcgcgtcttctccctaaaattatctattcgaagaaaagacaattgtggggagaaggttttaatcttctaacttgtgttgtcttgttttttgtaccatatagtaatcaaaagcaagtgacaaacaatgtataaaaccagtccataggaagggtctgtacacatcagactacatggttgagaagatgctttctccatttcaaagtttcaatattacataactcgaccagtgtagggtaagacagctcacaaccattatattaagataaaaagaatactttctcacataggtcgagaaaacctttgaacctctgacccacccatatatatgggcacccaatgtgagaaacgaccacgattaggacagggtccatgacctgtgatttggtgtaggacagacaagtggattttttaaccataacctgaagttcgttctcatggagagtcgaactcataacctgaggaatgctattcagaccaactaattaactcgactagaatccctttcgctcaacattacagaacacctggaaattttatgtaacttatcaacaactagccaaaagcacttcctaactttatcaactagcttcaagctaagagtgtcccacagcaacacaggaaacacgcacgcccacagccttgg

SEQ ID NO: 4023 - DNA, 102 bp, Zea mays
ggtcgctcgagcttggtgggctggggaattccaatctcattgatcttgcttgggcacttcgtatgcgttggctttggttagcaaaactgatccaggacggcc

SEQ ID NO: 4024 - DNA, 696 bp, Zea mays
ctgctgatgagagcaaaccatggccgttcggcttttgagaaggaaaaaaaacatgacagatcgttgcacaagatgctggtaagagcatggccgagcaaaagcactagcagaggcgctgaccaaccatcatgtggcacctaatctcaggcggacgtgccgcccagcccaactctcgccgtcgtcgtctctctctccgggtataaacacgtcgcggccacgcctctcctggtcacgacggcgcgtgccccctggtccttttcgttcgttgcactacgttgccacgcttgacgcttccactaccctggtccctggaccctgggcatccatatcggcacggccgtcgctgcaatagcatcgcgctttggtcagagcagaagccagcgcccatgcttaaccaaatccatcacggcgctgcctagttaatcaactaggatacctgattaaagaattgcgtaactagcagcggcgcaaagcctcggccggaggccaatcctccgtgtccggtcggtggcgcaacccgaccaaacaacttccttttaagcaaaccgctcgcgttcctgaattcctgacccccgctctctctcccccacccgcactcgccccacgtctcctctctcccgtcccgtctgctctctgatcagcaggagagaaaagtggatgcgccagcgaagcgaacaccgtccctaatcgtcggcc

SEQ ID NO: 4025 - DNA, 177 bp, Zea mays
ctgtaacgccccgaattttgcagttgaattttttcttttctttactcgccaaaatacgggcgttacctttcccttttctttttcccttcgctaaaccttgaccttttccaaagttctaagcgggattcggtttggaattcccgtgtaagaaaaaccctaaatactttatgttgtttg

SEQ ID NO: 4026 - DNA, 1187 bp, Zea mays
tggcaagaaggttcatgaatcacataatcgcctgccagtcagtggcgtggagtgagtagaaacaagagtcacagcctgagtatcatcttgtatttgagaaacaaacgcacatgactggtccacataattgtgattttttttgcgtttcgctttttctggtttgcaaatggcctgcgattggatgggacctgtaataccagattttaagttcagaattaaataaaaagtttttaattatttatttgagggaattattctcttatgaattgtctacttagaaatattttcttgaaaaaaggtaaagttaaaattttaccttgcactacatgctgggttttttattgttacatttaaattgaaattgatttgaatttagaaattgaaataaaaacagaaaataagaaaaaagggagagaagacttcacttatagaaaataggaaaacatataaaaatttaacaacatatcctttgtaacttaagcatatatatctagagcatcacaatctcaactactataaaacactagttttgacggttgtcttacgtcacgtacgaaatatgtaggtatatttttatctcctactagtgggacggtacccctagataggccgagcatagcaacttgcaagaaaatcgcacttcaattgtagtctatcttcttttgtctgtcttttggttcgtatgcaccttccacgtaacagctatttgagcaagagaatcacacttcatgattgtgatgccactgacttgagtctttcttcttttgtgtcttctcttttttggttcgcatgggtctttcacgcaaccgaaagtccgaaagagtaagaaaaaaaaaggttatctttcagttgaaacacggcaatcacaagccttatccgaaattaaaaagtcttatagtgacttgactaggaaaataaaagccaggtcgttaggcgtgcacaaagcagtcaaaataatactaacagaagataaatataatattcgagaagggaggaataagactgaagaagaaaggaaacttcctggtaaagcaatattggcagcaggaattcctttccaccgcgtagcggtcatgacattcacataatctctcctcccgagaggttaaagcaaatagagataggtgctcattctgaagcacttgcaaccttctcctcgcccaccttcatctccgaacacatccccc

SEQ ID NO: 4027 - DNA, 381 bp, Zea mays
cctatattacaacgacaaaagttaccccagaaaatagaactgcagtattgacatcctttgttttagagatgtttcctgtagattggaccagttccaactaaaagaagatggggggtcatgctaatagagtagacccaataaccataactggacttgttagaacttgaaggccaaatatgccataaatcgaatatgtgttcatcttctcatgtcccatcagctgagttccaataaaagtcacctctttcagtcgagtaaccatacggcagatgaggcccataaacaacactaccattcaaatatgtcatctggtccacttgtgaccctagctaaaaagcatttggaacattggcttgagctgtggtgtttggaactgaatag

SEQ ID NO: 4028 - DNA, 893 bp, Zea mays
caacctcataacgcgtgaaaattctgttttctattcgaccagctcttaaagaacattgaaatatgataatgtctagcatagcgagggcatctttagaagtatgatccattcatcaaggtctcccatgcaaaaagaacgacaccccttctccctcgtctcacactagcacttcattgcataaaaaatcaaggaaaataaaacgttaaggactgatttagtgactatggatcacgaaactatctctttatcaccaaatcaatcctaataaaaaaactacgaccgtataaagagtcccaacaaaccatccatgcacattttttataacttttttgtcccaaagaaaaaccacccactttcacatccctagctattccttccctctttcccgatctcactggcaggcactgcctccatcatcctcccagagagagactgagagagagagagcgcagccgaggcagttcgcccgcatgtatcccgctgctgcagagatcacgcccagcttctgcgcctgcagctccagcagtagcagcacaaggggctgcagtggaaacggccgctgctagttcccgttctccccatgatctctgccctttcccctactttttcttgttcttgcttgccccttttccttctgcgctagctgccgcttcttcgccttcctggagcttcccgcatccacacatacctctaaagaaccagacaaataaacgacacagaaccgtcggagtcgtcttctactactgtctccattatatgggtttgttgtgcacaggtgcgcgtagataggtagaaccgtagaaggcagattatcgctcgaggcagcagcttggttgctggggcacgcgatcgagctccaggcaagaagattattgcaggaaggcgcggcaggc

SEQ ID NO: 4029 - DNA, 539 bp, Zea mays
gacctgcagtacgttagctgcatccagcgagtccagtgctcaaagcaaagtggaaaagagatccaacttccacacaaacttctacaacagcaaaatctgcacagctaagaacatacagtgttacgataataacagaactgatgcacaaggcggggatccgttcagacttcagatgagcagggcccctcgcacctgcgcttccatctgctacgcacagttcaagacgacagtgctgacattacgctagatggggccggtagcacgacattattgacctggatgaggaacctgtcaatgtaagccctgacatagatctttggagcagcagtgtcgctactcacgtgacaataatttggcacatgatgacaggcagtaccacgggaaggtgattgctccttctcgttcagtccttctcaatcagcagaagtccccacaagaccacgatccattcttaaaatgtagaaaatctattgagttccgacgccgacgacgactaggtgtccagtaagtaacctgggcgctgccatcttccggaagga

SEQ ID NO: 4030 - DNA, 60 bp, Zea mays
tcttgatgcagtttgattgttgctgcccctggccacgaagtagagcgtcttgttgctgat

SEQ ID NO: 4031 - DNA, 936 bp, Zea mays
ctgatctctgtctatatattatcggtcaaactagaagagagcaccatgccaccaactgcaatctctttattcgtagataaaatatagataatgaagatattttctatcgtttatcttgtctttcatagatgggttgatagttgtatccatatagatataacagcataaaaaaaatcaaatattttaggtacaacggatcgacctatggcctccaaattccgtattaatatgggataactttcgtgcatggaataaaaaaaaggctgctaaaactacatttttatttagacgttaggctgcagcgttacctttttatatatcttgtggacgccacgccatggctactagaaaataaatctaaatcgcaggctaagatagaatttttgtagaaagggaaggatataatgtaccattcctgtcgtcgttttcgaagagcgttttgttagcttattttccccgttgcaacagctggccatgcatatttatttgctagtcaaaataccttccaaaaagaaaataaccgcagttgcggaccaggatcgccgaagtgccgaactgtcccgcatgcaacttgcgtccacaccgcaccgtaccccgccccacccgcaagcaacgcgcgccgccgcgaccctctcagtctcacccaccaccaccacggcacggcaccaccggccatgcttactacttaatgaccacctcgcccggccttaacctgcgtcgcgcccaccttaaccaaacgcaggccggctaattataaaaaagcaaggctactaatcacgttcgctagctagtcctgacccctgactgacctgccaagcggagcgcatatacctgagtacccaactgctgagcgcatctacctgagtacccgacccgacgctgtcggctgtcgcttcagccttcagcccgcgagcaggagcaggaggagtcgaggag

SEQ ID NO: 4032 - DNA, 1463 bp, Zea mays
tacggtggtagtatgaacgagaaggacccaaacccaatgccaagagtgcctaagctagtacgaccactgcacggccatgatcatgaccctagtgtgtgctcccggacggacgggacgggatggaacaggagggcatcggcgtcggcgtcgcacccggtgggggcatgcagcggcggtcgcggatcgacgtgaagcagaagaggatatggcccggcaacggcaaaggagaggacgtgtggggcaggcgtgcaggcaggggtgccgggcgtggcagcggcagtcccgcgcgggctcgccatcatccaggcctcgtgacgccgacgtgcaaccaccagttgtcgctccctgcacctgcaccagcagcgctggcctgttgacctggacggacgggaagaacaatgctatctgtatagtattttgtagcaaattcttcaccggccaaggaaaacgctccacgtgtagatgatatagtactaaataaaaagaagaagaagaagaagattgttgatactctctttttttttttgtggccacctgctgtcagcagatatagttaagaaatgaacaatggagcaggatctggtcacttatttcgacgcgtgacaaatgttatcctttcttggagcagtgatcttcaagacgcaacaaggagaaaatagcaagcccttcgcaagtgcacgcgagaggtagttacattagattagactgccaatgctctctcatcgtcactgtagctccggcttaacgtcgtcggttctgaattgagttccttttcttcccttttttttaaaaatgctaaggggtagattttaggaagaatgaggatttcgccgtttctgcaggctgcatctgcttgcttggttcgttactgttgaggacgtcgcctgccgctagccagacaggccacctaaattaagccaagaaatggttaactggttggttgccgctgctaatcgagcatagggacagcccaaatctctagccttttgatggtttagttctctctaaaggacaggcgccggcgccggcgccaactgataaaaaaaaattgtctgtacattgctacaatgcactctacatagaaggcgatataaccacggcttgctattatattattattatattataaagattgctcaagactagataaacatcatgtaactgcaagtacaacgtaaaaagaaactagcttgctctgatatatataattatttcgggcttctgctcctgcccgcgcccaaccaaaacacatttctttcctataccttctcgcccgcttccgtgtatctatccgcccattccccgccattgcatccctgcttccccaacaatgccgtcctggaggcagcgcgcgcgcggcctccggcggtgctagctagatccgcggccaagcggggtacagggcaggggacctcgagcggcgaacagaaaggcgtggccgccgggacaggcgggggcgtcca

SEQ ID NO: 4033 - DNA, 908 bp, Zea mays
ggtatattttttagtgatcaaatatttgtttgtcgctgtcgctggtatgcttcttctgaacacattgcagagtaggctgtggttttgctatctttatgcatatgcttgggctgcgcttgcagctgtggtgcccatgaggatcgttgtggagaaccaaagaaaaaaaaacaaaaaaaaaaaacaaaaaacattctaaaatttggcccatgcaggtctcgaacctgcgaccttcgcgttattagcacgatgctctaaccaactgagctaataggccatatatgttaacttatacttaaggtatgtttagaatcatatagattctatgaaaccacattataaaaactaagtggttcttaacataccaatttatacattaatctataaaaactgggattcctgttttctaaaaaaccaagaagctatcttgtcctatctaaaaacagttttcccattcttatcattattgatttcacaaaatttacatctattatcaccacttttaaaatagagtaaatatagactagccatcgtgtatyaaataactaaaaactaatttcttaaaaaccaggttccaaacacccttatacagttttttaataaaccggtttatagaaaatttgagatagaaacagttttttttttaaaaaaaactaggtttcttcctaacatgactttagatagtattagttcatttattatatcctggatgaacaagtgggctctgcaagttaatgggcctgctagtccaacagacattagcctctccatcgtatccttccgcgataaaaactatacacctaaacatagcgccggcagtggcaccgagcacgagacgaacagacctctaaaacctagcagaggcccgcgccgccgccgccaaccgcgacgaggaaggaagcaggaacgcg

SEQ ID NO: 4034 - DNA, 1500 bp, Zea mays
gcaccagtgttttcagaacgtccaattagtcacgattaatcggcgattaattacctgatcgtaacttcgaagccgatcaggagtaacgacacaatcaaggcgaccggataccagatcgcccgactagtcgtcggttaatcgcgactaatcgcccaatcagcgcatggacgatcagcctgcctgcctgccttcaaaactgaaatttcggcccagtggcccatttgatttgattttcgccaacgatttcggcccagcggcagcccacgagtcctttttcccacgtgaacactgaacacagccagccgcgcacaccagtacaccacgcgacgcaaacaacagagctgccagcctgccactgaggagtgaggaaccctaagcggcgcactgtgcaggcgaaggcggcgcgctaccggcgacggccgacgggggatacggcgacatcgtccccctcgacccctcctccatccccgacgcggcggcgccagactgcaggtacggttcccttcccacttcccaggatccatgtctccagttctccactccattgtccaatgtccactactccactccacggctccaatagccaataggccaataccggttcatctctacaggtgctggactagagtcgaatgctaggcggctgctagctgctaggtaactctgtaactgtggttgggggcttggggcttgtggccttgtgggtgctcgactgtcgactgctcgcttgctgtgctcggtttagattttagactttagatttagactgttgtgctgtgctgatttgcttatagcttgaatggtgaatgttgaatgttgctgccttgaatttagatttagagttttggactgatgtgaggtgatgttgaatgctgatgatgagcatacctgtgcaggtgttgaatgctgatttgttgtggcctgttgcgtcttcaccagttcatacattaaacttgaagaaccacgtggttgaagaaaagcccactgaaaatgagtaatacatcatcttcgtcaagtggtgagtgatgcaattagccaattacttgaattcttgaactgctatgatgactgacactggaatatgcatgtaggtgagcgtgctatgcagtgacagagggctgtggagatcataagttcataacatcctatgttagcctttcacttgatcataagttcataacatccttatattcatgcagggatgtgatatatgctgatattccaaagctcattccatttattgatctggtaagtgatgcttattcttcattttcctaggcccgtttgccaaattgaacctggatcttatcctatgctagccgtgccaatttgccagttgggctgttccctccctaaaccccagcgtcgcctccgacgagtcaccgctccgtcggctgcttgctgcagtccacgccacgcgctacgccgtcacggtcgctcctcccgtgacgcagccgtcgctaggcgccgcctatttctcggacaaagtcgctcgccacc

SEQ ID NO: 4035 - DNA, 112 bp, Zea mays
taccaacttccatattatactacatcagtctcgtgcctcatctaacaagtaatcgtcacagtggtagatttgcgctgttacacatcactgcactgcacaggcacagatccac

SEQ ID NO: 4036 - DNA, 406 bp, Zea mays
atctcccgtcggcccacggccggcactgccgcctgtcagattcaattcggtagcttgttccatttttttctctctctttcgatgattgtttttttccccttgattagttcagataattagtggtagtgtcatctatgcctgccggcgtgcggccgtcgacggacgaactgatccgtgaggccgggaaccgtttcccgccaaggaaggaactagccgttgggcgtctcgtttggttagcggaggtgtaaggcaccgggcatggggagggagcaaggaaccatgtggcgcactgctgcagaggcgcttggcacggcctgatggcaggcccctgccatgccaagcccaaagcgtgtcgtggtgctgcgcatgtggggtttccctgcccaggcatcggcaacggctactg

SEQ ID NO: 4037 - DNA, 280 bp, Zea mays
tgctatatactatttgatattcaaattattgtatctagatcgaatctgaaatccggttatgttgtcgtgctacacatatataaaaaaattttccgaccagataattgttctcacacgatatgatactcgaataatattcatacggagttacggaccataccgtttacaccgagggttctctctttgtctgttcactgttctactgggacgaccccaaatccccaaatcgaaaggggccgtccggctcagggtttctcgacggctccttgccctctccgcc

SEQ ID NO: 4038 - DNA, 192 bp, Zea mays
tcgagtctacctcttatccaacgacagcactaactaatacattgttgtcactggcacactgactcactcctcaacactcgctcgatctaaaccgcctcttatatttatataacagtggagccagcgctcgtatatcaacacaacagtagcacgtacgtagctgtgcggactgcagtgcagaggtagacaaac

SEQ ID NO: 4039 - DNA, 75 bp, Zea mays
ggtaccctgaggttttcttggactacagatgaagcgggctcgaagggcgtatgtgcaagagatgactgatgaggg

SEQ ID NO: 4040 - DNA, 132 bp, Zea mays
ggtgaggatcgaatcatgcgccgtttataaaaaacgtcttagcctgctacacgcacaccgcgcaggaacaaccaccaggcacagccaacaagcttgctagtgtgtggtttctctcatcaggtcaggaggagc

SEQ ID NO: 4041 - DNA, 444 bp, Zea mays
gagaatcattttactcaaaatcgtctaaaatccacgtgaacacaaaatcgtcttaatcattatgatactaaaaccatcactttctacatcctaaatcttatagactcttttttctttctccgcagttaatctccacaatatttagattatcttcattaaaaaaataaaccgggtcttaagctctcccctcgcaacaatttctcatatatttttttcacaactcgcgcgttaaaaaacctccttcgtctcctggtctgtgtcccacactcctatcattctcgccttcgacttcccaggagcgcccagcgcccgcgacgcttctagaacacgcgacgcgggcgagcgcgctggcgggtgggcgaggcaaaactaaggaggcgcgaggggtgacgatgcggggcaggtgacggtgcggcgtggtggaggcgggacagaggccggggg

SEQ ID NO: 4042 - DNA, 1500 bp, Zea mays
cgaataatatattgagatgaagggaatagttagctaattattagctaatttattaaaagtaactaataactaaattattagcaagactgtttaaatatgttcgcttgtgcattcaaacgtacctaaaattccatcttgcagctgcattttagtctgagctaaataccgcttcacatttttgccgtccaattatcggcgtgtaaataatttcttgtctgaatttatgtggaagaataaagaaatcccaacctgccgtgcaatgtcggcaggggcagctgcatccacagcgcgcccctcgttttttttttcccttctcgaggacgaggacacacgcacacacggaagaagccactagctctccgcagtccgctctcgcctctcggccttctccttgtgccgccgaacaccctcacaagagtcggcctctcgatttctcagtccagcctcagcagtccccttccctccctccatcaggtgttgcctcccgcagatccaaatcggaattcggtccttcgtccccaaaccaccaatccggtaaatatatatgcgctccctcactccctccccccagagtttcttgcgccgttctctctcgcgcaaattattatgccgggaaagattatattcttcccctttagctttgagcccgaaaggccgaagctttcgcgttcttccccacagatatctggagccgtagcttctgtttggtatggccgtgggttgaaataaatagtagtgtgcgggacgcccaccaattggcacgctgcgctttccatccctgcagctgcaagcatgccttctttttagatctgtgctgccgtgccttcctcttcatggtaccctgtggttggagtcggtattagcgtttaatgaagctactttttcctcccttgccttttggatgatgcttagtactactacgtcttatcagctatcaatcctcctctcgcgtgcttcttggataggttgcattctttgggtttgctcacagcgcacacaaagccattttactgctgggaatggtggctggcactattagcgtctccggctcttgagtgatctccaaggtaagcagcccgccactcccttggaagaatgggaaatagataggaatgttttgttttctcggttggaggagcaaggaattaaccactccacatccctccgtgatttctgaagtttatggctagaaaatttatgaggttgctcggtatgaagaaaatagtctttccttctatctgatcattcaaattgttcgcttcgcttcgcttcgcttctctctggttttgcttgcctcagtctagttgcaagatctgtattcggtttgacttgggttcttctcagtttgtttgatgtgagtagattggcgcacgaaatgaagtattaacctgactgaactgcggcagtttgttcatgttggtagttgaagcattcattcttgagtagtcagtcgtcgtaatggattatcagtcctttggaatgctacagggaagtgaagtg

SEQ ID NO: 4043 - DNA, 192 bp, Zea mays
agcgctgaagctgcggaaaggacagcttcggggctgtcgagtcctgctgacgtcctctgcttccgtaaggggccgagagccgccatcgtcatagagcgtgcggggcgccatcattactttgtcggcggagcgagccagatgggacaccggtcttgtttcccgtagcctaagtcagcttggggtagggtaatg

SEQ ID NO: 4044 - DNA, 1500 bp, Zea mays
cgatcataagatgctcaaccaaactttatgagaactgaaaatttgtagtttcacgtgaacatgaaatttgccaacattctgacgattatcaagtaaaaaaagtggtaaagaccaaaatttaaaattgtatacagaagaattcatccattttgagataaactgagttccaagcgttcttgggatgtggcatcagataataagcggagtttttttgtccacaaaaggtttcagtgtatagcataatattaacttctgcatcacttgccacaatctgctttgtattgacagaaaatctaagctcttaaaatatcaagaaaaagattttttataagaaaaaaggagcagcgcctgacaaaagcatcagataataagcggagattagtccacacatggcagtaattccattaagtgtgtaggataaagttttgcacatcacttgccgtcataataagcgctgacaaacgagcgaactgaaccagaaaaaccaacatgaagtaatttcgattaaaccatttgactccagtgcaatgcaaggctgcaaagggttggtaagttaaccatctcgatgtctgcaccagctttgctttctcaggatctttgggcttgcttcaatcgatgattgagcccttcccaagaagaatataagccaggcgcaacagtaaattgataaaaagatataattgttcggagctcagaatgatgcgtaaaccaatcacagaaattgatctcagatgtccagacatagaaatagttgagcatcttcatcacagcaccagtactttggcaaactcaaaaagatattaagagcaaataggacagacgtagcgactaatttgctgctttctctcggctgcccgcccgaaggaaggcatgtaactgcagacgaatcaacacggcatcagttcagaccgcccgtctgcttgcactctcttcacagagaaagatccaacagcgaagccctcgcacaatagaagagaagaggaattctactggaactggaatggaaaagcaatcgaaatctcaaagaaccgtgaacagagggcgccgccccaaaactaggagacggaatgagtagggttgtgtcgataactcgatatatataaatagagagcagattagggtttcggtctattcggcgtttggaggcccaacaggtaattcgttgcagcctgcaagggttatagagcggcccgctaattggattatgtccaaccaaatgggccaatgccgcgtgccgaaagaaaatcttcgcggcgtcgctggtggccgtatcgcaatccgacgcggacgtggtggcgcaacggacaagcaaatccggaccgcccagcgccgttcgcccgcgcgagcacgccgctgcgggaacgccagccatgctaaatcccagcgccgttcgcccgctccccgccacaagctcctcctcctctcctccctacacactccagagccagaggcagcacgtgctgccgtgctcgagcacagctaggccgcagctgcatcacc

SEQ ID NO: 4045 - DNA, 963 bp, Zea mays
agtgaccagcctaggcgacatggcatgggagaaatgggtggaaaggctgggtggttgacgtggcccctgaatggaatcacatgaagaacccttaaaagacacgtaccaaaagaggaagaaaagaggaagggggaggtgggaggacagcagaggaaggaaagggtaggcatctttttatatggtttcggggcagctgtgaggtgaggtgaggtgggagtggaggtggctgtgtaattgctgctgcacgggtggtgcatgtgtagcctttcagctgcaaaaaagctttagcagttatcttcttctcttctttattaatcacaatgctagcagccggcttgccgctggttcttcttcatgtgacccccccatgcaggcataaaagcaatgtcaccaccatgctcttgcactggaaactcttgcaaacttcatcgctcgattccagttcttcagccatgctctttttttttcccctttccctttcaatacgctttgtacgtcccatctatacttgctgcttgggtttactctcgtgcagtgcagctagcagctagcagcttgagccttgaggacacacttagccaggcagtttccaactagcccttgtggggggtccaatgatgcaatgattctggcctgtaatcatccatgcaagtggagaaaaaggtgaatcaaaccctgttagatccttgggaatagttatatacatagcaatagatactctcctgcagtgtaaagctggcttacgcggctttaaacatttttaaacctgctatccacacgaccacacattagctcatctcatggcagccacagtcgtcccgtccaccccctcccctgcttatatagcaacacagaggagttagctgcctgggaggcagagacgaaagcctactagcttccctttgggtcggtctcgcgctcccgctgcgcgtctgtctgtctgtctgtcttggagcctcatca

SEQ ID NO: 4046 - DNA, 1500 bp, Zea mays
ctagatgccaacatgaaacaagaacatgtaacatgattggggcccgttgcaacagcgagcgttttgagtatgcattgctcattctgcccttgcgtcgcccgtttgggacgttacattacctgctggattgtctataaaaaaattgagcttgtactacgtcagcatctatgccggcgtcagagcagacacagctgcagtgaattagcaccggcggtactgaactggagraaggaaaggtagagtgaatgaagtacactcttgtatatacgggaagatttaaggcctatttgtttcgctaattaatttgtcatactttatctaacttttctgactaaaattagcatttcaattcaaacgaccaaccttaaataaagtgtgatatagttagccataaaccaaacatgtcaagaaccttttatagtgaaccattggactattgttcatctcctacgtgcggttggggaaagttcgggattggaaaggattaagatggaaatgaactaatttcctctgcaattcctttcaatctcgaagtggatttgagtttccaaactagctctaacttttccaagggtaactagcaagggattatatatccatcaatcccctcaatctctatacactcaaacaagcctagtactccatctgtcccaaattaaaaaatcattttagataataattatattcatacaacacttaatacatgtgttttaattgtgtctagattcatcgttatctacttaaatatagagatgaaaactactccatctattccaatttatagtttgcactacaacgagccaatcaaacttagtgtaaaaagaccagacaaaagagatggagtaagagttcagagtaatactgttttgggacataagagattattacatgaaagttggacccagctggtgagcctgtaagtacagtaaaagggggaaaaaataatcaaagccacagcccacagtgaacagagcaaaaggtcaaatgaactggtaaaagaaaacctgccgtagtggactagtggacagtggtcgtagcaagcagatttctacttttctcgcctccggtttcactcgctgcgtgggcagaaaccacggggcggcggtgggcaatccaccacctctctctctccagcaggccgcgcgccgcagttttctccccgggcacatgcccgtgggcacgcgtgcaggccactggccacccccacgcagaaaaaccagcggccgcgcgcaccgacccggccgacgactccggcgaccgcgcgcacacgacaaaaccccggcggcgacgacagacccacaggatcagacgactcagcgagcggaacaccccctggcgccggccgttaaagtcaagtcaagcaccggagccggtgtataaagctccggcgactggtgcccaccacggctagctgccgtcgtcgcagaagtaggagctcgcgtttctccatccgtacgtcctgcagtagtgattgggcagcatcgtcatcgatcgatcgcc

SEQ ID NO: 4047 - DNA, 53 bp, Zea mays
cgactgcttgctgttcggtgaggaccgaaccaaaataacccaccccagcaacc

SEQ ID NO: 4048 - DNA, 1273 bp, Zea mays
ctgcctagctcctttactgaagggttgcccatcggtcatgggcttttgactcgccttgtgggctatggtggccaagccagccaatcatgcctctctcttgatgagtctggatggggcccacctcaatggtggcctaataaagaatttgcagtactctaccaatagagaatgagccgagatgtaaaagagttgttctaggcgtaggcttaggccaagttgagtcagtctatggacacccgttatgttgcagctcgaggacgagctacttgtccatgaggggtgtagtgtcagggaggcactattcacgcggttagttggtttgttagggaagagataaggattggtttgttaggcaaaagataaagattggatcagattagttagggaaaagataaggattagatcagattagttagggaacagataaggattagattagatttggttagatgaaaagagataagtcagttgtttatataaaagggacactattgtatcagttaaggttaaacatgaattagaagcaagccttcttcttgcccggttgtgggcagaggcttccggaaggcattcctgcaactacaactccctctccaattccctaatcccatcacaatccataacagttggtttctaagcttgagatagttttttcttcccaaatagaaaatatttttttttctcataatggagtgtacacagattcgtattcatatatttaaagtttgtgacctcatgttagtttgggcttagaccagatgtatttgcatcaaacatcttgctcaagctgaggcttgaacttctgatattgggcttggcacaaccttagcccatagcgaagatcttggattgcctgggatgcccatggattgctgtaaactcgacacctctccgataagctttattggaccttccaagtcatggttttaaagtcatcatcttggtgtccaggcatacccttggtgccacaggatgctacaaggttctagtatgccatatcatctaggcgttgcttaaaagtggcacctagacgtctaggcatacccctagcaccacaggacacagcaacacctcaaaaacaatgctcacagtgatgacacagacattgcaatgtaaaaccttgggcttaactcaaactgattaaagaatccagcatatgagtcttttctgtttttattggcgtggatgatatgcttcatgtgttagattttgatgtttattagttatttttatcaaattgcaagtgcaggttcccacaatagaagtataccca

SEQ ID NO: 4049 - DNA, 1500 bp, Zea mays
ggtcacctgacaagaaggccaatgtctacacagtctaaagttgtaacatgtttgaacaaccacttatttgaacaagctctacataaatgatatatataaaggagcaccaaaccataataaatctgagaaccagatcacaatgtctaccatactatataaggaccccgactgtcagcatattttattttgttccaaatttccatggatggacagtccaaccgtgttttccttgcactgtgttgcacacttttgaagatttgtcttcacataaaattagtagtttactttatcattttcatatgaggacttgatttatcttcacataaaatgtttattagtttttgtaacttatttgtaacttttttgagtgaaactagaatattttatgaattttaaatattgtggtgttggtttttacaatgtccttatgattagtaactttgaactacatgatgtcaattttattggtttcctttcttacatttgatctatcatatacatgattatgtattgtttaatttatgtatttgttgtatggttggacaattaatatcatcgggacgaactacccgacaattatctggtacctacccgagtagtatccgttatctgtttcttacccgcccggattattacccggtcctgtcctatatccgtcccgaattaactatctgtatccggtctcgtatccgagagaaatacattagggtaggatacgggataaccctgtatccggctatatctgtcccattttcatccttagaccttagctatatctttgctttaagacattgcattttgttttttttttctctttctatattgaacacttgattattctatatgtccattattaacattttctatgttatcactcatgctcaatcttggacatgacttgctcgatctcattcacattactagagtaaatcatcaaaccactagttgcctcgaaaactgatttccaatagtaaaaaaccggctttacggaataaaaaatagattttcttattgaatgaacgagaagaattggaagagcaaagttgaactgcaacgtgaaacggccacgtaggaaacagccgtgtctgcctcaggaaaaaaagaggaaatagccgtgtcgacggaacattccagaaggccgccgcgcaatgtgccaaagcgcatccaccccgtacgcgtccactcagctgccgcacgctgagatgctgacccgacccggcgagtcggctactcgctgtctctctctcccaccacaaatattcttcccgccacgatccctctcatccggaagaaaggggggaaaaaactcgcctttttctctctgctggttcaagaacgccatggaaaatctcgagcgctcgctgtgattcctgcgaatacccaagcccaaccaaaccctagcccggcagccattctcttcgttccctctttgctctgcgcgccacaccgcacgacctccccgaagcagacgtgcccgctgcccgtccgtcccccgtggcc

SEQ ID NO: 4050 - DNA, 145 bp, Zea mays
ggtacgtctccgtcacaatacctgcgccacatgtccatgtatgcagcttccaggccccgggtgaatctctctccctcgcagacgggcgacttcatcatcagctccctcagggtcatcctcagttcttgcaaggcattcacatctg

SEQ ID NO: 4051 - DNA, 160 bp, Zea mays
actgagattcagacgtctctccatccatccattctactactactacatatatgtcttggtggtgatgttggatttatattcttagttctttcttctttaatttcgccctggctgtcttgagagtgtagattgagagtcaaatctgtgcttgtgtctaaag

SEQ ID NO: 4052 - DNA, 1500 bp, Zea mays
tgctttctctatagctcttttgaaatacaacaaatatctaccgttttagagtctgtgagagagaactagcagttttcatgaacaccaatcactgggagtagatgccatcgacaaggttgacaaggttgtacgttcatgtccatttattgtgaagttcaatttagtgtttctcccctagcacgtcagaacaacgacaattggttgtgcaccttgacatcattgatcggccccgctacccaaaagagaatgtcaaattaagtcatacacaggagtgttgaacatgctctttcctctaggatataaatcatttaacacaccttccaaacttttatagctttgatcaccaagaagaaagctcatactaatcaccagaagttggttggttgatgacattagactcatcatgaaaaatagtctccaacgtctatatcttttattgatgagataatgcgtttttatagaaattaatagccaaggtgtcacctcttatctgaacaaatagtcagaaagacacgtttgcagtacttttgacaacaaatgcaacaatagatctcgcgttgattaactgtaaatatctaaacaatattgtttgtcagagtataaatcccaaagcgaccaattgtttggaaacaggcgctagtattttggatcaggtggtggacatgtggactacatgacactatactaacaaaaaagagctgcacataaagtagggaactagtctggcaaacctctgctgtcctggtactggtactggtagtagaatcgtataggagtatttgtatgagctgtgtttaagcacaaaaaaactgctttggccagcggataccgtcactttggatgcagcaaataatgaatggttttatatggcaaagatgaagggtgtagaagtctagaagacgagtcatgaaggaatcaggattactagctcgttattacgcgtgtaaattgtgcatttgcagtcgctttcgaaatgactgagcgaaagagggcaaatgtgcgagttctttgctcaaccgtaatctcaaccagatggtggaacatgctaccacggatgaagaggtcagaagtgcagcacggggcagggcattcgtcactcgaccgttggagtccagactccagccaggccatgcagctcccctccctccaggccaccagcgccaacggcaacggtcacttgccgctacgctgtcagacagtagccagcacactccacaagcttcttctcttctcttgcaggctccagctgcagcccggccggcctccttccctaggattcttttgcagcttccattgtctccccggctatttaacccacccacccccgcttcgtctctcatgccccaaagcaaagcaaagcttcaaagcatctctgctaggattttagcgagcggcaacgacgagcgacccaaaaaagcaatcattagtcaccatatctggtcctctcgctccacccccctcctctgcgacttgaggcaggacaggaggcacagacgtgca

SEQ ID NO: 4053 - DNA, 164 bp, Zea mays
tgcatgcctgcagccaatcctttgtcccaatttcaggcagctggtacatatttactcacactaatattatctaatcaagtgttgtattgtatgggataaaatggttatgttgtaccccttgcagatgaaattatgggcagtgccttcttagagcttatcaagtc

SEQ ID NO: 4054 - DNA, 1500 bp, Zea mays
tgcacgtgtttattattaataacaaataaaaggaagtggagaaggacctgatcctagatggtctatcattaaggaatcacagataacgtccggttatcatcgccgtgtcgatcgattggcctggccctgtataaatacgacgtccattccgatctgcctgccctgtcgcggaaagataaagtaagtacagatgctggagagtagtagtaatgcgtttcggtgatttttttttaaaaaaaatcttggtttgaccagagacaggtgagctagcctgtgtgagagagcactataaaacatggaggtaggttgatcagaatgtgacgatacgtacgattctggaaacaacattaatcaatctagaagaaaaaaagagtgggtgggcccaataacaattcgtttaagcggcgccagacgccagttccgaaccgctctattttatccaggaatgaatgaacaagctgggaagggaagtccatgatttgggggtgaccctgtcctgttttttttttacatttttttagtgcaggtttatgagcgtatgggtttgttgtgtgtacaccgaaaacatctgccttgttaacaaagcggggcgagggtgtcaagatgagtagagctcagctggtgaggtcaggctgcttttattttatttttaaaaaaaagagaaatgtaaggtacatgaatgactcgtgtacaactgctactctgtcttagtgtacaccagaaatcattttcgtgtcgacgtagcagtgcccgaggattacaaacaactacctgcatggacctgctggtctgaccaaactgtactgaactgaatcatctggtgttgtttagggaccgccatgcgtgtgtattcctcatgtttacctcctgtgcagggcatacgtgtttcacggggtgggggtgggggcctggcagatcgacatcagcgacaggaaaaagggagacgaacctaatccatctatcgccgtaatcaaatcaggaacaggtttgcgtcaggggcggcggtggcggtgcggttaattagctgttaaaacagcgcgcgtccagcgtggtggtggtggtggtgggagagtggtaggcatccatccatcagcacaagcacacacggtggttgtcgcttacctcactttacacctaaccgccggagttcccgttccacgggtcacggcccccggcgtcctctttgcgaaactcagtggcagtgatgagctggggtggggccgtgggggagtcctaccgctaccacccaccaactcagctctctagaagacctaccctcccgcgattcctcagtcaagtgcctatgcctatctataaaatccagccccgcttcacccacacacccttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgcc

SEQ ID NO: 4055 - DNA, 295 bp, Zea mays
ctgcaggctgctgccgcgcagcagtgccgctgccgatgcgtcaaaattagcagcaggggagtgtgcacagttcacggtctgctctctttctctctcttcccctattacgagtcccagcagctagaacaacacaaaccctctcctgtagctagatgtgtggtagtaagctctcgctgttaacctcggcaaagaacctactggaagtcggaagggaaaaagcaaagtaggagtagctagctagtatagcaaacaagctcccccgtgtgccgacgagccgccgactaggtcagccgcc

SEQ ID NO: 4056 - DNA, 271 bp, Zea mays
acttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgc

SEQ ID NO: 4057 - DNA, 1500 bp, Zea mays
tttttggtgtgtgtatccataacgaagcttataccaccatttggccagtaagacgtgattcaagaaagatcagtcaccccatcctgactttgagcagaaaaaaggggaatacccgctactttagggctgatttagtggataagaatcacgaggggatccatagaaatctccttgctatttattttgaatggcaagggaaccggattcctacccatggatcctcttgaatagcaaggggattcttccaacctacaccgaatccagagtcgaattcccacacccatgtcctttctttgaaatatgtttgaagtactgaagcttactcgtaagcatacgaaaaacaattccgggcggcggctgaatacgttaccagtacaaaaatatgctctgaaaaatttgaaggggctcccaaaactgagctaacaacaaaggacgaaactacgtcatccgagtgacggagagagactcggttgatagcagcatctgtgaggaaacaagataaacaagtgtgctcgtggttgatgaaaagctgatgttcagccgtttctactttgtatcctaaccatcgtcgccatcctctcccagcgctgccatatggcgggcgatgcggcaactccagacctggtctcctgttagtggcttgaccagcgagcgaggtagtcgtgtcgtgtgtgtttagggaagaactagtccaatcagtggcctgaaagctttcggttatggtaatgcttgctggtgtagacatcgtaaactaggagagaagtagctagaccccttgactcctgcttacatgcttttacctggtggtcattttggtgttgtagtggggagcatgtacttgctggccactagcgtgcttgctcgttgttgcctgcggcctgcaggcatggatggattctaaagtttatttatttatttaatttttcttttttaaaaaaatggaattttcattgtattgactcaagagcaaaatggttacttctcatatattgtaagtaaggatctctcatattcaacacgggtaatgatgctataatgataatctagatggcaggaaacgcgagaagtcagaacactggcgagtggtgatgcactacagctacaggttcctcaattctgctgattgtattcagccaaaaaaaaaaactgctgaaactgacaatgcatgtttgctcactgacaatacatgatggcaaaaccgaaaaaacaaactgaaaggacaaaaggatccaaacaagatgccttatcccccaaacactcacttccatttccatgacatgatcacaggtagaccagcatttgcatttgaccagcccctgacagcaaccccacagggtccattgccattgccaagtgactggatgccctgaaatccactataaaatcctccccgccctgtgctgaactgctcaccaccaccagaggtaccaagcatcgacacctgtcttcctcctcctttccaaccgccccaaccagctgctcaaagccaaggaagctcac

SEQ ID NO: 4058 - DNA, 257 bp, Zea mays
tccctttcagggtctcgcctctcaagaaaccaccaccagcagcagcagccgcctgcagactcgagctagaatccgagaaaagttaggtcgcttctcccatgggactatgggagcgccgcccggccggtgagccgttcggagcggttgttgtggcggcttcttgtagcaacagcttggagctggatggcgctacgctacggggctggagggacacgtgaacgcagctgcctgcgccgctgcgcgtttgggaatcggga

SEQ ID NO: 4059 - DNA, 877 bp, Zea mays
gaaatggtagaactaagaatatttgtctcatcccttgagatttccatgctattgatcttggttcctagtgtctcaggaaagaattacaatccgactctagcatgacttccatcggatcactaaaaaagactacttaggccttgttcgtttacatcggattgtacccggaatcgttccgattaatcaaagtttatataaattatagaagcaatccggctcggaattattccgacccaccaatccgacacaaacgaacaagcccttaaggtgatagtgtagaggactaggcataatgcgtgcgtttaatttgcacggaacctttcagggaaaaaaatatttagttcagagggttggagggcaagatgcctctcgggatacatatgtcagtacgagattacaatgtcctaacggccaaatatactcaacactgttaaccttttttatagggtggctaataaaaaataacatcaactctggcaacaaaacctgtagcatagaactgtctatttaatcaggatttccattgtcgatgtaaatcatgtactacacyagtatctgttatctgmtgtgaatttaattcctttttgcctatgaacatgtcccagcgtcascttatagagcaatgaaattagcagttgaacgaggctaatatatatacctaccttatgtcctttttatccctgtccaggaggagtacgctgatggagacgacctcgggargctggactgcgggcacgacttccaygctggctgcatcaagcaatggctggtggtgaagaacgtgtgccccatctgcaagagcaccgcattgaagaagacctgaaacccgaacraaggctcgtgtcagagacaycccccatgtttctatgttcactcg

SEQ ID NO: 4060 - DNA, 573 bp, Zea mays
ggtgtgtcgtccccttcagctgggaggcttgggaatctctagtctccctgagctttgttgggctctccgcatgagatggctgtggttgcagaaaactgatatggggcggccttgggcaaaccttcccatacatgtcccaaacaaagctagggcttttttctctatggcccttatttctaaggttggggatggttcaaacaccttgttctggaatgatagatggctgcatggcactcgaatctctgatattgcccccagcctgtacaagtctattccaagaagaattgctaacaaaaggacggtgaaagaagcacttttgtaaacaggaaatggatttcagatattaagggggctcttacagtaagagtcttggtcgattatctaaatctttgggaatccctctcagggattgagttacagccaaacataagggataaacatgttttcagccttgcttctgatggtaaatacacagcgaaagcagcttataatggtctgtttttaggatctgcctcctttgatcactacaaaagaatctggagatcttgggccccctcaaagtgccgttttttc

SEQ ID NO: 4061 - DNA, 148 bp, Zea mays
ttgcagcttcgaggcgtaacagaacacgctgtacacgcactccctccgccagttctaccgcggctgcgacatctacggcaccgtggactacgtgttcggcaacgccgcggtcgtgttccagggctgcaccttctactcccggctgccc

SEQ ID NO: 4062 - DNA, 255 bp, Zea mays
atgtccaatgaaacaaatattggtctatttacaaactaaaaacttactatagaattgtatgcttggggtaaacactggcattactgatcacctaacgcctttttaaccctccaggatccagtccaaagtagtgtgactgttggagtttcacattttgagagatgctcgctctgggttcaagttttgtattacccgttttatggaagtagtggatcaacagactatgaaggagattatgcagaagaggattcacag

SEQ ID NO: 4063 - DNA, 236 bp, Zea mays
tgtgtgcgcatggtgctggtcactagctagttgagtggtgtagtgcgtgcgttagttgcgtgcgtgcttgcatgctggaaggagtggccgagaagctagcgcctagtgacttgttcgtgtgtgtgaggaggttgcttgcatgcaaagcaacatgagttatgtggctcatggcgtgaaggctgggtagtggactagtggagttcgtagctctctgtatattcagtctataaaggcac

SEQ ID NO: 4064 - DNA, 347 bp, Zea mays
tatatatatatatatagtatttgaaaaggaaaaagctgcagaggacaataatggtcgcgcacacacacacacatgcatgatgagttgatgacccgcatgacatgaagggctctgccggcctataaatgcatgcttgcttgtgtggtattactgctttgctaataataataatcaggactcaggagagcgagcatagaagaagaaggcaacaggtacgacaggcacagtagccatctttcccatcctgtagggttagctctttcataagcttaggctagctagaggtagctctccatcctttgggaataaatagtaagtgtttgggacttgggagagggagaggcgtc

SEQ ID NO: 4065 - DNA, 864 bp, Zea mays
gtttgggatatagatatagttgagatgctaggtacgggctatcaaactgttaaaattagatatagttgtttgggattctctacctaagaataaaaatagggactactccttattcctcgtgccattactaggcaaaaaataaaataaaatgagaggaaaattcttctacaaaatcggtttgtgacgttatttgtaacaaaaggatcttctcctgctgagatgctaggtactagttacaaaacagtactaaaacctgcgcttctggctcatgctgatctgtctctcaaatcttgaaaacttaaatgatctacagaagcagccacaaggaaatgcgaaggttctagaggaggaaaggaataatattttcagtctccaggcaaaaaatgacgaagtcagtccatcttttcaagcactacattacattttatagcctatagagtaaatgtgatctgaaatttttttttgtccttactcttccatttgtatgctatctctgaaattacttgcagctatgttgtgcagtagtgggaacttttttaggttctggaaggtcagggtgagttggcttgggttcagtcggtgatcttgttttctcacgcatggcttgtggttgcagggatggacttccacgaactgatcgagatctcacacggcgaccgacggcggtaacaccgctgatatgcaaatgcaatgcatggtagatctgtgtgccgatctgcccggatatcgtcccgccatgtatgtttggtccaaaattcttattctttcccttggttcctcagcagagtaatgcattaaattgcccatatgttttacaggtaaatgaatattcttgtggtgtagacacactcaacatttgaggaa

SEQ ID NO: 4066 - DNA, 171 bp, Zea mays
tgcagaacaggtaattatgtcgctccagagtccagatgcatacttatgttcatctttggccttttgtggacaaattgtgactaatgttgatgtttttaggcattggctcatccatactttaaagggctagccaaggttgagagagagccatcttgtcaaccaatcacaaag

SEQ ID NO: 4067 - DNA, 683 bp, Zea mays
ttcatggtgattttgcgatcgaaagttcctttcaaaaaaaaaatttgcgatcgaaagtcgaaacagaaagaaacgtgatgcatgaaacaaattgcaaccgtgtggaggcactggatgggagtccaccagcactagcactagcactagcacagtaccactcgcgggaaatggacgaagacgggatccttcgtgccacccaaatcagggacaaagtttcaagtttctactatgactgattgaccgcgctagggttcatgaacagagtgggagggagttttagctcacgatgatgcggtcgcggtcggcgtggctggagacagtggcgagtgggtggaggggagggagccggccggtccttcgacaggaggatacggaggccagcgttcgacaccggaggcggcgagggctcggccatggtggcgtgcgcggtaaggcttacccggttgagtctgggcgatctaccaggcgcctggagagggtcagcctttgacgcggtgccgaacacaagataacagcactgggcaagctgcggcggcgaaaataggctacgaatacgagcacggagggaggggagaggctcgccgtcgcagagcagaaggaacagatgcgccgtgcgcggcggcagactggcgagccgtcgaggagctcgagctgaggaatgaggaaggagaaacacaagacag

SEQ ID NO: 4068 - DNA, 1319 bp, Zea mays
ctgcgtaaatgctgaaggattatagcttcaactcaagatggttacgaaggtcaaacgtgatatcgagccagagaggaaaagacctgttagtctctgatgcttgtattaggataatgtgtatgcatcaaggtcataaatgtacttttacttgggccagtgctctcgtactgttcacgctggattgtaattggattcgtgcttttgccttcgaacaaaccgaaggtacaaatgtaatatacattatgtatcactttgtcaatatatgatatggatcttaatgttgtttaacatttaatatgaaatgaataatcatcataatgttacatctgtaactatatttttatatttataaatgatgaagacttgttcttcatgaactttgtccgatatccattatgtccgaaaggagataatgctttgaaggacgaagatctttaatgtttaataattatgttgtcttgttttataattcagtaataaaaaacaagagaccaacaaatacttcataaaaaatctcatatcttggcattttaatcaattggtgccaatgtaagattagagtttgggatatttttttttgacttttgaaccctatatagaataatcaacgatcaatcatgaatccgtgagattgaaaaaaatatacacatatatataatacaaggactagtacaccacacactatggctgcacatcaaaagaacacacactcactgtgtgtcgccgtgtcgcactagtagtttgcgacgatttgcttcgtctaaaacaacgataaactcaatgatttgtttcttagattttcagcaaactacatttaacgaatagctaacgaatagattactgaatggtgactaaactaaaaccaattactaaaaatacatgccatacattatatactcgatatatataaggggcctcgcagtttcgtagcatgtaaggaatagttgatttgcgagactagtaaggggttttgtggaaactaaccgctccaccttttgaaattcttcttcttcctggttttttccgtgtggttgctttgctttgcttagcacaggcacagcgcagcacatgaggagaagaagagggagaagagtaattatttactaattaacaaagaagagaagacttcttccttcctcgtcgtctccagcccattccaattcttgattccatcgccccaccatccaccactccccgaatccttccaacctcctcgtcgtccagtccaccacctccacgcgcaatggccagcggctaggcggcaccaaccagaaatcacaaggattcgtttcatccggcagcgcagctctagagcctcc

SEQ ID NO: 4069 - DNA, 1500 bp, Zea mays
cctcctcatagttttgtcatgatccatccatcaataatagcccataggtcatcttcccaaagtcaagactcgtaaggtaaataaataaataaatacagttactaatatttattaccataacaaataagtactattatattgtttttatagcgtactagtttgatgccatattagtttttaaaaagttttagttaaactacgatagttttaaatctgaccagatataaaattccactctttttttttccttgaacagagacgctgcgccgtagggccaaggcaaacagagacgctttccttccgcagacgtacacatcacccgacgcaccaagggggccaaaagtaaacggccccggccgggcacagccgtgggccacaccacccccggccgcgccattatcctgccggcctcctccatccacttgctgcttgctcaatcagccacagaccgcgcctacattgaccacgacgttaatcacagcctttctaagattatcatcgattataaatttcatatactccgtatgtgcgatgcgagatgaggcccgaaaatatattactgccaagatgagtgtgtagtgctcttcgatgcacctgccactccctccacaagtgcccactggaaacgcgaatcttgggcgcctgatcggctgttgctttcgcctttttccccccagatctgcaatatgttcccggataaaaaaagggtatacaactgttaggagaacactgccatgaaaatccagcagcgtcatttttcattaaagaaaaaaaaccttgaattttaactgccctagcccctaggttagagttctcgacggtcaagtggtttcttctcaaggtttttacatgtagatgtagccatgtgggagtaattaatatagtaacaatagacaattcagtatgcagcagaaacttcatttgacattaggctggtaaccatggtttggcagtacctgattcagaagatatgcaggaatatatgcaacaataaataacctcagcatggcgcaatattcaataccaacctgggctctggaaaaagatattctgtggcaacttccgaagtttgatgacgacccagagaaggataacagctaagccttcgtacagcgaagttggacttttgcacgtagagctgtagcgacccaagcaaaacgtcaaacatgtgaagtgggcaagaaaaaaaaaagtattcccgattttttctttcctttcctctctggagattgtattgaaggggggaaaaaagaaattgctggtggcaaacgtgtaagtaactgacttggatggttctgcaacatatacctttgccactattcctcggggaacaagaagacgaggaaagatcaaccccaccagagagagcaaacagcttcttcttcctcttcctcctccatgctgtcgtagaaagaacctctggttctttagctagtcagaccaccaaaatccaaactgagcggtctcacagcgagcggcaggacgtttcatgagagaatc

SEQ ID NO: 4070 - DNA, 260 bp, Zea mays
tgggcatatctagctgtttctatctcaaaagttgggctgaaccgtgctccctatgtttctttccataggacgtattaggatctgtataactttttaaaagcattttttgaccaatattttttttattatgaatgctagtgctaaaataaaattatattaaagatatgttaaatacacatatattgatataacttttgcacactgagcatgtatataatttgactaattgttagttaaagtttaagaaatctgaccttttc

SEQ ID NO: 4071 - DNA, 279 bp, Zea mays
cggtactttgcccactttggatctgaacgggcaggcaggcagatcaacaagtcgcagcgcagtcaagcaaggcacgtcggtccaagagcacgacgagcagacgacgctgccggcccggccgtgctgctcctctgagtccgagatctgaaggcgcggcaggaaggaaacgggcgggcgagaggatccagcagccctcccccacgcgcgcgcgacggttagcgcgtcccagatctcggtgcggcgcctcccgcccggccctgccggcgagagcgcggcccg

SEQ ID NO: 4072 - DNA, 876 bp, Zea mays
ctgaaagaagcggatacaatagagtatactgtagcggtagtatatattttttctttgacttccttttgtagatctgccaaacacaaacacaactaagcaatgtagcacatactattggcatgaccctccactcatttacattctaaattggatatatttttatagttcctgaatttgatcactcctaaatactttgtctgaaatatgttacttttttgcattacacttacagtgaaaatgtcaactgccacttggtacatgcctcataaataactaaagttgacctcatgttctgtgcaatattgttttcttcacttggtgaacattaaaaaagccttattttttatgtagcattgcccaaccattataaaagggtattaaaacgtgcgcgagattgttgcactatttttctccattgcttctgcataaaaacatttcatgatagtttgttttttatggcggagtatacatcttaactccgtagcaacgcacggttataccgctagtatacatcttttaactttattttgtgacaggatcaaatgctttaagctgggaaaaatgatctccgattcttccgaaacacatggaggtgcgatgacaaatgcattttgaagcacgacttgttgctatgcttccttcatacgtgtatgtgcaagatttttaggaaatttaatggatttaaaattgtgtgaaactacctctaccatttataattgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggaggga

SEQ ID NO: 4073 - DNA, 459 bp, Zea mays
tgattgtaattcctcacaggctgtgtcctgtgcctataaatagtgaacagtattcttttactgttcacgcattcctgtaattgctaacgcatcactcgggaatcagtgtttgtcaaggcaaaggtataaatgtacctaaacgttgtattcaaatatcttaaattcatataataagatatgtgaatgatgtcatttattttcgatgtatttatctttaatgttttactctactttgtattatctttacaagtttaattacgaaggtgaaaccttcgtaacattatgctcgtgaccttcgtccgaagttcattaaatccttatggagataatgctttggcggacgaagggcattaatatttaacattttatgttgccttgttcttaattcatagcatttgagaacaagtccccaacattggcgcccacctccggtgaactaacttccacttttttgagctg

SEQ ID NO: 4074 - DNA, 1500 bp, Zea mays
ctttgctctttttggctcgacttcatatagtccctaacacttagaaaaatataattagtacctaaaacaattgactaagtactagaagcatacatttttcacttggtaccatatagatttgtagtatgcccattttcaaggatgtttctggcactctcggtaggtggtgtgcaacaacctatcctgtttatggcactcatagagggcgtcgagtttgaaatcagacacattgaggttgtcgagctcatcgacgaggatgttttgcagcttgaggttatggtagtaggcgtcgtgcctgtgggagtactcgaatgagtcgatcaactagtgaaagtacctcttggtggcatcctccttgagtcagcccctagcgattgaaagagatgtaagtgttcaggatcctcgtgcaacgcgaacgaggagaacataaaggagggtgtaatctgtcgcattatgtgctttgagttgtatctcagtgagctgagcctaggatttgttcttcctcatggattggtcggctcactagtagtagccgactactaataggtatttgtgttcgattattggttctaattaagtgctatttctagtgactgtcgagtagtgcaacatgtatcaatattatggctttaccacataccacacaattattgtttttggtatggaaacccggtgatcaattacttgagatgtcattgaatttgcatctataattggtttagtctattcaagaaatcggctacaattcatacatgagcatgcttttggcctcacgttagttaaacgccaggcccaatgggacgctccagtgtcacggcatgagactgagcagaaatgatgctgagtcaagtagactataccgaaacagtgcttgactcctagtcatagatgccagtttcaagttgttgcgcctgaaacgcatttaagagagaatcggggttcttgtatttcacccctgacaacgactgggctctattcattaaatgttaaccacaaaacccgctatacaataaagataattacgaggatgaaatcgatcaaaaaaattcaaggcaaaccaggttcgttggtcactaatggtactgtacccaacaaaacagaagggaaaaggtcataagttgcttttgcaaccgaaacgagagtatacaacatcttttttattgctatattgccaaaaatatttggagaataatttactttgctctaaaaatagaaatacccgttaacattaatcatgttatcgggtcttggcaagtaattgtgatctgggatacaaaaaattacttcttactggaacatcagctttattttggtctatttggcttaattgaaatgaggtggcttttaatcacaaaccaataccatcaattgtgcaggtcattttcagaggtactcattggttcaggttctggagactcctatagaagaaagaaacacatcaacaaattctcgatgtgtgtcaagcctttgaagtggtggcgatggaagtctttgtgaatc

SEQ ID NO: 4075 - DNA, 193 bp, Zea mays
acgtgcaggagagcagtggttgtgtgttcatgaacggattggatttgttgaagggtaggggtggtggcagggcgggtttgtttcttcctcggcgtcacgcccaatgcttatttatgtttttttaagaaaagtggcttgaaactttgtgtctgtattccaatcaatatgaatatatgaaaattgggaaatttgc

SEQ ID NO: 4076 - DNA, 1449 bp, Zea mays
tgaccaaatctctatacttttctctgctctcttttcttctttccaacttttctccgcttcaaggttttccaatcaaggaaaaaaaatgcttacgtgctgacgtcaaaacttagaattaggggcatgttgatgttcaaattgaagcatcaaagaaccatatagtgccgccggccaacagcagcatcaaagaacaatattgattgtcttgcaaagtgccgccggccaacagcagcatccaagattctcttcttctttttttttgtgagagggcctctagccgagttagttaggtggtctgacattcttcgggttctgggttcgacttgttgtggaagcgaattttagctgtggttaaaaaatcacctcaactgtctcacgccaaatcctatgtgaggaaatcttttcttaatataatactcgrggctatcttatctcgtagatcgatttttttaatttctttttctcaatatattccttttttttgtctccacggagtgaactaatttagataaagtttgtgttaaatcactaacatgttgtttttactgtatttaccccatctttgatgttcgccagcctcgtgaagacagacaccctcgcagacgtcatttctttatgaatagtaagatgcatgcatcatcatgtatgatttaatcacagcctcaaggaaggactgaacggtcacagaaagtaccctcagtccataaatatatgacacgttgactttttaaaaaaactttgactacttgtcttatttaaaaaataatgaattatcatttatttttatgatttattttatcacttaaggtagtttgtacttaactttaaaaataacgagtgatcaaagttttttttaaaaaaatcaacagtgtcatatatttgtgaacggaattagtatatatttttgagtaaaacacaaagactgttactctttctttagttctgtaaaggttgcaatatatatctaaattaattaaagaatctataaagttaggaatgttggctctccatagacgcgttacaaaagctaaatttgaacacttgtgctaaagttgtggctgcttctgccaaatgctgctgctagtacaacagtaaaatggtgctctacacaaaggaacaccctcagtattactttataagttttggtgcctatatatatagtaattgggaacatgcctgaactaattcaaacatatatgtatatttacaatggcaggcgtagctttttcagagctgtgcgaggtacaccgtgccaaccctcgtcgtgccatgtcacagctccagagctccggtgaggcacacgacgctcctgcttctgctccttcgccgacgccgtctccttgagcttaaccagatttttagacatgatgatgttattggtttatatataaatgtataccagcaatcattgtttagacagttatacattatactattgttacatgtctt

SEQ ID NO: 4077 - DNA, 1492 bp, Zea mays
ccactctcatatatatatggattaggaccaaattaaagatacagttcttcggaatgtgtgatgatctatacttgacagatatatatatatatatatatatatatatatatatatatatatatatatagtatttgtttaatatataactctgctagtatatatagtatttgttctgaattcaaaatcagtatcaatttataagtgttctctctaaaaagaaacatatatatatatatatatatatatatatatatatatatatatatatatatactttatgaccccataataataaaaaaagagatacggaagtgtactacttgtgttctacaagaagcattcgtatacaatcttcctattaattagcgtgcctaaccgtaccatgcatgcaattctacacgtcagaatatatctctctgttttttttttgttgttctggcacattgaacacggaattgcattgggttgggtgggagaggaagaaaaaaagagggagaaatgttcttgacgcacagatcgacggcggctgtcttgtagtacccccaaattcgccattctcctatgagggcgggcggccgcgcgcgagcgagaatcgatgctccggattttgatgtggacctaaagcagcgcatgccaatgaaagcagagacagtgggaattgcattggattttagttctttatttcgttcgttctcagctcagagagagagagagagagatatgaaaaaaaacatgatgcatgttcttaaacatggccctaaatagaggccgagtgctcgtcaaaggcagcatccaatgcccctacagtagaagcgattgacgcatgcatgccccggacggatcggaggagggagcgacggacatctaatcaaacctaacgacgacgacccagcctgcttgccaaaactgattagaaaagatgcatgagctgcttttaaatgttcttcgatccacgagagagctgggtattcttcatattctgttcgcttggctagctagctgcacaatttgctcgtcatgcatcaaacatgcacatcttccagattgcagatataatattctcatcaggccagggtcagcaaattaaagcaaacagtgttgtccggccgtaagcatcagcaggacagcagctagtagctactacccaggcagccaatggcttctaattaatcatgtgtcgtatagctagctatacctgctgattccttgatcacgtactactacgtgttacgaaaacgaaacgaagccgatcgagatcgatgctttcagatgccatgtatgtagtacgtgcatcaccccagcacctctcgagcgccactataaagccgtgccatatccagaagggaactgctcatcacacaaattaaagccgccaagagtcccagcagatcgatcgaacagctagctagctagctatatagcgagagggctccatccatatccatccatctgctactgctagcagctgctggctgttgctgcttgcattgag

SEQ ID NO: 4078 - DNA, 1367 bp, Zea mays
gcccaatatttagtatttatatcataatataatatgctagtttacactttacaaaatttatccaaccaaataatccagacacacataatctttactaaatccaccaaacaaattgcactcatacttacacaacatcaaaatcaacggttcatatcattgaataacatcatctctcttgcgcactcaaatctaatggacaatattattttgatcatccttcagccctccccttctaacatccacaccgccgtcaactcttcccctcgcgccaccatcgtcgtcgttcaccccactcttgtccttcttaggaacgtagcattagcacgggctatatactagtagtaaaataatataggtagctaaaaagccggtaggactgggcacatggaccacgcgacacatgttgcccactgcccggtcatcacgctcatgtcgtcgcccgtctgtgcgaccataccctccacgtgatcatcgttcgccatctcgccaatccaaccctccaggattctagggcgctgggcgccactgttttattctccaggcacgcacggtcgagcaatcaggattcatattattttgcggccgtcgttcttatttctcaacttgcaaagtgctaatctgcaccgatgtatattatctagcgtcttaaatattttaaaaaccaattttaatgcacatcatcatttacatataaagtactaatttgttctactrtatatcatagaattttttatatagtctagagggtccaccattataaattcgcatggggtcctcaaaatcataggacaggggctgcatgagacgtccgctagctagagtcccctttagtcctgattattattaccaaccggtaccaaatgtctccattaatctcgattagctgacacgagagactaaaatgcgaggcctttagttcgaaatagaaagttccagttgggaaatcaggaccaaagaagtttttaacagaaactagatcctttccgcactagtaggattattttaatggggatgggcctcctggtcctggattcttcactttgaccttattttattcatttaccccaatggtttgaattggatctggatggcttattttggcctttattaccggggggtggaccttaacccccccccctttttattttgttttccgccaggcattcaacctttataattaaagcctttaatttaacccccttttggttggggggtaaggggtacctattccacatatgctgtcacatctcctttttttatcaggagagcactacgaatgaagcaagtaaagggcctacaaatagtccattgccggagcattgttatggcaaattcaggtgaagcgaagcgaagcgaagcagctagca

SEQ ID NO: 4079 - DNA, 1190 bp, Zea mays
tttcttccctttttctcctcctcgtctcccttctctctctcctgcgtccatcctctctctctcatctcatctggttgggtggagtggagataagctagagaggtgagctctgtgggatcggagcgagagcaataaatagaaattaaggtcggggccgcctccatggcggcgtttgcaggcgccctcgaattcctcccctgaacccattcgatccgccccctagctctctctcttcctcctccgccctctttatatagcggtagcctcccacctctcatctcctcatcaccccccaaaaagcagcttgcttgcttgcttgcgttctctaccacgacttatgctcgatcgtaaactaacctcagcaccgtcctccagcagatactacttgtgtagcgggcgagggtgaggtgaggtgaggaagaaagagagccctcgccgcgtgcttaggccccccccaagacgccgagagaggaaagggattaggcagcaagaggaggcgctccgctctcggattagaggcgagcttcctatttccagcaaaggcaaggtgagtagcactgrtagcagtactgatgagtgagtgatggtgcggtggagcactgcagcggcaggtttatctttctcctctcttgctcactcgcacatgcatatcccactcacaccagcagcagcgagctgaggctaggctagccatcctcatcctcaactcctacgcgcttagcttgcttgcacaaacctctctctatgtctaagagcttctcgctgcagatctaccgccgatccatccgctaccgagctatgccaatctatatatgcagctcatgcatctaacctactgcatgtcacacagccccagccccatgcccgctgtaccgtgccgccgtgttgttgcttttgcttctctgcctgcgcgcaccttctgcttctgcgccagcttttttcttactcccaagatctctatttgtttttttttccgttgttgctgtaggagaggatcagctagctagctgctaggaggccggagggagagaaagatcggaggaggagctgcaaaggctagcttttctttggtgcggctggtgctggtggtgaactggtctcggtgctcggtggtgcgtggtgtggtgcacactgcacactctccctctcgcgttcgtcttgatggtgggtggtggtggcagctgcctcgc

SEQ ID NO: 4080 - DNA, 770 bp, Zea mays
tttagtaatttagatattaaaatataataaaatgtagggactggacattagttactagaaacaacatgtgatgacaacaagattttttcctataatctgttaaaaaattggcagggtgtcctatatataatgacggagtgaggagtagaaacccatcgcgtcgacgtgtcaatgcgtggtaaaatttgtgagcccaggtggcatctgcttacggcacgtgtgcacctgtctccgcctgtgtgcagcacaaagtggttccacactgtttgtatcattgtatgaggactgtatgtaattcaggtggaattggaatcaagcacttgtgatgggcaaaagtgtgagagtagtgctcatggcaaaagaaaagccaagatgaaattatattgtctaatgtctattaaagaaaagaaggtcaagtacagcagcacactgccttttttatggcttgacaggcttgttactcgtaatggcaccaatggagcatgtcggctcacccttaacctcaacgtctctctcttttcagttaagcgcacctggtagcttccttcctgcaccgctcgtggcagggaatgtgtaaagaaaaccaaagccggaacagagcggagctagggataaagaacatcaaaagcagtgcggagactggacaccggaggcatgaggcatctttctcatatcacaggtcacaacagtccatttcagtctcagcgctgtcgctcaactgctcaaggaggcacggggctggaaagggcaagaggaggagaagctgaacc

SEQ ID NO: 4081 - DNA, 1500 bp, Zea mays
ttttttttctttcttttcatcctttcggggtgtgcaaaggcgccaagcaaagtagaaacgttcacgacgcaactcgttccgtctgtcatcgtccgcgcgcgcacgactgacagccggcacgcagggctgtctgtctgtgtctggcctctggctccgctcgcttgcgttgggaccacgatacccgcggccggcttgcgggtgcccgacgcgcggccgctcgccacgtaaagccggcacgacggcgacaccacgcaaaacgcagtaacgcaccgcgtccccgccccaatcgcgcatctcgggatccgcgcggccatcaccgaggagttgtcgcgggcgcgggccgggcgacgtgttcggcggcctgggacgggacatcgctgtcacagagatcgcgctgccgggggtcctcggattcgcgcgcaagattttttttttctttccttgggcactttctctctcgcgcgaaactggagaactgctttcctgatgagcctcggcgtcgatttttctgccagttcgctttcccggatgcggtcggggatgacagtgggggcgtggcgggtaaccgcagcatctcgccgttcgtgctgtgtcgtccggtgtcaccttttccaagcttctgtccaacaccagctgcaggacagcaggagtgccaactgttcgccgctgcgttcaggtttctgtttctcacctcacctgccgtttttctcaagggcccagggcagctcatgcagctaagcattttacttaggccaccctctcaaataatgctcgcaggatatgaaagcggcgacactaaacgctgaacgtttctagaaattagaaccgactggagatgaaatttactcgcggaataggatggcttcttcgtagatacgcagagtatcagtactaaccatatatgcaaagcaaaacagtgacattctgcgccttgttcttgtacaactatacatttgactgcggtcgtggacacataactgtaacacaaccattacttgggcacatacgaacaacttcaccatttgacaaaatatatttaccagatttgacaaacgtacaactatgcatgaagcagaaactatggaagctctaactcaagaagatttctgcatgcaatcccacttctcagggtagagatactcaggtgcaaactgctttggaaggagatgagaggacttgatggattcaatttccatccataggaaagatttaggttgtccgcagcaaatcgttgtaaaaaagggaattatagattacactctactgtctatagagtaaagtgttgttatggatatatttgagatcgtgatttctatgawtaaacatattttatatgtcatcatcataatgttaatttatggaattaaaataatacggaaaatgcctatatttctaacaatccaaaaacctaatgttaggcatttttctgtcagaggttttgctgctgtgctaaagcctgatccttttgatggtaaaaacttcttgatatggaaagctaaa

SEQ ID NO: 4082 - DNA, 324 bp, Zea mays
ggtaggtatgcctgtctgttcatccagtcatccaggatgtatctatttctatgtgtctcctgtatccgtagttccttcctgattcgatgttattgatcatctatgctctgttgatctgttcctctgttcctgctatgcttgatatatttttcactacttccacgctagcactacttttctatactgttgttgagttctcaggcaaaacaaacactaaaattaaactcatggctgggtacaagttttaactctctccgtcttggcatggaattgaactgaaggttttcgttccaacgtcacgcaggggagccattcctgtattgg

SEQ ID NO: 4083 - DNA, 295 bp, Zea mays
tctcggatttaaagtgatgtggcacatttttattggtcaaaaactcgccacgtggagggccacatggggctcagccatagtggatcgtggaggtgggatccggtgtggctacagccatgcatgggctacaggtcgaacggcaacaaaaggcacatgcaggggagacgcatcgcgcatgcaggtgggggcacgggaggttttttccagctttcgctgcatgcaaatcaggagttcacaaggcggttcctaattccacttttcctgcaaccgcacacacgcatggacgtgcaaccgc

SEQ ID NO: 4084 - DNA, 665 bp, Zea mays
ctgagaccagacagctcgagtctttatccgtcgccyccacttgacccctctcgccactccctcccctccatcaacaattcggtttcttgggtgattttttttcttgcttgctcggtttcttgtggggcgggccgcgaaccggcgaggcgggggcgcggggcaacgcaaagcagcgcaggggcaacgcagtgcagcaaaagcttcgatctttatccgccggattcctctcctcccctttcctctctctccgtctccccgcttgctttgtgcttcgttgttgagaggaggggagaggaggggagacccacatccacttgcctttctcctctctcctctcgcagccccccttccaactcctcctggtccctggaaaaaggagaccttttggtgcaagattcgatctgctgtggctgcctcgaccttgctgcgtgcgcggagatttggtttcttggctggcgcgcgcgggcagttggagctctttgattcaacaggttcagattgcagcggcgagcgactgctctgcggtcgaggctgctgctcgccgggtgattccgtgcccgctcttggtggcggcgggcggtgtcctcgtctgatccgtttcttcgggaggctttggttgatgtgctgggtttcctcggagctcagttccccaattcgccattttg

SEQ ID NO: 4085 - DNA, 1500 bp, Zea mays
tctctgtggccggagctccctcatccggtcatcccctcctctcggcatcttctccctgctgtgctcgccggctccctgcgcgcagcttggccgcgtggctctctggatctcgcccctggctcggatttccttccccagccgagatccctccctgttcgtctctgctccggtgttaggtcaagctccccatggtgccgtcgccctcaagctcgcgccctgctctctctgctctctctgacacgcgtctgctctagctcgccccgccgtcgagctcccttgcgcacgtgtccctagcccctgctctgctcatccatggtcgcacgctcctccggcacgcggagctcttccttgcttccgttctggccgtgccctggcccctgctcatacggcgctcggactaccctactcccagttttctctgccccatcttcctcagcagccgtgcggctcttcctctgatccgcacttcctccagctcacctccactccctgccctttcttctgcttgattcgctggagctttcacttctcctcccatggcgcgcccagctgctcctccctcagctcggctccccagcgccctgccggcggccccctagtgagcacccgtgacttccccctccagttccctgcttggccaccccatcgccatggccgctcttctctgctcgcgatgtgttgctcctacgcgccaggacctccaccgagttcgtccgtggccgcgggatgcagctcatcccatctctctcacgccgttttccccagccacaccgtcgcgctagttccggatctcccggcgcgcccctggagtctcctcgccgcgtgcccagccatcatgctcccctgcgcgcggagcttttccctccgagttcgccctacgcgcagccgcttttcctctccctgctcggacgacgctgcaccctgatctttttcatcgcaggtgcccaaaccatggcttctcgatgctcggccctgagcacacgcttgctcccagggctggtgcacgtgctcgagccatgggcgtcgtcgaactcgcctagttactcacctttcccttgcttgccggcgtctggacactgatgaccgttgttcctgctcggtctccgttcgtccgagctttgtcttcctgtccgaccagcaccttttgccgagtttgctgttcttcatcgcttccacaccatgaacccgcccgtcgcgtgctctttagcttcccacgcacgcacaagctccctgccatggatgcgcatgagctcctcacgcgagtctctggtgcccagccccttccccagttcatgtgccaatgccgtcggtcccagtttctcgctcacgaggccttcccaaaccgtcgtgtgtccctgcgttcaaccttctcctgtcgtggagcctgtcctgggtgccgtcagggatacctgaaattggagtccaaactcgtccccttatgaaatcggtagctggtatgagtatatatttataaatctcatgtgaattcatccgtggctg

SEQ ID NO: 4086 - DNA, 1500 bp, Zea mays
atcaccattcaccagtcactaccctacctccctacagcgaatagcaataccgggtctgggtggatggtcacactgtccatgtctgcagtgcagacagacagaagatgcctcctctctatcctaccggctgcagtctcgccaactaattcctcggtgcagcttagctaaccaacccctcgaatctttaatcattactagtatttttttctctatcgaatccaacaacgaaacgaagcgatatagttttactggtagtcgaaagaagtagatctggacatctggtgagctagcgtgtgcatgattgggtggcactgggggttcaggtacgcatgtgacgagtccggggcaataattctcggtcacaagcggacaggatgatgcgcatggagacccaaaatcccctgttcgactaacccgacagctcaggaatatctggatcgcaggagatgccatgccagtgccacacatcgcttgctcccggccggggtggttttggtactagttgcactgatgactggttcgtcgcggtctaaacttgacccggttgcccccctccttttttttcttgctataattaactgttaaagctcgtgtgagttgtgaccactgctccaggaaaggatagccgctgagatgctgacacgcgggtccagctgagaggtgggggtacgtcctacgtgtcagtgctggagtggggagtgacgggcaacagcgacgtgaccggacgcgacgcgattagcgggcgcatcgcatgtgcgagggaggaacgatgacggtaaggagacaagacaagcgtatcaactgcagcttcctgcaggctgccggggtgggttgctgcagtaggtgccgctgctggccaatgccaacgagccatttgcccggttggccgtggtcacctggcgtggctcttccggcctgtggattatgtgggcggaaccgcggaaggatagggatggagcctggaggaggggagagacgcgtccggtgacgtcccctgtccaccgttttgagtaggagcgctgtcaacgtggcgaggattcaaggaggacagacagtccagggcaggttgatcacaatatcaactgtttgttttaggtaggagccctgacaacttgacatccgacaccgtgacattgaggtgtgctccggaggcttctctcggatagttttattttggaacttgattgctggtcgaggtgaaatatatatactccatgtcctgattgccgtgctacccagaggccacactgcctgaaaagaaaagaaaaaaaagaaagatgtaaaagaaaataaaagcaaaggaaaaattaaaaccaaatttgggctgaattcactgatggcccgaaactgtaccgtagaccccaacccacacatcgcaagagaggcccagcccagaagttttcaaaactccgacgtataaaaaagaccccagacccacagtcccctcctctctctttccccccgtgtcagtgtgtcacgcttcgaccacgcggcggcgcc

SEQ ID NO: 4087 - DNA, 796 bp, Zea mays
atccccctgaagcaacgcagcccaaggaagacaagacagcccacttcaagaatacaagagtgaccggttcacaatgggcctggagtatatgggctccccagccagagaagaatcccttgtatgatgagacggggtgagggagagaggctaatgatcaaactatgtactctctagcgtgatcaaactatgtaaaacaatcttcttcccatccaagacaagccgacctcggtaatccaacctatcttctctcctccaatcggcgtcggacaacgaggatgctgacatgaaggctcgtacgtgctctagttgtacacactcttcatcggggaatcttgttgattcttaactgaacccgtgcttgttctgaacttggtcgtaaaggatgcatcctcttgattcttaatgagccagatttgctaataagctttgctttgatggacggtttgtgtcttcgaggagggaaaatgactaatttgttatttatcattttccttttttgtaaacaaattctctatatctggtgactggtgttgctcacgttcacaaagaaagacccgacaacatctaccaccaaaagttccgcaatttatgcttttttatgctccgtcaaactgcccaaaaatgggcagcagtccgatcgacgacgtcgatgcatggcgcttatacaggaggagaatgcttggaagagaatgccacttgcccaaatatagcaacccttggggcctttatagccgagctctgtcatgaattaatcgatttcgtagtaagtcctcgaccatccctgcaaattaccgcg

SEQ ID NO: 4088 - DNA, 464 bp, Zea mays
tattggatttgattgagtaagtgagagagggttatctagcaatctgaaccatggtgagttaagtccgtgtgtaatttgtttagtggatttaatggatgttatgagtgtggggtaatttggttgggtatttttagaaactttaattttgtggattatatagtgaaattagactataactagaaactcactctccaatatagaaccacacaagaatactaaaccgcgattaggaaactaataaagtactaaacgggcacaggccagtctcagtgagacgactgccttctcagcccagagtttagtgggccgcgtcgaagcccctccagggtaaaaagagggctacaccacgggcctgctagaatcgtggcgtctccctggggataaagtacttctccagctcctctgcgtcttccgccgctcttgctgtcctctgtgctatccgctagggtttatctgctcgagga

SEQ ID NO: 4089 - DNA, 672 bp, Zea mays
cctcgctctaacctgacacctggcatattatcaatttatcagaccacatatatacaaaagccattattgatacgcgaacgattcagaaagaaaaggaagagagaaaaaccactcgctcctgtgtgtgtacatatatatatgtctgtgtgttgtgatttttttctcgtcttgttaatttgttacgcagaaaataaacacataagctaaatgcacgcaacacacgtgttgataagatttttgtgtaagggataaagagccggcatgcactactctgtaagcagcacgagaaagcgaagtgttatcgatcgaataatcgctgaggaacacacgtcggcaacgacgtcgatcgctattatatatatcgtcgtcgttgctgatacagatggacttttgcaaggtcatcaaggtagaccaaataaaagccggcatcctcgcctgcgacgtacgtcaccggcggcgtcctcatctgcaccccaaccgcaggcgctgtgccgtgccggccgccatggtctgtagaagcatgaggccgttaccgcgttacctaccattacattcacatctcaaaaggccttcgacagcgaccgcaacgcgtcgtctactcttcgtcttcgatcacaaaactcaaaaggccgcagcgtacgtcctggccgacgaccacagactgtacgctgg

SEQ ID NO: 4090 - DNA, 477 bp, Zea mays
gttcggacggaggcagcagtactgtacagtacgtactattgtaaaatttgactgcgtgctgataatttgctaggcaggaaggcagttgtacgggcgcaacaacagacaaccggtcgtcccctacccgcattcaaggcgccccccgcgcccggcgtacttgcaagaaagcacctcgccccctattaataaatgcgtggcccggctgcccgtcgatcgcctcataattgatgccatgccttcgcttcccctcactcccgtcgtcgtcgcagtcgcagctgcaggccagcagccacaggccacggccagcaggtgaaaatccgtcgcatttatggccaccgggatcctcctcggcctataaatccgtctcggcatttatgagcacggacggctctcgtccccctcacttcacttgtcgttcgttcagttcctgtcgctgccgacgccgccgaggcccgaggggaatcgaccaccatcacc

SEQ ID NO: 4091 - DNA, 674 bp, Zea mays
atgttttccgtattttcggtactttatttcaattaaaaatcatctttcgtagtgcatatgagtatgtaagaaatgtgcggtagtataaggtaaaagctgtacactgaaattataatagataaagactgacatacgtaaatatagtgatgtgacgatagtctaatgcctacaagattcgtagcaagtgcagtttttttcggaaagttgtagttttctcacttccgatatccatttccagttttccacttccacacctaacggctaggcgatggatatttgcggttctgctgccgggatcggacggcttgtgttgcctagccattcgcaacggaccccgttcccaaaaaaaaagtcagtaaccaccccacagtactactgagtactgacccactccacactttcgtcttcccgtgcttttgtttctcggactagggacgctctctcccctcctgcaggcagtcaccattacgaaaaaagccaacacccggacggaaaggttggagcggggaggaaaactcgcgcaagatcccgccttttccgtcggggtctgacggccccgctcccccaccggaagccaggcggccgcaaagcagaggccgtaggcggcggttgctgaaacctatatcacgccaagcgcctgcgtagtcaagggctactcgagccttgcccctccc

SEQ ID NO: 4092 - DNA, 49 bp, Zea mays
ggtaagatggttctgagggaactagaagcacagcgagaattagttgact

SEQ ID NO: 4093 - DNA, 117 bp, Zea mays
ggtaattgttctttatattacagtgtgatatatcttcttattttcttcaacaaatttttaattttgcatctttttcttgtaggttaagaaataagtaccatcctacaaaccttggaa

SEQ ID NO: 4094 - DNA, 1037 bp, Zea mays
agctatacagtgcagatattgcaacaacccgtctatatttgggaaatgtctacttgtaggacgcctagcaatttttttttgaagtaatggtataaaatatggctctatcgaacaataccataatggcatataacatgattacactattgttgatggcatagttggcttgccctattgatgaatcaaagttttggataattgattatgacttcaaatgttttagtattcatatttcttttttctctccttaatctattgctcatccagctcgtagttttaacaatatacattattttttccagattctctgcctttggtctgctgaaagctgcaaattcatgaatgagtacaatgtgccaaattctaaaacattagtcgactttgattttgatgaaaataaggtgatcactgttagtgcagcattcagtttctgttatttgggtatcacttgctgaggtcttcatgtttgactgcaagacccaacattacctgtgtatcacctttttatatgtcacaatctttatctattcttacttaaagccgatagtataagtgtataacacgtaaactggttcagtttgtatttccatttgttgtatcatattcataccatccagactattgtattttattaatggaagaagtactgaaccatgatgtttttgttgaaatagctttgttttaaattttttagccatggcttgtcttttctaacaaagtgctaacttcttatttacctactagaaatttgatttgaatgctctgtgaagattgtaggtttgaccagctcccagatttgcatatggagacgcagtgaaccaagaagcatatttcaatctggtggagcctcattcaatcatgggttatgcatgaggtgtggattctgtttttattattagttaaggtagaagagctgaaccatacaaacaacacacttccaagcctataggagatcaataggaaggcagccggaggttagaccatcctagcatacgaaaagaagttccagtattacagaaatggtatgcaactaagat

SEQ ID NO: 4095 - DNA, 498 bp, Zea mays
tatccatgaactaacaacacagggtattctttttatttatgttattgtctataagttacatcacattatccttatgtattcatccttacattaccaacaagtttatcattcgcaccgaggacatcattgctatactcgatcatttcctccaagggtggtggatggctaggtcctcgtggtagcaaatccccaacaacatcaggtgacatcgctacccttggtggcggatggctaggtcctcgtggtagcaaatccccaacaacatcaggtgacatcgccacccttggtggcggatggctaggtcctcgtggtagcaaatccccaacaacatcaggtgacatcgctacccttggtggcggatggctaggtcctcgtggtagcaaatccccaacaacatcaggtgacatcgccacccttggtggcggatggctaggcccggagggtggtactcttcctcgtggtagcaaatccccaacaacatcaggtgacatcgccgcc

SEQ ID NO: 4096 - DNA, 236 bp, Zea mays
tctaatcatggctgtctttgcttccatggcgatgcaagtcacactgacaagccccatcctaagcctaaagcttggccttcgttaagacaaagaaaagaaaccactttggcactctctcgtataaatagctccgtcccatcgtcgtcatatctcgcgggctttcccgcagcaagatcaacgtcgtcgttcaagccagcggtagtagagactacgaccgaggctagctaagctaagag

SEQ ID NO: 4097 - DNA, 1226 bp, Zea mays
gatatgaactcaaccataaaagccttaaacctctgaactcttgtgtcaatcattcatcacaaatggatgagaccaacatacttctcaacttgtcctccacttaccccttttcgatatatatatttattaatatttgtaaacaagacaaatccgtattcatattcgtcgtgtatgacattatccacatctggctccgacaatgaacaaaatacaaagacaaacatggtggaagcgatatctgtctgtattctacaccaggaaactttttggtttggaactcccttttgctgtttcttggattgtttctgaatctgcttccgcagtgcctttaagctctctaatcaatccttgggctatcagtacatcatcacttgacgagtatagcatagcttcgatgattaaaagaaagagtrtacgctatgatttcgaggtatargtcttgtcttttgtttttgcatagaagaggcttccatttgcgcggtcgtcatccgtggacatgcaccgcagcatccattcgtcgtagccgcatttggctagccgttcagagatcagttgccttccataggcaaaacacaagctaacattccagtttattaatgttcaggaggacggctgtggcttcgagaagcagaaaaaaaagggggtcgctttccgcgatacgagcacagttccccgcgtagcgttggatggatcgtggacggcgatcgcagccgcctgccgtatctgccaacgtaagaggatccggttccacggcaagcggacaatcctttccacttccgctgtgcgctgatgcattctatgcttggcaatgccagaagcgccagcttgctgcgcgacgtcacgccgcagttctcctggctggctgtgtgtgttgcattgttgcttcttcccaccaattgccattgcgaaattgacttcctacgcccgtttttaattgtcggccctgaatcccatcgacgaacaggagaccgatgatgttagcactgttcatggcagtagagaacaaacgggcataccctctgaattatttaatttactggggggggcgagggatccgaagatacggacaggtatgctgcatctccattacgccattgtcatgcagtaggaaatcctatctttttcccccctcgagatgcatctctacatatagcacacaagacagagagtgagcggagacgaacaacgcccgcgcagaggccggggctagctagctagctcctccg

SEQ ID NO: 4098 - DNA, 181 bp, Zea mays
aacaccgattgcacagttatgatttttcttaacttaattgtttttattagtggtgaaagggttctgaaagatgtttgtgtatgtatggttgttagcttcgtagttcttgactgctgtaactattggttggaggccccttgggcttttgttttttttttgggtttggcttggaaggggcaaa

SEQ ID NO: 4099 - DNA, 1404 bp, Zea mays
aacaccgattgcacagttatgatttttcttaacttaattgtttttattagtggtgaaagggttctgaaagatgtttgtgtatgtatggttgttagcttcgtagttcttgactgctgtaactattggttggaggccccttgggcttttgttttttttttgggtttggcttggaaggggcaaaatgatgcgaggaataattgttgatacatggaataatggaatttacctgtggttctggttgcgatggattttgaatggaatttgcgaggtagcaaaacaatctaacaagttacgtaggactgagattacagccattcggaacaaatggatagccatgatgcatgatccgaaccgaagcttggagcttgcttcttgcacaagtaattctcatccacacaatagatcaaccaccgtgcatttcaatgcagctacaacttgtacgcgtgagtagacagcgaaaactttaagattataatctgtccggattatataatctaataaactttaaattaaactatataatttcgataaattataattccaaacaaacaccatcatcgtcgctctcggtcaactcctagataagccagttgcagatccttcctgccagtgcaagcaacctttcgctgtaccttttgccctctcccaaatccagatcgaaacgagtgcatcgcatccacaagcctccttacccagaattacatcagcgacgaccgccgactcgccgaggccgttccggctcaccggccaccgcctccggcggggtccctcccccgctcccaaacgcgccgcgcggatcagccactgacgcgtgggcccaacccgtacgctgtcaccccccaccccacacacacacgtgttccccagttccccctccggccctcccgcaccgcacggcagggcagcagcaaccaaccgcccaccgatcgtctttttctgtttgtttgtttatacctatctcctcctcctcgcctacgactacgagttcgccgtggcgcgccacccgccaccagtcagtcccgccgcgccgataaaccctccctccccgaatcggagaaccgcatctctgagattcccctccgacacccgccgtccgcgctgggatctcccatccggacccgtcttccatcattgcccctcgaatttctcctccacagactcagtttcgtcatccgcgcttggtttcgtcagttccggcgggcctagcagattcgtggctcttcctcgtacacaatccgggctgggtgagtggggccccttttccgcctagcgggttgcgtgcggccggcggtgttgcttggaaggcaaatcgagtgtttagggggccgcgtgcgggggcggtggtaaataaagctaccagggttggtggggtcattagcggagctgtgactctgtgaggcgacg

SEQ ID NO: 4100 - DNA, 843 bp, Zea mays
ctgcaggatctagggttccgacgactccgctcacggatggagggtggtagaagggcgagcgaatccctctcggtacatctccattcctccttatgtttttcttcttcacgcggcgtgcctcgcttctgtgccgcagtgtgcgaggcttgtagtgggtcatccggggcgcgcgcctgtagcttggtgccttggtggtttagggtttgggatgggtggcgcttgagcttagccaccttgttttcgggttgttttgaaggcgtagttacggattacagcttggcactcggaattagggtttggagccttttattttcagtagcctcgtgtgctttgcggtcagactggttgagggcttggttcaatccgactgctgtaaaccaaagctttacttgcaagtaatgttttgctgggagttcagtgctagtgagcgcatggtcctggggtcaaaatgcaccgcacatgttctattcatcagccaggagggggtatggtcttagttgacggagaatgctctagaaaatgtagaatttgcacttcacttttggcgtttttaaaacagccacacatatgttcagtgcgaattgcaattttgtgcgggtcatttggtatgcaacaatcatcattactgggtactaggtggcagtcttatagagacgtctgagatgctgcctactgcctaaaatactatctcgctctctcacatacactgatatacactcacacatgttttgtgcaatgattttcacacatctgcctgggtagttttgctcccatatatgaattatgttatatataaatatggttctccgatattttttgcttgtattttgtaggcatacaccc

SEQ ID NO: 4101 - DNA, 442 bp, Zea mays
ggttaatcttgtgtttggtctatctggtttgagctttggtctggaattatgttactgcttttgtttcctctatccattccaaaacataggacattttttgttgtcgtaagtcaaaaattctctaactttgacagagtttatagaaaaacaaaccaacatcaacagccttcatttcttaatcttatatagaagttgcagtattttagtctaatagatggacatgttttaaattttgaggcattgaaacaatttgcatcatgaaggcgttcgacttaatgtttccaaggttctgtggcagtgcgaggcattttgggaggtggtgagcgcctcgcttggcaccttcattttcgtgatgatgctgtcattcaggctgcagtgccacacaagttcgtttggtgtaggtgctgcttgatttttggcggtgcatgccgggtgttcgaca

SEQ ID NO: 4102 - DNA, 1320 bp, Zea mays
gaatgaattttggcaataatataacacaagttcaaacttcaactattatggttttttctattgcaacgtacgaaaacggctttagtattttaaaaatacgaagttgagttgaaaaaactttttttggaacttagaagcctcatgtagatttaacatatatggagaggacatattagatgaaaaccaaataagtattggatatatgaaaggtttgctagaactagaaatcatagctagaagttgcaaggccggaaaatagaatttacaggcatggttgtattacggttttgcacatgtattcaacttcaagctcggccatgtatattatatgaagaaaacatagccaggacttggtacggtttctatatattatatgaattgcctttaataagatatattggttatgtgagtctgaatatggagccagtaaccattttgcattaagtagaaattgtgacgtatgacgagaccgttgaaactgatattttatatatggtagataatagagacttattcaattttgagttataagatattttaaatttttaagatacatagtttttgtcatgcacttaaatatacactatatttaaatatatagtaaaataatatatctagaaaagctaaaatatttttaaaattttagaatggatagagtagaaaagtatgtatagaaagaaatacaaaaggacaactcaaacatcatgattaaagttaagggtaggtttgaaattttgtattgcaaacaaatactagtagtatccttataaaagaaatacgcaaaagaattatggaagaaaactaacacctttgatcataactaaatgaccaataatagctaatcagaagtcaactttgatgcctaaactatggttaaccatagccggaggtattaaattgtaaacagatcaattccacatttggacgtgttcagtgctggtgtaagcggaataattaaccatctcgttctgagcatcaccagttcaggtcagttctcccctgccatcaacctctaggcgccgcaagcacgtcgttgcacccggcctcggatcatcacacgtcaccccacctgcctcagcggctcagctggatgggcgccatgtccccatccaaccccgtctccggaatctggacgccctcccgtccaggttcactccggccccctcatcttcctcccgtccccctcttcgttgcccccagatcccgcaaaccgcgaaaagaaaccgcatatcagcgggcgctgctcgttctcatcgccccccctcgtctctcgcggagccgaccccgtccccattcggacctcagctagccaccaccacc

SEQ ID NO: 4103 - DNA, 68 bp, Zea mays
gaaatagttgctcattctgaaacacttgcaaccttctcctcgcccaccttcatctccaaatacatccc

SEQ ID NO: 4104 - DNA, 1020 bp, Zea mays
agagtttaacaatgtattctataaaatataaatattgtaatgtgatgttcactcacattgtcgagctatgttattcttgatctttagacatacatagtttatacctggcttttccttcgaaattagatttgayacacccctggcatggtaatagataacgatctaaatgtctattcacaatttatttgagctcttaaataatttaaattaaaaaataaatagaaacaaagtctgattttaatccgatttagttattaaattttatagcgtaaaatttagagcacattaccacttctatacaccaagataattacaagctagaaaaattagaagaaccaaagcacatgcaacaaataagccgagtgtataagatcacaaacaacgctctatttaaggcaggcgtctacacgccatcctagacccgcccttaattttaattggcttatataaaagaggtaggaaaaaataaataaaggtttagtgcattggcacatggtgctttgggatgatgattatgccaatacaataaacatatggagaaaaaactaataatagaaattgctaaaaagtgtgtggcttcccttgggctccaaccacacaccctttcctcgctccattcccgtaggatgcatgcatgtttcctcgtgcgtctgcatcgtcagtttcctcattcctcttgcagactagtagctagtgttcttctcgaatttgggacgtctcccaaatcccaatgatttccgctttttttccctacagcgaattctcgatgtaggcatgtatcggggaagaggaaggtgtgaatccttgttgcccagtttctctttcccacatctcgatttctttgttgttcctgctgcgctcgtgtttttatatgtatctatctacaaagaagaatcgaagagattcagtacgtagatcttgattgatttctgaaagaagccacaagagaaaggaggcgccaaaaaacaagtggaagcgaattggaatctgccagaatataattacattagatttgagggt

SEQ ID NO: 4105 - DNA, 910 bp, Zea mays
ccccgctttgcctttgagtgtttccactccacctcatcagtcgccgcccccgccccgcggcgccgcgggcccctccacctaccttcggcgcccgcccttcttggcccagcccccctgcacatctgcttgcccccctcggccgccggcggcggcgatcgcgggtagccgccccaaccggtgagtcacggtacttgtccttgggtcgcttgggggcctcgccagatccgatccggcctcgggtggctgccggtttctatcccgggtctgcggcgcgcggctagatcttacggcttggggggtagttgccgttcgcttaggtcagtagtcgggatcggtggtttggtggggttgcgatcctgggtgccgttagccagggggaaagtggtggctttggctcgttgctaggatctgggatatggaactgctagtgttcgtcggttgtgatttggtgcagtgtgggtcggatgaatggtgggaagctagattgaggtttagagctgtttgtcttcacatgttatattgcaggcgtcggtgttgttcgtggattggtagtgaccttgctccaaggtttcagtttagaggatgtcttcgtcttttaaggcatggtattcctagctggggagctggaaacctacttttgtactcttctgaaaacgagaatgttgccatggtgtccagcatggcagtgcatttcgttttttatttgatttcggcatttcgccacgctagtttgcaagctaacttttgaacttttctgcaggccgaggttgcatagaggtgctggtatcttactctgcttctggttatgctatctgcctatgacttcagcttcccaaacttctccctgcttcttgcccctggttggtaaaaatctgtaacaactgctgccctgactgcaaaagacgcaact

SEQ ID NO: 4106 - DNA, 396 bp, Zea mays
acctgcagaaccgtcaggacatgccaacaaactacccgaactatgggcaacacaaccacatttttttgctaaaccaggcactctcataggcatagagaggccacaccttctggaaaaacacactaatcagtcaacaatatgtctatccactggtctccagccgtaagcgcgactcatctcctcacttgccgtccttctgatgagcttgcttgccccgattttgtgttggcagtgccttttgttttgtttttattttagtctattgtataaggtcaggagttactgatgctttgtcatttgcatactctgttctgttgctagcagacttgctttgaagatcttgatcaccacaagagatttgctgaatttccggtcactgtactttttccactggac

SEQ ID NO: 4107 - DNA, 512 bp, Zea mays
ctgcatgggtttgaactgtggtgacttctacatggagctaacggttgcgcctctctatatcttctgctcagacaattatacgacggttgtcatgagaaaaattcagaaccaaaaggagcggacgagcccgagatgcagcggttggtagcaacgggattgaagcacgactgcacaagtgtgctgtgacgtgtgaccgagtggacgggcaagatcgttaacggaataaacgatctatagtcggttgaatttagtatatggacccaatgggtcaaactaaagtgggcacctggcgttcatgggccacgaccctctgcaaagatccgcctgaacactgcagcggagcacgttcaaaaatcaaaaccatgtgtcggtgctctcggtctcggcaacctccccattccacaaccgtccccgagaacgacctcacatagtcacgtttccgtcttccgaagcagcacgtccgctcgcctccgagaacccaccacctcgccgcccgccaccagcccaccacc

SEQ ID NO: 4108 - DNA, 296 bp, Zea mays
ggtacgatcttctagatattggagccataccgggcttcaactgtattacaaactctacctcccgttcaggtggcaacccgggaaaatcctcgagaaagacatcgggaaactcacatactaccgaaatatccttgatttccggtaccatgacttcatagactctgccagtagttttgtttggaatggggatgggcaaaagaatttcttcttgattgtgactcaacctgatggttctttgatcagtattgagtgttgctttatgcttggccaaccaattcacacccaaaataacatct

SEQ ID NO: 4109 - DNA, 582 bp, Zea mays
ataacaacacggcgacttgttgtctgctgagtagctagtgaataatgataacaaaaacaacacggcgacaaggctgcaccattccggtgggttggatctagccgggtcgggtgatgtatgatcaggtctaagtctaaactaaataaatgacactatgcacggccgttttttccttttttttttcttgttgaggaatccacggccatgtttctgttgggcaacattagattagaggccgaaggcccgaatttcgcgaggcatcggcaagggcgtgggaaaatgtcatccaacactcggcctgcaaaagcccgaattccgcgagaatgtcagcaggccgtgggggaggaaaaaaaatcaaccaccaatcgggacccgttggcgtgatccatccacccgtccactccgaagcgctcgtcgcaaaagctgtggcactgccgcactggcacagtggcacgcgattcctttccttccgcgtccgcgtccttctcggctgtctgtgcagttgtgctcgcttgctccccacgcccacgtcattccccgtccgctgcggctcacctccagcctcacggtcccgcgaccgct

SEQ ID NO: 4110 - DNA, 319 bp, Zea mays
cctccgccgttataaaatgggaggagggaggggggcagcgaagccatccatccatccatagatccctcacctcactcactcgtgaagaaccagagaactcacccaccctccttcatctcctacatccacatctatccaagaaggtccgttctctcctccccgctcccctcagcaataatctccgcacggcaacctcgctcctccgttttggttttcctctgtgtgtgcgtgcattcttttctcttgtgcgtgcatgacgagctctgaccgacgacgacgatgtttaattaacctctggctgttggcgacattgcaggcc

SEQ ID NO: 4111 - DNA, 112 bp, Zea mays
ctggtccctgtcctgtccatctgtaccgttccattccaattccatccccggaaagcgcaagccgcgggagagcggccggcgtacgtaccacgaggaccgccagcccagggcc

SEQ ID NO: 4112 - DNA, 893 bp, Zea mays
caggacacatcaatagaattgattcgtctctagccctccaaaatcaactcaattcccattagggacttgagagaggggtgttttgtgctcttttgttgctcttgtcgcttggattggcctttttattttcccattcttattctcaaatgctttgtaagcgaagcaagagacaccaaagtgtgtagtggtccttgcggggtcttagtgactcgtaagattaaggaagaaggctcacttggtctaagtgatcgtttgagagaggggacgggttgaaatagacccggtctttgtgacctcctccttggggactaggttctttggaaccgaacctcggtaaaacaaatcaccatgttcattcaccttgattcttatttgatttgtttttcccctctctttggacttgaatttaattctaacgctaactccggcttgtagtatgtgtttaaagttataaattttaggtttcacctattcacccccctctaggtgactttcaattggtataagagccagtgcttcattaagagcctaaccaactcgaagtgatgtctggagacatgccaagagggagatcatgaccggcgacaagcctgcgagctcggggaggactctctcaagggagtctggcaacaagtataaggagtaatcctcttcctctatcaagtcacatcggaaaggtgacaagaaaaaaagaagatgaagaaggtggtctactacgagaccgactctttgtcaccctccacctccgactccgagtcgaccactacttctaagtgtcatgagcgcaagaagtttagtaagatgcccctacgctatcccgtatttcaaagcgcgctccattactttccgtacccctaggcaaaccaccatattttgatggcgaagattattgt

SEQ ID NO: 4113 - DNA, 258 bp, Zea mays
agtacgtaatctaggctgaagatttctgcggcacattgaatttcatattgtcgcttggattacgtgtaaattcatattgaccagcagtactaatattgaactttgaagcctagtcagatcagatattaataaattcattgttttatgataatgatactcggtagaggtaaagaaataaagattgttcaagatttaccactatcgttatgcagtcacaaaataaatggtactaatatattgtttgtaaaatagagatct

SEQ ID NO: 4114 - DNA, 1500 bp, Zea mays
ccttttctttttatttttctcttttgaattcaaatccgaccaaaccacaaattcaaaattgaatattccaaacatatgcatcaaacaaaaagtaaaatctagactcatcatgatgcaacattttgtctcccctagggtttaatctactaaagtagtaatacagctccaaataaaataatctagactctactaaaaggaagagaaaagaaaactatagagaggagaaaaggatgtaacacctaaatttggtagatattaaagaagaaattttatatcaccaaatttagggtgttacatacttgaagctaaagatgcccagttcccgcgggaccatcatggcgtcctcttccttcaaggcagcctacacttgcaagcaaggcaactatgagctcgcctcaacactggccacgacaaaagaaatgagtcgagcttcaagagactgcccctaggggcaccccaggcgctcccgcgactagcttaggcacctccaagtccgccaaagaggcgaaggacgcatggaccagcgcggccaacgcaaccaagcacactcgtgttgggacatcgtcctccgacaagtgagaaggctctctcgttatctgccccgagctctccctcaacatccggtcaacggccgggacagtcgacaagaaaaaagtgcaaagtcgttagcgagaaggacgccaaaaagttcttagaaacaggatttgtaacagaaatacaccacccgacgtgggcgacgaatcctgtacttatcaagaaaaagaatgagagcggctagattcgagcccttttccactgctacgcgacgaccaggctcaggcttatgtttttgctaccggctgtgagtccttccgggatcccgtcttcatctacacgcccgaataagcagaacatgacgattaagtcaccacgctctgctcgagggtgggaaacagggatcactccgtgaaaacgtgcccggacatacgcaccagctaccgtgaccaatcgcaaggcccatgactcaagcaagaagcaatatcacaccaaaaggcacgaacatatgtttagccccatcattcaaacaaagtttattacaagacaacgatgtaacgtcgtttagatgccggtggacggctccatactccaagggctcatcaggaggaacttcgcgtcgacccaacttgcaatcaaccgggcgtgaaggtgaatttgttcttcaatacgatatagctcctcgtcgctctgtccggcggcaaagcccttcatgatcacgatcgtgttggtctcgtcaaaatgagagccatctacctcaaggctatactgctcccatagactacaccctcaaggaccacgtattccacgtggtcaggtagcgtccgcagccaatcgggcagggcaactttgaccggcggagggggagaaaggtgggcgcacaccgtgctcacggccgccctgagagcctggagctctgtgctctgctctgagagtgaagcctccgcttgaactctcgcgataaca

SEQ ID NO: 4115 - DNA, 620 bp, Zea mays
ttctctcctggctgcgccaccatgatgccgccacggaatgcgcagagccgccgaagagagcagagtcccagcgagaaacgcaggagctcttccttccacctctggcgaacctccaaggaaactcgacgcccagacctgctcgcgcacagggagcatctttgctccggcggctgctcgccggcctccctgtctcctccccagttcttcctctcacagccgtgcagcgccctcttctctacagtggccgctgctcctctctgaagctatgcgcaggagctctccaggacgccgcgcctcctccctgctacacgccccggtcgacgacgaacttcccgtggtctgggaggccgcgcccgcccagatccgccggaaggagcgaaaggagccccgccgccgctgtcatcacaggccgcacgggcttccggtggcctgctcaggcggcggctagggttttgaggggcgctcgggtcgcccagcgcggggacgaccgagcgccgtctgcttcaaacatttggagctcatcccctcgaaatacagaaggtgcatccacaaaggattaatctcttcgtctaattttcttgggcatacacagattcagagcatatggcgatcaagtagct

SEQ ID NO: 4116 - DNA, 1500 bp, Zea mays
aaaattcgccatacttgtgtctaatatgttttttgctcatcagctatcggtacctattgtcatccctaccgtaaccatgtgtcttcatctagcaatacgcactgctgctggctactgctagatagtatacaactacacatacatacatgcacatgctttgttttcacggttcctcaccgggttggtccgttcggccgttcctgcccgtggccggctggccgcctcgtcccgtcgtcggcccctcctgcgtttgaaaccccggccggcccgttccccgcctcaagatttttaccgatagggcttcattccaccactagcagtatacgtacgcggtacgtacacatttgctacctgcgtgtgaccgtgtcgttggccgcagcagcacgagaaccacaactgcagcgttatcagctgacatgcgcacattctacgagacgattagtttcagagagacggagagtccaaaacaagcatgagaattaacgccgtgcttaatttctggagcaccccaaaaaaatcgaagcaggcagtacggggtagttaaaggtcttccctcttccggtcaaagccggtcaagaggcaacaataatgatgagtgaagccgacacgcgggcccgcgccttccttgtcacgcgcgaccgtggccccacccaccaccaccaagcacccccgcggtgacggctgacgcgcgtgcccacctcacctgacgcctgctgcctgctggtggtccctctcgtcagcttctgaccccgtgtgggtgtgccccgtccgctttttgccggctcgcgccaacgcccaccaaaccaaaccgaaaacccatctttgtggaacatatatatgccggttgtcaatcaggtcaagattagtattcactaaatactactgtaatagcatatcacagttgtttctttccacaattttagaatcaagagtggctgagcgtgtgctgttgttggatggtaccacgagactgcgcaaaatctcttcagttcgagaacaaaccgaccaagttcaagccaagccttgaacgaaaaagattaagatcactatagtgctgacatgacccaacaacaaatacctaagcagctgctcgacacagtacgtacgtactgctggtgctggtgccggtgcccgtgcgaaagcgaggagcgagcagacacctgtacaaaagaaatacaggcaggaataccaggggcggaataccaacaagcggcggtttatatacatacgccaccagcatctttaacaccaccgctgcgctaatccgccattcaaacgagattagcacaaaaaaaaaacaataaacaaacagaggaagcagcgcagtcggaggcagtgaggtgagctcgccctcctgctcctgctcctgctcccgcagctgcgctgtgctgccatcgctttcccctcctcccagtcccacccccagattcgcatgcgcgcttccctctccaccgccacaggcacagcgtcagcgcctagcttagccagctcgccgccgca

SEQ ID NO: 4117 - DNA, 336 bp, Zea mays
ggtaagaaaacatagctagtcccagtcccttgctctaatttttaattgtacctttgcaactgttctaagttttttttcctcccccacagcttaataataagcttggtacatctgttactgctacacaagtttctaaagaagaagcaaaaacttctgtatcagctgtagatgcacaactcttttctaaaggagaagcaaaacctactgatgtttctgttctgccaactagtaccatctctggaacgccggccgtaggggggtgcaatcggtattccaggtcttacgaacattcccaatcttgaatctgtgaagcgagcccaagaacttgctgctaag

SEQ ID NO: 4118 - DNA, 1500 bp, Zea mays
aggaaaagatgttcccctttttattattatttttttaaaaggaagggtctcagtttttttatgccagagaaataagctgacagacctgcatgtctagtttgcatatttctgatacagacggtttttagctagatgctgctctggatccatggagacatagcatgatctccctggatcaaacatacagagaggcacagttggatttggagtgggcagtaaattaaataaaacatccatgtgatcttcccaagattttgctggagctagctgttaaacacgcacgatgcatagtggcatctgcagtcacaggttttgtagctcacttttagtaccgcgaaccttacagatttaagcacactccacatgatttgcagcccaatggtgagctagctgctcccgagttgcagtgcctcaagttgccagtgttaactggagggaagaccaactatgcatatgcttggtgttaatttattattggtccaaaaaggaaaagagacactttgatctgtcactgcctgcctggtagcctttttccatgaacactgcattggtcctggactgtttaaacttttagatgggtagttatttgatagcatgtttttaaatcctaatcgtagtgatataacacagctgagtcttgagtgccacagtgcaaaagcacccaaaaaagaaaaagaaaaaaaaggagtacgtagtggtgtgaagtggaacagggagtatatatatatattttttaaaaaaacatgagaatgaagagcgaggccatggatcacccaccacaccatgatgctctgtctacaaagaaggtagcagaacacaatcatcccatatcacatgcctcctcccctccaaaaggtaataccaatcagttcattggctgctcacctgttgcacacatcattattcatctatctatctatcttatcccaagctacaccaacagctcagcaacataaaacaaaacctgtcagttattaacagcttaattcaaagcagccttcggtatgcatgatatgcatggtggcatatatatacatatatatatgaatcatcagcttcttcatgcacatgtgacgataggattagcaggctgtgacacatgattgtggccatttgggcacctcatcgtcatgctggctttcaaggtttgactggctacatttaaccatgtttatgtatgtatggtataacaattaaacgctgctgttagaaagaaatgcttcaccagagatcgaggcaaaataaaacaccagtttcacaaacaattcagctatcagtacttgttcgtaccgttctgtacctgcaaacagtgatgcatattgcagcatagctactggtatatatacacacgcatccgacgaaacaaaagcatcaagctttcctgcttgagtgcttggcctataatatatagctccatcgatacggttttgcataaagatcaccacctccattctcacgcacaaggcctctctctcgcagattaagccagagcgagagagg

SEQ ID NO: 4119 - DNA, 855 bp, Zea mays
gtaacgttagcacaggctatatattagttaatgtaatagagtaacaaaaactctactttgcacactatctattaggcccctgcgcccattcctgttagggcaacacgtagcaacccatttttttttccttcgctgtttccaccccacggctgtgcacgccgccgtcgaccctcacaagccatgtccaacagaattcgacagcggccttcctcccgcccggcagtcttcttcagcacgccggccccctgcttgcgagatggaccgtgcacgccgccgtcctatccagccccgcgatggccgccaacgtggggttcccgtccgacgcgacagcaagctccgccccggcgcgggtgggagcccacctccggccggccttcatcgtcgcagtcgcagctcctttaatttgcccagccgtcttgctagctatatctagaagggccacttaagtaatttccatgttattagccattttgatgttggtgagaatctttatggtccgatccgacatgtcatctcatcaccaccgaaactttccgatgtaaacaaagtcaacaagtatatgaatatcacaatcgttttcattcacaagcgacggttctcccttcaaagttcaaacacacatatacatatggaaggtacctcactaatctgctttgaaattgttgcaactttgaaaagagaaccaccaccggagcacttctatacgatattttgtgtctatctatctctatatatatatcatgggtacgtacatttgcatgatgtgtagtttaacgctttctacgttgctatacgtcatagctaagctagtacctagccggccgcgtatgtacgtgtacgtattccatatcgtcc

SEQ ID NO: 4120 - DNA, 1500 bp, Zea mays
gcctagaaccttgtggagcgtcttgcagagactttggactctccattgagttgagaaagagagagtgttcaaatttgacatttggaatcacttaagaggattgaaaaagtctagtcctttaggacacctcaacagagacgtgtttcgtttggagcccaaacttcggtaaacagatcgacgtgtcttttgtgtttgattgttagttgcgatctcttctcttctctactccatatgttctcctaaggtggtcttcactctattcactcgtgttgctccaaagtttattcaacacattgataagcaacatactgcagtgattcatcaccctactttgcatgcctgatggtatttatgttttactcatgcaactattaacgaatgaccatgatatacatgcgttgaaatcaacatctgtgtgctaaaaatagacattattcatattgctagtcatatcgacaagttgagttattgtcctttttaaatacttcggcttatattaaatttgatgttatgtgtaataccagttggacgagaaactttatacgtatgcttcgcaacagctgtgtatacattctacatcgttgaggagtctttatcttctttcctacgtgttattttttttgtttttttaggaaaaaacgtgataaaaacactttgtgtacgtactaatacaagttccccccccaaccggtattacttgaaatatctttatacacatccaacatcacactacaaactccgtaccgctaggcttaaaatttttgaactaccataatacagactttatattgctaggttcaaaacttcaagtgcagaacttataaactttgaactactatattacaaactttatattgttagacttaaaatgttatattatcatgctataaattttacactgctaggtttaaaactttaaactagcacattctaaactttgtactgtaaagttcaaaactctgcaactaaattcagaaactttatactatcttattttaaattgggactttgtactattacatttaaaactctatattcctagacacaaaactttgtaatcacgtaaattgtttcgaaatatatccaatataaaaatattttttatggatcttgttataaccaatatagcaatgtaaacagaactaaaagtcgttacttttatcagaaatatatcagataaagtttagtctgtaactttgtacaccatgcgtatctgcggcagaaaaacatcatcaaagcgcctctcctagcgccctcccctccctcccgcgcagcgcacgcgctagtaattgggcccgcgcccctcctcttggatttctggcgcgaaatatagatacatcaggtggcggggagccggggagacagacctgtggataccaattcagaaaaaacggaggaaacgaaaacgagaaggccctcctgcctgccccttgcttcctcccgagtcccktggcggcsgcggcggcggcggcgactgctcgacccgcccgcccggccgcc

SEQ ID NO: 4121 - DNA, 134 bp, Zea mays
agtaataacttgtatatattttttctgttcttatacaaagctttgaattcttgcattatttttttgaatagaatttgtatagggtgcatagagctttctataggatttgatgaatcgttgtgcttgtacttgtg

SEQ ID NO: 4122 - DNA, 1008 bp, Zea mays
tttgagggtaaaatcgttgaaaacaaaggaagctgcaattcaaatacctattaaggacaaataataaacaacttagagaagagcatctaataatgtagttacatgtatatttataggaggaagcaggaatacggttttcataggaacgaactatcacaaaaagtggtttatactttacagctcatcgtctggtttctgtttcttctcttacgacctattttcttgtttttgttgttgcttctgttgggccttcctttgtttcttttctagcttctctgccagcccactcagttgcctaccctctgtacacaggaagatgtatatgctcatgaaagaaggaaaaataagcattaaaattatatgtaaagaacacgatacactttaacaacaaaaccaaatagcagaaaagcaccttgtactccaatgcatttattcccttccacacaaaatcaaacaaagttattaaattctctggacttggagcgacgacaaatatatttgaatatctaagaagtcaaaaaattgcactaagaagaattgcacactctaactaaatattaacttcccttaggttgagctctacccagctgctacaactctagcaatggcaagaccaaggcctgctgatttaccacatccatgagcaggaagcagagcaatcttacttcgcagggacttctcaggaactaagggaaacaatagttatgcaattatccattattaacttcgagcgccctatccagtgcaaggtaaaaggagtgaagaattgttcatgtcatattaaaatttagcagaggatttgattaaatcatttagcacaattactacttcaaggaatgaatcttccagaaaacagaagagcattaaagcaatgatcaggtgaaacacagagagactaaacataatttacattaaaattgtaactgttctttgttttatcaagtatttacattaaagttgtaactgttctttgtttcatcaggtatttttatttttcaccaaccgtgt

SEQ ID NO: 4123 - DNA, 47 bp, Zea mays
aggatctggcgctgccaccagtccagccacgtggtgtgaggaggacg

SEQ ID NO: 4124 - DNA, 171 bp, Zea mays
ggtaagtttgtaaatttggacattctaatctccatttttatgtttgaacccattgtcatttctattccttaaacatgtgttttgtaataaagctgttaggtttatcaggattgtgaaaactgaactgtgaaaatttgatcaattaatgtatgttatttaactgttccgttc

SEQ ID NO: 4125 - DNA, 215 bp, Zea mays
aagagcataattgtaaaaaaaaactataaaagggccaaattgcaaaaaaaaaagttggaatttcgaaccggtaaaatagcagatcgccctcccactccagtcctcccggttttctagggtttaaagagcttgccgagcccgccgtgcgccggccggcacatctccactactttccgccatcgccggagccgaccccttcgtctccgcacgcggca

SEQ ID NO: 4126 - DNA, 1500 bp, Zea mays
tgtggtgcaagcgtggtccaaaatgttaaataagaaagaaacaatccatgcatatcttataagtatttatattggctaaattccaagtaacatttgcactcacattatgcaaactagttcaattatacacttctatactttttttggtttgtgttggcatcaatcaccaaaaagggggagattgaaagggaattaggcttacacctatttcctagataattttggtggttgaattgcccaacacaaataattggactaactagtttgctctagtctataagttatacaggtgccaaaggttcacactaagccaataaaaagatcaagaaaagggttcaacaaagagagcaagggacaaccgaaggctgccctggtctggcgcaccggactgtctggtgtgccaccggacagtgtccggtgcaccagggaactcgacgcccaactcttcaccttcggggattttcagaggactccgctataatttaccggactgtccggtgctccaggggagagcgactctgaactcgccagcttcgggaatccgctccgctataattcaccggacatgtccggtgcacaccggactgtccggtgagccagcggagcaacgactacttcgcgccaacggtcgactgcaggcgcattgaatgcgcgccagcgcgcgcagaggacagtggcacgcgcgggtggcacaccggacagtctacaggacttgtccggtgcaccaccggacagccaggcgggcccacaagtcagagctccaacggtcggaacccaatggcctagtgacgtggctggcacaccggacagtgtccggtgacgcaccggactgtccggtgcgccatacgacatcagcctccaccaaacggctagtttggtggttggggctataaatacccccaaccaccctccattcaagtcatccaagttttccaccttccaaccacttacaagagctaatcattcaatacaagacacacccaagtgatcaaatcctctcccaattccacacaaagctttaatgtttagtgagagagatttgttgtgttcttttgagctcttgcgcttggattgcttccttctttcattctttcttgcgatcatctcaattgtaatcaaggcaagagacaccaattatgtggtggtccttgcgggaagtttggttcccgtttgattgagaagagaagcacactcggtccgagggaccgtttgagagagggaaagggttgaaagagactcggtctttgtgaccacctcaacagggagtaggtttgcgaaaaccgaacctcggtaaaacaaatccttgtgtctcactctttatttggttgcgatttgttttttcacaccctctctcggactcgtttatatttctaacgctaacccggcttgtagttgtgattaagtttgtaaatttcagattcgccatattcacccccctctaggcgactttcaattggtatcggagcccggtgcttcattagagcctaaccgctcgaagtg

SEQ ID NO: 4127 - DNA, 757 bp, Zea mays
tggtggtgagcaagggaggygacggctgcggcttgacgaagaaggggtaagaagaatcgggaagatcggagagagacgacagcacagcacaccaccacaagactaggattgtggtaacgggaagctgacaggggaaggcgaacatcaacttaactcttcatgtcctcctgacacttgtcactgtcctcccagttggactagtgggcttgttttctgggacaggctgcccttttgcctctcgcaagccatggaagcgtttccatcttaggccatgtttggtgacaacatatctggtgcaccatgtgcacctgtcttctatgtgcaccagatatgtccccatgtttggtttcaattagggggtgtttggttgctcctgctaaagtttagcccgggtcacatcaaacgtttgacttttaaataggagtatgaaatatagacccaaccaactgaactagattcgtctcgtcttttaattttcggctgacaaattagttttataatccgactacatttaatacccggaacggaggttcaaacattcgatgggacatggctaaattttagcgggttgtgcgatacggcccaagtgtggttcagcaacgccgaagaaaaatcagacaagaagcccctccggccctcgccctccctagtccctattcgccgcgcccgcgcccgcgccgtctcgaggtccgccggtctccttccgccgcaagctttgctccattccaccgccgcctcttccgcctccgtcggcaaa

SEQ ID NO: 4128 - DNA, 304 bp, Zea mays
gacatcaacccattccctccttgagatcatagcgtaagcacaagttatatgttagaaaaaaaaagaaagtcacccgaaaaagaagtacataggccacatctttcgttggccgggccgcgttgggcatggccgcatgggcctgcaagactgacggcgcggccgcgcgggaggttgagaagccacggtgagaccactgccgttaataccgaacctctcgcgccgttacccgctggtcctaaaaccctagcgaaggcgagccttccacttccctcaacctgccgccgccaccgccaccgccgccgcc

SEQ ID NO: 4129 - DNA, 456 bp, Zea mays
gtgttcatttgagctcttgcacttggattgcttttcttcttccttcattcttgtgttcaattcacttatattcaaaacaagagacaccaagttgtggtggtccttgtagtggacttagtgtcccatttgattgaagagaaaggctcactcggtcttggtgaccatttgagagagggaaagggttgaaagagacccggtctttgtgaccacctcaatggggagtaggtttgcaagaaccaaacctcggtaaaacaaatcaccgtgtcatccgctcttattcgcttgtgatttgttttcaccctctcttttggactcgcatttaattctaacgctaacccggcttgtagtgtgtgcttaagtttataaatttcagatttgcctattcaccccccctctaggcgactttcaattggtatcggagcccggtacttcattagagcctaaccgctcaaagtg

SEQ ID NO: 4130 - DNA, 1500 bp, Zea mays
tgagcactatctggtgcacccgtagacatagaaggctgggagcttccaaatgaagctctaacgactcctaggctccttggggatataaaagggacccttaggcacatggagcatgtatccaagcatcacaagagcatactacaattcgaagactccacgaccacgcttttgacttgttagagagagatttgagcgcgtgtttgagctgtgactttgttattttgatttgtgtgctctgttctttgcttgtgtgtggtgttgctgcaattgtgctcttgtgagcgtttctactcccctccttactctagatttggttgtaatcaattgtgtaaggtgtgagagactctaatttgtaaagattcctcacaactaggatattgatataaggaagacaaccgtggtattcaacattgaactttggatcgcttgagaggggttgagtacaacccttgaccgatggaggttaccacaacgtggagtaggcattgggcaaaccatgttaaaaatcatcgtgtgacttgtccattttacttattgctattactgatatctcgagttctcatattcacttgtaatattactcctaagtttaataatcatcctaaaggagcaatcaagtgaagaattctcttttttctcctctcttttcatcattacttggttttagttctcactaacacattttataaaccaagtttatgttgtttagagctagttttgcaggatcacctattcaccaccgtctaggtgctctcagctggattgtgataacttgactcgagagaattgtgatatcctggtccaaggctaaatatgattgatagaatacttatatcaataagcctacctcgacataatctctaagttaagcgtgcttgctaagagtaatcttggctatggtgcatcctctaccgtgtaaactccaccagaaaaagcctccaagtgagacacacggggtgtcgatcctagggattgaatccatgaggaccatgactggcagttcgcgaatcaactgggctacggcccagtcctctaggaaacatttttaagccccatattaattgaatcgactctgttgcagtgtggcaggtggctcactatgttcgtatcaatctcgagtccagtctataacctagcctgctgcacctattatacaccatgtttttgcacttgcgtggtgtacatacaaacgaaagccggttttggtgtagttcgtccaatgctagtataaggagtaataatattatagatgtgggaatcgacgactcccattgtcaacaaaacattttgaaacaaaaccgcagctacaataacaaatgtagtatcccttctatgcgccgacgatagcgtgcatccatgtgcacggtgcacgggatttaatgctgcacgcaagtcaaccacgtacagcatgttgagctctgcgatcgagatgccaatgtgtgatataagacaacgtgtgcgaccgagagggagcagatcaagctagctttgcaaaggtag

SEQ ID NO: 4131 - DNA, 1500 bp, Zea mays
tgaagacctcactcactgttatatagcccatagcccataggactgcttccaatggggagttaatgcaacaaattcgcacatggccctttggttcttgtaaagcctgatcacaattaatgtctgcatgttcaagccaaggcagcacaaaaggcatctttttggtagcaaaccaaccacttttactacaattggccagggcggcgacaactagagctatacatttggatcaggcctgttggacaagccaaaaacacgaaaaaagcacgacacaatcataacattatggagacgaggtcgcaccccacaggtgggcacaagcatgactcgtttacgtagacacgaaatataccatttacaggcaaaaaaaggtacatattcatttggccatccgctcctaatcatgtaaaccatccactccaagttgtatagtcgtatgtctaatcatgaagatgaggtgtcaaccttagtttcatgttctttgattatttttttttggaattatgaaagcctaaaatgttagtatctactatctagtaaatagtatatatgttttaaataccggattctgatgtgaatttcaagctttgaaatggattaaggctctgtgcgattttcgagccaaaatttgaattttggactacccaaaattgaatctggtacgtttaaccaataacgcgtcattacgcggggcgagagctaagcccgtggtcccgtactcccgtccagtgggcacgacatgtaatgattgtgggcaggctcgatccaaaattgaatcatgccatatcttttgggttttgaactgtgaagggctggtttccctttctcgaacccaaaatcttcgtcaaccaaattgatatgaatggagaattcgaggttgcattgatataaggcgatgcgtggtattggtcgatgggctctgcgatgtccaaacaagctttgacgggaaaccgtttttttaaaaaaaaaataaataaaaatatcaaaccgatcgatttttagtagtttttttttttttggcgaaaaaccaaaaccgaaggggacgacatttgacttggaaactgtacggtgaactgcgctagctcaaaattaacacaagtggctttgtctggcgtggtgtggcaaacaccacacacacgacggcattcattcattcatatggtgtgggcgtacgggagcacgagatcgaccggggcggttgggcgctggagctggagaaagagtagggcgggccacgcatgcatccaccaccacccagctgcccgaacggacggcacgagcggaattctgattcggcaggcggcaggccgtcgcggtcgaccttgcttgctcgctctgttggttgagccggccataaatagctagcaatggcgtttcgtttcgtttcgttttcacccggctggagcccaacctcagctagcctggggaccgctgcacgaacagtagtcctccctcctcctataaagtaaccacccgtccaccagctagctgaggtcgtcggcc

SEQ ID NO: 4132 - DNA, 722 bp, Zea mays
ataatctgtggaaacggatggttgtaaatgcgcaacgaagtggtgcctgctgtgccgtatataactattatttgtagagtagctattagatagatatgttcataagattattcaaacaaacttgctcggcgatagcatgaatgtggatgaaattagatgcataaataaataaatggaagtagagatgaaagtggtaattcgatctgttaggataaatttaatattttaaaatagatatatataaaatttgacgttgatctttttttatgttatcaagcacattagtataaatatgaataaaatattatataagttgttttatgtattatttgctccttacaacacaaaagttgaaaaaattatcgaatttgtttccgaatccatatcaaagtttatatatattatttgaaaaaacatagtatgaatttgaggtttaccttttatgaatcttaacaagctgaatattaaaaacaagaatacaaatttatattgtatattctatatcctatttatttacaataaaaaatttaattaccaaataaatactgtttccgaccgtttttattcctaaattataaaacactctaaaagatcctacccaaaaaccattttaagccaagacgcactcgctgatcctacccaaaaaccattttaagccaagacgcactcgcttcggttatataatagggtagacgcccaactcgaacctgagtacctgagaa

SEQ ID NO: 4133 - DNA, 661 bp, Zea mays
ggacaatagaagaaaaggagaaatggagtctccttagcttccttggtcaccatccgagtttgttggcgcctgagaattcatggtcatcatcgtcgtcctaggctcctagtagtcggcgtagtgtatggctggttattttagggttttgtctttttgctagtttgctagttgccttgttgggttaggacctcgggtctggtgcgctactgtgctgggcttggtggccggctcggcctcaactcattcatacaaataggacagatgtacacgtatgaatacccatggataatcgggttcagattattgcatctgaaacccatactcgtttacccaatgggtggagattttgttccatatccatacccatggggacaattcttgtctcatacccgtaccctaataggggaattctccacgggttagcgggtatcgggtccccattgagatctctacttagaccttacctgccaagagaaggtcccattccatctcgttgctcgaagattttcaatctggactgcaaaactgggccgaattaagctcatcacacctagcccgtggggtttaccttccccttccttcgcggaccccaacttgccggaagcccgcaaccactagcttgatcgatccaaamccctcatcgatctcgtcgcatacgscc

SEQ ID NO: 4134 - DNA, 806 bp, Zea mays
caaacggcacctaaaacatactcccttcagcttcaacactcggtcgctgcacgtgttttggaaaagcggttattactctgcggatgaatgactcaaggagagagtactggacgaggacggaacatacaagactggtcagtacacatatttttatgaatttgttataatgtttaggccgacaatattttttagtttagaagtagtttctttggatattttttgtcaaaggagtgtgaaaatttgaagaaaaaaaaacccttcctgtgagccggcccaccgaaagattatttgactctagcggattttataaacatgtgtgtaatcagtaatcacaacataagctaatacctaagagttccatgcgtcaaattggctcccccaagtagcaatcccttttgaatcagtacgtcctcgtttctgatcactcacctgaacatccgtttggcgtgaaaccgatccttcccctctcgacatcgaacacaacaccgaagccttgttgctggacgttgccgagcacgttgaggccgtcgtccgccgcctgtagcccaaggcagaaatacgtccggcgatccccgcccaccacggggatgaggtagttcgcctgaggcagcgccatgtccgcagcagcggcgaagtgcagcacgatgcttggcacgcgaacaccagttcctggcccgttgccgtggacgtcgtagcacgtgtcgaacaccgagaatttattccgtagcctgcgcatccccgccgctgccgcgtgcgacacgaaggcgtcgcgaactgccgcgtacgcgtccctggtgaaccgtgag

SEQ ID NO: 4135 - DNA, 1500 bp, Zea mays
ccgcttggcgcacggtaaggccgcgcgccgccgcggggcagctggatggagacccgccgccgccagcctgtgatgtgagcattcgagaaggccaagtgggcgcaatatctatatctatatttatctgacggacgacatgggcacggcgaccgatatggtacgtggattttagtatcttttttgacagttggaaaacatgtttcgtagtatgtagattgacgctgaaaaaaaaggcaatctgtcaagtaaaacggaggttgaaaaaatggacttcatctagaatagcacgtactacctcttcaaccaaacgaaagaacaccgtggccttgtcaaacagccttgacaactgaacgcatgacgcgcatacgaaacagtcacgttgcatgtattgcatcagttgctcgtgattgaccgatcggtattcggtatgagagggaaacctgggaagcggttatacatcagtgggcggtgcaggactgcagaacgagaacgagcagtcaatcagaaccgcctttcctgtctcctgtccgtggcatggcatcacggtcaaatccaattgccttggcaggcggggaaggtaaaaaaagaagccgcggtcgtcacaccacctggccgctggaccccggaaactctccgaatcagctcagcagcacggtggaagcagcttgcaggatcattcggtcagatgactcggattcatcgaatcgaagttccctcttcggaagatacccaggtcacgtttatttatgcaggagttaaacctccttcgccaagaacgcctttttcctacggagcagggcatagactctctagacaaaaaattaaatgaacgaatggttatctggcatactccagtagaccagtaccactacaagaaatctcttctcctggacaaggtcatccggaattaatatatcacaaatacattatatgtacgtgtgtgcactgtggagtgccgctaacagctggggctggcctttcagccgaggaacagaagtgatcaccagacggacgaatctcctgcgaattctttttggtgcgttttgaattttcctgtggatttgacatttgatgagtgaatgaacttttgttttctcactgacagccaggcgtaagtacttctggtcctgttccaatgttaccgtcagctgtgacacgatagggacaccataccatttttcttcatctggacgttatgcgtaatgcttcagcgctgtcggaaccagatccaacggccgagaccgcacgaaatccgcgcacacccccactgccgctgccacaggggcagggcaataggccaataggtagccacaaccaatttccagttccattccctttccgtttctgttcctcagactctcttttcccgtcgccgcctctcgcccccgtactcctcgccaccaccaccaccaccacttccctcccctcccggcctccccccaccccacccgcacccgcccgcgcgcccctcattcattcgcctcgatttcgccggcggcg

SEQ ID NO: 4136 - DNA, 601 bp, Zea mays
tatatatatatatatatatatatatatatatatatatctgtggtgtgctctcgaggtttattatgtcagttatcaaaataattcaatgctttacttgatgacttcagttctccttgtacctcccactcagaactctgagcttctgaacatggaacttgactaataaagtaataatactgctgatgacttgagacttggcaatggtctctttcttgtcgtctatctgaggctcaaggcctaaacttcaaaggtgggattgtgggaagcacaaatctaatctatcgaatgtcctagtggaacgccatcttgacttgaatgatgacttcagttctccttcgttgctatatatcccttgaacctatacatacgcgtatctctcactcagaactttgaacctcttcatgctgcaaacccttcgcccaggatcgcaatcccacactacaaagtgatccatctctgggccttgccgacaacaaaagcaactacagcgtgagaatacttggctaattttctttagttacgcatgtatcctctgttttggctccaagttcatcatatatacgtattcgtttgttttcaggcttttttctgcggattgttg

SEQ ID NO: 4137 - DNA, 828 bp, Zea mays
ccttcgatttcctcggtcgcgatccgggtcgcagctcgccaccaagcaatgtatgcgaggaggcccaacactgcctgtaaggcccacaagagactatagagaagttggaatggatcacttgtagcaccagaaagacacggccgagtcgtctttcccgacgcaaaagtcgacgacgcgtgcgccttgctcgctcgctcgccgtctgccgtcgttctaggtttagagccaggtcaccagcgctaggagggcgcgaagtcgagtagacggccgggcctctcccgttctccacggacggctagcgctactggaggcgacgcctggacggcgaccccgcacattcacagccacaccctccacctgtgtgactattcaagggcttaggccgagccgcccggccaatcgccgtccgccggaccgctgaggtgagctgttaccatggacaccattaacctatttagatgcaggaacagatggttatgtagcttctagcgtcttctgaatttccttggagtagcatgtcatgattcatgaatcgagattttcttggtctacggagtagagctagtaggagtagcttctatctcagctaggcccctttctccgtgacaccacttagggtactctgttttgggatttggggtcaattgagttgttcgaatggggataatcagaagtggatgtgattaatgttcgactaggattagcattttacggtataacttggtcgtgcaatttaagcaaaatactgttgctaacacattttcatttgtttcgacttgcaggaatttgttttcctcatctaaagttactgcattgtattccatagaa

SEQ ID NO: 4138 - DNA, 294 bp, Zea mays
ttagtaataccctgggtactgacatgccttgcaaaagtaatcatcgccgttgcttgtttcttattgaataaggatgttatatcagtccttgagttgcctcaggctctgtccattttgagctaagctcaaataaactgatgttgtggtgtgcaggttcctgggataatctctgtgtcagcgaagctcctgccgacgatacagaacctggtgaacaaagtggcagccgagcagcaggatgagcaccggcaccctcaccagcagcaccctcaggtagcagaacccctacagccacag

SEQ ID NO: 4139 - DNA, 653 bp, Zea mays
ggggggggggagtgctttggcgatgtcggggacggcgaatcgtctccgtccccaggcgcgagtccgctccctgcggcggtcacggttcgttcgggrttcggattgccccgtcgtcggatgctgtgcagggaccgccatcggggggttggtgcggtcgttggattggtttttgggggggttcaagttccccttcgtttcagaaaaaatggccgtgtgtgtagaataatacgtatccatttattttttcttcttctagagcgtcatgcttgccaatcattttagcccgagcagtgctagtggatgcctatggacggcgagtctgcgagggttgctcggatttgttgctcggttttgcctaccgttcgtagttcgatcatcgcagtggactaacatgtcctgattgccagaaaacgtagctttcattgctaaggttatcccttagtgacttgcattgtagacttgtagtagtattttctcttcttcttcacaaaatgaaataaaggttctgaccacatgcatatatatactgtgcaggctgctgccgtagaattttcttatcattcgaatagttgatgagcgagaatacagagcaagaatcttgatggtgcgtgtggtacaacttggttaaggaaagctgactgcttgaagtgacc

SEQ ID NO: 4140 - DNA, 431 bp, Zea mays
ccaacttagtcgcctttttcagaatttggatcataaatataatggttataaatgattatgaataaaaaaaagaaaatatgtgacccaccctaatattataacgttgtgttcgccatgggttaccataaaatccaagtgattagtaagtgtaagcttgtaattagaccagatccgaatacgaacagttaaacaacccacgactagggtttgggtgctctgtttccgacagcaagaacggaagagaagtgtggctgtgtgggcgtacctgtcgggtgccttcgtcgacgaaggcacagaagcgtgatctggcccatggtgtaaaagcgcaaaacacaagggggaaaataagatacgagcacaccaaatgaccaaatggcactagaccacggcgccgagcacatctttctctttccctaccgaccgagagggag

SEQ ID NO: 4141 - DNA, 47 bp, Zea mays
tcggcggggagggctgcggcgtgctataactgtaactgtaatgtagc

SEQ ID NO: 4142 - DNA, 118 bp, Zea mays
ggttttcttttgcttactaattatttgttaatatacactatactaaatgaaaatgtagctgcaagttaatgacaatttctgtggtgcatgaataatcttcaggtacttatcatatctt

SEQ ID NO: 4143 - DNA, 1053 bp, Zea mays
ttttgcgggagataaatatttgagaacagttagtactaaatacggaccaggagacaaaaaaaattgtcgaacggggtagttactccgtccgtttttttatttgtcgcgtttcaggagcatatacacgctacgtggtgtgacgcttaacagcacggtatacgtggaggaaacggttactatatggccgggaaaaagttttatctttctttaacgcaagaaagaaggcagcaaagtcacacaattattcccccacgggtgaaaaatagaaaaatcaggagccggagaccacccgcgtgctctgctcacacatccttcagcagtcgtcgtcctcgttgataagcaggggaggtggatcactcgaacgaacctaataataagtgagcttccaggtcggggagagggaccgccggtggaaaaactttggaggcgcccaacttccaagatacccactagctccctcccagcctcccaccttgccctttccacccttcgctgatgctagaatgatgggatttttggagctctaagacaagtactactgatccttgcgcttcactcgccctcttgctccctgcgtgttcttgatttggcctcaaaatttgttgcttgttttctcgtggtgaggaactatcttacctacttgttaggggatgagacgttttttttagttctccttgaaatttatgtgcatgctaatttgtttgattctttttgcagtttgaggtgacatctcggttctaaaaatctgccagatttcttctccctgtttgtatggacaaatttgggaacgaaccctagtctgtgtgtgaagcagccaaagtagtgttcttgcggagcaaagcaaagctaaagcggcagcagttggtgaggatacaagagatacagaagggcttgttagattctgtaaagacattcttattagctgatattttttttccatcaactggggccggtttttcggaagtacgcccatcttggattaaagcctctcaatttcaggattcggcacaagcacaataccatcaggtgaacaagagccatttggtcttgggc

SEQ ID NO: 4144 - DNA, 1500 bp, Zea mays
cgccctaaaccgtaaaatgtgtagacttctccatcttcctcacaaacaagctacacgatatctagattctcgtaacagctagattatctaaaaaatctatattctcagaaaagttcttaaaaaattgtctcaaacaaaccctatatactggctcattacatattatattacgttacattacgagctcgtaaccttcaatgatataattttcatgcctggaaccgatatatgcaaattagtagtcgcaaagttagttaatataataacacgtctccacaaagtttgacattgtagttatcaccgaaacttatgagcatcacaaataatcagctatatagcggagaacaacacggcgggtctggtgacatcagaaaataaatcaacaattcacggtctcctgctagattggattggatatcgaccgttatcttttgattcagcttggagccaaatgtgttttccacgtctccagatcgacaatctgagcctagaaaattctagatcggtgggggaaggaaactatccccacgcgcagactcatcaaacaggccaatgacatcataaaagttatgagcctcgaacacaaaaaaaaaatagcgcgtccgtgaagccccagcgcctagccatctcatcggaccccaaaataggcgccgcccgcccaggccatgggaccccaccgcccccgtctctcaattcaatcaatcccgggccgcccgtccgccgcggctaccactcgcccctcctcgtcaccagcggcggcaccatctgctccgccaccgcgttcacgcgctcccgtcgctgtcggccccgctcctctatttatataccgccccatcccagctccacgctttccctaggcaggcgcgcatccagctcctgccttgcttcctctcctcccggttcccgaataaaatttcctggacccggagcgcgcagcgcgctcccccgcctcccaaggaaacttatctaagcattccggcggtcgatccatcttcccgtccagggagagcaaggaataatcaatcaaccggccagtgaaacgttaggaggaggaggagagccggagtccgtccagcgcggcgcgggttgatcccttgcgtctccgcccctgccccgcgccggcgacacctttttgcggtgctagcgttgcgtcgaggagggacaggcgctctgcgtccttcgcacggcaacggcaagacggcggcgttgaagatgcgggtgttggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttggccgcctcctggggcggcctgcactgggagcggcagatccgtgcgtccgccgcgccgaggcggccccccgggtccgccgccggggccggg

SEQ ID NO: 4145 - DNA, 1500 bp, Zea mays
actgtcggcttattgaggatttcttttattatttcatcccatcactattgtttttcagtatagatggttgcccaacaaccaatggattcattggctttatcrttggccttgtctaccatctattgcttggctatcttttaccctcacctatcgragatctaaaaaaagatgaacaacggatctagaagaagaatctgaaacaaagattctcatacacaaaaggtgcgctctcatctagtttaatttcacaagtgtttgtcaaatttgggaaaacaaaacggagagttggaacttgraaggaaaaaaatcattgtgatcacttgcatcacttgatattccacctcatctgtcatctctctcacacacacacacacacacgatgtgttgctattttttggagggagcgattcaagtgttatcgattattttccatttggatcaagaactcttccgcggaatgtagagtggccatgaatttagaatcggcatctcagtgtggcacgctctgtgatcgccttacaagtatgcggatacgcaaaaaccgcgcagcaatccatatccaatccaaccgaaccaaccaaccctcgcctcgcgcggtccgcctccgccatcctcatccataccccaacggcgcgaatccggcgcggggcatctcgagaaaatcgttcgttcggaagtgaggaaatccctcaacaaagggagatagaaaaaccagatggcgttagactagccagccgctgcctcggcccccaccagagcagaggccgccacaccctcacgtcccttcccggcttccccacccctcctcctcctcctcctccgcttccctcgcgcggcgcggaacaagtccaaggggacggcaggaaggaagaggaggcttccagattcttgcggaactcccgcgccacccctctccacgccaccaccaccgccttctcctcatagccagccagcctcccgcgtagggtttccgcgcgccaccatctccactccaaccccagcacccacccgtcctaccgccgtcgcatttggacctctgcgtctgcctgcagccctgttcgccaatcgccaccgacaccccctcgtcgtaccggtttggggatttcgttttccctttctcactgttgccggttgtatcggggatctgggagggaagtgtttgtcttggtgctgattgtttctgacgatttgggcgtcattatccaggtcgagtggtgttggtgatgtcgggtgattagatttgggggtggattggtagaggggatactgattagctgttttggggcgcctggcttatctgctattggattgggatccatgatcgagactgctccgtgaagtttttggtcctagggattgtgttttttgatcggcccggaccaggaatagagggttctcttgagggaggagatctagggccgcgtgttctatcgttctctgtagataaaatcaaaaaaaaaggagagagagatagaggtagtggaagggagactggaggct

SEQ ID NO: 4146 - DNA, 1500 bp, Zea mays
ctaatttttagtcgttttggaccgaaaaatatagattggtcaagccgtttagtaaagcaacatatcacacatacttgcaaattgttttcacatcttaatgaaatatatatatccgtatgcaaattagcaagtcaatttttagaatagttcatagccatcggttcagaactttatgcgaaagaatgttggctctacgtctgcttatgcgaaagaatgttgtctcttccctttcctataggagggtgaaataagttttaccagcagcgtcgtaccggaggtgccagtagccttagtgtaccagtcgctcctcaaaatggactcactggcagcaaaatgttctctaacgagttgactcgcgtgctcgactgggattgtactttgtctcttctgtcaactgagctatggtgaattctatcgacatcaacgttagcacgatggttcgcccaactgagcatgtccccggtccacaaaactatgtagttgagaacctcacatgtagattcatattagttaacagtttgcttgaacaaactaacacagttgtttgatctatgcaaaagatggcactgattgtttgatctaaatgttgcgagatgctctccaataaaaattacatggttgcctcatggtctatgtaaggaaaccttgaatttgaatgcgtacagcttcagttgctctgcctgcttttagaggattcgtctttagatgggttgaatattgttatattacttgtctttatgtagtaatgtagaaatcttgccacaacacattttcctacaacataaacgataagagggccatatttttgtgctaaaataattctgataatcacaactgaccatcccctttcaataggattatgatcttctttttatagttttcaccctacaatacaaaattgttatatggaggccatggtatatcatggtatcatgtattatcaacttacgatttgcctatttcaattaatagtggcattgagccaattttggktgttcgaaatggcagatttcgatgtttgctatgattgctgagttgattattgatagcatcactaaatagtgacctatgcgtacacaaatatcccccattgcaacgcacggatatatacctagtcatatatgaaaagctattctccaatgaggaattcctcattatcattcctaacattacaaccacttttgttatttgcgctgggctgcggctgcttctacacaccagcgaatccacagcatcatgggcctgcaggatggactccagcccataaaaacccataaaaagggtatttcagtcttttcttatccaattttctctctctctcccgcctcctgttcagtttcccactcgccggaaccgccgcctctccaatccccgctaaccctcgctccgttttatcgcccccctctgcttccaaatcgaatcgcgtcctctccattctgccgtctcctctcctactcctcccccctgccgccgcaagatccaccagggctctcgaccgca

SEQ ID NO: 4147 - DNA, 746 bp, Zea mays
aaagtcattatctctgtcgagtcaggcgtgatgttggttttgcttagatgcctgtcctgaatggcatcgctgcgtccatgtgaagtagatgcaaaccattcctttttatgtttgtgtgtgaagttagaactatgtatcagtacttctttatgttttcgtcttataaatcctcgttgctgtgtcagttctgttgaattcgtggtttgtctccctgaataactcactgtatggtgggtgtaaattaaatggaaataacttatcaggagaacatactgtgcgactctatatatgattgatttggtgaaacagtacaaacattgtttgatagtcgaaataatactaaacttcaattccatgaagctggataaacttttttaaaatgaagctggataaacttttttaaaaatgaagctggacaaggccgaaacaagaaatgtgtttctaaaccgggcccaatctatcacggcccatctgccaatttatggcatgaaactgcacaaggccgaaacaaaatgctactgggccgggcccaacccagcgccactctgtaaaatcgcttccagtttgtcttcctccagaaaaaccctacagttcatccctctcgacgcgccgccgccgtctcgccgctgcccacccaggtaatttccgggtttcggagtatagatccttccgggcgacccattttttttaacctgctgatggtaaagtttcgtccgtatgcagattgacggctccaattggcgccc

SEQ ID NO: 4148 - DNA, 158 bp, Zea mays
agtaagcgcgcgcgcaaacgtggctgccgtattctctctctctctctctctctctctctctctctctctttttcccgttctgagctgagaccgcgagagagagaaaaacgtggcaggctgacttcgaggacgcgctgtcgccgacgtgggagaacctg

SEQ ID NO: 4149 - DNA, 1424 bp, Zea mays
ttcgttgttcggctggctgctctgctgggttcgatggaacagggagggctacttgcctacttcgggaggctagggagatttgaacggcgggcgggggaggtgggagttgggacttgggagtgggagacaacgcgacggcactactgctgttgctgttggtggtgacctgactgctgcgtgctgacgaggaagacgacacggaggcggtggctgcatcttcaagatcacgagcgccatcctattttgttttactactttttatcagaaaaacctattcacgagtggagctgcggcgcgggccatcccggattctttggtgatgatcgcctgcgctgtgcaactgcgggctgcggcgcaggtgtgcttgaggcttcgttgggaatctttgacggagcagaggatccttcggcccctccaggatccgggtccatgggacccacgtatcagtgtctggctcaatagaagcctgtgcagtgaaacaatgagaagagctcgagctcaagtattctcagcccatgggccgcacatacggccggacaagtaaacgctaaggccgcatccagctttaaaatcaaaaccaggccgcacgagcacactctctcctctcgctcgcgtccgcacaaatcccgtgctcccccgtctgaaaaccctccccacctccggcggcggcggcggcgctggcgaccgggtgtcttctccggcgagtctcccccctagtaacaaggttcgcgcgcacccctcctaatgtccccttttcatccgtacgcggtcgcgtgctgcgcggcagccctagcgagcggcgaagtgctccgaggctggcaactagggtttgagtgcgcgtgcagtacccttgtgctcgtgtgcctgcttcatggatgcatgcttcatagatggttggttcatggatgcgactgcgtctggacgtttggatcgatttattatagtgcccgtttgggggcacgtggtgtgagctcactgctctgctgctgattagggtgtactgtctgtgctctttctcgtcttctagtggcctgattgtgcctgcatacagagcaaccaagctcatggcatgcaggtgtgatgtgtttggttgtagaccggatggacgcagccaggctcaggcttatttcttgtttggttccctacatatgcagctgagcttttctctcctgatgcaacgggccaggctctggagatgcgacctagttacctaaatttaggtatccatggagccaggctcccatgatgcacggccaggcagatattgcaacaaatcggaccctaaaattgtgtggttattagttttcttgcactgccttagctttttctcccactctttcgactcctgcagagctcatatttgagaggtactatgcatctttataattaacttgagcttggttgcttggttgtttccagaaaat

SEQ ID NO: 4150 - DNA, 1500 bp, Zea mays
ccatgcatatcttgtaagtatttatattggctcaattccaagcaacctttacacttacattatgcaaactagttcaattatgcacttctatatttgctttggtttgtgttggcatcaatcaccaaaaagggggagattgaaagggaattaggcttacacctagtccctaattaattttggtggttgaattgcccaacacaaatctttggactaactagtttgcccaagtgtatagattatacaggtgtaaaaggttcacactcagccaataaaaagaccaagttttggattcaacaaaggagcaaaaggggcaaccgaaggcacccctggtctggcgcaccggactgtccggtgtgccaccggacatgtccggtgcaccagggggactcagactcaaactcgccaccttcgggaatttccagaggcgactcggctataattcaccggactgtccggtgtacaccggacagtgtccggtgcgccaagggaggtcggcctcaggaactcgccagcttcgggaaactccaacggctcgtccactataattcaccggactgtccggtgtgcaccggactgtccggtgcgactccagagcaacggctacttcgcgccaacggctacctgctgtggcatttaatgcgcgcacagcgcgcgcaggagtcagaatcgcccatgctggcacaccggacagcaaacagtacctgtccggtgtgcaccggacacccaggcgggcccacaagtcagaagctccaacggtcagaatccaacggcagtgatgacgtggcaggggggcaccggaactgtccggtgtgcaccggactgtccggtgcgccatcgaacagacagcctcccaacggccacttttggtggttgaggctataaataccccaaccaccccaccattcattgcatccaagttttccacttcccaactactacaagagctctagcattcaattctagacacaccaaagagatcaaatcctctccaattccacacacaaaactctagtgactagagagagtgatttgcttgtgttctctcgagctcttgcgcttggattgctttcttctttcttgatcctttctttgcaatcaaactcacttgtaattgaagcaagagacaccaatcttgtggtggtccttgcgggaactttgtgttccaagtgattgagaagagaaagctcactcgatctgtggatcgtttgagagaggggagggttgaaagagacccggcctttgtggcctcctcaacggggagtaggtttgcaagaaccgaacctcggtaaaacaaatctccgtgtctcacttacttattcgcttgggatttgttttgcgccctctcttgcggactcgtttcttattactaacgctaaccccggcttgtagttgtgtttatatttgtaaatttcagtttcgccctattcaccccccccctctaggcgactatcaattggtatcaaagcccggtgcttcattagagcctaaccactcgaagtg

SEQ ID NO: 4151 - DNA, 1500 bp, Zea mays
gatatggggctattaataccaccccaactagccatttctcaagtgtgagagctgagaaacataggaagtgagttgagactccaatcctttagctctatacactcaaatgcttaaagaatcactcgatgattaatgtaggtgctttgcaaagtgcttaggttagttagaccactatattagcacttgctctaggttgtgcctagctgttagaagtgagcttagacaccctcaacttcttggtgcttatgtgcacaattgtattgtaccgggaggggctgtatcctacgagatcacaccaaatgtgtatgttgtgtggctatcaccgtgtgtcgaaggtaatgaggttcgcagcattttagtcagaagctcaatattgaagacgacgaggagcatccgagagaggtcgaaagcggagcaccacttgtgtatggagaaggcctgtggctatctacggagttacctaactgtggagcttggcccttgtgcgagattctctttgtgtagggataccaatgagaattagtaaaaaccttgcatgattcttaataccttggtaaaaataccgaagcatcaacaataatttacttctctatctcaattaagcttccacaattgtattgctacctttggttgtgtgctttacctttcctagcataatcatagactagttggtaggattggagcctaggttgcataactctttttgcggtagagatagcaacacttagacaaaaccttagatgcactagattgcttggccatccatataggtcttgtttaataggaaaaaatagaggcatggattaaagcgaaaaatagctatcctaattcacctccctcttagtgtcggcgttccgagaccggggggtccctgagccgacgagtgaatgtcgccgcgtgccccagcccagatgggtcgagcgcgagggcgagcgcgaaggggggagagcgaggcggccggagaccggcgtgagagaggtgggaatcccgcggccttcgtgttcgtcccgcgcccaggtcgggtgcgcttgcagtagggggttacaagcgtccacgcgggagagggagcgagcggctccaagcgagcgcctgttctcgtcctcgtccccgcgcggccaaccctctctaagagggccctggtcctcccttttataggcgtaaggagagggtccaggtgtacaatggggggtgtagcagagtgctacgtgtctagcggaggtgagctagcgccctaggtacatgccgttgtggcagccggagagatcttggcacccagctggtgtgatgtcgtggccgtcggaggagcgatggagcttggcagagggacagctgtcggagcggtcgagtccttgctgacgtcctcttgcttccgtaagggggctgagagccgccgtcgtcacagagcatgcgaggcgccatcattgcatatctggcggagcgagccagatgggacgccggtcttgttctctgcggcccgagtcagctcggggtagggtgatg

SEQ ID NO: 4152 - DNA, 871 bp, Zea mays
tacaacgctgcatagtcaaaattgcgtaatatatgtaggaaaaatataacccaaaattgatcatgatttcatatattgaagaatttgaccataatttgaaattgtttaacataaaaagatatcaatggttgagacctaaaattaaaactgtttgacacaaaaggttaccaataactgagacttaaaactatatcaggtgactaaagtaattaaggataactcaagataaggcgctaaacgattcaaaaattgctatccctgttccctaacaaattgaatctgaatttggaatagactagccagacatcagtcacgcgctyaccacagcggagatgcagcggggctggatccagaggctgtatctgcctccgcggcggcgcaggaggagcgaggagccgaggagcaggccggagagatctggagtcgccaggcggctttccgttcgccgccttcgctcgaggcttggttcgccgccgcggtactccagtcgcgcgactctggcccgcggacgggctgaacggacagattgggctagattgaggcctgttgggccttcggacctcgccagaatccgctacaaggggagggcccgttaaagcacaccctgtggccccttggcaggtgcgccaaactgtggccaatgcccatgcgggttgcaggaatgggtgactgttgcggcggcgccaaccaaacgcgtcgtgctcgcggcaggccacgtgtccctcgaggctcctccggcgaccacgtcgccgcccgccatatgaccaacgcaccaatcagactccgccggcgggaagctgatcgttcactgctactagcgcagtgcccacgctggtgcagcaccggatcatctgtgtgacaaggaagaaga

SEQ ID NO: 4153 - DNA, 354 bp, Zea mays
tcattgttttagtatagtaaaaaatgaattgtccagtatatgttatccttttaattgtactagctagttgattgcaagcgttttttttgtttgaaagttcaggcacatgaaacgtagaactcccaatctttattgccttggagttggtgttggttctgtcgacaaagtcaaaagtcatccttattatcatataaaactcttctgtgatgcatgcagcgagctaactgctcctagtaaattatagtagccttgaacatccttcgaattagttcttttatcgtttgagcatatgctgtgtatcaaaataaagcatgcagccagtctttcttgctcaacgactcaaaacctcgcttg

SEQ ID NO: 4154 - DNA, 142 bp, Zea mays
acaggcggccaggtacgcgcccgtccgttggaggctgctatgctaattgtcatgtcccactagatctgatggcaaaattttgatcattagataatcttattgagtagtatacacaattttgatcacaaaattgtggtgttca

SEQ ID NO: 4155 - DNA, 1500 bp, Zea mays
ctgaccgtccaatttttatctgactcggagctagtactatatataatgtaaaaaagccaaaacaaatagttccaatgtaagggcttgttcgtttgtgtcggattggtgggtcggaataattccgagccggattgcttctataatttatataaactttgattaaccggaacgattccgggtacaatccgatgtaaacgaacaaggccttaggcaaggttggatccgccttatccatcgccaagtcagacgctgatgcatgcatgtctgccgcatttttttattggtttgatgacgctgagaggccagcctcttggaggtcccgragatcattcaccgtgccttcctcagcctcccctaaggacgatcactacttaaaactatatacttttgctcttttttagacatatgaactttgttgtgcttattgtatttgcttttgggtcatcaacctaactaccgcatataatgttagtggttataaactattgttatgttatgtaatatatgtggtctgcatataatcgtcaagtttttgcctatttgaaagcactcagtttttaagaaacaggtttataaaaactgacttggttccaaatatatcagtttgtgtcccagtttatagaatctggattctcagtttcttaaaaaccaagaagctacttttccctagctaaacccaatttatgaaaaataaagtggttccaaacattataacccatttttttttcataaaccagtttccaaaaaatagagacatatagaaattgaattcttaaaaactagattgctttcaaatargactttggaacaacttcaaattatcgtgttatgagttatttgcaatccaaatttattactattattattattatactttataccatcataaaagagaactttgtgctatttatattatttatttatgtatagttttgacactaactacagaagcggttgtcacatcaagccgtgcaacacgtggccaatgatctactatatgcatataaagtcggcatgggacccgatggatggaggaccacacgccactactggagtactgtatactacgtacgaatgcaaagcagctagcaaaggcgcgtcgtggtcgatcgagtatatccaggcttgcttgtctcgaaagtcacagcaaaagtcacagcaagctaattactccctccattccttaatatatatcgttcgttagtacaaatttgaactactaaataacaaattaagagaaacggaggagtactatattcgaagaaattgatgttgcccttggacagatccagcaaccactttcgttggagttgagttagattggacagaccgtttcgattgggccccgccttatcaatcgccaaaagtcagacgccgattggctgccgcatttattatattggtttggtacttggtagtttggtgacgctgaggcctcgtccccgatcagacttgttcggcctcttcgacggcgtgcccgtctccccgggctcattcgcc

SEQ ID NO: 4156 - DNA, 394 bp, Zea mays
taggtatgttgtgagccgtcgcaacgcacggtcaatcgactagtatagatttatgtgctatgtggacaccatattatttcgccgtgtggatcgttcatgtagtaactattttataattttatttatgctttatagtgctttaacaaatatgaattcatccaaataatttcaaactaagatccgaaacataaggccttgagtgtgccacgctaatgggtgataaaaaaatccttggacctatcttgtcccacagttcgttccacttccaccaaccttcattgacttgtccgttgactaatcgacgactgatccaaaacgtggcgagtggtgtttacattattgccacgtgaccacgtcgacggtggaagaaacattcgctgctcatggttcatga

SEQ ID NO: 4157 - DNA, 1180 bp, Zea mays
gtttagttcttaatggatactttcctgtatttttgtttttggccaccgtatcgtacctccggattgtattggtctattttggaccctgttttcttctttttaatataatgatacgcagttctcctatgtgttcgagagaaaaaaaaactagtacaacaacttgaagaaacatacttttatgaaaataaaaaatgcaagaatcatgatataggcattgcagttaacattaggagaagacaatgcctatagttatcaggtctccacccgtcgcccgcgggttggccaaaagcgggagagcaccggcaataaaatacgctcgggaagctgaacgggggatgggcggacgcttccagaactctcgcccgcgccttcgcgaacgttcgccgccacgtcaccttacccgctcccggattaaacaacgcccccaaacgaaggcgtcgcggccatcccttccattccagaaccgtctggaatgttcggcgccgacgccgggtgcccggcgtaccgtgggggcctcgcgccgggccgtataaagtcgtcgtcgtggcggcccgcgtgtacttgcctactggtaaaggtcccgacgacgcggtatcgccgtatacccgcctcaagtacaaagggaaagctgcgactcgctcggaagtggggtactgtacttcccgctcgctcgctctctgctctggtccttcacgctctgtacgttcatgcagtgttgctctcactcgctttcttcttcctcccctcgtctgcccctcctctgctctgtgccaagttctgcttctcgccggggcagtttcagtactcatttctttccttttctttccaatttgcagaaccttcagttgaggttctctaatcgggcccgctaaagtcgagagacaggttttcgcgaacatttgcatctagccatctctactcaactgaattcttgtgctcttgtggcattcacaaagtccattttcagactgagctagttcagctgtcatttttttttcagccaaaggtcgcgttcttttggacctgctcttgattcgttcgttcgttcgtttggattgattgattgattgattcctttcgacttcccttcaccacccccctgctccgtcaagcgtgcctctgttcttctgccattgctggatcgcgtttgtctgtttgttgggttgctggcgctgcggcc

SEQ ID NO: 4158 - DNA, 1174 bp, Zea mays
tctgtatatctccgacgacgacgaccgatcggtccgccgccgcgtgggccggtgctgctgccgccttagctaagagagttactacctagctactaccaccagcgatccgccgccgccgcgcgcgtgggtacgctggacgattgagacgactggatcgaattgacttggtagcagcaaataaacgaaacagagatcgatatccgcgatacaagcagttggttgtgcgtgctgggtcggcgggggggttttatagatgagatgagatgatatagggcgagacggggatgaaggcagccggcccccacgccacgccacgtcaccgtctacgtgtccgcggccgttgcggcaggcaggcacaggccgagagcccgagagacccggacgacggaggattggcataatgccgatccctgcttttgtttagggcaataatgcaacggggggaggcgttgacattgcgtaattgcacaattgcacttgcaccccacgcgccgcccaaacggctcggtcctagctagctagctatgagtacacagattgttaggaatctagccgatattccgtgctcagtttaaacaaaaaataacacggtaaatttaggacggcatgtatatgcatacttataatactacctcagtaatttaggttctatttggaagtaagacaatttttaagaaactgttttttatattttagctaggagaaggtgacttcttggttttttaagaaaccgggaatccaatttctataaactaacgcataaactgatatgtttagaactacaccaatttccataagccaatttattaaaaactgggtgcttccaaacatatccttagatcgtccttaaattaacacaaaacttctatagtttgaattttcaaatcctataaaagaatttctctcttaaatttatttaaaatatgcatgctcaaacggatactgattcatgtcatgcgaatagagaatgaaaacaaaaaaaatattgcgtgtgtgaggaagaggacatcccagtatcatatcctataggaggaccttcgccacccgttccctcactaatcctatataaatgactgaggaagagcttctattgtcaagtcatagaacggggttgcgaggtagcccaattctacagcactagtctttttcgtctcggtcgccatgtccttcagcg

SEQ ID NO: 4159 - DNA, 462 bp, Zea mays
gctatatttggcttccctctaactctcactgatatctcatttttgtcttgaggcattcactgcgtgccctgcacagatgtgacccattttgaaaaatatactgataattcctgggcgtcccccccccaatgggtgtgggcaagggacggcttggtacgctgagtgttttagccagctgcttctgagtagtaatgtgatgtgacggcgagtgtaatcatatcctttgcgctgttgactggagtcccaatgggtgtagagttgcatgaaacggcgtcagccgcctgacgtgtcttcagacgggttgaagtgcttattgaatgctttgcgactgttcggtgaccgcggttggaggtgagcggttgccttctccctttataaataacgtcgttacccctctggttttttcacatctcctcgttgttctttattgcttccttctcttctctcccgtctgcttccgcc

SEQ ID NO: 4160 - DNA, 1500 bp, Zea mays
atcgctatcgctctttgagctcctctctctagctatgttcgtagcccgcgttttcgcttgcggctcacccactccagcgctccatcctgttcagctcccatacgatgtgcgctgtgcggccgtttgccatggtccttcttagactgtctctagcaactattctattctatcttctattttaaattttattttacaaacagtataatcaacaatataaatcttctattttaagctatctgttgttgtggagcgccttacgctcgtgccggtgtcgccatatgcgcccatgcggccgtccgcccctccccgttcagacaacagtccagaccactgtcatactttattttttttggttgtcctccacgactgcccatgtttttacaactcaattcaatacaaaatccacatacactaaattttatggtgcatagaaacatgagctgcgaggtgaatgcgggcacccggcgcacgcacaagcgagcaaaaatggagtgataaggttacgcactttcagcctgtactatgctgcaactcaataaacttgtactcctactactttgtattgtatgtttgtttacatgggctttggctaaaattgtcggaatgacgcaaccgaggcaacggactgtattccccaccaatccagcccacgttcttctaaaaaaaacaatccagcccacgtactacgactcatcccgtggcttgccgaccttcctcaaccgcaactcttttataggcgtgtaccggtctacgcgccgtacacgcctctacagatccaggcgctcttctgctgcagcgccgcctctcgtcctcccggcgtcatcgtcgccgccctgatctccgcaggccggcgtgtggcggagatccatccgtgcttgaactgactccttccttagctagtaaggaaaccctagctcatctgcatgcatcttttggttcgttctgtggaatgatcctttgtttgatgtgagttgtcaaatccttcgacctggtgtgatagcgtcgatccgtaccgtgtgttgtggttcgtgttttgggctgcagcgtagtaaaaaacttcctttaatttgagtatgtgttcaattgaactcctgtgccgctacccgctagtttggactggtccgctcgtggtttagggcctgtttttctcctagattatataagttgtattatggtggaagggtaggagagtaaaaacactttgggatcacaaataagctgaaatgctacccaatactagcttatttgtggttccaaagtgatattttaccctcccacttttccaccataatccaacttatataatctaggagggaaacaaacacaccttagttccttgttttttgtaagtctggtaaggcaatgttattattgtaagttcactgctacagagtaccttctcttttgaaaagtactggcacttttttatcatttattattgttattaatcgcttgagttgatttgagttttccgttcatagcaagtacctattatcaacc

SEQ ID NO: 4161 - DNA, 1500 bp, Zea mays
ttaaataaacaacaagataatactctctycccgttcataaatatatgacactgttttttttctcgtcttattcaaaaaataataagttttttgtgatttgttttatctcttaaggcagtttgttttaacttaaaaatttttatttttgaataagacaagtgatgaaagttttcgaaaaaagtcaacgcgcaaagatagtggagccgccaattattaaagacgcgaaaatgggctcaaagcttttctgtgcagccgaacagttgtttctgggccagtccagaccccaaacagtacagctgggctgagcgcaaggctatggttgtttgtgatccgaatcagattcttccagcgccaggcaccccggcgaatcagcgacgcgcgtcattgattgatcgctgcctgccccatcggcccggcggaccgatcactgtcgccgtgcttgcaggtgcgcgcgcacttgatccgacagctccgtggcaaccacccttggctcccaaattctacttgcgcaccagccgaagcagcgaccacgggtgagtatcgcacccccatgacgtcgccttgccatcgtccgcggccctcccctcagccaattcttagcttgtgtcaacaacaactgcgacgacctcttcgctcctcgccgcccgaaagcgaaaggcttggcggcgcttgatccgtgcccgtgagaaggctgtgtgtggccgtcgcggtggtggttgagaagccaagggaagggttgagttgagcaccagaaacgggtggtgggacacttgttcgtccttctagagaacaggcggtggtgctgtaggctgtgtgtgagggtgaggcaggcagcagagacttggtcggaaatgtacggttgctgaatttgaacggcgacagccgcacgaactgatcgatcgtttcaacggtttccatgtccagacttcagagtccggttgctgctctgcttgcagggcttgcagccagccaggtaccatgcgaagatcccagtgcaccactgacatgccaagatcttgcctgcatcgcatacctctaagtctgacgctcgcttttcatgtactttacttttggaatttcctagtgcttcctccaagttcagttcctgctcctaactgccatcagactcgccacccaaaacgcaccaaccagaacaatcacccctcaccaacatctctttcttgtttcctctcctatttatttatttatttaggaatccaaaaaaaaaggttatcttggcttgttttacactatcctcactccaaccaaatactaggggcaatatatatatcaaaccaaactaagctaacaaccgctgctagtgctagctgcagctctccgtagctattaaatactataaataacggagaatccaaagcctaatccttggataaaaattctagctaaaccgaggaataaagagcgataagcccggtgtctgtcaacactccagaagagccgcagcgcaaaggagactcctttgtggcgtgcgcgaccagc

SEQ ID NO: 4162 - DNA, 297 bp, Zea mays
agggctcgttgctgtcggctgtcgccgtcgccgcggggccgtgcactcgatcgcccggcaccgaacctgacgtgtcccgtactcccgttgcaccagcggccgtagcacgcacccacccgcctcgatcgaaagctgatcgacgaaaaaggttgcgccgcccccgccactgttctctgaagcgctcgtctcaaccaccatttgcttttgctgtaacactcttctctaactacgccgggatcatacaagaacgatacaatattgtattccaatacgagacgtttacgtgtagatatatat

SEQ ID NO: 4163 - DNA, 1500 bp, Zea mays
tgtctaaccagtaaaacataatattcagatgtttttaatattaaatataaattatatatgtatatatgtttttgtaaaataaaaaatataatcgtgtcggcttagactagtactacgggccgacgttcttggctcttgcaaggatcgtgttgtaccaagacatattggatggagtaaataataacatcagttagctaaatcaaaaaatatattatatggagagcggagacaatcaataaaaaatcttgaaattttttggtggataatttatatgagtagtattgttgtaagccgttgtaacacacggacaactgactggtttgattgaatggatcaccaaatatcacattgatttgagcagaatatgtcatccagcgacaagatgggttaaccaaccattcagttatccgaccaaacatctcaatcgtatacaagaatcagataccatcatcaacagtttcatgaaaatcagacggcaacaatggttccatttatatatactaycgctccgcaccatctcttactgaaggactagaatagggtggtcgtgtggcgcacaggggtggtaatagatcgcgatctaaataattttttataaaatattaggactctaaataaattttagttaaaaaataaaataaaatatagtccgattctaatccaatccttaaatcttatagtataaaatttagagtctattgtcacctctagtcgtgtacataagggtcaggtagtaatagattgtaacccaaatgtttctacacaaaatgatagagccctaaataaattttagttyaaaaatgaatataaaatatggctctaaataaattttaattcacaatatggtaagttcatatttttcttttagtctactcgtggctactacactcggtatactatgttgatggtaatggtaggaaaggatcgtcattctaggggcaaataatcagcatgtgcaactcaatgacgacgagcccgtgctcaaagtcgcacccgtcgaggagaatggtctccactgtttattccttgacgatgacaattttatctggcaatggaaaaatagtaccagtgggcgaaactatatcttacatctcatagatctccttcgcctgatatccgagctcaccatactgaaataaatcgaagtacctaggatgctgacaggtatgccatgagagatcttgtttaagagcaggaggtgtacaaaatccaatttcaataggctcaaacacactttaacacgttgcctaaacagggcagtgggtaagacataaaaaaaatacactaaactctgtgttgaatcgtccgaaagtcctcaatggaacctcaaatcaaaggaaaagcttagggcgattgaccaggcaacagcttcgagtgacgacgcctcactgcatctcgaagcgtttggcaatcagcacgctcatgtcgaggaacctctgagcgcagttggtcaggcaggttgattccccggagctgaacttgctcccgggagcgctggtg

SEQ ID NO: 4164 - DNA, 850 bp, Zea mays
tgcatgcctgcagttgaccatggagaggccttgcaactatcagcaatctattttcagttgcattgtgccctagtaaaatttctatgaagttaattaccgtatagcattatccacttgcatattttcattatttttctcttggctatacatgtttacatttgtctgcattcttccttttttaaaataaaaatatgccctgctttttaggaaaacacatataaggtagcttgcctgctttctttgtcaacttggtttggcaaatatatggctgtatttgttatcagttttcatctcatctaggcaggataaaacagggaacttaggagcgcatattcgttgatgcctgagtgcaatgtgcaagagcacgtcacctactgaattttacatatttctattagttttctctttgggggttccatttgacttcaatcgttgtcgacttgatttctgatgaaaggaagaatgactatgttatattataagctttccttctcagctaggaagataatacaaaaaaaaaactgaaaagaaaggtttggatagcctcttactctgattcattgcaagtaactaaatgcgatgcaacagttcatttgtgaatcaacgatgacagactgcaaaacccatccacaatattgaaacttttattttcagaatgtcgtgataaatttattcattcacatgatatgaatccttttatggtgacttggtgcagggccacttcgatatactctctctttcgggctcattcttgcttgcagaggatggtgacactcgcagcagaacaggtggtttgagcgtggcactggctggaagtgatggacgcatagttggaggttgtgttgctgga

SEQ ID NO: 4165 - DNA, 586 bp, Zea mays
cccggccgccgaggaggactgccgcagctactgcggctcctcgtcgtcggtcctctgcgaggacggcgcgtcgggtccgggctgcggcgacgaggccgccgcgccgccgccgttgccgttcgatctgaacgtgccggacccggcggccgacgacatggactggcgctgcgacacgctgctccgcctctagccgccgccgccgcaggcccgcaaccactcctccccagactggtgcccccaggatatctcgctcgcttcgcgtggccggccgacgctgatccggcggaacggagcggagcaatgcgtgcgtgcgtaccccaccccgccatgaagtgctatcgtgctattttgctattctctccatagaaattgataattttagtctctctctctttttttttaccactgccaagactcggtaattactctgtgataatgtgaataactcattatgtaatccgtggggagtggagggagcctggtctcgcgaaaccttcctgtctcctcctgctgtgtgtgtatctgtagcagcagcagcagcagcacgatgtaatactgtctgtcttgctgtaattctcaagagata

SEQ ID NO: 4166 - DNA, 1500 bp, Zea mays
tatacatttttattttttgtgaatttaaaacgaaatttgaaagaaaacatggtgggaaaccgtttccaaaggctggtgataaactggaccgtaggtttaacgtcgattttttttcaaccctggttctatcccagacgccgtttgatccacaaaatgtaacgtaaatagtaatggtaatgattcactcttaacgatcggcggtaacaagtttgaataagccgatatccatttctagtgtggtatccaattacggttgaacttaaacaaatatgatttaacgttattggttgtccattacgttaccaatatgtgaaccaaacggcaccccagttctcatcccgtcttattgcatataatctccttggagaagtcagctctccagttttggtatatcttcatattgatttgtctaaagatatagccatttctctagttccagatggtccaacgtacaatactttatggttgcatcactaatggttttgcccggccattagttcccgttttgcatcactaatgcttgcatcagtggctctaaaacacgttgtatctccattgggccatgctggtctaagtcatcccatatatttgaaccatataaaattcaaatattacaatcaaataaagtttatcgcttactaaattaaaaatattaaacaatatgagtagcatttgaccacataagttctaaatgttacaacaacattaagtctatgtattactaaattaaagaaactacacaatatatgatttattaggacgtatcggcgcaagcaagacccatacgtatgtgccatgctggggcccaacaggccaaaatttaagacttgactttagactcatgtttttagctcagtccatattatttcgtgtcagagcatacttactcatgtttttaaaccgtgctcctgctgcctaaaaaataccacccatattctcagcactaaccaccaccgctgccgaaccaaaacaggcaccggtttaggttttgcccggcccagtccaagtgtccaaccctacagtagttagcgagaggaaaacagacgcaaattaaccgtttatttacaaaccaccaccacccggccctacctccagttcgacacgcagagcaaaaattcagaaaggcccaattaggacagttagaataaaggcgccataggatcacggatcaccggaggcgttttgcgtgattgattgcgtttcgtaagactcatttctcatttgttttgctacgttcgctttgtccctttcctcctcgccctgtgcttgtctcgcacgttctctctcgccttccacaggcccccctcccctcgctctcccatctcatcatctcggcggctgcaataaaataaatctcgtgcaggggggagggcgtacgacgacgtggacgcaccgtcaaaggcaccaggctgagcaacccctctctctctccctcttatccccaaggcgaggagcggagcggagaggagggcccttctgcttgtttctccgctttgcaag

SEQ ID NO: 4167 - DNA, 161 bp, Zea mays
cgtgcgtgaggagcactggctcagctcacttcggctgcgcctccatcgatctgccctcgcgttctatggttatcatctccccttgcgctggttgctgatccgtgctctgcttatcgaatctcctccttggtcgcagggtccggcggcgaagggaaggcaag

SEQ ID NO: 4168 - DNA, 89 bp, Zea mays
ggtgagcatagcgccaacccacctcctctctcctccttttactgcgtttattttccttgaactgctgctctgtttgtttgtggttccca

SEQ ID NO: 4169 - DNA, 727 bp, Zea mays
ttttctgctatcattttgaggactagcatctgaacctagctcggttggttaagggtgcaaatgtattcaatatcgtggatcctcagaatggctagaaagcgccaacactttcttgaggagaaatgtgtgcattgccgtagatgccaacttattcggaagttacaatatcctttctcgcttgcttatctacttgcttgaaatttacgatatttgtcttgtactggatgttgaaatagtctttttggcaaatatgttttaccgttcctagggctaatggttggaggtcactgttattgtgtgggtactaaccaaatatttaccgcatttcatgacttgacctccctatgttcaggttaaaaggaagaaagctaaacatgccgggatgtttgatattgccaagacagcaaatagacccatgatacatataggtggctgaggtatcctcttatcaacatctgtacatttttactacaatgactatgtaatagattgttcacggacatgacaagattgatatttgagatgatttatcgcatggcaccttctatagttgccttgttgcacgcccagtttggtggttctcaaacttcagtagtcggtcccttttatgttctaacttctaatgaggaaaaaaattgcaaaccatttcatgagatcactgctgagtttaaacatcccatggatttttactgctgtttaagatatcgttttggaatctggtgatcaa

SEQ ID NO: 4170 - DNA, 268 bp, Zea mays
attggttatagagtagagtttataatataagagggagataaaaacaaactagagacattagtattagtgggttaggttaggtacatgcctaaacacaagcaagtgggcagaccactaaagtctacaacagcttcagctgcagcgttcctctcccgtatcctgtgccagctgactcgccttctcaagttctgaaacgcagcggagcgcgccggaggagagcaaagcggacagtggaggatagagagagcagaacaccagatcagatcag

SEQ ID NO: 4171 - DNA, 226 bp, Zea mays
ggtcaggctgctgaagctgctggtcaagtgaactcatggggtagaaaaaattacttcctggtctcatcaaagagatcctgcccccaggttctgttgaccacaccaccaggcttgttcttggtaatgcgctctattttaaggagcttggactgagaartttgatgcatctaaaacaaaagatagcgagttccaccttcttgatgggagctcagtccaagcacctttc

SEQ ID NO: 4172 - DNA, 1271 bp, Zea mays
gccccctttggagatcacaaagtgaagatcaacaagtatcaagtaaagtccaagaaacgaagaattgtgttgccattggcgaactgtccggtcgagggcaccggactgtccggtgccacacgccggactatccggtgcaccagggaacagtagcccaatggctagttcctggtggcactgtggaggaggacatggactgtccggtgccacaccagactgtctggtgcaaagactgacagtgccaacggtcgtctgacagatccaacggctaggcgcaccggacaggggcaccagactgtccggtgtgccgtagagagcagcagcttttctccaacggctagaattgagttggggcctataaatacatcacccaaccggccatttgaaggtggggagccgaagcgacataccaagccatagtatagacatttctaggtgctcatacacccaagtgcttaatagaatcactcggtgattagcgtaggtgctttgcaaagttcttaggttagttagaccgcattagcgcttgctctagatgaatcctagttagttgagtgagtttagaaaaaacacacaatctcttggctcttgcgtgagccgttataattgtaccgagtggggcgagagtcttgcgagaccgtgacaaccgcgtttgtgtcacgaccgccaccgtgtaccggagggaacgaggcccgcgacatttttggctgaaaactcgatagtggagctggcggggagcgtccgagaggagccagaagcggagcaccacttgcatgtggagaaggcccacggctctctacggagttactcgaccatggtgcttggcccttgcgtggactaccctttgcgtaggggcaccaacgaggattagtcgagaccttgcgtggttccggatacctcggtataaatatcggtgtcatccacgagagtttgcatctctaacttgctctttacctttcgcatttatattaagcatttaagtttcaatcttgtctttatacttagattgtttaggattgaaacttagacattgtggtagagatagcaacacttagacaaaacctagtttgcacattttagattgtttatttgcataggttttgctctagggatttatttgtggtctagtttagagaaagttttataagtcctaattcacccccctcttaggcatcacccgtttacttcaattggtatcagagcctggtttggctcatttgaaacgctttagcttcaccactaaaagagtcgacgctttttagagaaaggag

SEQ ID NO: 4173 - DNA, 1500 bp, Zea mays
aaactataaaagcatatatcaaaccgaccctatctatggttgtacagcgcagacatgcatgtgaggcaaatgtgttgactctgctgccctactagctgctagatcagcacacgactccggccggcccaccagcagccggtgtacgggccgggccgggccggtctgcttcgtcgacgacacgcgtacgtactggcgccggccggccctggcctagcttgtttttctctgttgagcttgtgatagcctaaccaccgctcgtcctatgaatgtgccatgcgattttgtctatcgtccaactcttcactggtacagtaaagtttttttttcactcaatcttgtatatctgactcattttattatctgcaggtgtatatgcacggtacattctaattacatctcttctcttttcttctctaccatcgtcttctctatcatcgtcgtgcctcaggtatgtctattctactctccctatcactgcctcgttaccttataaatagaccttgaaaatcactcaagyccctatattattggaccgtaagaaccacytaagtccaacacaataggaagccgcaaacagtgtatcgctctcttatagtaccaccatgctaggtaaaagtgaacgagcgatcgaatgagatataaaaaaggggttaagcaccttttaaacttatatctttctagaccttttgaacgagcgatcgtagcgcagcagacaccgtgctagtgacacattatatatctgatttattatactcatctgtcttaatttataattcgtttgactttttctaccgagtttaactgactcgtcgtattttttcgacaataatttgaataaatgtcaaacgaattataaattgggacatatagggtaaatgcctactagttattatatactataatactcaatgctggggttgtcagcactaaaagttaataatgatagggctctaatcgactcaggtaactaaaataaagaagaatgcaggtcccttagattccacttcaaatcaggatgagaatttttttggatggttttgaaaattaaaagagagatgtctagtctagttttgaaattcgagggacgaaaatagtttcgacttttttcccccgaatctaatgccgatgtgatgtcggatgctatgggctgacgccgaccctattctatggttgaaaatgggctgggccgttttcccagcccggtagggaagactcatggtggacgaccaacttaactgctacgagtcctggccatggagggattccagcttctggaaccttcctttcgctatacgacctgagttcgcttcaggcagccgccgctctctctctctcccgcgtccgtcccaccttcgcaagccagccacctccctgagaggcctgaccgtgatttcggcgtggcatccaaaggcggtcaagattcgagaggccggaggaaccaagcgtagggcctccgaccccacgtcgtcgtccgcgcgcgccgcccgccgccgcagggag

SEQ ID NO: 4174 - DNA, 1500 bp, Zea mays
gatcttcaagattggattgcgtgtatttgagatctagcatagattaataaaataaaactaataatcatgcaaaagaattgctatgcctatctccaggtttccctcctccatgtcgatgccttcattcactagacccatgctgaacaacctgcaaagggcaacagccagccacgccatcagaaccaagggaaaggagcagagctggaccatgccgcggagaggctacactacagagttgggaaggaacctagcccaaaatgtccaaaccccgtatcgcgacttggactagacccatgctggagaagaagtagtaggccgagaggtggtcatcaacgctggcaccgcctcagagtggagtggcagtagagccacttgccgcgacctttagcatccctgcaaacacaacagtatactcaatctattacatcattcagtagcaacaataaaatcattcatgggcgtgtagaaattctagtaaattcttgatttatcaggctcgtggagggcgtgggaggtgaatccgttggccgtccgacatcaaggggacggtcctctggcgaggggtgtaggtgggggtaatcttgacactggctgcgtggcaggggcttcgaaggtgaagtcatccgcctgggcggtgctcctagcggggtgggggaaccgccaatggcgagggagggggtggtggagttgctggcaccgtggtaggcctgggcagagctcctggcggggtgggggatctgccggcgggggggcagggggtggagttgctggcaccgtggtggggcaaatggagctccaagcggggttgggggcttctacagtctggaaccttcgtgggcgtcgcagaaagaacagaaaagaataggatgcttcgctgaacgcctggacgttgatgaggcaacgaacggccgaaaaaatttgcgccgacgatttatcaggctcgtggagggcgtgggaggtgaatccgttggccgtccgacatcaaggggacggtcctctggcgaggggtgtaggtgggggtaatcttgacactggctgcgtggcaggggcttcgaaggtgaagtcatccgcctgggcggtgctcctagcggggtgggggaaccgccaatggcgagggagggggtggtggagttgctggcaccgtggtaggcctgggcagagctcctggcggggtgggggatctgccggcgggggggcagggggtggagttgctggcaccgtggtggggcaaatggagctccaagcggggttgggggcttctacagtctggaaccttcgtgggcgtcgcagaaagaacagaaaagaataggatgcttcgctgaacgcctggacgttgatgaggcaacgaacggccgaaaaaatttgcgccgacgtggacaacgtagttgggctcgtttctaaccggctttaatataatagaaatgcccacagtaagtcgccttgcattctgtatgaggtacagtatttttacagttcttgaatcgtgggaagaagaagaag

SEQ ID NO: 4175 - DNA, 1082 bp, Zea mays
ctgcagcccttctcagcttgcaggcgtcgcacgccactccttcacctgcatggccactacgtcgtcgtatcacgtactcggtgaaatttatacattacactaagatcgttttctctcatcaagtcaacacaaaccataataatttaaatcaaaccaattcaaacaaaatgttcaaataaacagtaaaatctatgcaaatagatattatggtacctagatcaagtcgataagaagacttgtacgaatgggctcataggcttggtgtcaaaagcccatgggctcggcaactacgactagaaggaaggcctatccgcaaaggtattccaaaaggataaacatatcaaatattttattggattaggacatttgatcgagatcttattagatatgccaaggtccaaatagattaaaaaaacatatatatgtaaggatagagttcaacatagggtcggttacattcccctattttgtaagcaactcggatacacatttgtaaaccactgtctctcctaagactataaaagtagaatctaggtgccccataaggacaagattatcatatcagaatacaaataccactagtaaaaactaaaaaggacgacgcggggtgttatttcacctttagagccctgtataaattttgtatcattcgtgtctttactttaactttcgattacatgagcggctctataaattcactattgaataatcttcgacaacaataaactttgagctactatacagtttacaactttcccttcccttcacctttttccttacaattcctataatcctggccttgttttttcctgagactattgtaagttcctataattcctatagtcctgacgtcgatatctgactggcccaaacacaagaaacagagaggctggccaggcgacaaccgggagcatctttggaaatggcaaattggatctcgatggcgtaagcgctcccgtctgcacaagtctggctggcttattcggcgccgtggcgggccagctgcaaagataagagtcaagacccgatcgagtgtaaagctacttgggtcatcaagcgtgcaaggtctcaatctcgcggta

SEQ ID NO: 4176 - DNA, 990 bp, Zea mays
ttgaaataataggaaaatatctctctttccaagaatcaatattatgtatctgcttcattccatcttgaccatagtggatcacataggatgatttaggtcatgtttttggttcacgactaactacgatactttgtttaagattagtcgtccgaattgaagaactaatcttaaaaaaaaagaaaaggttgacaaagtgtgatagtcaacaaaccaaataggccctaattcacacccaaatttctggataaatgaattcgatatatgagtgttcggtatcaatatctacagtctaagtactatacttgacagtagggatatcatttrttttagctgtgataatatatatatttttttgcgttggaggacattattatatacacaatcatacatacaactctataataagcaatttaacgagcagttagcacgaaacacaaattatctccagatgaaaaacaccgggtagaagactcggtgtcatcaaaatgtgcaagtcgactacaaaagatacatatctgcgtgagctgacggttccaactagtggtatttataaattccactaaaaatcacagttctgtaatatacagctgattgattcatccagttacagtgaaccatcgggaatttggaacagacaaatgttcagctttcctgcatgagaatatggaagatggttatgctttcacccataagaaaaacaggggctggggagggaggctatccaacaggcggggcaagtataatatacacctttttcttgttatattcaatcatcgccttctcaaattctgcacgtttctcagtagctatatcataatacttgaccttttcctgtgaaatgaattaagtgaaaactattgtttctataagtcaaatttcataatcatatagaaggcacaagcgtgcagtatttacaatttaaagaatccatagtttatctttatatttgcaaaaatcctactgttttcgtgtttcgaatcgtttgctacc

SEQ ID NO: 4177 - DNA, 1500 bp, Zea mays
gtaagatctgtatagcctgaaaattcaacaaatgtcataaatgcaatgtcgtcctcatcacagcatgtaccacgcgcggcggaaatattttttaaaaaaaatactagtatttagttatatgacgtggtaaaacttaaagagctcaccagctctgtaggattcaaacagagcatgagcccaactcccatccaatatgaccaaggcgggacaacgttttattgaatccagccttatcttcgtggtctcatcctgttggagttaagttggcccatgacgaccacaagggtcattttagttcaatatatatatatgctatttgacagtattttctgtttttttctttttacttcttctgattcttaggtaacaagtagttctcaaacattttgcaaatcaggaatgagagttacctactatatagtaaaaagaatatgaaccaagagtgagtaaaacaacaaaactacaacagagtaacatggttcaggcaatgaagtacactgcagaataatgtcacaagcctattccacctcttccacccacattcttgttaatggggagcctgggttgccaatttatcatcgaggccttcgccatagtgatcctctctctcccatatgctcttcatcttagtcatggatattctgaattctttggttaattatgctacgaataaccatctgctttagccccttgctgtccatcatgccaaacatcggattttcttttatgcagatgatgcagtccttttttaaggtctttttaaactgatttacttgttatcaagcatattcttggactgccccttgctgtccacagatcccccaaggagtccttgcagctgcttgtggttgtcgacgatggtatagatagcagtagcactgtacacaagcagcaagcaacaccccacctccttgtattgactgttgcattttttaggaaacctaaagtcgtgtttccatctaattgtaggcccattttactctagtctccggtctctctctccactctaactacgggtcgacctgcgtctcctcgaccatcaccaccttgacgatctccgtgaaggtatttttcttctttctttgatgcatattattataattagtttgttagttaaaatttgatgcatgatttctttgatgttagccaagcagcctgggggcaaattcaaagaattaaagaacatcgacacacttgtctaacgcctagctgccatgggctttctacaagaaagttctcagttgctctggtgcagtggcactgtggcattagacagatcaaggattacccaagacaggacacctggaaagagaaaacctcctcgggttccagaattagttgcacacactgatcatcgctggaggttgtatcccctcttccatatccgaaagaacatccttcagctgaacatcatctgcctcaaacagactgaaatctgccagacctacaccatccttgcttccctcgtcagccgtagaacacccatcgaacaggcatccg

SEQ ID NO: 4178 - DNA, 1500 bp, Zea mays
tttgttgactttctcgacaaggttgtgtgaaacttgcgtgttgtagagtgtgggtatgtttgccttagaccttggcatgtgggttggggtttcctagaccccagctcgaggcctaagtcgaagtagatgctagaaggctatgcaatgtggtgaccaaaccctagggttcgttaacctcaccctcgagacccgtcgttagatgacgtcgtgtagtttgttctcgcctccgctcttccttggtgggccttgtatgggcgaaggtgatgcgaagggtcaacctcatttgtaggatagtttgttttgttatgggtgcgatctataggtgtacattctggccacctaactcggcacgacccagccccgaaaaggcctgacacgattgaatttcgggtcggaccgacccataattattgtgggtcgtgccgggttggccctcgggcttagtgctcggcccacgacacgacacattattggttaaatgtgtcgggctcatttcgggtggcccgaaattataaaaagcatgaaattcaaattctagcccgaaattcacacaaagcccaaaattcacatcaaagcccgaaattcacaacaaagcccgaaattcaaaacacatatatcatttagtagatattaacatttcaagcttcataattcaaaaaaaatcaaagaacacgaaaccaatgggtggttgacacctcatctccatgattaggcatgtggctagccaaatgaacgtgggtctttttgtgcctataaataagttatttcgtgcatacataaatgggtcatgctcatgttcgttcgtggaccgcaacctcgacctaagcacgacccaatacattgggttgggccgacctgacccaaaattatttcgatcttaccgtgctttgtcgtgctttggtccagccgactagttctgatccaaatgtaatgttctaaggtcattcttaatgcacaattttgttgcactgtttttaagaagtaatgtcaacatttgtctagaaaaaatgtatatcgagtttcatccctatgaaactctctcctctttcatgaaactctcttatatctttcttgttaaatttcatgtcatgccatcatgcttgcttatgtgacatgtaatttaattagaataaaactctcatgaaatagcctaaggtagtaaaggtgtctctaaccgctctcatatctcatacrctatctttttcattacttcaaacttcacactacaaacgatatcatctacagtgttacgtctcctatattcaaagcaaattccatattctttctattatcccatcatttattttaaactaaactccgcaaacaatgttaaatagtgtcatctagacctacgttgtctattgtacatattatgttggagacagtctatcgccccccaattcgcaacacaatcgtcctccgccaccctccattaaccctagcggcagcagcgctcgtttgatccccgcggcggtccggcgtccgggtaggggagcgagg

SEQ ID NO: 4179 - DNA, 662 bp, Zea mays
ccttttctgcatggttgccgccggttcagagaaggtgcagaggtaagaatttgggagagaaaatagagggaataaggagaggaagtgatttagcacctggatttcgcgccaaaaacaaaaattggtggcgcggccgcacaggatctgcaagagacggccggaactcgtacaatcggaagaggcggcgtcggttcttgctagggacgggagccaaagacgtctctccaccaagcaccggctgcagagattttttttagaaaaccccctggagacagatgtggagacgcttgattaaatggcgttgtacacgccctaagtccatgtattggttggccaagtagcgcacacagtctccaaaactagtagctggagtacagtttaactccaccttaaagtttatctgcttcgacctcccaactcgcactcgattgagccgttgctttgggcgttccatacataaatcgccatcgcggcatcgggccaagcgcgaaattattgcgagtttgctagccccaaccacaccaacaccacccgctccgcgtggccatcttcctcctcgtctccactctccactgcaagagctagacgaattaatgctgaggcgtctagctcttccctcgccggcactggccgcatgctaaggcgagagtggccttcttctc

SEQ ID NO: 4180 - DNA, 828 bp, Zea mays
ccttttctgcatggttgccgccggttcagagaaggtgcagaggtaagaatttgggagagaaaatagagggaataaggagaggaagtgatttagcacctggatttcgcgccaaaaacaaaaattggtggcgcggccgcacaggatctgcaagagacggccggaactcgtacaatcggaagaggcggcgtcggttcttgctagggacgggagccaaagacgtctctccaccaagcaccggctgcagagattttttttagaaaaccccctggagacagatgtggagacgcttgattaaatggcgttgtacacgccctaagtccatgtattggttggccaagtagcgcacacagtctccaaaactagtagctggagtacagtttaactccaccttaaagtttatctgcttcgacctcccaactcgcactcgattgagccgttgctttgggcgttccatacataaatcgccatcgcggcatcgggccaagcgcgaaattattgcgagtttgctagccccaaccacaccaacaccacccgctccgcgtggccatcttcctcctcgtctccactctccactgcaagagctagacgaattaatgctgaggcgtctagctcttccctcgccggcactggccgcatgctaaggcgagagtggccttcttctcatgaccagtgcatggttggtccgggcgtacgttcccatgttgctccgtagcagaatctcgtcggcgtccatggagaagacgcgccgtcaccgggtgctggctgtgctgctgctgctggtggtggtgctggtctccgctctccctgatctcgggagctgccacaaag

SEQ ID NO: 4181 - DNA, 667 bp, Zea mays
gcctgggccagtagatacgctcccgtctcacgtctccacgcatgcaagtaaacagatgaaaaaacacctagactgcacacgtgcatacaggttggactcatgccatgcaggtaaccattcataagcctaaatacagtcaacgcacagactggacctgagcgcggctgaccaggtaaccaatcaggcgtataatgactagtgagagagacttgtgttcatttgagctcttgcacttggattgcttctttttctcattctttcttgtgatcaactcaattgtaagcgaggcaagagacatcaattgtgtggtggtccttgcggggactttgtgtcccgtttgattgagaagagaagctcactcggtctaagtgaccgtttgagagagggaaagggttgaaagagacccggtctttgtgaccacctcaacagggagtaggtttgcaagaaccgaacctcggtaaaacaaatccttgtgtcacactctttatttgcttgcgatttgttttacgccctctctctcggactcgtttatatttataatgctaacccggcttgtagttgtgcttaagcttgtaaatttcagattcgccctattaacaccccctctaggcgactttcaattggtatcagagcccggtgcttcattagagcctaaccgctcgaagtg

SEQ ID NO: 4182 - DNA, 73 bp, Zea mays
gatgcgatgaatgcattgcataccttgaagaaaatgcgacagtaggaggagtgccacgttgcacggacgttaa

SEQ ID NO: 4183 - DNA, 176 bp, Zea mays
tgtctgacaattttggccgctaatttctgccctgatcggtttttttttttgggttttccaaccgcaggttcttcgccgcggagctggtgctggcgctcgagtacctgcacagcctcggcatcgtgtaccgggacctcaagccggagaacgtcctcatccaggacagcggccacatc

SEQ ID NO: 4184 - DNA, 72 bp, Zea mays
gatcctcttctcgaggagccgctattcaccacaaccggtgaggaagtggatcctaagatccttgacctcgct

SEQ ID NO: 4185 - DNA, 120 bp, Zea mays
gtagagagcgcctgccgtgcatgcgctgcaacagttgggtgtggtttttattatgcatatacatgctgggtatattattgtcaaaagctagttactgtattttgacaataatatacccag

SEQ ID NO: 4186 - DNA, 805 bp, Zea mays
cgacccacaagccctcgtaattaaaaaaaaacatcatgttttgctagatcaagccacggttctatccgaaataaaagtctaaaaataaatgcaatgctagagtttaaaccgtcatcctcccacttctcatatgcagattctaaccactataatctacaaccatttatgtttaataatgaattaaatattgtaaatattctaaatagaaaccgtacgtaaaaccattcatttaaaaatttcaattagagttgatttggtgacccgggatcccgagaggattggaggggattgagaaagaaattagttttttttgtcttttaatccccttcaatcctcccggaacctccttgtcacaaaatcaacccttaaggttaccgaaacctatataaatgcaaaagccacacgaaaaaatatagacggctcgaacctgatcctttcctcttcctcagctcctcacacgacgtggcgtggcgttgcctccccttcgcttcactccgatcccctatcgcggccatgacgggagccaagcaatctcgccgatgcaacctcctgacgtttttctccaccatattggccaccgttctgcttttgatcttccagcgattctcgccgacggcagctgcagtgccgcagtggagaaggggaggaactcaggaacatatcgacgttgcgcggggagccgaggcagtgggccacgggcaaggacgatgcgaagattctctccgaggcggaagctcgcgctggcggcggaggagagggtttgctgacggcggacgagggacgcgagttcgcctcgctctacagc

SEQ ID NO: 4187 - DNA, 55 bp, Zea mays
atcctgtaaaagatgcagaaatgctacgcatggagctacccatgataaaaaacgc

SEQ ID NO: 4188 - DNA, 1142 bp, Zea mays
ggtccgcgacgcggtcatgcgggagacgagccgactagtggagcaggagcagctgcctgcgaccacaaatggacgagtgtaccacacgcgaacgccgcccacgcgacggagggacgaagaagcggaactctgtctgagagtataatattgtagtatagtgttacgttggcgcggcgcggcgcggaggaagtcgtcggatgactcggatcgtcgaatcgaatcctctacgacactaccacaggcacccacgcacgatgtatctatcaatcgctcaaggtttccaaggccgaacgtgtctggaccagcgcacatagattgggaaacgatttgtatatgaaaaaaaaaagatttggatagagcggcagcagccagcggattcattctagaaccgtccgcgcgtggtcccgttggcgtttgctcgcgaccgacgcgacgcgatccgcacgcaccggcaagccagctgcgcaacccgccaagctccacagcccatcgtttcccgccacctcaaagaaaccgcccccctttttttctaatcagaagagaaccgcctgggcgctgggccggccggaacgagggcacggccgtcggcgtcgtcactttcatccctccagttttagagctctaaaaacttcaaaatactttagcttattttaaaacttcacctagccagagcttctggtctaaagtttagagatctgataatgttttaagaaagaaagccctaatccgctggcgcctttgcttaaaaaaaaaaaaccagtgggctaggctagtagatggggcggggtgggtccacgaggccagtgagtggggtcaggaggaatcctgggcagcggtcctgcccgcgggcagtgccgtgccgtgccacccccagcataaaagcgaggactgctcggtcgccgtggtgccgcagtttgccgctctcggcactcgttcggcttcctctcttctctttccggcctatcagcagtcagtttctctcgtctggtaagctccttgggacgccttcctcctatccctttactactacagttcttaactcctacctaggagaagagaacttctcgttctagatccactcagctttttataagaactttttgttcattggagcctgtgctgcttgtggaggtacagtgctg

SEQ ID NO: 4189 - DNA, 589 bp, Zea mays
tggatgtcgatgcgtcagctgtctccgataccaatttgatatggtgtgaacgcctgggtgatctgagtggtaagtggagaaggaggtgggattgggagagagatcgcaagggataaggcgaatgggtgggaatgtcgtcaccggagctgcgcggagacgcagcccacgatgaccgaaggagttcccaaccggggttttacttcgataaaaatccaggtacaatctactgtcctctttatagattagaggcgcccagctctcaagtctcaactgactaacagataagggataagcctttccctgatactctcaacagaaagataacaacttgggcctaaaaactctcaactggactctaacaaaccgaccaacctactgctgcctgcgcctgtagtgttcccctaggaaggcatcgacaacaattgtatatatattaatcattatttccgaggagcattcagttatggcctccttaacacttttgtttctttgttaaatgatactgagttggattacttaaccatgtttttctttttttttcatatataaacaggaggaaagaagtgcagccatttcactagctgacaag

SEQ ID NO: 4190 - DNA, 144 bp, Zea mays
gtctcttagtcccatctgaactccgtagcatgacagcagagggcggcggcagcagcagcaaatccctgctcctcctccccggccccaaaaccggacaaacccctgctcctcccgccgccgccgccgccgccggggcacgcccgg

SEQ ID NO: 4191 - DNA, 583 bp, Zea mays
atatttccttagttacaagacaacatcgtgatatttgagcatagtacgatattttagaccagaaggcgtttggaaacacgtctaaaaaccctgtattctaaaccatggttttgtcaataccacgatatttttttagggtcaaatttttttgtctagactaaagtttttttcttacatgcaactatagtcttctgttcttctacactataacccaaatattgtctctaaatatggattggattggactgattatataccatgccattgcatataataaattatgatattataatccgtagttttgaggaacatcccaaacaagatctaagcgttaatttccatgtggtcatttggatcaaataaaaaaagcaattaagttagacacaaaacctcccttttccgttttctccctcactgtcgctcgccggtcctggctccgcgcctgcgccaccgggttcgcgtcggattcgctccctcttcgccgcgccccaccactccatygtcgctgggggatctctagggtttagcgcagtcgccggctccacctcgcgcsgtcctcgccgccgccaccaccaccaccacc

SEQ ID NO: 4192 - DNA, 975 bp, Zea mays
tactcatcttctctagttycggctccgataccacttgatgacatagagatcgataggatctcacgactctcgaactcactgaaacagagaacggagagcgcactgagagagacgagttttggtgctgcttgcttgtaacagcgttttctagactctattaataccaggaaaacaaaacacaaagatacatcaacgccacgatcacaaccgtgtccatacccacgacctacacgacgcccactcttctccgtgtgactcgctcagctcgaacaacctttagcatgagctaactgaacgctaactaactgaatgacgcctaactgaacactagctaactgactaacttgactcagactgaaactcaaacaacacggactagcaagagttatctaacaggtcggcggggacggaggcagcgggtggcgtctgcctttggcggctctggacggcttctaggagaagagtaacagtagtagtaccgccgcgcaagggacgactgggaggaggagaactgcggtggcttccatgtcgcgtctccttcgtgctccctagtcacaggcgctgctctttgtgcttgctacgaacccgtcgcgcagcagtcgttgcatgggaagacgacgacggcgcgcaacagtacgtggcttgacgtgcctacggccaggtgacggagccgcgccgctgccgccttgagcggtccgagcaggatggcgctgccacggcggcacctccactggcgcgacgcgcgacttctgagtccatgggccatggcaattgaggatgggcctggcatttgggctgctggcaaaggtgacacccaaataacaataacatggcctacatgcgctgagaagaatagcaggaaaaagaaaattggtccactttggcagaggttcgaggcgccgcgaggaaatggagcagacgatgccggatgtgcgtccaccacctccggtcacccagatctgaccggcgtcggcc

SEQ ID NO: 4193 - DNA, 130 bp, Zea mays
atccccttttctttctgtggcacttctctaactaggaactttctcttgaactgatgttggaacagtggaatccaggagagggaacggagggtcgacagcttgtgaggtgctcttgttccaccacgaggac

SEQ ID NO: 4194 - DNA, 1500 bp, Zea mays
acgaattcccgagagcggccttttcaccagagccagccaggcgcaccggacactgtccggtgcaccaccggacagtccggtgcacccagactgagcagagtcttggctgctcgagccaagtcttttccaattgtcttttctctgattctagcacttagacaaatatgttagtacacaaaaaccaatgtactaagtctagaatcatacctttgtattgatttgcactttgtccaccctttggcatatactcattcccttaatgtgtgttgggcacttaatcaccaaaatcttatagaaatggcccaagggcacatttccctttcaatctccccctttttggtgatttatgccaacacaacaaaaagcaactaaaagaagtgcaacatcaatgcaaatgagaacacaaatttgttttgattcaaatttggcatatttggatcattctttgccaccacttggtttgtttttgcaaatcaaactcaatttcctatctctaagtcaaattcacttgttgaggcatagagaaaggtattccaagagaaattgatcactgattcaaaaactccccctatttcccttatttcccataatcaaacattctccccacaagagaccaacttttgacaaaaagagacatttagaattttgacaaatcaaaagtcctaactctactattttcaaaattctcaagtggtagctgatccatttgttgctttggcccttaatttctccccctttggcatcaagcaccaaaacgggatcatttttggcccttaaaccccattgcctcaccaaaattgtcaattaagagcaaaaggcaataagagacatggagatgaacttggagtaagttaccctcttatcggagtgcagtggaagtctttcatggtccaagtccacctttccctttcaatccacctttgagactaaatcaagtaaactcaagcacacggttagtctcaaagggtcaagttgtagcacatctccccctaaatatgtgcatcactcacacatggacttttgaggtccggggagtgtttgtacaacttgagcaccataaataaacaacaaaatgcataaaagaacatgatcaaggcataagacacatgtatgctacaaatcaatccaagttccgcgaatctaagacatttagctcactacgcagcctgcaaaaggtcttttcatctaaaggcttggtaaagatatcggctagctggttctcggtgctaacataaaacacttcgatatctcccttttgctggtggtctctcaaaaagtgatgccggatgtctatgtgctttgtgcggctgtgttcaacaggattatccaccatgcggattgcactctcattatcacataggagtgggactttgctcagattgtagccaaagtcctggagggtttgcctcatccaaagtagttgcgcgcaacactgtcctgcggcaacatactcggcctcagcggtggatagggcaacggaagtttgtttcttcgaactcc

SEQ ID NO: 4195 - DNA, 1500 bp, Zea mays
gtccaaaatgttaaaaataaagaaacaatccatgtgtatcttataagtatttatattggctcaattccatgtaacctttgcacttacattatgcaaactagttcaattatgcgcttctatacttgctttggtttgtgttggcatcaatcaccaagaagggggagattgaaagggaattaggcttacacctatttcctaattgattttggtggttgaattgcccaacacaaataattagactaactagtttgctctagtgtataagttatacaggtgccaaaggttaacctttagccaataaaaagaccaagaattgggttcaacaaagagagcaaagggataaccgaaggcaccctggtctggcgcaccggattgtccggtgtgccaccggacagtgtccggtgcaccagggaactccaaaccaaactcttcaccttcgggaaaactcataggcgctccgctataattcaccggactgtccggtgtacaccggatagtgttcggtgctccaggaatgaagcgactctgaactcgccagcttcgggaatccgctccgctataattcaccggacatgtccggtgtacaccggactgtccggtgagccagcggagcaacgactacttcgcgccaacgatcacctgtagagtcatttaatgcgcgccagagcgcgcagaagtcaggcacgcgcagaagtcggacactctacagtacatgtccggtgtgccaccggacatccaggcgggcccagcagtcagagctccaacggtcggaacccaacggcctggtgacgtggctggcgcaccggacactgttcggtgtgcaccggactgtccggtgcaccatgtgacggacagcctccaccaaacggctagtttggtggttggggttataaataccaccaaccacctcacattcaagacatccaagttttccaacttccaaccacttacaagagctaggcattcaatacaagacacacccaagtgatcaaattctctcccaattccacaaaagctttagtgctaagtgagagtgatttgttgtgttcttttgagctcttgtgcttggattgctttctttctcattctttcttgagatcaaactcacttgtaattaaggcaagagacaccaatcgtgtggtgatccttgtaggaactttgtgttccaagtgattgagaagaaaagctcactcggtctgagggaccgtttgagagagggaaagggttgaaagagactcggtctttgtgaccacctcaacggggagtaggtttgcaagaaccgaacctcggtaaaacaaatccgcgtgtcacactctttatttgcttgcgatttgttttacgccctctctctctcgggctcgtttctatttctaacgctaacccggcttgtagttgtgattaattttgtgaatttcagtttcgccctattcacccccctttaggcgactttcaattggtatcagagcccggtgcttcattagagcctaactgctcgaagtg

SEQ ID NO: 4196 - DNA, 1094 bp, Zea mays
acttaacacaaccgtcagttcgaaatcggagcattttccacaggcggttcgtttaaggaaccaccaataaaatcatttctagtgtccgtcctctatgagaactgctagtggaaacgatttatactggtggtcctatatgataacggacagtacaaatgattttagtatattttatatattacaaattatcttagacgttgcacgcctcactccgcctgctagctcgtgtctccttgcagtccgtcactcccgatgccctaccacacccaactcatccgctgcctcgaactcgtctcgctcctcatcgccgacgcgccacctcatgcatcccttcatcgttgttgccatatccggtctccctccgtcatcctagccaaagtgaagaaggcgggctcgatcgtcgaccatcgccacacaccaagacacagatcctccaactcgtgcctccccatccttgtagccggattcacttcgtcgtcgccacccatgtgaaggaggacgatgtggtcgcgaccgtttccacatggtaacacgcggatctaggtcaactgcttagtaccttcattgtttcatgtacatgctagcttttttacttgttgctctctgccctcatgccatctttatttttaatctgtcgtactatgtttgaatcatcaatgagctagcttataccttactttgcgacataacaaatttgtcgtagtatgtttcaatcattaataatttgtcctactatgtttgcttatacctattagctaaaggtttcttagtatacatattagtaatccattttgcatattgcaaacaatatatacatactccataccattaatgtcttattcactctacatttttagcagttcctacataaggttgcctaacctggcaccttcattcactgattcttgctccccaaacaaacctactccgtacaacctatgccagaagcatgccaagacaactgccatggcaagttcttatatgcataacttatctatgttgcttcttttactacatgacctccatttcagaaattgttaaatgatatttgtatacgtaccaattagttacgtgcatgtgcaacttgtccacaa

SEQ ID NO: 4197 - DNA, 844 bp, Zea mays
tctgcgcgagaggaggcagagacggtgagcggagcgggcgagcggcggctggacgcgacgcgggcacgcggctactggctggcggctggcggagtggaggcggagacgcggctgggcctattcgctcgcttgtactgggccgcccctgccaatgctgcaaaactcgaacaggcccgaccgcccgacggattgtgttgtcctgtcccctgcaactgcaaattagtcttttttgtcatctatttcgcgttccttctgcgtatcaatttcagttggaaatctcctagagacctagagagtaaccatggactgatgacgtccatatacttgaaccccttagtatctttcctgttcttctttgcactagtgcttcgagttcatgcaaagaagaaggcactagtgattctggtgtagacgacagggattccgattgatcccgtcctactattattctctgatccctgtaaaccaactgcaggtggagatcatctgccacggcgagccaatctgcccctcgagcacgctgcatgggctgatggaactgtggcatcgtagacagccggcagagcccgtggaggcattggtgggtgcgccagccaaggagttcgtcatagagctgggcttccgtcgccgccgccacccttatttggcgcccggcaccgtcgcggtgcctccggagccctcctgatcagcttgcaagggtggctccgctccgctgtggagcctgagctgcactcttccgtccgtcgtccgctcttgtcctcggtcctccatccccaaccagtttagccgtgtatgataaaacagttttcttttactcatttcagacttttcttttactcatttt

SEQ ID NO: 4198 - DNA, 647 bp, Zea mays
tttgtatgtatgtccatgtttattattattcattcaaatgtggacacacaaaaaaagttggtaaaaaggaactatattttggactggttttacactaccaaaaatgattatcgtaacagtatgcaccacgcaatgtttagcactcaagctaacgctaggtcgtctaaatgaatcgagtaatagcgcaatcaacaactcgccaaacaagcctactatatattgaggcacacaaaatcacaaggttttgttgagtactcgaggagcacgagcgcgaccattaataagaaaagaagaatgaagaggcatccctttgtcgatcgctagaaacatccatcatccatgcatgatgcttgacgccttgatgcatactactactggtacgtatgacatgattccccacctgctcctccatgcatggcacatgttatgtccattccgtccatccatgcaccaaggcgggtcccacatcccaccaccaccaccatcagcgagcctccgcaccgcacactccccagcctctatccggtccggcggtacaaatagcccccacccgccacccactcagcaccatttcacaccctcttgcctccccgtgactacctcgctgtcccctctcagtgtccaagcgacgacaccacgccgccgag

SEQ ID NO: 4199 - DNA, 1500 bp, Zea mays
actagcagcaatacgtacgtactattgtcctggttttgctgaatttctctatcctgcacaaacgaacagcttgtcgtcagggcaacagttgtttcataggctaacatctaacccagcaaatctcagctgcgacggcatcactaaaaacttggttaactgaggtgtttaaatccactaaaagctggttttggtagctaactagtacgcttatggtatccgggcttcaacaacagatggtcaaagtcaacaccgctgcgtcggctttgcttggcacaaggaaaagtcagaacaaaagccgcctcgcttgtatacataaaatgagtaaaagaaaagtctgaaatgagtaaaagaaaactgttttatcatacacggctaaactggttggggatggaggaccgaggacaagagcggacgacggacggaagagtgcagctcaggctccacagcggagcggagccacccttgcaagctgatcaggagggctccggaggcaccgcgacggtgccgggcgccaaataagggtggcggcggcgacggaagcccagctctatgacgaactccttggctggcgcacccaccaatgcctccacgggctctgccggctgtctacgatgccacagttccatcagcccatgcagcgtgctcgaggggcagattggctcgccgtggcagatgatctccacctgcagttggtttacagggatcagagaataatagtaggacgggatcaatcggaatccctgtcgtctacaccagaatcactagtgccttcttctttgcatgaactcgaagcactagtgcaaagaagaacaggaaagatactaaggggttcaagtatatggacgtcatcagtccatggttactctctaggtctctaggagatttccaactgaaattgatacgcagaaggaacgcgaaatagatgacaaaaaagactaatttgcagttgcaggggacaggacaacacaatccgtcgggcggtcgggcctgttcgagttttgcagcattggcaggggcggcccagtacaagcgagcgaataggcccagccgcgtctccgcctccactccgccagccgccagccagtagccgcgtgcccgcgtcgcgtccagccgccgctcgcccgctccgctcaccgtctctgcctcctctcgcgcagatccgcccctggccaagagcccaagaccatcgcgtccctcttcctggactccggggagtcgtccttcgccaactcctcggcgcggacgacgcgccacgtggactgcgcgtccgacagccagtccaccgagtccgaggccccggcggccgacgacttcgcggacgccatcgtccgggggctccgctccgacgaccgcctcctcttcgagccccacgggccctccagctccatcctcgagaggaagcctccggcggcgcctgccctgcggccgcgagcggcggcgtcctcctctcgtccttcgttgacggcgtcgcggtggcgttcgactccgccgacccgtcag

SEQ ID NO: 4200 - DNA, 186 bp, Zea mays
ggtaagcggcgctccgcgtcggtcggcggcggcaacaacaacagccacatccgcaagtcccggagcgcgcagctgaagctggacgtggaggacctcgtcagcagcggcgccgcgctcagccgcgcctccagcgccagcctcggcttctccttcaccttcaccggcttcaccccgccgctccagcac

SEQ ID NO: 4201 - DNA, 1500 bp, Zea mays
gcaccgagatggacggacaacaggagcgccagggaactgacgccggagttgaggaagaagatgtatggcggtggggaggagagaggagacagcagggaaagagttgaacagatagaggagagcactcggcacctaacggacggtggcgagggacataactaacaggggcactatgggaacgacaagtcccataatgacgattagtgaagccaatgccaaatgttcaaacctgccagcattacaatggcaatatgacaattgcttggttggacttggagcccgttgtaatctcagaaggaacacgcgagatagtggtggtttaacagctcgcctcgagattcgtgcgacggtaggattccgctttggatggaactccccctgcccttcctcttaacctacccatgccctcctactaattcccctccaaccaaacgagctgctagcccttctaaccttgctcgacccttgyccgccgcctgaactcgcctcccccgcggccggtcccctgcatctgttcgccgcgccgcaacccggaggagactacgactacgagcaccaccaggtattccctccccctggtcctcccttcctgctgtgcgatgccgtccgcccctgatccagagcgtggtttcggatctagacaagatttgggtattcctgaggaaccttgactaggttttaattggggtttgtttggtaacaccacctagggtttgggtatccgtaaggaatctaactggatttaattagggtttgctgggtaacacgcaacacacgtattcgttttttttgtcagattttggtttatttatgcggattattttttccccaactgtgcatgtataacagatttgtttatattcgcattttgggtatgtttggatagatagatacacttttcttagttggtgcaaaataagatgaaatagatgaaagatatgatctccatgtatcctttgaaccaaatcatattatctttgtttgcaagttatttgggtaggggtaggtacatgaaagttctgttatgggtgatatcgttgaattgctcatttgctcacacttcatattactagttattctgccatatgatgttatatgttgtccgtcctacaattgaactttcacagcttggatgttctcatccacattggttctgtatgatctctttctgatattatatcctctatttgtgcttaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatcyggtttccttgttctgaggtgtcattcgctagtgctcagagccggcttggttttctcgaaagatcagcagccactcttgattcaggactttgtcacacctgatagcatctagttaatacatctttatccaag

SEQ ID NO: 4202 - DNA, 700 bp, Zea mays
cataaataaaaattagcttcaaattctatgtttatctatgttaaaatattagagttgtcatataggttggacgttttaggaacatccttagtctctgagggattaaatggaaaaaaaaatacaagagctagtccattctacacgactctctatatatattgtgtgttaactatatttatgaagtgattgattaaaaacacatatctacgcgactctccatattttacatatatattatttcttgattatatttatgatgcgactcattttaaaaacatctcagtactgtattacaaaagacaactgttagttcattatcacaccacatcgatggttctctgacaggtttggcccacaggctcatgcacgtcctcgatgcctagcgttgtgcggcaggactttgagaaccggtgttgacggcatgcattttatttttttgcatcgaacacactgtggttagttctagcctcccagccacccacgcttctctcgtccctcccctttgtcggtgtcttccccctctctcttctcttctctacaaatctctcttccgcatccgccgcaaaaccctaacctaagcggctcaaccctacgattaccgccgccgccgccccccgctcgcccacgcaagcttgggcgggcctccctcagctcggccaagagcccgaccccctgctccggcaccagcgccgccaccgcc

SEQ ID NO: 4203 - DNA, 691 bp, Zea mays
ctgttatcgataccatttttatttatccctgaaatcaggtaaaattccagaatttccggtaacgggtaattaccgtttttttcatcctaggcacacaggacaggcggcgaggagactcaggtatgtatacagtatacgttttctacacactggacccagtttgggcccgtaacattaccgttgggcctcctggcttggcgcgcaaaagtggcccatcgtcttcacgcgcgctctcctcctggatctggtacgcagacgcaggcgctgacagttccacgccccgtcgccttcggcccttcgctgtcgccttgactcggagtaagtcctctccgtctcagctcgcgagccacagtagcagccgccccttcagcctccatcatctggcgctcgtccgctcccttcctccgcacctcgccaccggccgctgccgcaccggtcgcccctttcttcgcggccccatcgcatcgcacccggttggcctcaaccggctagctccgcatcgtgccccaccaaatgggcgccccgggccgcgacctcaccgctctcctatctatccgcggcagcggcagcccgtctgttcaagcggtaggctatcgcctttcagtgtctggtaggtggtatcagtgattcagtgtgaggacggaggcggaggggaggtggggcaaactcggtgtgaagcacatcagcgggc

SEQ ID NO: 4204 - DNA, 673 bp, Zea mays
tctgcaaggaaaccaaaaaaaggtaagcatataacagtagaccaaggaggaaaagaaaaggaacactataagatatatgcgtgctcaagatgtagttgccaccgtaaggtacagtagcagcatgatgccactccctacgttctattttatttgtcacggtttagttcaaatatgaactagcgggcgacaaatattcgagaacgaaggtaatataatttgaatataaagtctatatgatcaaatagaggaccggatatatctgtctctcggattggatgtgtgcatgcatattactacaccaaaaatataaactttctatggttttttttaacttcctacatcttttatataaactgtagaaatatacgtttacatgggtgattttgtgtgcgattatgtgtgtgtttatatgatatcgatgttatcgttgtcaagagtgatttccataaacttttactgtatttttatttcacagtaaatgaccatgagcaaaatctttctattattctgatttcgaaacgtgccttccaaccattcggcccagtcctactaaacttgctaaaagcttaggtaggcctaatgggataggccgtgggctatatgtcagtaaggaaagaaaagagaaagtatccagccagccagccagccagcgagcaactgaccagtgggcccg

SEQ ID NO: 4205 - DNA, 184 bp, Zea mays
agccatcagtcgttgaagctgctgctgtatctgggttatctagtgtctctgccattgcccatggatggtgctgtctttcaaagtatttgtatggtttgtgtcgtgagtcgtgactgagctggtttcatggaccagttgtgttctcgttacccaaaactatcgtgcgaccgcatatggcttaatc

SEQ ID NO: 4206 - DNA, 703 bp, Zea mays
tgctcgttcaagactcgctgcaagcatttgttgctagctcgtcccatttctggaatagataaaaaaaacaaaatagataaatgggaacgagcttctgagttgtgcgtgagaaaaaaaggatcacgagaggatgaaaacttggaccaaaacttctgatttttaaacgtggaggagaaacgaatctgtacctgcgctctggtgtacccattgctggtcctcgtcagatcgttcccatcaccacgttcacggcaaggtgtaccatttgccagtaaacatcgcaaaaacaatacacttttgtagggtgggggcggcctgtttcattcatggccggcttgctgttgccccttgccgtggaggcgtggcgtggacgtggagtgagtggggatggatcaggccggtggcacgctgctcgagaaatagtcagccggccagggccaccaaccgcgcgcctcatggtccaatcatgcgcgtccaaatgtgcatcctttctggccgcacgatcgctaggattaacggccacaatgcatcctacgagaagcttccctttctcccatcaatcctccggacctccgtcctataaaccgccggggagcgtggcggccattcgacgcaggcacccagacccagcagctattgtggtcgtccctcagccgcgtcgcaccgcatcgcattctacgattcgaagctctctctgctcgcagcc

SEQ ID NO: 4207 - DNA, 362 bp, Zea mays
ttgtagatatccttaatgagtccaacatacttcgttggtcttcgttgctaccttgcacttttcttttttgttcacaccctgtcatgctacgaacgtctagaacttctttcttctctttaataactttcttgttccactaccaagtgtctttatcttcacctccttttgttgctccacgcaccaccttctggatgcagtttgatatcatctccagtaacgactgctgtccaagcaagccttaggtgcaagcgagccttctgggcctttagatctcctttactagggcttaggacctacctgatgtggtgaggcaacataggcggatttaatcaccattttttacttactattatttcaggtta

SEQ ID NO: 4208 - DNA, 435 bp, Zea mays
tgtcctatgactgaggatctagaaagtgacggatttctactattgcaacgactcaaccgattatgtgtttatgttgatgttgaatggtttttaactaaacgaattttatagaaactgactgaaaaactgagcgtttgacaatccgcagcagtttttagtggccagaagctcaaaaaagctgaaacaaaccggggcttagtctcatagagtagtaaggatagggaaaagtggtgacacgaaaattgacagccgtgagaaaataacattgacttataaatcagtaaaaattaaaaatgatgatttcagtcaagtgaaaactgtatttactatatggaatatttgattcgaaaaaggtggactctgctgccctacttgaccgacgctcgagaagtcgagatagagacaaccggcacccgccgatcgctcgctggtggg

SEQ ID NO: 4209 - DNA, 1116 bp, Zea mays
aaggatgatccaaacagttgactgaatgatcgtgcctaccagatgagtaaaagtcaagggaatggcatcgaacctgatgatgttgtttcagaatatggcgttgattctcttcgcttgtacgaattgtgtagtggttgtttctatttgtgctatgaaaatgctatatggttattgtttaatttcagtgtacaaacttggtgttctggaaccatataaacattaaaatgtttagccgcatgtttattcacatgattttctacgtccttgaatctggaaatttgaggctctatatagtactatagaaagtcatatattggagcatagaaatttccagaacaaatttcctatagagcctcaaatttcctatggaaacaacaagtttgtatggttcaaattttctataatactatatagagtattatggaaacaacaaggctctatacagtgttgtatttttgttaataatattatttatttgaccttgaaaataattaaaatttaaaattttccattacttggagcaaaaagtagttcttgcggttgaatgaaaagaaaaggcgagaaggattgagagatgatagttatgatagttaaaataaaaattgtattatatatttgtaggatatagtaatatagagaatattgttgttgtggtaagatagtrttatataaagagaaaatttagaaaaaatggttgcagagtcttatactatcttcagtaggacagtgtaaatgatcgtgtaaagtactattttataatataaattatattgtttataaaataaagtttaaaataaagggtgacagaagaattatgttgaaaatagccttagcctatcttgattgacctcggcgcccgtgtcatcatactcgtgcgccgtcctggcctcctgggtctggagtcggtatctcccagtctcaatcacgaccgttcttttctgatcggacgtcgcatacccgcacaggagagagagtccggcctctataaatccaccgcacggctgttggctacagatcaaaatagagttcacacgcacaacccgccgccgcacgccgggatctcgatagactctggctgccgcggaaagcggaaagaaggcagggatcgtggccaag

SEQ ID NO: 4210 - DNA, 404 bp, Zea mays
gattctcgtgccctactgtctcaactgctatgaacgtgggacatgcaagttaaactctaacatggcgcagaaccggaatgacaatacaggaacatgcgtgtcagaacgaggatgtcacccgtcatggcatggagactgactcggagatgaattgttttttttttaacatatacacacaatgacccactcgggctttcactgctgctttactagcccagcccaccaaactgcaggcaagacggacacaaacacgaagcccaagtagaaacagactgcacccctttttcccaaacgcccctgaacaagacaaggcccagaaaaaattcagcaaacaagcaaaggtacggccaccaccaccggccaggaagcaagctcaaaccctaaccgccggcgacgccagcacg

SEQ ID NO: 4211 - DNA, 854 bp, Zea mays
ttgtacattcaatcaccatttaattgattgtacggttacataagagggtgggtttatatccctatagaagtctttgattttcggaggaaaatattgctttatattttaaggcctgtttgaaagccctcagtttgtaaaaaaaatggtttataaaaactgtgatgattctaaacgtatcagattatgtcacagtttataaaaactagattaccagtttcttaaaaactaaaaagctagtcttttccaactaaaactagtttataggaatttaggtggtttcaaacactgttattcagtttttttataaaccagttcctagaaactggagatagaatctagattcttaaaaactagctcgtttccaaataggacctaagtagatgggtttttagcatttccattatttctatgttcttggttttcttatgtcatgtttggaagtaactcagatttttttttaaaatttgatttttattttttagctaggaatagtcagcttctcaatttttaagagaatctaatttttataaattaaattataaatcaatatatttagaatcaacttaatttctataaaccagtttgttggatgctctcacgctgcagcgtaatgaccgcttgtgatctgatctgacggtagaggtaagttgttctagaacaagtagacgccaccgaagaatctagaatacagcacgcagggcacaagggagaagaagagggggaagaaatattctctcccgtcgaaagacggagagaggaaaagggacaagggcaaggcaagagagaggcgtcgtcgtttgatctgctgccggagtgcgaagaggaagaggaagaggagcgccggagttgtaaag

SEQ ID NO: 4212 - DNA, 340 bp, Zea mays
ctggaactggtaggttgatcaatcattttaaccattcagtttcgaaaggggtagaggcatccagcagttccagatccttgttcggtgcttcaactacccattccccttcttcagataaacaaatgccaatagtagcagtagatcatgcatccatcgtcagaatgctgcccatccagctcctgtgctctttgtttgtccgggttcagcagatgaaggtagattttgctgcgtatcccatatacatatggttgaagtgtaagggcatggaaaagtgagtaaattaaccaaaaaaacaaagaccagcgaaaattaatttgcgtggcattctaagcttttatgt

SEQ ID NO: 4213 - DNA, 1500 bp, Zea mays
gatcgcacgtagccgtagtacgtaacgggcctgctagctagcttttagcttcgtgttctccaagaagaagaagaagcggcggcggcgacggcaggaccgtcaagctggggccgtcggagcttgacaccaccaagtaggcaagtaccgagacctcaaaaggcttttcgtactgggtgcatcgcacctcgccgctcggcgatcgctctcggccgccttttgtttctacgtgtacgtcgcggcgcccggaactcgaggacgagatcggacgggcctgtgatcgcggtggataggggggggggggactcgaaatatctcacgcgcgcactgtagtaggtgaccggtcccttggcctctgccttttcttgttctcccgggcgcattttttctgtggcgtgcgtggcgtgcatggaatagaaacatggatgacgccttttcggttcccgccttccgtgtctcgtctcgggtcgcatgattgcacgtaacagtacctaagcgagaaagagggctaggtggtttataccgtttggtttcccctcccggtgccaagggacggtggcctggcctcatcggcggatggatgggatctgacggccgtcgtactgtgcgggtacagtggtacactgtacccggtgtgggtcagtcgtccaattatctgtacggacgcaatttcgccccgccaaaggggaggcgccgcgtggcgggagatgtgatgagagtgggtgggctatgcagccagtggcgaaagaaagccgtgccacccggccgcggctcccatattccaggagcggccaaggctccgtatgatggagcactagcagtagtgagcacccgagacaacagtatgaacagcagcgaatgtgttcgccctctatccggaacgtaggacagcctgcagcactgcgaaccattttcaaattcaaacaggacacgcgcttttttgtttccacatgttcgccacgcagggcacggtcaaattatcttgtcgcctagtgcgagggcgagccagccaagacaaccgccggcgcggtgaatgatccgacggtcctcaagtggacgcgcctccgccgatcggctgaaaggaacggcggagggttggcaaccaagtttcaccacaaacgaaaagggtaaggcgaggcgaggcgtgggcccgcaagaatcccctcccgcgcctctccgcgaatggggaggcggcacccacgtgaccggctcgaccccacgccgccctccctccctgcctggcatgcgcatgcgcccgatcgcgccatgtctccctctcctcccgcgcctctatttctaccgccccgccggcgctacccgccgcccgcgctctccatccatccccgtcccccgcgatcgccgagctctacctcctccagcacacgtcccgcggcagcatccgtcagagaagctagctagcgcttcgatccccgatccgtgtcgtagacgacagcggggccccccggcggccggttgtttctcgcagctcggccggcggcggcc

SEQ ID NO: 4214 - DNA, 887 bp, Zea mays
gggtcgggtcagacatgttcttttttatggtcgagtcggatgacccataatcagatctacgtgtagagctctactaagctagccttaatctcatagggcccacatgatggtaagttaacaggttaactccggtaatttttttcacagccaatggtacgaaatacgagtacgaggtgattaattctacaattaatcgcgattcaccacggagtgagacaagacaaacaatttcattccatcacggattcacgagcatcacgcaccagccgccgaagcaaagcccctatcatacggcccacccgtcagtaacatgtggtccccgtccccgcgcgcgcctctgtactcccccgcgtgggccccaatagcttcctcccctctctccgcaaacggctaccagccttgccgcccgctcggcccaaccaaacgtgcaccgtccgattccccaccagacggccggatccgccccgcgcccccgaccgttgcgcggccacgtcagcgcaagtgactcgaccgttggggcggccggcaactctgctcgccatttcaaaaagcgaaggcgaagcgtccgacggaataaatacaggcgctgccacgccctgcgccccaccagatcctcttcctcctcggtttgcgagctcatcgattgctcactcatcactctatgctcacgagctccagccttcagagcgctataattccggcccgatcctttgttggaaaccttctccgagctttccacggttcatgggagcgcgagtggtgggtgcagcaagctccagccttttctggtgggtctgagctgagctgagctttgagagatccatcgagctggtctggatcgctagtttcgctggttggccgtggagttgatttgatttctgggagcg

SEQ ID NO: 4215 - DNA, 1271 bp, Zea mays
ttttccgtattattttaattccataaattaacattatgatgatgacatataataaataattaaccatagaaatcgtgatcttaaattgatccataccaatatgaatcaagagaacatagagcatgtgaattatataaatcatataaatacgataaacatgtatactgactgaacaaatgaaaataaacagatagaaacataaatagcatgactgtaaaattaaaacagacagatctatcatattataataagacagaacagataagataaaatcattcgtaaatatgaaacagcatagatgaatatatgaaacatatataatctccagaacacaaaacagtaagtaaataaactgatcataccctcctatgcgctctgctgatccagatccttgtccagcttcccttgtcatgttgaagatgtttttgggcagtcgcgtagacgctccccaaaaacctaattgtcgatcccccgtgcaaggtctcgaacggcaccggcttcggaggcacctgccctctcgctcctctgtgcgcgcagagtcacgagatggaaataccctcactcggtggctggactgtgagactgaaagtgtttctcgcgtgtaccgagtgacaggggtgctcctctatttaacctctcgcagagggaagctgaaggagaaaggtcgccgagtcacgccaagagtcggccagctctagccgagtcatgccatgagtcggccagctctcgccgagtcacgccatgagtcggcagctgaaggagaagggtcactcggctggctgacgaagagaacgaagagacagggtcactcggcagacgaagagacagggtcactcggctgacgtacgcggttagtgagtgctaaaaattaactaaaaattaacacaaccacaccacgcccgctcgcctgcctcgccacgccacgcccggcccggcccggccggcgtcggcggcgcgcgcgcgcgtgtggcacgcccttgtccatttcttgacttctcaagttaagtggaataaatcccaccatataagtcaaggcaaaagacccttggacttccaatgtggtactattggtattctccaccattacacaccatagagtttattcaataaatgagccaagcccataaaagatccaacacgtacactgcataaataggcgagcagcgggagagagacgaccgacgaggacgaagaggaattaagccagagcgatcgaggtggtgtagtgtagcttccgagcgaagctcctaccgttgccgccggccggagat

SEQ ID NO: 4216 - DNA, 566 bp, Zea mays
gtgagagatgaacaatacgcagaagtttttattactggccatatgtttgcgccattgatgaaaccatatggattgtaacacaaaggaggtgttagttgttcgtaatttgtacctccgatgattttatatgaaacaaaaacacgtctttgcatgtaatgtaaatacatacattctctggtttgaaacttcgaatacacatcgtagatttttcattttaaacaactatacaacataagcatcaactgtaatgttgtgttctatacacgtgctctgttgtgatacatcgattgcctgtaatgatcactggctctaagacctgtatggagcattgcttcaacttgttttttttttacaaggcaatgacgaatggaccagcagaggccacctgccctgcttagaagctcacaggtagagctctgcatccccaggacaacactccacgtgccctgcagcctgtgacgtgtcaagctgtgaggacaccacgcagtcatgcttctccttcccgcgtctctcacatcatatggagcacaggggcgagcggcagcagcagaaggtcggcagcagcc

SEQ ID NO: 4217 - DNA, 1300 bp, Zea mays
gattaaatggtattgggatagaaataatgtaattttctttctaatctctttcaattttgaagtggatttaagtttccaaactagccttaagtgatcctcatggtggcggtagccaaacatcttgttcgcacctacctcgaaccttttttttttggtttcacggagaagaaactaacaatggctggtgaaattataggtatacacactatgatggctagctaagagtgcgatggatcaaagcagcacagcgtcagcgtcaccggcctactagattggactgcaagcatcatcgaccgtcgaccgacggcgcgtgcgcctctctcgttcttcgtagtccgagaatttcgcgtacgtgtagtagggacggacttcgcgtttgcccacccaccaccaacccatccaacttctgggttggggcgacgacgtccgtggaagcaagatgtggcgccgcagtgggagtgcaaacgagcgcgcaagccaccggtggtgggtctttgggttttctggaacgcgcggactgcggccacggtacggtgcgcgcggacccaaaggacattcaactcgtcctcgaccgcgggaggcgctcgcgcgggccctcttctgcgtgccgtgcacccgtcccaccgcgaggctaccaggccaggagcggcgggccccgctcgcgcgcgacgatttttgactcggttcacggtgggaggggtacagggtcgcgcccactgccagctgtggaagcttctattcggaccggagcggctgaaagggcgagcatacgtactaacgtacgtataccgaagaaacacacaagactgacccgcgcgaagaaatagtcgcagctcacgctgccagacgaaagcaaccgcctcgctggtctatcgccgcaaagccattccatcctttaaatcgcccgaggcgacggggcgagcgactcatctccctccccagacaagcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctaagctagccacttcttcttcttcctcccttgtaggtagtagtaggctacacaccaaccaccatatatacatactaggtactagcaggcgagcgagattcgtgcaataatcaaggcagccagttattaatagttaatcgtcggcgccgagcgagag

SEQ ID NO: 4218 - DNA, 1500 bp, Zea mays
ggtttctaggaactaatgtttagtcccttcattttgttctattttagtatataaattgacaaatatagaaactaaaataaagttttagtttctatatttgataattttgtaactaaagtggaataaaatgtagggattaaaaattagtccctataaaccaaacacaccctaagttgatgctagtttctgacacatgttttcttcccagaacagttagttgtaccaggtaacttgttagtgttgtaactgataaaaagtctctataagatcaactaccactttcttgcatactgaaaagagaaataatagacaacccatttatttaattcaaataagtgagaagggagccaacaactaactgacaaagaaaccaaacaacctgacttcctgcaaagtttcaaatgacatcaatatactttgttgttggccatcaagtttatttttttcatcgtaatggtaaaaaaatagtctttaagggcaccaccaacaagccatttaattcaattctatacacagcggccgcttctatattatattttcaacagaaaaccttgtgcctaaaagataagaatcctgcatgtgacgatgctgttatttttacaaattggtagcacatcatccatcacacgacaggataaacatcatccatcagacgacaggataaacacgagccgaaaataacaaatacgtcttgcaacaagaaagaacatcgtacttggaaacagataaagtagatgacgagtgcctgaaaaccgccgtgcagtgcaggccagggcatgctgttttttgagctcaaacaggtgtgaaccaccacagccaagcacaagcgccaactacccacaggaaacagagtagtggattcagtgctggccttctaaattctggccatacacagaaacagggggccatatattgcttcgaaagatcaggtcgttgcttaccgcttttgtttatcccaatccagcacgccttggtttcgttcagatatggatgggtttcctggggcctgcaaaaccaacaccactccagtcagaacacagtaaagagcgctgcctcctgtcctcggtgcattcttgagcactaagctcgcactgatgcatataatcagtgtcaacagtgcgaaagcccatcccaaatgatggaccaaactaaagctatcctgagatgcagtagtaaatatcttgccagatatagactatacaggatgtcggttgtaaggaagggggccctaatcaggaactcacatacaacgtaatataatatataacctggtaactgaacatgatggaaactctggcagaagaatgacagactgcagagcacctggttgcagccaataatgcaaacactctgtgggctccttgtgcttttgctctcctccctcccaaccttctccttataaatacaaaggcgtgtgcaaggcagaaccatcagctaagatagctgcaaaacaagcgagttacttacaaccaaacagaagggtagaaaccacctgaagcc

SEQ ID NO: 4219 - DNA, 1500 bp, Zea mays
gtttttaggataatctcagggtgccatacgctgagttttcttcagatgattctgcatgtagaaaacacaaaacagtttgaagttgtgcaatcgttcacatgactagcaatttttatccctaaactggaacctactatgttggttaaagtttggttattcttggattcaaaataacacgatgagatgtgctcttgcagataggctatgatctgtttctaacacattttttgctaatggcttccaggaaacgacacaagattggtgaggtcatcgccaaatcttgcctggagaaagggatctccaaagttgtcctagatcgaggcagattcctctaccatggtgcgtaaaagctcttgttgattctgctagagagcacgtgcttgaattctaaatccgtccaaatgtgtgttcgtatatatcttcaggatcacctattatcttttcccttttttctttaactctgtatgtcgagcagggktgtttacagcttgctttcgtttctgttcttcaatatttcaggcataaatgacagaactcggtgctagaagcagttccgcatgttgtccactccaaggacgatggcttgataggatggccttccatttggagcagatgatattttgctctgatgcttaagagtgagtcgtagggttcatgggctctctccaatttgacagagtgagatgcttaacatgagtagattaggcggtggcagggattccgctgtgctgattattttctcgggagagtaaggcacttacattgttctcgattagcaatgcgtatacctcatcgctccttgtcgtaggccttacagctcgtgcttcggctttcatgcaacccccctccttgcttcgattagcaacacatgattagaattatttctgtaggttttggtagataatgctttatagtagtagagattagatgttagaaaagaatattttagatattgaggtcgatgattatcttgttcgttttcatgtaccgttttgcactaacattctatcgaataatttatatatcatcgcgacattgcaatgtgtagtggtgaaatagttagattaaaataataaaatttatgtatgataaaatcacaaacggattacgaaaccttttctttttacagtatatcacatttatacataaattatcttggtattatatataagttatctttgtattatatattcccgttgcaacgcacgatcactcgttgggcgaggggcgcgtgggggcaacgcgacctcggccgctcggggaagggtcggtccacacacgccgctcgcgcttcgcgtcggttttatgcacgactccttttcgcacccggctggccggctccccacctgctcgcctctcgctccgaaacttctcctctcgcgtatcctaccaggagggtgggagacccagggagcggaggtgtgcgaagctcgcctcgcaccacgcgctgcggcctgcggggcgagagatcggggcctgagctagggtctggtggcggag

SEQ ID NO: 4220 - DNA, 147 bp, Zea mays
cgctcttcgggcgtggtcaggcggccgatcatcagccccaccatcaagccgacgatcgccagcgacagcatcacccgcgggaacgccttcgaacgcacgtccggttcaggggtagaatgctcgtcatcttcacgcttggagccgtgc

SEQ ID NO: 4221 - DNA, 124 bp, Zea mays
cttctcctatagtattatattatcttcctgatctgatcatgtggccataaatagcaagggccttagattgttcggccagggatagcataacaccgccgaggaagcagcaagcagcaaggtcgac

SEQ ID NO: 4222 - DNA, 1114 bp, Zea mays
gtaatccatcattgtcgcaagaggcatatctcagaccgagtattcatcgctttgtctagggtagatcaatacatgagagccagctgatcacaagctttcaaggctttcaagagaaacgagtgacgacacaagcattgttccaatgtacactagaggcaggcaaatctctgcaaaactatctttaaaggtttgttcggattatagcataggcaccaggagtgctagatgagatagtcattaaggcggcaatgaagtgtctcaaaactgacctgtgctctttgctagaaagccttcatagaccctcgaaaagttgtttcagaagacggatgaatgcatctgagtagacattgactattgtcagtgttagcaagagcagcaaaatatgcagaaatcacaagaacgtttggaagggacacaagacacgtctaaaacattcagagcacaccccaattcgatggtaaaaagcatgttccaccaacacaagcagcaagttaattttctaacatgccctaacaaagaaaacatagtacctttcgcctttcggggtggtccaacatcaagagacagacagaagagtaggtcgcaccttcaaaggaagatatatatcgtaacagttgccaattaaggaggttgtaccgtgtgttctgcaggtaagacaaaaccaaatacggccgccgtgccgtgacgatggtacaaagtgaaactgaaagaagtttccaagccagaactgaaacttgttcggctatgttcggaagagaaatgcccacacatggatttgctgaggtcactgcttataccgtaccagtcatatggttcatgatgatcgttccagatctttggtaaataaaacctctccggcctgcatgaatcctagtttattgggcttattctgtggactgaagcaaccaagcagcagatgtttgtgtcaaagtgctctttctcagcagcccacctgcgtttgaccatatcgatatgcatgagccaagcagtcctgattttctcctataaatgggaatggttcagcaagcttctccaagaaaagcagcaagcagcagcagcagcaacactgcaacagcaagcaggcagagcccagaaccaggcagctagcagaaac

SEQ ID NO: 4223 - DNA, 765 bp, Zea mays
atatacgtatattatatagcgaaattagaatgttatatgaatatatactgctgtaccagtaaaataaggaatacatgcagtgtttaataattctaaccaaaaaaatagaatcacaattgtataggaacacatgcaatgtttcataatttaaacgaaaaatggagttgcaattgtacatatgtgcatgaactggaatattggataatattgatggtgaagtatcaaagtgtgtacaaagtacctggttgatgagtcactggacttgagatgacctgataagattagtgagactgaacttgatttcgaactccagtttatcctggtctgctatgaagagaaaaaaaaccaaatcagtagatgccgtagttaaggtatatacgtatattatatagcgaaattataatgttatacgcaggagcagtaagccaacaaagagcacccctttttttcgatgtatatgtcatctggaaagtaggagtgataaagaagcaggggagagacggaagatttagaggatgataaggcgactcgagaagcaacaacgttcaaatggtgacggtgtcaacaataatctgttaaaattgcgagaagatcttaatttccacagcgatggataaagcaatacctggtttcctgatgctgaaacttttctgtaacaatctgtcatttttcttctcacgatcaagctcagagatttccttattatgaaagcagcagggaaagcagcatgactggttcttgaacactatacaaggctttggagag

SEQ ID NO: 4224 - DNA, 412 bp, Zea mays
ggtacgccacgtcggtatccggtttgagcaaaaccggttttgtatagttttgcacgcgccgacaaagttagatgacccgtttttgctggttttctaagtttggtgactgaagtgacacaacgtgccaagttcgaggaccgatactgtattgtactcaaaacaagtagtattgatgttgccttttgttctaagcaacctggattcagatgttagcattactttgctagaagtagaatcaacaaactacaatttattgttgtagaggacaaaaggatgcagctcctggataaacttaagtacatggagcgagaattggtagcaacccaaaggatgggagagtgcattacaggaacaactactaaaggagttgggtgactatcaggagcgtattgtggtcaagtaatgaaaataa

SEQ ID NO: 4225 - DNA, 451 bp, Zea mays
ggtacaacccaatagaccggttctaggatcagtacagaatcatcaatatcatccgcgaaggaattgataaaagacatggaagggaatttgcatcgattatctgaaagctcaaaaagggagaagaaaactcttaagacggaactttcatatgtgaaagaagacctatccagatctgcttccaaaaataatgctgaggttcatatgtttatactattgcaatatctatttgtggttgcctgttgactcatctattttaaacatttgaggttcatatgagatcagatagtactgctcaccctagattcttttcttatccgtctccgcgtagcaaagaaactaacctagaatcagagcaaagagattgcacgaaggagggagcatcggagtagcgacaacagaagagagatcgccagggctgctcgcctgtctggagagaggaaggaaacaagag

SEQ ID NO: 4226 - DNA, 761 bp, Zea mays
ataagcatgtcataactcatatatctccatgaatgtttacaagcgaaagtacaagcccttgtattaagttgtgtgtgctctaatttatgcgtgtaatttctaccagaaaaaataaatttatgtgagtaatttacatcagaagaaatagatctctaagggtgaatttgggagctaaaataccggaggggattggaggcgctaaaatctcattcttattcaaaattaaataaaagtgaattttagtattagaattcactacggttttgtggctctcaaactagccctaagggttagtttgaaaactgaaatctcatcctgcccggagattgagtggagctcatttttccactcaatgcccgagaataccggaagagatttaagttttcaaagtagcctaagttctacatccgaatgttgtgtcatagtagcataagaatattcaaggaaaattacattttgacaccagaggaaacatgccaaactaacggtagcttaagagtgatgtgatcatgtaacgagcgacggtgataaaaaaagatctagctggggtgacatccctgatcacgcaccatgcaggtcacaaagaataaaatagttctctgtcccctaagaattatcgtaaagctacgctggtttgctaaaacgcgccggcaagtatgtcttcaagtgcaacgtgcaggacaacaagcattaaaaccagctaaaacatttacgcagagctaggagctagccaagagcctactacaccttgtcaggtagcc

SEQ ID NO: 4227 - DNA, 212 bp, Zea mays
agtgagtcggcgacagaagcttgtctcttggcccacctacgcttcattctgttgggccgactaacagcccacaggcctggttcgcataattaactcatcgacccatcagctccgtctcccatccgaccgagcggaccacaccaatcccacacccccacccccacccccacccaatcggaagaccgtgcggccgccggccgcgatcggagaag

SEQ ID NO: 4228 - DNA, 221 bp, Zea mays
tctgcgaaccagagaagaagcagccatatagacctatcgatcatgccgatcaaagggtaagacgaggcatgaagggattcggaccgtgtaactcgggcggtcgggcatctttgccccaacccacgccgcgtgtagcctctaggtactggtccacgaggtggcggcacttctggtggtggttgatcccctcgatgcggtagcaccagcggaggcgctcccgg

SEQ ID NO: 4229 - DNA, 649 bp, Zea mays
gtttcatatttgtttaaacggctagcgcccaggcgttatatatagctttatttaatctagcgctgatcgagtgctatatactaatctaatattattgtttatttaatcttgattaggcgcgaagctaagcaaggatgacacgaaaccatttttctcagatggaattggtgggagtggatttaagaagctccctacaagattgccaaatgtagggaggttctatagattttaggttgtttataaatttaagatgacttttacataactgttagagaaacaattttcttaacttcttaaatcggtgtttagagagtgttttacataactactattagagttgcttaggttttttttgtcattcacccgtgcaagcaattccatgttccgtttgtagtacacgttgcactgctcctgtaccggactgatcagtgagcccgctatccaccccactgctggctgtccctgccctcgggttccacgcagaggaagtgaatcacccattgcacttttccgcgcggaggaaggtgaatcactcattccactcccaaacctcccgaaaaccctcgtcgtcttcctcccaaatcactcactcgcttgatctctcctctccgaacccggcaacccctagaactagggttccagcgaccca

SEQ ID NO: 4230 - DNA, 914 bp, Zea mays
caaataaaggacgtgataaaatttgagatttgggagctgctgaagatatacttgtcggaaatattttagcttacatgaatcgtgattgaacccaggttgtgtaccgagtgaagctggcttgggactcttgcttgggagcgaaggcttgaatcaatgcacgcttctcgaggctgtagaaaagccgaggtctcactttcaggtcaggtctccctcccggcctcccctatgtgctgtggctgggctgtcaggctgtcactgacctcttgtgatttgtgaatccttctcgccaagacgccaacaggcaacagcccaacacatggaaaagagagctgcagaagcagacgcccaaaaccgccgtactccatgctcctactgctgcactactgcactagtcggagtaccacacaatacgagagtggccggtcgcactgagcagcgcagcacactgcaaactgtagtagtgtgatgtgtgacaaccgagctggagcctggagctggcggcccctactcgctgaagaccggaagagagggctctggtcgttacacgagagggttttaacggggaggggaggggaggggaggggagggcaggggagcattggtagcagcagtattctttcccttcctgcttgatccatccctttctcctctagcctcgcaaagtcgcactctactgggcgctctcgcttcctccttgagcggcgcagccgcgggcgcgtagtgcacatctctctctctcccccctctccccctcgccattaatttgctgcctgccatcccggtagcgcttcgctgcgcagcctgcgcctgaaggttcgatctttcactcccatgggcggtggacgcaactagtctttctttcttggtgtttcttggcgcctcgtgggaggtgagcgccgaggagcttcgaggga

SEQ ID NO: 4231 - DNA, 652 bp, Zea mays
ttgttagtactaactaactataaattttttgatgctgatggatcaacccattatattccacaaacaaaataaaaaagggaggagcgagaagatgatgagctaacttatttctcaaaccaaacaacctatatatgtggatgtatatatgtgatgctagaagtgcgatgctctcaatcgttgtcttttttagaccaagattattatacactagctagttaatactcctaaattatataaatgcatgtcagctaatcagaccatgctcaagcacaactgtggttttaattcgtatcagcttctataatattttgttttttataaattgcagctgcagcagtataaacagctggttttacttatctaaacggtgtatcatgtttcccttttttctgaagagttgagtatatgtgacagtctacgctgagacctgagagattgggacgcatcacatataataatgagccagcagctagcattttgaatattgtgatccgatccacccgccaccaccagacccgacccgacccgaccctttaacacgaccggtggtctataaatagctgcatgaacctacccgaacgaagagcaagactcaatacacaagcagagctcaaacaattcttgcttcccgctagctagctcgcaagaaata

SEQ ID NO: 4232 - DNA, 855 bp, Zea mays
cgagatcgggctgttctcgtcgtcgtcgccgcaccagggcatcgacggcgagtggagcgacaagagcgggatcattgtgtaccgctggaacgactaggggaggcggcccaacacaggccacgctaaatggaagaagcgctggagctactgcaggagcgcgaggaggacgcgccgccggccgtgccgacgccggttgcacgtctcctacgacgacggctactccctccatccgtggggtgcatatgtgctgtgccaataaaaccttgtaccggtatcagacgacaaattacctgtgatgtctatcacttgagtagtacagaagacatctagttgagattgccgtggccgaatgaaatgaaaccatgtggcccgaggcgggctcgacagcaaaacacggttaacgagcttggcgagtgaggccacggctgacgctctgtggctcccgacagcccacgctgacgctttgtggctccaaggtcctcgcttccatccaccccgacaggccacggctccgcccccaccgctctcgctagtcgctaccatggtggtatcctacacggaggagcacgtgtaccgccacccctggcaccgggtgaccgccgcggcgatgcgcaagttcacggacccggccgcgcgcgccgcctccggggcgctctcccacatcctggagacctggacgtccacacgctgtcccgcgacgtggacgcgcggtcgggccggctgcgcgccgtgcgcgccatcgcggggcggacgccgccgctcccgttccctatccgcgccgccgtggcgggagcgggcggcgacgtggtggtgctctgcgtcgagcgcacggacgtggacgcgcccgcgcgcgac

SEQ ID NO: 4233 - DNA, 430 bp, Zea mays
aaaaagattagagagtttaaaatccaattttagcccctctaaataccctacggtatctttactcctaaataagctctacgtttttaataagtagtagaattttttaacaaaggagtaattatttagtttttttaaaaagtattcagattacatctacaactgaaattcttgaattggaagtaccgaaggacccaaacggaaaaaagggtagggtcgtagggacatgctatatagcaaggctagaacaagaagctggtcgtcccccgcgtttttatccacctcgctttccttcacttggtttctaatacgcaattcgcggggaacccaaaaccctaatcctctctctccacgccgccagagagccgtgtgggagctcggtcctcggacttctgcatcgatctctgctatgagtgctatctaggtttctcag

SEQ ID NO: 4234 - DNA, 981 bp, Zea mays
ggtaagactgagacataacttaaggattgtttagttcgtgactaactgtgccacactttacctaaagttagtcgtccgaattaaagaagtagggtatgtttggttcgtgactaactatgctacattttgtctaatattaatcgcccgaattgaataactaaccttagatagaaaaaaatagataaagtgtagcaagttagttaagctcttaactttagacaaaaaaaagttatacaaaatatgctaagttactaaacatgtctttactctctcgccaaggtagacatggtggactctgtgctgagccaagtttgggtcgtgaaaaaaaatcggccttcaaattgggctgtcatgtgtgtcatgctgcgtggacatctataataaaaactagactcaatcagaatataaataaacaaaaataagataaaataataattgcacattgagaaacgagtgaattaatgaatcagtcatcatagcctaggcccttcctccgccgctccgcgtacgcgcctccacaggatcgggccagcaaaatctaagactctatacaaaattccggaagatcaacctataaagtagaattacactaatataggctataataatatgataaaaatgatatattaaaagttatgtgattgtatctaactgtctattcaattttgtattatataattttacttggatagtattattttgttagtgttatttttaaaatgaaatcttgaacgacattccccatgttaaaatggagatatagtcatgatgaaagacaaagacaccatacacaactgagttaactcatgagataaagatttacctagagattagttgatttattagcctaatgtgctagaactggagaccattggaactggggggctgtttccttgaacaggctgcacacccactggttcgggcctgcgcctccaccgtgcccgcgaggttcgtgacctgacgcagccgccgatcgagtta

SEQ ID NO: 4235 - DNA, 913 bp, Zea mays
taatatttttatagtcacgagaaaaaacccatcaagttgataatctaacctatatccgtacatgtggataaattcacacataaatcggtatattatagggtttttatctacaaacggctaaaatgtgcgtgtcatccaagactagagcaacggcgacgccttcgggtgcccgaggccgcgcggaccgcgtcaaagctgtgcggttgcgcacgtcagcccggcgcgggcccacggggccagtgccgccgcacgcggaaaaagggtctgccacgtcggccacgtgcttccgaaagaaggggcgaaaaaaacaaggaggcgagggacatttgtgccttggcttcgctgctgtgctgtgcagtgcagtgctctcgctgcggccctctcctctccctcaccctgtctctctcactcttcccatccaatctttatttccacaatccattattccttcccccttcgcttcgcttattcccccactcacttcccttccacaccgccgcctccggagaagggtccacggcggcgtccttcctcgggaggcgctcggctcggattcgctcctgctcggcggcggcgtcgccggctggtgggctcgcgcgcgcacctggtgctgggctccgcgggcgctcctcgtgcgtgacacgcgcccgatgcgtcaggatcgcgcggccggcgcccggggcctgccgtgattctgcggggaggctggatctcggtgcttccgcgtgcgggaaccagtgagttttctttttgtcttctcttccccggcggctagcggcgggccgcttggtgcacgtcagcgcgggaggccggaggttagccgatctggtgctctcgccgcccggagaggtggtgctgggcccactgccgggttctgcttagtaggaggcggaggaggtaagtccctcgtctc

SEQ ID NO: 4236 - DNA, 112 bp, Zea mays
ggtgagccttgctcttcagatgcaaattttctcgccgattttgggccaccagcatgttcttatctagtttcttgccatatctgttgccacgccaaagcaaatcagtgagctg

SEQ ID NO: 4237 - DNA, 1500 bp, Zea mays
ataaagaaacaatccatgcatatctagtaagtaatatttattggctcaattctaagtaacctttgcacttgcattttgcaaactagttcaaattatgcacttctatatttgctttggtttgtgttggcatcaatcaccaaaaagggggagattgaaagggaattaggcttacacctatttcctaaattgattttggtggttgaattgcccaacacaaataattggactaactagtttgctctagtctataagttctacaggtgccaaaggctcacaataagccaataaaaagaccaagaaaaagggttcaaacaaaagagcaaagggacaaccgaaggcggccctggtcgggcgcaccggactgtccggtgtgccaccggacagtgtccggtgcaccaggggacttcaagctgaacttcacaccttcgggaaaactcagagccgccgcgctataattcaccggactgtccggtgtacaccggacagtgtccggtgctccagaggagagcgactctgaactcgccagcttcgggaattcgctccgctataattcatcggacatgtccggtgtacaccggactgtctggtgtaacggcggagcaacggctacttcggcaccaacggtcacctgcagcggcattaaatgcgcgccagagcgcgtagaagtcaggcacgcgcgaagtggcgcaccggacactctacagtacatgtccggtgcgccaccagacatccaggcgggcccagcagtcagagctccaacggtcggaacccaacggcctggtgacgtggctagcgcaccgaacactgtccggtgtgcaccggactgtccggtgcaccatgcgacagacagcctccaccaaacggctagtttggtggttggggctataaatacccctcaaccaccccaacattcaagtcatccaagttttccaccttccaactacttacaagagctctagcattcaattctagacacaaccaaatagatcaaatcctctcccaactccacacaaagctctagtgattagagagagagatttgttgtgttcttttgagctcttgcgcttggattgcttctttctctcattcttcttgcgatcaaactcatttgtaatcgaggcaagagacaccaattgtgtggtggtccttgcgggaactttgtgttcccgattgattgagaagagaagctcactcggtccgagggaccgtttgagagagggaaagggttgaaagagacccggtctttgtgaccacctcaacggggagtaggtttgcaagaaccgaacctcggtaaaacaaatccttgtgtctcacttcttattcgctcatgatttgttttgcgccctctctctcggactcgtttctatttctaacgctaacccggcttgtagttgtgattaagtttgtaaatttcagattcgccctattcaccccccctctaggcgactttcaattggtatcagagcccggtgcttcattagagcctaaccgctcgaagtg

SEQ ID NO: 4238 - DNA, 299 bp, Zea mays
catgcaccatgtatgtttatgcattggaaaaaacatagaggacatgttgatggtctccatgatggaaggaccacgccgcacggagaagcccaccggtgtcatcttccgcaaggtccgctcggtcgtccatgtccgttcgtcctcttcctgggcggttggcgcgtgatctggcgagacctcccaatgggtcaaaatctattttgtgcttggcgatgtattccttaaggaccgccatgctcttctcctttggcgcggtcagctgcttcgacaaaggataccatactcattgttgatagcaa

SEQ ID NO: 4239 - DNA, 366 bp, Zea mays
ggcacttttttttcttctctatgtgcttgtaaataaggagccatgattctaagaacagtcgtctgttggggtgtgtgtgtgtatgtaaaactatattgtgacagttctttctttcttagaggaaaattacagcttatcttaaatcctctttgtgctttaccacactactacagatttgcagatttcagttgtaccaactattggaatagtaaaccctaaccctaggggttgggtgatgtattaataggctgagtaaactgagccaggcccattacagaggggtgagatggtcattacacggggaagaccccaaactctaaacgggtattctaacaccccccgcagtcacaactctatcctgtacag

SEQ ID NO: 4240 - DNA, 188 bp, Zea mays
tgtgagtgccaactggaggccctctctacctccaccacctgtgtttctatgcttgaccttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcgg

SEQ ID NO: 4241 - DNA, 1500 bp, Zea mays
atgtaatcgcctgcccggccgtctggcaccggtggcctcagggcaggcagacggccggcgcgggccggggccagtggcaacaaacagcaaggccgaggctgatagctagcgcgcgcggcagcgtggaagcggaacgcaagggacctgacctcgcgcgcgtcgcgtggtactcccacccaccaagtatcaacagtagcgaccatgtccctcttctcttctgataggaccgatttgcgagagggcgcatggaacaggatatataagagagagagagagagagagagagagagagagagagagagagagagctttgtatactgaccatgcacggcgaacgcgcaccagctggtggattgtaagtaacatgcatgcccgacgaactcgactgtccatgacgacggtcgacggttcggttgctggatatgacggtgaccgcatgcatagacagatgaaaaaaaaaaatccacgagcgatacaagtttagcacgcaacatacagcagcgatgtgggcggttagtaaatcggtgcctgaaaatacgtcgtgacactgtaaccagctaaccctgcaccgaacgtgtccaaatcgcgacacacacacacacacacaccgggacaggaccagacggcatcgaccatgcatcatcaggccggccggtgcggctcggccgggaggcgggccgggccggtggcccactagctctgtccactgcctgcgccacaatgccccaccactcattccggccctgcccgcttttcagacaaacagtcgctagcggctactggcctactgctgctggcacagtccggccggcagaggccagagagagagagagagagatggtggacgctcacggtctcggcattgctgctgcctgtgcggctgtgcctggcgtctgaacccccgatgcctttcccaatttgcccccgcgcccgccgtggccattcacgttcacccacccggccccaccaagcaagcagaacgaacagcaatcaatcaggcaaggcggcaggcagccagcctcgcgccccgtttgtctctccactcactcccgagagagcaagagcgtcattcaagagccggtggacggaggcgaaggcaacaacagatccgatgctttctcgaatcgggcaaggtctatcaatcgaatccgtcaggggacgagccgcgcgcgcacgtcaaatccaacgccgatccgtcgcctcgtcgtcgtccatcacatcgatgatcgatcccagggggtaccgaccgaaccgagagccgccacgcccctatataaacctccctccctccagtccccaccccccacacgtactccctcccttgcacttgcacacccatccactcgccgcccaagcccttagcttcctgcccaacgctgctgcgcttcacgctccatcgcccctcatccaataactccaacaaagaccggattgcattgcttcgatctgcacacaacagaagaagcacgcccatccgcggctcttgcttcttttggcacc

SEQ ID NO: 4242 - DNA, 1500 bp, Zea mays
tacttggtcatatttgcttctattgttgctgtagtgaatatttagcttgtgtaattaagtagtttctctccaagcttgactagttaagtggccatagtttgtgtaactaagcatttatatatagatctctagttgtggttcggtagtgtaacttctaaaaagtgctagtgtagtgctagttgtggtttgattactaccatgtgtaggagctcgtttgtgcttgcttgactagttgcataggtttgtgtgaccttaataactagagttatttaggtcggccatgctggcgtgcggggtgagtcgaccgcgctagctaatcagacgtacgtctgttggtagtgcattttgggggatcgattatgttggtccaggtgatggaactttcggtccagccagggcggatctgaagggggctgggggcgccaaccctctacatatatgaaacttcattagatatatatagaggtggagtatataagagaaaggaggaggaagaagaagagagagaaaaaataagcgcccacacttcattgaagaaagaggtgcagggcagagaagaagagaagagaaagaagaaaagagaaaaatctaattagcttgtgttaccttctcactagtctttagaaaattagcctccatttagtccatttctggatccatcactgggtctatctattcattgtgagaaatctttacactttcggtcatgaacatcctccacgccatttgcatcaaccagtgttagtgatactaaaccacgagtttaggcattaaccctggttaattagcataatcttgcgatgaacacgctaagctatctctaatcgctatcaccatgcatcacattttggcatcatagttccccccgctggattcgtctctctttctccgatgcctctctggcccccgtcactaccacctagggcgcctgctaagctgacccacgggccccaaaatactgtggcccacgtgtcagtgttatggcttatttgtttccgtagctgaaaaagatgtgcacaagaatttgttctctcaactctctcctcctccccacattattttatgtggcacacccctcctggttttgagaacctctcgaacccttctcttcccatcttgcctgcctcccgtagtcccgtgcctcaccttctcctctatagcttcttcctttctcttctctccttccctaccctgctcataggtcacagctctgttggtgttccttctcttctccacgcaagcaagcattcactcctttcggtttttaatttcttctctgtttgcttctttctgcatccataaggttttaaaaacaggcagaatcataaacaatccccttctttaaaaaccattgcttccttttccaacacttccttttaacctaaaaacaaagcaccactctgttgcaattggagttttctttctctttttttcgctgcttttctagttttaaatttttttgcttgctagctacatcagtacatgagctagcagaaaagc

SEQ ID NO: 4243 - DNA, 214 bp, Zea mays
ggtgaactcgttccttgttgttgaagctaatcattccttaaatgaggtactaataccttgtgattactttattattctaaggtgtttgggaggtgaaccatctagaatttgagaaggcaacaaggcaataaaagctgctccacttgaggggatttcgaaactacaacaagtgcaagtttaagagggcatatctttcagctcccaaggttgttta

SEQ ID NO: 4244 - DNA, 467 bp, Zea mays
ctgcctctgcctgtcctctcattgtctgtctgtcctgtgcttgcctgccctccgcccctcccagtcccagccccagtgacccagaggcccgcaggcccctcctctcctctccattaaagacaaggccaagcccatccatcctcttcctccctcccacctccatccccatccccatcttccaccctcccttgctcactcatccacacaccccacgcttgcaatttgcaattcccttgtttggggtaacaagccaagcaagcaaacctcctgctggctgctgtccaacagcaacatgcaacaacccaagcaaatcaaagcttcaccatcaccatcaccgccgaggtcaggtcacctcagctttgctcagctccctagccagcagtaactgcccagtggaagtgcagagtggcctgtgagtactggcagtacaaatcacctcatctccagtcctgcccggctcgcctgcc

SEQ ID NO: 4245 - DNA, 354 bp, Zea mays
ggtatgaaaaaaatcatgtttacttaattgtgacaaactgctcatgtgtctgcttagtatcgattgttgggcagaagccggaggtttcttttctactgcctgagccatattatgtagaccaggtgataaataatactggttaagttatcctgaaagcacacttcttttgccaacatttgctgtaagtgacaacttgttctattttttatctgctacctccataagtttgcaagttaaactttgctgaagcagccttgcctgtaaagtatgactcccctttctcttggaacgttgtcgctgacttcatgtatggcaaaatatcatcatttctactgtcaataaataaaatacact

SEQ ID NO: 4246 - DNA, 259 bp, Zea mays
ctgtaaatacataaatgaaacaaaatttacattctgtttgcccattatcagaatatgataatcttgatttgttcccttatccccaatctaaatctataaaggtgcaatttatcaggtgctgagtgtaatgtaccgttttctgctttaaagagttactctgttttgggccttttggcatctgtgagttttcttatctcaagagcctcaaggttctcaccttccctctatatattatttgattctcacattgccgggcact

SEQ ID NO: 4247 - DNA, 1232 bp, Zea mays
cactatttattaattactatcatatcactatatatacaaactattcatatattcatatgttttttccattcaaatgttgagtgggagaaaaaatcaatcctacggctagttcgggaaccccattttctcaagaaatttccatttcccccaaaaaatattagtttattttttctttggaaaatagaaatcttataggaaatggagttatcaaactagctcaaggctatttagtaggagttcttccagaggaggttatatatagccgtgtataatacttctatgatagaaaaaatacttttgctcctataggtgggttaattgtaatataaggttatttggcaactccattttttaatggattcttattttcccaagtgaaagtaaggtcgagtttggtaaccctatttttctacgggtttttcattttcccaaaggaaattaatttatttttcattgataaattggaaatcctatggaaaaattggattgccaaactagctctaaactaatttttcttgagaaaattaaatcccttagaaaaatagggttgtcaaactagccctaaaagtttttgttaattagtttcattaataatttaaatatatgtatagtttatgtatagtttcatacattttgtgcatatatgtatgctcaactgaaaaatttataggcacaaacgtacaacagtagcatagcatacgtataaaaattatttgagataaaaaaaattaaatgaaaagaaaccataagaaaagaaagaagaaaaagacttgtagatccttttagcttccattgacttaccctaagaagcttgacacgcaatagcggttggaaaacggcagtaaataattttgtaatcgggacaatatgtgacctcgattttgtaccagtggggtttaggtaattaggttaaagacgtggggaaggaacagagcaaagtggaaacaaatttcacccaccaaccaatgtttggctgccgtatgccttattgacttgtccacgacacgcagatcactttccttttccccccaagaagatgggcgagacgagggccaaggagggggtgtcgcttagactagcgaatccatccgccaagattccgtgcacctcgaccgccgccgccgctatctgtttgtccccgcccccgcgaccgcggcagcctagcaggaggggaggatccatgtctagtttctagagcagctgcttgcgtcccttgcaaatcacatcgaccg

SEQ ID NO: 4248 - DNA, 163 bp, Zea mays
gctgtaatgagtattgattaggtgcccccacaacaacttgctccttgtgcttaccggtcgtgactattgaggtgcccccactaacaattttcagtattggttggttccacttccataatgctacctccatatgttaagtttttttgttcatctatgactataa

SEQ ID NO: 4249 - DNA, 903 bp, Zea mays
tatgttctgtttgacttcaatctcaatttgtccctttgctgtatttttaaagtattgtgttattgagttcttcccttcccatctcttgtggatttatggagaaccttcgagttcttgtcatatgggtgttgttggggattgatttgtgaggagatagactctttagatcattgcgcacatctatactgtgttgttcttggtcgtgatccgactttatttccctttgagttcgtgttgagaaaaccccaacaaaatcccatcactctcgggattattgatctacacattgatttcaaagttgctctggttgatacttcatcagtggacacatttccccccacgcaaactatatactaagtttgagcgtgttctaggcattttctttgcccgacactgctgtccgtgtgctcggcactgccggacttgcccgcggcactacctctcctgcttcctgatgtttctgactctgatttttcataggaagttaggtatgcctgtctacaggtttttggtacaatcaaacaactttagtttgcattgtactctgatctattgctttgagtccctagaggttttgggatcaaagtcatgtgctctcaagtcgagaatttttagtggctcccattgaccccctctagttgcctcaccggtccttcaagaggttgcttttgatgatgtgttaagccaactccaatagtagcagtaaacgagccttccaagcggttgaggatccagaggtgattggtaaggaaggctagcctatcagaggacttctagagcacaagtgctcatgagatggagaacaacgggatccaatcgcagagaagcatgtcttcgatcagcacagtggcttagtctagcgatcaacatgcgacaggaagtagcagcaacccggatgagtct

SEQ ID NO: 4250 - DNA, 607 bp, Zea mays
ctttgcatcagtggcgctgcggtggtaccaggcgactgtgcaacaacggcgatgtgatggctcgtccgtgctcgcgtggcccatgcggcggcagcctgcacgcccacgcctgtgtggttgcagcggtggttgtgctcacctgtgttcgcgcttgccggagcagcgaggtcacagaggatgtgtgcgtttacgtgtgcggcgaaggcatcgatgctagtactatttctgttgcttgttttttttcttctatctgttctttcatacactaaaataaaatatgtttatcacacatgattgatcgatgtgtacatcggtgattttaaatcagcagcaatcatgtgtgcatcccattggtttcgtgccgacgatagaatctgctaggggatgtatttgtttgtgctcgaatagagaataaaaatagaacttcttgaacataatgcataaaatatataagtttagtacctttattttttttacttccttttcttgctctcctttgtagagccaggtgctgataacgtgttccgtcccccagatccgatccccctccccttccctccctcgaggaggccaggccagatccacgggcctcgcagatctggcggcc

SEQ ID NO: 4251 - DNA, 163 bp, Zea mays
cctgagacggagggagtataagtaaaaaaaatttagggagaaccgctacgcctgggagaccctttctgattttggggctgtacaccatcacgtcatctcaccttcagatcaaagggcccaattccacccatccccatcgcgatcgcctctctccagctaagcg

SEQ ID NO: 4252 - DNA, 270 bp, Zea mays
cgcgcgtgtacagttccgccgccaccaccatttagttccaaacacaattcatcggaggacggttccacgatcgcatctctacatcgacatcccgacatcatcaagcaagcatgccagcagatcatctcccgactcccgacgacgacaataacaccgaccggtatcagcatcacccccgcaccaggagggggtagcagccaagcagcaacgtccccaacacgcccgtgtcttccccatgccgagtaggtcgcccctgcctcattgtccttc

SEQ ID NO: 4253 - DNA, 79 bp, Zea mays
acaagtccatgatgcgccggtggtgtaattcaggtttgggagaacaggaaggtgtcaagaagaaagcatcaaaaaagca

SEQ ID NO: 4254 - DNA, 1004 bp, Zea mays
gggggtgcaggtggtggtggttgttgagtgactagaatgacagtgctgccattccctgggtcgcagacaaggggaggatgagctgcggagaaggggaaggaggggagcgataggggcgtggggtttaggtgactgggatttagcggcgaaatgacgggaaacccacacctgtagactagatcattgagggaaggcaggggtagtttggggaaagcgatttgaaatgaatgcgctgcaaggaccgcccggtggtgagaggaggacgtgggggggattcgattggtttgaaagcatttgatttgattttgatatagttggtcgggagggcgacttttgtttgggaaagtagtaaaaaaaggttaatcgagcgcgtttgcatgtgggagatctcaaggggtgtcgttgatccccatgactactctagtctagtctaataaataataatagtctagtaatccacatccccaagcttctactgttcctgctgctgccttcgccttggaggcttcccccggttccagtccagcaggcagcaggctagctgggtgacgctgcgcggtggatctggttcgtcgtccccgttcgaaatccccccaaggttggcagcggcacatcacggcggcgtgcaaaggcgacgcggcaaaacagaacccgattcgagtgacatcaggacatgtgcacccacccatcacggtttgaaatcaccagtccagctaacaagcaggttactactactaccagccagccagccagcccctcgttttttttgaagggggtgagaagaacgaggctatggttcagttggagaaccacacatgattatgctgcaaataaaattcaattccgatccaggagagtgccggactcaactgtctatgtgctctccacatgcccctcattcaaaacatgtacgctcactggactggacgtctggaccaaccggtgagctgtgtagcttacttcactctaaatgaacgtacttgcagtcatcagagtatggtaaa

SEQ ID NO: 4255 - DNA, 1358 bp, Zea mays
acgtcttaaaaaataatctcacataattctgcacttaaaatagcccaagcaggcaaagagacttcccagacttgtagctggaacaatttagtcagtagcgaggagttccagagttcacagcaacagtttggtcgaccgtaaccatagcaagactacagaaaattcggaggagtggcatggaaaactttccacgaaaagtttgtacctccgaaatgtaggataatgctacgagagcctatgacctatatatatacgggtttctttgatttttttttcttttggtcattcagcctgtcattctgagaagcacgacttcacgaggcacgaacaaaaaaaggggggaaataaaaattatatcagtattccgaaataaataaaaggcacaagaaagaaaagaaaagaaaagaaaataggggcctcgaagttgaagtagagagagaaaataggtgcccatacgcccacgcccaataggcttctctggcgctgtacctttcagctttataatctgccccccaagcaaatcccacagccaggctcgcccactctctccctcccccctcctcttcctctctctctctatctctctctcagtctctctcttcctcctcaaaactctctctcccagcactgaaaattctccacatactctgctgctgctaagtggtggcatctcgtttaggcgagatccccctcctcccccgctttccactcctctcctccaccctagtcgactccttccctgcaatccgctggccggctcacagtaccagaggagtccaccggaggagctcagctagactcccaccctggtggctcgatcggcaccggccgctgcctgcgagactccgccaggtagatcctgccctctcgctgaattccgattccctttcggcgtccacgtgacggtctgaggcgtggggggagtgctgaattttggcctcctcgtccttctacgtcccaattctgcccggacccgccgagaattgcccgttctcgggacgccgggcgtgctgttcacggcatgcggtgctttgatctgtgaattctgggagacggaaccaccttttctctctcgcctttacccgaaatctcctgtaaactgtgggtgacagtgataccactctctgcctgggtgttccgttcttaagatcaagtgctggacagtctagtctagccgttaactaagtccttgcttcctttttttttcactctctctgctggattggggaatttggtggtttccatctaccagtaaatcagtaatgctcctttcatgcttattatcttggatataattcaagtggtaatctgctgatcctgcttccactctgttccgtgcaataccctaacagcgcgcg

SEQ ID NO: 4256 - DNA, 1077 bp, Zea mays
tcttatttcttagtatggggtattgcatagcaatgaacttcagttaccacattgacatattgacatatatgatgctaggtattgatggtattttgaaaaatcctgctttggcttcctggacagtcgtcgctcctctttcttaaggccggcgctgccaggaatgtgacgccgcccccgaacccaacctgttttccaccgtcgccgccaccgccgccgttagccatcgggggtcttgccgttgcttctggctgccatcacctagggagtcatgcggggagagctaacggggtgagcgggtggtggacatacactgtatatataagcggggatttttctctggctggcgggtgggaccctcttacgtcacgtacacgagaaggagcgatacgccacgcgtgtccgaggaacacgttagaccgctccactctagtgggtaggctaacaggtggtccacctatctaccccgttacccctccgtcccctcgtttttagttcctccttggcaacactaaacacctgatgttaaaattagcacctcatgatgaaattacatgggaaaaagtgtccccgttattagttttatatttacataggtaagttttgatcgatcgtcgtctgtcttctccatcgggtaggtacgttatgactatcaaatccgctcacgtacgtcatatgattttcttcttgttcaatcgattcaccggtcatcacattcccacgaaattgctagaacaatacctcttgtctccgaacagttcttacagtgtcttattttggtcttgttgtagtgtctccgaacaatcccgtgaaaatgaaaatcgtcaccatcacgtccaaatgcttacctggtcgcgtatttaaattgtataaaaaatgatcagattttatcgatttgtttgaagcatgtaattaagatgctggagggcgaggaatttgctggcctgcgcgcacgttgcgatcatggaggtaaacaattgaggaatgcggtggccgcgtacgtgctttgatatgatgctataatacgcctgatctgattcgtagaaggacggcggcggcgggcgcgggctgccggcggcg

SEQ ID NO: 4257 - DNA, 75 bp, Zea mays
ggtatccttcattaacctgaacatcttctcttactgtttggatatggaagaatcagtctatgctttattcgttac

SEQ ID NO: 4258 - DNA, 286 bp, Zea mays
cgtaggcccgtagggtccaccagcaggcacacacgcacaggctttaatgcgaggagctatttagtgtcgccagtcgctacttctttctcgtcttcctctcctgtctcctcgcagttgcgcagcagggtgctggaagaagtttctggttggaagaatccggttgaggttgccatttcccaacttcttccagcggttcggctcggaggcaaactgagatgtcctgttcgtgatcggtttattcttgcagctgtagacagcttgtcgattcgttgcttgaggagcagcc

SEQ ID NO: 4259 - DNA, 1500 bp, Zea mays
cctgtactttttggacgtgacaaataaatccttcgacctttggtagatatcgaatttgacccggtctatagtagcaagcaaaaaaaaaacccactgcttcggtacaatggtataaactcccttgaaacatataacaaaatatgcacatccaaaatgaaaggtcgttttctagaaatttatatggaaacggcatattcgatatgcatatatatacactagaggacaaaatcatacagtataatattttgaaaacttctatgaattatagtatgttttaagcgtttctcacgactgcagagaatggatggctcgtacacaaatgcgtcgatgtctagaacagcgtttaattgttttacatttttcacttggaaaaacgaaaaacccttggaaaaataaggttcacaaactagctctaagatggttcaaaaaaaccatgctacgctccggagaaaatgtaacccaaaaaaacgagacgacaaaccaaaaccatgggaacaagatagccaccgataacctcgtcctgggatctcagccgtcaaacgccagaccgacggtcgacaagcgacgggctggccgaggcccaaacaaggatatctaaggccaatggcagtgatgagactcgcctcgaacccagaacgcgacgcgacgcgacgcaggcccacccctgtgaccctgtcctgcagaaatattcattatcttatattcaaataaataaaataaaaaccgactgaatttgcttatttccggctcttgttgaaaccgccacccgattcctccgctcgccaaatcctcgccgtgccctcgtagcaattccttgcgtcggcgcatcatcgcggcctcctctccctctctctctctatctctctcaatctctccgttggcaaatcgttgaatcgacgtgcttggccccggccgctctgagcccgccgccagcctcctcgtctgaagaagaacgacagccgtcgggctccggtggtcccgccgaagaacggcaggtagccagccgcgctcatcacgccggcgactcgattggcattgtattggcctttccgtttgttggtaagggaccctaacttcgcttgatgttttttttcttttctttttcctcggagacttatttgttcggtagatcgatctctttactctcttctatgatcacagtcagatcgaaaagaagaggaaagaatcgggaagcccgcccccctggtggatatgcgaggccatgtttttcatgtcacacccccgaccgattcgcctcgatttcgttcttctgttcttctgcgccgcaatggctccttcgctcgttcatatctgttattctgttgtgaatactcggtttgagtcaatgatgcgatttctttcattcaaaatcttctgggtgctcctgtgttattctgatttattcgctctgtttcgacgccagttaatctggcttgttcgactattgacaatatcgttgcattcttatttgcgacagagttctcgaagcaaaacgatcgg

SEQ ID NO: 4260 - DNA, 324 bp, Zea mays
atctgcatccgccgctagcgctgcgcgagtgcggggccttcctccactcccactcgtctcgcagactcgcacccgcgttccccgtggtcaactcgctgcctccagcgacgaccgcgagggggggccgaaataggcaggcaggcagcggcaggccacccaaaaagcgaccaccctgcgcgcaccacctcggctgccattgccattggccattgccatagccatggccacgccatgacgccccgcccagctgcacgcgctcacacccccaccgctccactccgctccgcctaactctcaccctcacccgccaccgctcgcctcccc

SEQ ID NO: 4261 - DNA, 1500 bp, Zea mays
aggcacgcatcgggtgccctgccctgcctcggtgggaacgagctggctggcctggccctgccggaccggacgtcggacggctcgggccgggaggttagttatccgtgaccctgacgcacggcacagccggtgtctgtgcgtacgccgccgccgtgcgcgtctcgccatgccgtatcggaccactaggggtgcatgcggcatgcacatgcacgagctcgctgggtggcgtgcgcggggaggacacaatcacaagctgctgtgggctcctgcctcctggacagtggacagcacgggttcgcctcacctcaggcacgcgtagcgtagcagcaggtcaggagcatcggaaagtggatcggcgacgtaccatactggaacacgtactggaggcggcgttatgttggtctcgtacgcagcagtacttcgagagctttacgtggtgccagtttggggttttcccgcgattcggatggacacggaaaagagttactattgtctgcttgaagtgaagtatatgggaaaaatactactagagcataggcatagctaatgctgtccttgagacttgagcagcttggcatttgccaatcgccactactagggtatgtttgcatagctttactttaaaaacttcacctttggttttctagcttcaccataaaataactgcaacaaattgttaaggtggttccaaaagcttcaccataaaacaactccagcttatatagtacaattgatttatatgagtttccttgattaccctagataattagtgggctgttgcgagagaaatcgaaggttgtatgttacgtaaccagtggcatggtgagtaattttcgcacaacatcatgagaagatataaaaacaatgcttctaaagcacattctaaggagcttcatgaatttcatgaaaattgcctctagttttgattttttttaaactagagctcgtggagttagacctgtttgggtggaagaagttgaaacgaagttaaaattcttgaagtaaaactctcctagccttttaattgctaaaatatgagcctccctcattacttttataaaaaaaaataataagtctcttccaggttatggccagctcatgtccttgaccgttcgatgcacctaccctacccgacccgagaccatgagtccatgacccgtgcgccggttgccatccatcagtgtggactgtcgaaccgggggatgggttgggacgttgggtcctggtccacgtgaccacgtctagcagtagcagactagcaggctctcgaaactcacgttcccgtgtcgctcaactggcacaggactggacccgtcccgtacggcatcgcaccccgcagccgcaggccgcatcttcctcgcgtgctctgccctctgtgcctgcccatccgttgatcccatcggcttccccttcctcttccccgatccccttcctcccccgatcccatccaattccacttccacaccgcgggcctcgccgccgacgccgacgccgccggcc

SEQ ID NO: 4262 - DNA, 184 bp, Zea mays
cggggcgcttcgtcatcggccaggatggcacgattctctatgccgaggtgaacccggactatacgcgccgcccggaacccgaagacatgctccccacactgcgccgcgctgccaacgtcgctgcctgaagcccgtagcgcttcgggtgcgaaagcaccgggagcacgtctgtccggagaagacc

SEQ ID NO: 4263 - DNA, 354 bp, Zea mays
ccgctccgcccgcctgccgcggaggttaagaggtagtagaagttgctgggccgccctgctcccttgcccccctgtcccgctcccgccggcggagacggagagccatacccgccaccggtcttcggcgacggcggcgtgtacccgcctccgggcttcggcggcgccgtgctgtccgacggcgcgggcggcgagcacaccgccgggcacgtcccgcacttgctcacgcacagcacggccgtgtcgtccggctggccgccggccgtcgtcgtcgtagcctcgccgtcacaggacaccaccgccagcagcggcagcagcagcagaagcggcgccaggcgcgtcgctcgtccgcccacc

SEQ ID NO: 4264 - DNA, 1500 bp, Zea mays
catttaaaatagaaatcgccacacatatcttttctaaatttactcgtatgtaagggaacgtgtttgactcatgcatacattccttttttgcgcgcatggggcggttggcacacccaacaacctggttgagtcgacgcgttgggttgaactacgttgcagggtggtcgacctgggctttctttaactgttggaagcacagggctcccgttatacctgccctatatatatatatacatacatatatatatatatatatagtttatatattaagtgccctgggcttccaataatagaggaagctcaggctagtcaatatgcacatttggttgaatcagacctggtcagcatatacacagtcacgacgccgttaacccctgtttctccgtcagcgtcccacgtctcccccgtttcccggtttccaaaaccgtcttcgtgcaatcaacagagagaaacccgcgcgagtccaggatttcagcttctgcatccgccgaacaggaaggaaaccccttaacccctgcggccgaggcgactttccctgtggccgaggcgacttgccagacgatttccgccactccaatccagctgcgctccttcaatctccgaacattggagcccgattgaagagccattgctttcccgagaagttccaagtaatccatccaacttgaaatacatcgaggtttccgtcgattcttgaagtatttttgtcgatttgaagtcggtttgattgtttcccttagtttttagttgtgtgtgatttgtatccgattatacatttctctaatcggctcattgcatcgctcattgcatctctctttggttcaggagccccgattttagagcatctgcatttcttctagatccgctgtatcgctcggccttcaaagacataggcaacgactccggttcaggtatttattcatgagtttgcagagagtaatttttacataatattagtaacatgtatatgcatattggtattgatatatatgcacatcgtcaatactgtttatgcacatttgtacagatgtttatgaacattggtcaagatattatgcacttttgtattgctctatctacctgaaacattagtttacacacctgttgtattatatataaatacatacagatactattatttatgcaatagttatttaaatattcatgtttgcatatcagctaaatgtgtatattattatgaaccagttattaaaatatgttgtatagttagttgatgcaaaataggcatttattttatcatgcaccagttacaattatatgaaatagtaaattaatctttatgcgtgtatataaccatggttcattaaatgttgtcatataaatggaaaaggtagtttaagttatgtaactccatttcgtattatgtagtatgcattgtagatagttatagacaacattcgattttttggcatatatttatgcataaatcattgtatttaaaaacaatattttttcaacagatatattgattgttgaacc

SEQ ID NO: 4265 - DNA, 904 bp, Zea mays
agtgcacggagcagtagcacccaaccatgcagccacatcacccacaaactgagcaacccacaccatacacgcctcgattagtgatccatctctaccacctccttttcaccaagtcaccatttactcattactgaccgcctctgcaatttggggatgactactaggagcaatactgacatctggatgttcatatatttaccttggtatgtaagggattagcttttaacaccaatgacatatttgataatcatgtttttaggcccgtatccaataatttgagctcaaagatttagctttaaattagagcaattttttttctcgaaaacgcgcaggagagctgcgcccctttatatattaagaagataggaaaaaggtctaaaatagaccaaacaacagcaggcctcctcacggggccagaaaatagcatacaaaaaagaactcatcatgtgaaaggaacaaaaaacacaccactctagggagcagctgcagaagcagccagagaacatagggccttcgccccagctgcctcccaacgacttctctcctcgtctgcccaagcaaggatataggtgaggcaaggagacaatccatcaaagacacatttgtttcgatgaatccaaatagtccaagcacccagaataatgagggagttaaggccttttctggtgacacctgagaccacctctgaaacctcctcccaccaattcaagaaggaggtgaccgccggctggggagctagggagtgaaggccaaatttccggaaaagctggtaccaaaagactctcgagaaggagcaagccaccagaagatgatcaagggtttcttcagcttggtcacaaagcagacatttctcatggtggtttaggcctttcttagctaaacgatctgctgtccaacatctatt

SEQ ID NO: 4266 - DNA, 720 bp, Zea mays
tctggagcttgacggggagctgttcgtcagcacgcagcggtcccctacctggcgcgccaactgtcggcgtttcgagacaggggggtcccaaagccgacgagtgagtatgctgcgtgccccagcccagatgggtcgagcgcgtgggcgagcgcgaaggggggagaggcgaggcggccggagtcgagcgtgagagaggtggaagtcccgcggccttcgtgttcgtcccgcgcctaggtcaggtgcgcttgcagtaggggggttacaagcgtccacgcgggtgagggaagcgagcggccccaagagagcgcctgtcccgtcctcggtcccgcgcggccaaccttctctaagaaggccctggtcctcccttttatagtcgtaaggagaggatccaggtgtacaatggggggtgtagcagagtgctacgtgtctagcggagagagagctagcgtcctaggtacatgccaatgtggcagccggagaggtcttggcaccttgctggcgtgatgtcgtggctgtcggaggtgcgacggtgcctggcggagggacagctgttggagcggtcgagtccttgctgacgtcgccctgcttccgtaagagagctggggggccaccgtcgtcatagagtttgtggagcgccattattgcccatccggcggagcaggccggatgggacgccggtcttgttctccgtgacccgagtcgattcggggtaggatgatg

SEQ ID NO: 4267 - DNA, 1000 bp, Zea mays
cgtatcctgacatgtgagccgttcgatatgagactcgtggcccaaattaaatcgttgaagaagtacatccccagccattagatcgtgatctaagcgctctgatccaatcagccgaaggggtatcccctgacccaatccatgccacatgcggccgatccaacggcgttggtacccctacccccctcacagctagagatggcatcggcgcarctccgacctagcggtgccatggccaaacctacaccccgcattctccggtgcatcgtttcccacgattagtggtgctacacaaagcagatctgaacgcgaacttaaggtaggatttcttactattgggggtcttcttctccgccgaaggtcctcaagacgaagatatcgtttgcaaacaacggtgaggatcctcttctccactgaaggttgtctagacgaaggcattgtctgaaagtgacaacgacgaatgctgaagctacaaccgaagagcgacaacttcggcttaagatggcgacgaaggtcaaacaagatgccgaatcaaagaagaaaagactagataatcgctgatgatttatgttacgattatgggtacatgttaaggtcataaatgtatttttacccgggctgcgtcccgtgcctataaataggtgaatagtacctccatactgttcacgctagattgtaattgctcccgcgtcaacaccttcaatcaagtcgaatgtattaatgtaatataaattctgttaatgttcatgtatatatgtattaagaaataaatatgcgaatgaatggataagcgacatatattatctccatggattcttattctcgtaaaaccttcatgaccttcgtctgaagaccattatatccaaaaggaaataatgcttcggaggatgaaggtccttaacctctaacaattgtgttgccttgttcttgattcacaacatttgagaacaagtgaccaacattggtgcccacctccggtgaactcacttccacgaccacgaca

SEQ ID NO: 4268 - DNA, 1500 bp, Zea mays
ctctgttccagtgttccttcctcctccactctttattatattttactcttctctctccagcgtaaaaaacaaatcgtgctgtgcgaacgatgagagagaaaagagagacggaggcaagtaatggcaggaggaaccttcttttcctgactccctgtggctgcagagtgcccatcatttgtccctgatccttgtgcttcgttcctgttgcgctttccttgggccatcggtagactgagccgtcgcgaagccttcccgttcccacaaggggtgtggcgtggagcgagcctcgccaccactgggctcctccggcgacctcctccctccagtcacaggttcgcgttccatccccattccccctcggtggctccgtcaatgaaatgagctctctgtttctcggcctgccatttgtcgcgacgcgaggggattcggttgtatcctatcgagccccctcgcgtgttttctcgttgtatggcccgagtttgtctgttcttacgtggactgctccagaaattttggcacaggatttcctatatttctttctaaatacaatgtcgttcacttctgggtcgtcagtatcttattgaatatttctgtatttttttcttcttttcgtcacccttatgttctcttcgaggagatgttttcgtcattgtcatcttaagtcgatctatcattctgaagagctcttgcgaaaggctgttccatgttgtttatgcgtatgcgcttcgagctccgagccacaggagagtcccccactcacaggcaatcacgcaacgatttggatccatgccatttctttttcctggtcttgaagtgaatgggatggaacagccacgttccattttatttgtttttatatttattcgtggggagtgtgccggtcgcatcgactttaacatttcgtgttacaccacggttattatgagttgtcgtttactcacatcgacacggttcctgttttggaatcagctccacggagaattttgagtttgtgggaaaaaaactgatgataattggactgggaatatagtgtctctgattagaagtataaaagttggtgttcttccagttggaggagattgcctgccatctctgagaaatctctggtacttgttagcgctaccactgaaatcctttttcttttttttttcccttcaaataaacctgttgcaggctgtcctgtactcccgtttcacctgtttcgctctcccgcgagctcttgatgcatttggatcctggtgctcaagactcctgtgaacttaaccgatttcaatccatcgtttgcttttgttttgtttcaactggaaaatgtttctcctgatatctgttcatcaaaacaaatatcatatcactaccgttgtcagattcccgttgcctttggatattgtccttgtctacctctgtaaatctgaagctaatgtccagacagaacatacattgacttagtactgagacgtaactattttttcacccccattaggttgagcaatccaagctgag

SEQ ID NO: 4269 - DNA, 1500 bp, Zea mays
acctaccctatatatactcatgcatgtatatgtttcaatttcaccatgtaaactcaaatccaataatatgattcaatggcgatcttgttgttgctcatgaacatgtagtgtgtgtacatcaattataccattctttttatatacactagtattatctacctcgtacagtggtgatagttatcttattgacactactataataaagctgcattggtactagttcagaaccggctccgttaccggattttttcatccggtactatggaaacgggactagaggcatagtcttagttgcatgaatgggtgttaattaatgcctttatggtatgtccaacccacgtgcatgacctgtattttaaggcgtgtctaacggggtaccggataagtacaaaaaaaaatacaagagacgtgtctcgatgaatgaaagtctttagcattgttgtataaatttaaaatatcttgaggggttctagtgaataggatacaagaagatacattgagttgtatgaatgagttttttaatgtatctagtgctttgagaactgcaatacaatatcttagttgtacatgcctaatatctcttagtgccggttatagccatcaactggtattaaaggggatcatgtggccgtagaggatccatagatcatagtatggacgcccctttactactagttacggggtataaccggtataaaagagactcttttagaacatctacaacagttttcttaaagaaaaactccctggctaaagacagacgttggaactggctgagtgataataggtattaaaaaaatctatgttctctatttttagttgtcagatttttttttgacgcgcatgcatctaatttttgggagtgaacaagagaggttactatatatatataacaactttgtagatttagcaaccttttttacataattgtttgaggacccttttttataacaacttcttaaatacgtatttaggaactctgcagatgttcttagtaccgcttatataaatcaaatgctattaaagagagtatccatattgattaattattattgtctatatgtgtttatttacactacttatactatattattatatatttagctttttatatattgatggaatacatatgtatatactaagagcattatatattaatagtaatatatatacattgtattgaattttgcattagaaattttgaacaccaaatttgaatacgttgtgaatagtgatccaagaattaaaatttttaacttaaatatctttgagttttttctagcatcctgctgtttgggcagcacaaacacaaatcccacactccgcgatacacgtaggtatactcgtaaatcatcacacagttattcgtgtatatatatacctcatatatactcgtagagcagatgttgctacgcgttagcacctgtactctcagtccggtaggagtaggacgtaggacctcacccgacatactcgatcccgacgccaccaacagttacc

SEQ ID NO: 4270 - DNA, 595 bp, Zea mays
gggaacatggaatgctcttgatttaggaaaaaaaatcagcctaactgcaaactcaagctactacaacccctcccataatagcgtggccgaataggtggcacccgtaaaaaatgtaaatcaagcatatgttggtcgcaaacgggtgattttgtttctgctaaagggatgtagatgtaccaaactttttcccttagtataggggtgtttggtttgttcgtactaaattttagttcatttattttattttattttagtctctaaactcttaaatataaaaactaaaactcatatttagaaatttaacaactaaaaaaaataaaatgtagaaaccaaaatttattccgtagaaactaaaaaccctaggtcataggaggcacgtgcagctcacacgggacgcggatcccctcttttgattcccctctcttcttgcaagagggtgtaagaaaaccaagccgccgccgggatactacactacccagctcctctccagtctcaacccagcccgcctctcgaacttccagaaccgtcctctcgctgcctgcggctgctatctctgtcatctagaggagagtgtaagggcactagatagagagtg

SEQ ID NO: 4271 - DNA, 497 bp, Zea mays
tttggccaatttcgctgcaaccatttagttttgtaagggcacatgtttgcttgcttgcttgtagaactctagcttcattggtttatagcttgcagtgttagattggaggccatgaaaaacagtatcaatctgaatgccagttcttgtttattgcggcgagttgaaaaagattcatgccaaagtgtattaggttcttaacttgttatactgctaatttgtctatgatcttgtgctccactaaggggttacatgtgcatcaatgactagcattggatcattattgttcatatgacaccatgattattgttcatatggcatcttgatttgtttattggactactataagaatctaccacgcgttcctgaaattatattatttctccaatttgtgtgggcatgcttactaatgaattaccacatttcatggttacgagttacaacaatacaaagcatgctaattttgttcctctgctttcactgttacattcagagtcaat

SEQ ID NO: 4272 - DNA, 1500 bp, Zea mays
gatctagattacattccaggacaagttcaaggacagttgctgtattccacttcctaaaactacaaatgctggccatgcatccaaggtacaggaaggaatcaatagtcaatctattatagggcattccccataatctgctatgatcagaggatcctttcgacaggagaagcctgtagattagagagtgaccagtctccctgtcactgtattcatctggttgcatagtctttggtatcgcagtgacattgtatattgcttcccatccacaagtttccagggccactgttttcactgtatctgttgctgctgctcattgcctgttctcgcttctccgcccgtgcagctgctatttgtttatcgcctttgctcagaagccttcaaattgccaccaccagcaaccacaatgtgccctcctgatcccaacaaattggatgacgcctctgcgtggtttccttctgctccactgcctcaactttgtttgtttcctgcatcaattgctcgcaccaactgtcaaattgctgccacccctaccctctaagtccctctgctactgattcccctgcagctgatctctgcgaaaattgtcctcagccatccttcacgacctattctcacagcagttgtcctcctatacattagctgtactcgtcctccatttttaacggtgtgccacctgccctcccatgcttctgctcgtggcatcaatttattgccatcaaataccattggcccactaaaaccagccacaaaatcaatcactactttctgcaatcatatgccaggctttctatgtttcctgctgctaccttccaacggctagcttcacagcactaggataatctgggctcataaggattactttcataatactgataacctttgtaatcctagtagcggaatggtttatactttatagtctagtggttgtgactcctgtagcacctcatgcacctgggtttgatttctgagcgaatttcaggtctggctaaaagacctcccttgctggcaacaccaagtagtggctgggcgccggtctatggtaatggtgtcagtcggcctgtgtggtcatgtagtcctaccacaggggggggatcagtactggcagggcgccaaactaggtgggtggctctggccactgaccttgggtatggagagatcagatattcactgtcagggttttggagtttgcttgatcgattgaaggctgaggtttcttcttccatgcaataccatcagggcggtctttaccctgctgctgaaagtacccccccccccccccaaaaaaaaaacctagtatccttgctaaggctaatagccttcctaatactggtgcatgcatggtttccatatcaggaccacattctgtataaatgacgagtttcctgttgcaatgtgcatgaaattgttttttggggtacctggctctgtaaactttatggccttatcttcattgcaggtaagtctgaggtgtctgccattgtttataaagctggggagtgc
